(12) United States Patent
Honda et al.

(10) Patent No.: US 12,390,499 B2
(45) Date of Patent: Aug. 19, 2025

(54) BACTERIOPHAGE FOR MODULATING INFLAMMATORY BOWEL DISEASE

(71) Applicants: Keio University, Tokyo (JP); Biomx Ltd., Nes Ziona (IL)

(72) Inventors: Kenya Honda, Tokyo (JP); Koji Atarashi, Tokyo (JP); Seiko Narushima, Tokyo (JP); Efrat Khabra, Petach Tikva (IL); Hava Ben David, Rehovot (IL); Eyal Weinstock, Kfar Shmaryahu (IL); Yulia Matiuhin, Pardes Chana-Karkur (IL); Naomi Bluma Zak, Jerusalem (IL)

(73) Assignees: KEIO UNIVERSITY, Tokyo (JP); BIOMX LTD., Nes Ziona (IL)

( * ) Notice: Subject to any disclaimer, the term of this patent is extended or adjusted under 35 U.S.C. 154(b) by 866 days.

(21) Appl. No.: 17/436,693

(22) PCT Filed: Mar. 6, 2020

(86) PCT No.: PCT/IB2020/000182
§ 371 (c)(1),
(2) Date: Sep. 7, 2021

(87) PCT Pub. No.: WO2020/178636
PCT Pub. Date: Sep. 10, 2020

(65) Prior Publication Data
US 2022/0152132 A1    May 19, 2022

Related U.S. Application Data

(60) Provisional application No. 62/815,265, filed on Mar. 7, 2019.

(51) Int. Cl.
*A61K 35/76* (2015.01)
*A61P 31/04* (2006.01)

(52) U.S. Cl.
CPC ............. *A61K 35/76* (2013.01); *A61P 31/04* (2018.01)

(58) Field of Classification Search
CPC ................... A61K 35/76; A61P 31/04; C12N 2795/10121; C12N 2795/10132; C12N 2795/10221; C12N 2795/10232; C12N 2795/10321; C12N 2795/10332
See application file for complete search history.

(56) References Cited

U.S. PATENT DOCUMENTS

| | | |
|---|---|---|
| 2009/0304638 A1 | 12/2009 | Yoon et al. |
| 2011/0217756 A1 | 9/2011 | Tsao et al. |

FOREIGN PATENT DOCUMENTS

| | | |
|---|---|---|
| KR | 10-2013-0087118 | 8/2013 |
| KR | 10-2018-0137814 | 12/2018 |
| WO | WO 2007/113657 | 10/2007 |
| WO | WO 2019/048930 | 3/2019 |

OTHER PUBLICATIONS

Lee et al. (In-Ah Lee & Dong-Hyun Kim (2011) Klebsiella pneumoniae increases the risk of inflammation and colitis in a murine model of intestinal bowel disease, Scandinavian Journal of Gastroenterology, 46:6, 684-693. DOI: 10.3109/00365521.2011.560678) (Year: 2011).*
International Search Report and the Written Opinion Dated Jun. 12, 2020 From the International Searching Authority Re. Application No. PCT/IB2020/000182. (15 Pages).
International Preliminary Report on Patentability Dated Sep. 16, 2021 From the International Bureau of WIPO Re. Application No. PCT/IB2020/000182. (11 Pages).

* cited by examiner

*Primary Examiner* — Kade Ariani
(74) *Attorney, Agent, or Firm* — McCarter & English, LLP

(57) ABSTRACT

Disclosed herein are bacteriophage compositions and therapeutic uses thereof. The disclosure also relates to bacteriophage that are capable of lysing *Klebsiella* bacterial strains, e.g., strains that are associated with inflammatory bowel disease, and thereby capable of modulating disease.

13 Claims, 28 Drawing Sheets

Specification includes a Sequence Listing.

| name | family | subfamily | genus | KP2 |
|---|---|---|---|---|
| 1.2-2 | Myoviridae | Tevenvirinae | Kp15virus | S |
| PKP-55 | Myoviridae | Tevenvirinae | Kp15virus | S |
| colon-11 | Myoviridae | Tevenvirinae | Kp15virus | S |
| 1.2-4br | Myoviridae | Tevenvirinae | T4virus | S |
| 1.2-4s | Myoviridae | Tevenvirinae | T4virus | S |
| KP2-5-1 | Myoviridae | Tevenvirinae | T4virus | S |
| KP2-4a | Myoviridae | Tevenvirinae | T4virus | S |
| M16-4a | Myoviridae | Tevenvirinae | T4virus | S |
| KP2-9a | Myoviridae | Tevenvirinae | T4virus | S |
| M16-9a | Myoviridae | Tevenvirinae | T4virus | S |
| colon-14-15 | Myoviridae | Tevenvirinae | T4virus | S |
| colon-6 | Myoviridae | Tevenvirinae | T4virus | S |
| colon-1 | Myoviridae | Tevenvirinae | T4virus | S |
| colon-36 | Myoviridae | Tevenvirinae | T4virus | S |
| KP2-5a | Myoviridae | Tevenvirinae | T4virus | S |
| M16-3-2c | Myoviridae | Tevenvirinae | T4virus | S |
| M16-5c | Myoviridae | Tevenvirinae | T4virus | R |
| M16-6c | Myoviridae | Tevenvirinae | T4virus | S |
| M16-7a | Myoviridae | Tevenvirinae | T4virus | S |
| KP2-14 | Podoviridae | Autographivirinae | T7virus | S |
| KP2-15-1 | Podoviridae | Autographivirinae | T7virus | S |
| KP2-15-2-1 | Podoviridae | Autographivirinae | T7virus | S |
| 1.2-3b | Podoviridae | Autographivirinae | T7virus | S |
| colon-14 | Podoviridae | Autographivirinae | T7virus | S |
| KP2-8c | Podoviridae | Autographivirinae | T7virus | S |
| KP2-8a | Podoviridae | Autographivirinae | T7virus | S |
| KP2-7-1c | Podoviridae | Autographivirinae | T7virus | S |
| KP2-7c | Podoviridae | Autographivirinae | T7virus | S |
| KP2-16-1 | Podoviridae | Autographivirinae | T7virus | S |
| KP2-5 | Podoviridae | Autographivirinae | T7virus | S |
| Mcoc3c | Podoviridae | Autographivirinae | Kp34virus | R |
| MCoc4c | Podoviridae | Autographivirinae | Kp34virus | R |
| MCoc5c | Podoviridae | Autographivirinae | Kp34virus | R |
| MCoc6c | Podoviridae | Autographivirinae | Kp34virus | R |
| MCoc7c | Podoviridae | Autographivirinae | Kp34virus | R |
| M16-9-1c | Podoviridae | Autographivirinae | Kp34virus | R |
| MCoc9-1c | Podoviridae | Autographivirinae | Kp34virus | R |
| MCoc9-2c | Podoviridae | Autographivirinae | Kp34virus | R |
| MCoc15c | Podoviridae | Autographivirinae | Kp34virus | R |
| MCoc8a | Podoviridae | Autographivirinae | Kp34virus | R |
| 8M-8 | Myoviridae | Vequintavirinae | Sc1virus | R |
| 1.2-3s | Siphoviridae | - | T5virus | S |
| 8M-7 | Siphoviridae | - | T5virus | R |
| 8M-1 | Siphoviridae |  |  | S |

| CT-123-1 | CT-141-1 | MKP2_2161_1 | MKP2_251_B | MKP2_251_C | 8M-all |
|---|---|---|---|---|---|
| S | R | S | S | R | R |
| S | R | S | S | R | R |
| S | R | S | S | R | R |
| S | R | S | R | R | R |
| S | R | S | R | R | R |
| S | R | S | R | R | R |
| S | R | S | R | R | R |
| S | R | S | R | R | R |
| S | R | S | S | R | R |
| S | R | S | R | R | R |
| S | R | S | S | R | R |
| S | R | S | R | R | R |
| S | R | S | R | R | R |
| S | R | S | S | R | R |
| S | R | S | R | R | R |
| S | R | S | R | R | R |
| S | R | S | R | R | R |
| S | R | S | R | R | R |
| S | R | S | R | R | R |
| R | R | R | S | R | R |
| R | R | R | S | R | R |
| R | R | R | S | R | R |
| R | R | R | S | R | R |
| R | R | R | S | R | R |
| R | R | R | S | R | R |
| R | R | R | S | R | R |
| R | R | R | S | R | R |
| R | R | R | S | R | R |
| R | R | R | S | R | R |
| S | S | S | R | S | R |
| S | S | S | R | S | R |
| S | S | S | R | S | R |
| S | S | S | R | S | R |
| S | S | S | R | S | R |
| S | S | S | R | R | S |
| S | S | S | R | S | R |
| S | S | S | R | S | R |
| S | S | S | R | S | R |
| S | S | S | R | S | R |
| S | R | S | R | R | S |
| S | R | S | S | R | R |
| S | R | R | R | R | S |
| S | R | S | S | R | S |

FIG. 1 (CONT.)

FROM FIG.1

|         | colon-11 | PKP-55  | 1.2-2   | KP2-4a  | M16-4a  | colon-36 | KP2-5-1 | 1.2-4br |
|---------|----------|---------|---------|---------|---------|----------|---------|---------|
| colon-11 | 100.000 | 88.330  | 89.326  | 46.322  | 46.189  | 46.172   | 44.927  | 45.392  |
| PKP-55  | 88.330   | 100.000 | 96.680  | 50.975  | 51.038  | 50.961   | 50.651  | 51.207  |
| 1.2-2   | 89.326   | 96.680  | 100.000 | 50.361  | 50.701  | 50.666   | 50.323  | 51.073  |
|         |          |         |         |         |         |          |         |         |
| KP2-4a  | 46.322   | 50.975  | 50.361  | 100.000 | 98.168  | 95.437   | 97.707  | 96.030  |
| M16-4a  | 46.189   | 51.038  | 50.701  | 98.168  | 100.000 | 95.024   | 96.923  | 96.413  |
| colon-36 | 46.172  | 50.961  | 50.666  | 95.437  | 95.024  | 100.000  | 96.273  | 96.502  |
| KP2-5-1 | 44.927   | 50.651  | 50.323  | 97.707  | 96.923  | 96.273   | 100.000 | 98.533  |
| 1.2-4br | 45.392   | 51.207  | 51.073  | 96.030  | 96.413  | 96.502   | 98.533  | 100.000 |
| 1.2-4s  | 45.415   | 51.207  | 51.073  | 96.016  | 96.409  | 96.508   | 98.534  | 100.000 |
| KP2-5a  | 48.451   | 52.918  | 52.493  | 93.451  | 92.955  | 94.313   | 92.973  | 93.033  |
| colon-14-15 | 48.282 | 53.619 | 53.501 | 92.015 | 91.339  | 93.190   | 91.686  | 91.869  |
| colon-6 | 48.401   | 53.660  | 53.501  | 92.003  | 91.343  | 93.472   | 91.688  | 91.869  |
| colon-1 | 46.935   | 52.249  | 51.882  | 92.858  | 91.850  | 93.218   | 92.423  | 92.039  |
| M16-3-2c | 46.618  | 50.874  | 50.548  | 93.118  | 93.569  | 92.669   | 92.687  | 92.625  |
| M16-6c  | 46.381   | 51.522  | 51.143  | 93.689  | 93.283  | 94.485   | 94.209  | 93.625  |
| KP2-9a  | 46.880   | 53.232  | 53.046  | 94.368  | 92.869  | 93.734   | 93.212  | 93.226  |
| M16-9a  | 46.532   | 52.896  | 52.830  | 94.410  | 93.294  | 93.957   | 93.278  | 93.229  |
| M16-5c  | 46.677   | 51.669  | 51.643  | 91.876  | 91.499  | 91.813   | 91.914  | 91.817  |
| M16-7a  | 44.571   | 47.964  | 47.379  | 88.288  | 88.821  | 88.528   | 88.579  | 88.221  |
|         |          |         |         |         |         |          |         |         |
|         | KP2-15-1 | KP2-14  | KP2-15-2-1 | KP2.16-1 | KP2-5 | KP2.7-1c | KP2-7c | KP2-8a |
| KP2-15-1 | 100     | 99.77944 | 99.93557 | 83.38125 | 85.62897 | 85.40345 | 85.56453 | 85.56205 |
| KP2-14  | 99.77944 | 100    | 99.77981 | 87.98049 | 87.70204 | 85.37439 | 85.53583 | 85.53583 |
| KP2-15-2-1 | 99.93557 | 99.77981 | 100 | 88.07751 | 87.79099 | 85.23503 | 85.39584 | 85.39337 |
| KP2-16-1 | 83.38125 | 87.98049 | 88.07751 | 100 | 92.53075 | 94.6746 | 94.67198 | 94.66936 |
| KP2-5   | 85.62897 | 87.70204 | 87.79099 | 92.53075 | 100    | 91.93352 | 91.93097 | 91.92843 |
| KP2-7-1c | 85.40345 | 85.37439 | 85.23503 | 94.6746 | 91.93352 | 100 | 99.99744 | 100 |
| KP2-7c  | 85.56453 | 85.53583 | 85.39584 | 94.67198 | 91.93097 | 99.99744 | 100 | 99.99743 |
| KP2-8a  | 85.56205 | 85.53583 | 85.39337 | 94.66936 | 91.92843 | 100 | 99.99743 | 100 |
| colon-14 | 86.71193 | 89.18009 | 89.15457 | 91.54822 | 93.07423 | 92.63276 | 92.63021 | 92.53324 |
| 1.2-3b  | 85.66118 | 85.62027 | 85.48491 | 93.46059 | 91.31087 | 92.07773 | 92.09582 | 91.97748 |
| KP2-8c  | 85.68349 | 85.64013 | 85.50717 | 93.46846 | 91.34391 | 91.82003 | 91.81746 | 91.71993 |
|         |          |         |         |         |         |          |         |         |
|         | MCoc15c | MCoc8a  | M16-9-1c | MCoc9-1c | MCoc9-2c | MCoc4c | MCoc6c | MCoc3c |
| MCoc15c | 100.000  | 99.998  | 90.194  | 90.240  | 89.906  | 89.733   | 85.601  | 86.588  |
| MCoc8a  | 99.998   | 100.000 | 90.196  | 90.243  | 89.909  | 89.735   | 85.603  | 86.590  |
| M16-9-1c | 90.207  | 90.189  | 100.000 | 99.984  | 99.973  | 90.326   | 88.754  | 87.246  |
| MCoc9-1c | 90.234  | 90.225  | 99.984  | 100.000 | 99.989  | 90.339   | 88.767  | 87.259  |
| MCoc-2c | 89.900   | 89.891  | 99.973  | 99.989  | 100.000 | 90.108   | 88.531  | 87.028  |
| MCoc4c  | 89.648   | 89.671  | 90.216  | 90.229  | 89.998  | 100.000  | 94.572  | 95.720  |
| MCoc6c  | 85.520   | 85.543  | 88.653  | 88.653  | 88.417  | 94.585   | 10.000  | 95.044  |
| MCoc3c  | 86.496   | 86.505  | 87.108  | 87.134  | 86.903  | 95.713   | 95.024  | 10.000  |
| MCoc5c  | 85.729   | 85.739  | 86.862  | 86.884  | 86.650  | 95.001   | 96.034  | 98.882  |
| MCoc7c  | 86.176   | 86.208  | 87.159  | 87.219  | 86.985  | 94.715   | 94.668  | 98.603  |
|         |          |         |         |         |         |          |         |         |
|         | 8M-8     |         |         |         |         |          |         |         |
| 8M-8    | 100.000  |         |         |         |         |          |         |         |
|         |          |         |         |         |         |          |         |         |
|         | 8M-1     |         |         |         |         |          |         |         |
| 8M-1    | 100.000  |         |         |         |         |          |         |         |
|         |          |         |         |         |         |          |         |         |
|         | 1.2-3s   | 8M-7    |         |         |         |          |         |         |
| 1.2-3s  | 100.000  | 4.321   |         |         |         |          |         |         |
| 8m-7    | 4.321    | 100.000 |         |         |         |          |         |         |

| 1.2-4s | KP2-5a | colon-14-15 | colon-6 | colon-1 | M16-3-2c | M16-6c | KP2-9a | M16-9a | M16-5c | M16-7a |
|---|---|---|---|---|---|---|---|---|---|---|
| 45.415 | 48.451 | 48.282 | 48.401 | 46.935 | 46.618 | 46.381 | 46.880 | 46.532 | 46.677 | 44.571 |
| 51.207 | 52.918 | 53.619 | 53.660 | 52.249 | 50.874 | 51.522 | 53.232 | 52.896 | 51.669 | 47.964 |
| 51.073 | 52.493 | 53.501 | 53.501 | 51.882 | 50.548 | 51.143 | 53.046 | 52.830 | 51.643 | 47.379 |
| | | | | | | | | | | |
| 96.016 | 93.451 | 92.015 | 92.003 | 92.858 | 93.118 | 93.689 | 94.368 | 94.410 | 91.876 | 88.288 |
| 96.409 | 92.955 | 91.339 | 91.343 | 91.850 | 93.569 | 93.283 | 92.869 | 93.294 | 91.499 | 88.821 |
| 96.508 | 94.313 | 93.190 | 93.472 | 93.218 | 92.669 | 94.485 | 93.734 | 93.957 | 91.813 | 88.528 |
| 98.534 | 92.973 | 91.686 | 91.688 | 92.423 | 92.687 | 94.209 | 93.212 | 93.278 | 91.914 | 88.579 |
| 100.000 | 93.033 | 91.869 | 91.869 | 92.039 | 92.625 | 93.625 | 93.226 | 93.229 | 91.817 | 88.221 |
| 100.000 | 93.016 | 91.875 | 91.875 | 92.032 | 92.634 | 93.633 | 93.231 | 93.234 | 91.826 | 88.233 |
| 93.016 | 100.000 | 94.579 | 94.588 | 91.945 | 93.174 | 93.757 | 93.119 | 93.312 | 92.327 | 87.877 |
| 91.875 | 94.579 | 100.000 | 100.000 | 93.072 | 93.182 | 91.881 | 93.366 | 93.505 | 92.867 | 88.129 |
| 91.875 | 94.588 | 100.000 | 100.000 | 93.037 | 93.188 | 91.897 | 93.370 | 93.508 | 92.879 | 88.137 |
| 92.032 | 91.945 | 93.072 | 93.037 | 100.000 | 92.933 | 92.427 | 92.663 | 92.518 | 92.825 | 88.098 |
| 92.634 | 93.174 | 93.182 | 93.188 | 92.933 | 100.000 | 91.926 | 92.058 | 92.376 | 95.560 | 88.716 |
| 93.633 | 93.757 | 91.881 | 91.897 | 92.427 | 91.926 | 100.000 | 92.866 | 93.295 | 91.544 | 87.667 |
| 93.231 | 93.119 | 93.366 | 93.370 | 92.663 | 92.058 | 92.866 | 100.000 | 99.735 | 91.774 | 86.845 |
| 93.234 | 93.312 | 93.505 | 93.508 | 92.518 | 92.376 | 93.295 | 99.735 | 100.000 | 91.630 | 87.674 |
| 91.826 | 92.327 | 92.867 | 92.879 | 92.825 | 95.560 | 91.544 | 91.774 | 91.630 | 100.000 | 90.218 |
| 88.233 | 87.877 | 88.129 | 88.137 | 88.098 | 88.716 | 87.667 | 86.845 | 87.674 | 90.218 | 100.000 |
| | | | | | | | | | | |
| colon-14 | 1.2-3b | KP2-8c | | | | | | | | |
| 86.71193 | 85.66118 | 85.68349 | | | | | | | | |
| 89.18009 | 85.62027 | 85.64013 | | | | | | | | |
| 89.15457 | 85.48491 | 85.50717 | | | | | | | | |
| 91.54822 | 93.46059 | 93.46846 | | | | | | | | |
| 93.07423 | 91.31087 | 91.34391 | | | | | | | | |
| 92.63276 | 92.07773 | 91.82003 | | | | | | | | |
| 92.63021 | 92.09582 | 91.81746 | | | | | | | | |
| 92.53324 | 91.97748 | 91.71993 | | | | | | | | |
| 100 | 97.71098 | 97.82326 | | | | | | | | |
| 97.71098 | 100 | 99.85627 | | | | | | | | |
| 97.82326 | 99.85627 | 100 | | | | | | | | |
| | | | | | | | | | | |
| MCoc5c | MCoc7c | | | | | | | | | |
| 85.828 | 86.267 | | | | | | | | | |
| 85.830 | 86.270 | | | | | | | | | |
| 86.992 | 87.296 | | | | | | | | | |
| 87.002 | 87.342 | | | | | | | | | |
| 86.768 | 87.108 | | | | | | | | | |
| 94.994 | 94.701 | | | | | | | | | |
| 96.040 | 94.668 | | | | | | | | | |
| 98.882 | 98.582 | | | | | | | | | |
| 100.000 | 98.303 | | | | | | | | | |
| 98.324 | 100.000 | | | | | | | | | |

FROM FIG.2

*FIG. 2 (CONT.)*

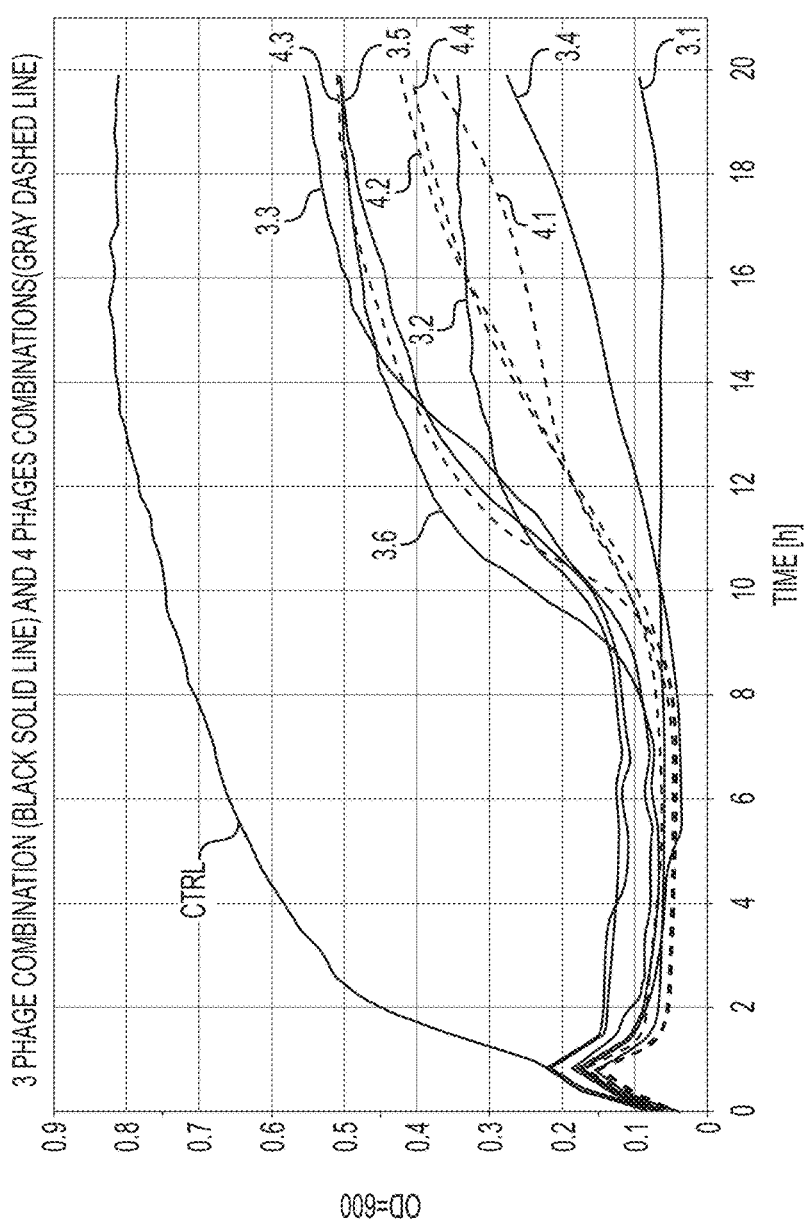
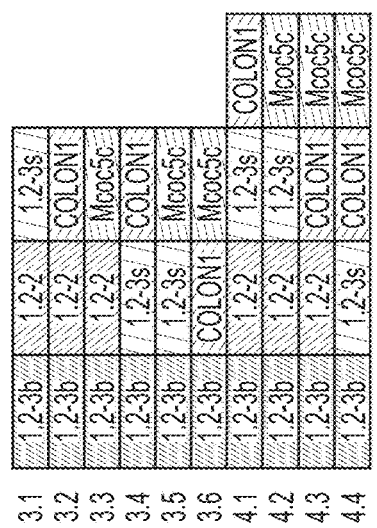
FIG. 10

| MUTANT | MUTATIONS | | colon-1 | KP2-5-1 | MCoc5 | Mcoc3 | 1.2-3b | Kp2-8C | KP2-7-1c | 8M-1 | 1.2-2 | PKP-55 | Colon-11 | 1.2-3s | 8M-7 | 8M-8 |
|---|---|---|---|---|---|---|---|---|---|---|---|---|---|---|---|---|
| colon1_1 11_S83 | LPS (rfaQ) | | R | R | R | R | S | S | S | S | S | S | R | R | R | R |
| colon1_1 38_S110 | LPS (greA) | | R | R | R | R | S | S | S | S | S | R | R | S | R | R |
| Mcoc_5C_1 | LPS (rfaG) | | S | S | R | R | S | S | S | S | S | S | S | S | R | R |
| Mcoc_5C_4 | LPS (wcaJ OR wbaP) | | S | S | R | R | S | S | S | S | S | S | S | S | R | R |
| Mcoc_5C_7 | LPS (wcaJ OR wbaP) | | S | S | S | S | R | R | S | S | S | S | S | S | R | R |
| 1.2-3b_2 27_S92 | LPS (mfpsA) | | S | S | S | S | R | R | R | S | S | S | S | R | S | S |
| 1.2-3b_8 29_S101 | LPS (wecA) | | S | S | R | S | R | R | R | R | R | R | S | R | S | S |
| 1.2-3b_7 12_S84 | IRON UPTAKE (fhuA) | LPS (wecA) | R | R | R | R | R | R | R | R | R | R | R | R | S | S |
| 8M1_1 | IRON UPTAKE (fepA) | | R | R | R | R | R | R | R | R | R | R | R | R | S | S |
| 8M1_6 | Cobalamin uptake (tonB) | maltose and maltodextrin transport (LamB) | R | R | R | R | R | R | R | R | R | R | R | R | S | S |
| 1.2-2_2 20_S92 | LPS (HBAD) | | R | R | S | S | R | R | R | R | R | R | R | R | R | R |
| 1.2-2_2 21 OR 22 | LPS (HBAD) | | S | S | R | R | S | S | S | S | R | S | R | S | S | S |
| 1.2-3S_6 14_S86 | LPS (lpxM) | | R | R | R | R | S | S | S | S | R | R | R | R | R | R |
| 1.2-3s_24 or 25 OR 26 | wbaP OR IRON (fhuA) | | S | S | S | R | S | S | S | S | S | R | S | R | R | R |

*FIG. 14*

INFECTIVITY AT 1×10⁹ PFU/mL

| ISOLATED ON | | KP1 (ATCC BAA-2552) | KP2 | KP4 (ATCC 23356) | KP5 (ATCC 13882) | KP6 (ATCC BAA-1705) | KP7 (ATCC 700603) | KP8 (ATCC 700721) |
|---|---|---|---|---|---|---|---|---|
| KP2-5 | KP2 | R | S | R | R | R | R | R |
| KP2-5-1 | KP2 | R | S | S | R | R | R | R |
| KP2-14 | KP2 | R | S | R | R | R | R | R |
| KP2-15-1 | KP2 | R | S | R | R | R | R | R |
| KP2-15-2-1 | KP2 | R | S | R | R | R | R | R |
| KP2-16-1 | KP2 | R | S | R | R | R | R | R |
| 23356-B1 | KP4 | R | R | S | NT | NT | NT | NT |

INFECTIVITY AT 1×10⁶ PFU/mL

| ISOLATED ON | | KP1 (ATCC BAA-2552) | KP2 | KP4 (ATCC 23356) |
|---|---|---|---|---|
| KP2-5 | KP2 | R | S | R |
| KP2-5-1 | KP2 | R | S | R |
| KP2-14 | KP2 | R | S | R |
| KP2-15-1 | KP2 | R | S | R |
| KP2-15-2-1 | KP2 | R | S | R |
| KP2-16-1 | KP2 | R | S | R |
| 23356-B1 | KP4 | R | R | S |

*FIG. 15*

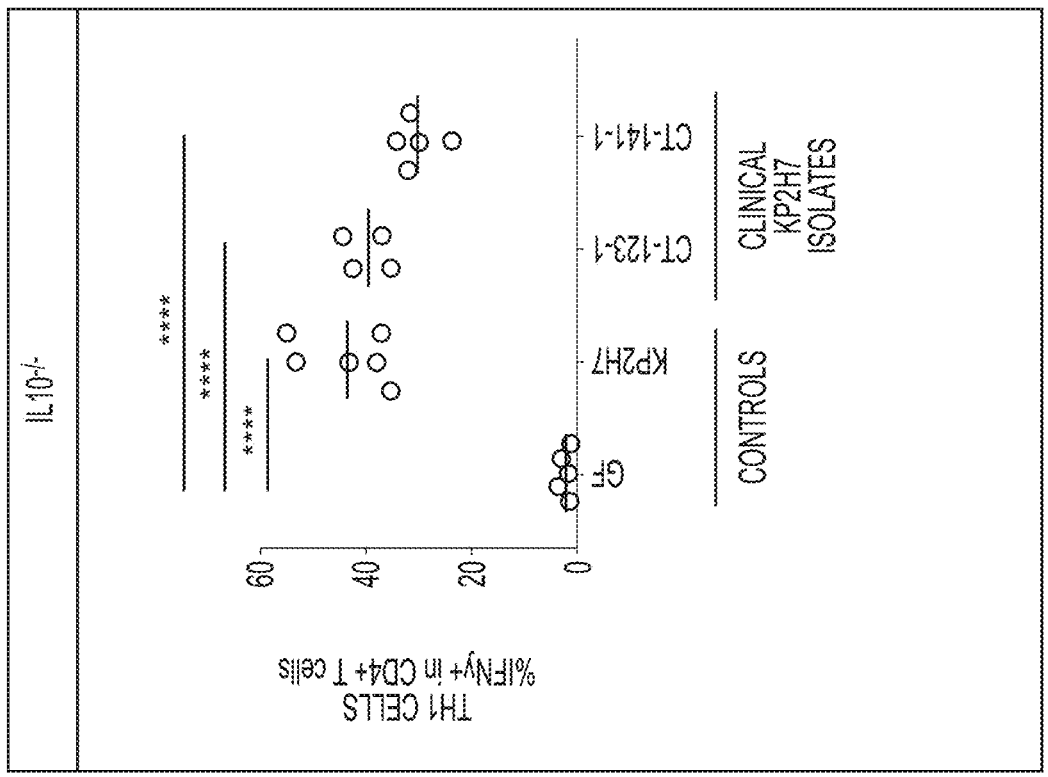
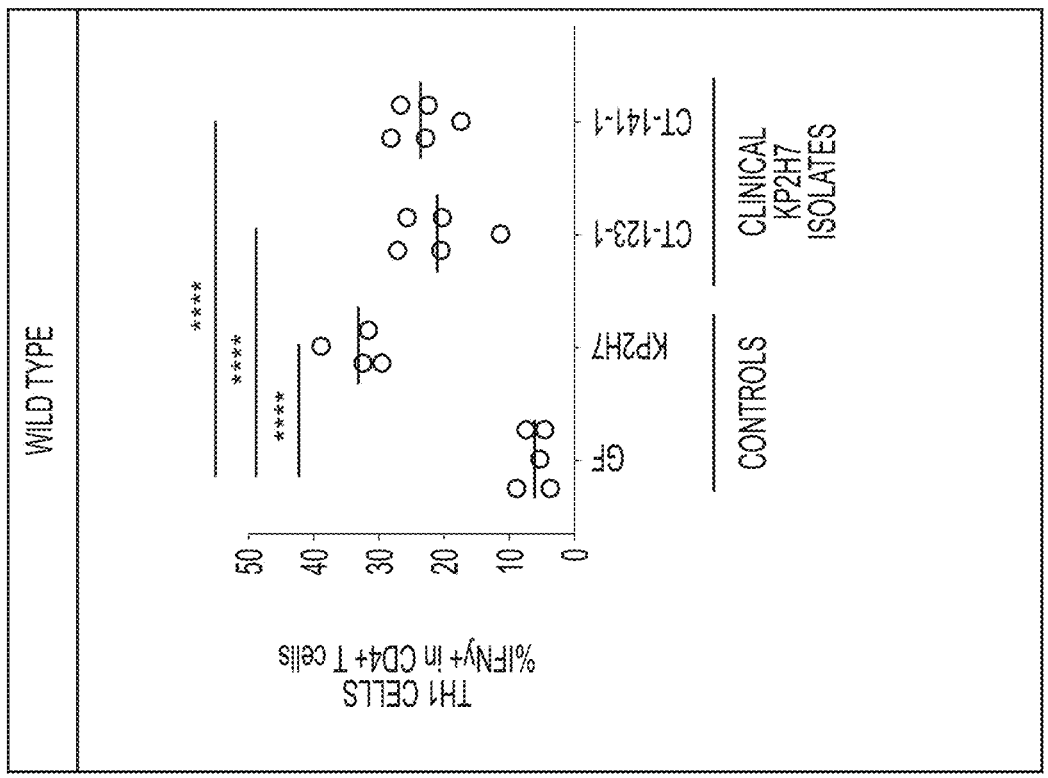
FIG. 17

BACTERIOPHAGE FOR MODULATING INFLAMMATORY BOWEL DISEASE

RELATED APPLICATIONS

This application is a National Phase of PCT Patent Application No. PCT/IB2020/000182 having International filing date of Mar. 6, 2020, which claims the benefit of priority under 35 USC § 119(e) of U.S. Provisional Application No. 62/815,265, filed on Mar. 7, 2019. The contents of the above applications are all incorporated by reference as if fully set forth herein in their entirety.

FIELD AND BACKGROUND OF THE INVENTION

Sequence Listing Statement

The ASCII file, entitled 88041SequenceListing.txt, created on Sep. 7, 2021 comprising 18,004,250 bytes, submitted concurrently with the filing of this application is incorporated herein by reference. The sequence listing submitted herewith is identical to the sequence listing forming part of the international application.

This disclosure relates to bacteriophage compositions and therapeutic uses thereof. In a particular aspect, the disclosure relates to lytic bacteriophages that are capable of lysing certain *Klebsiella* bacterial strains. In certain embodiments, the lytic bacteriophages are capable of lysing *Klebsiella* bacterial strains that are associated with inflammatory bowel disease (IBD) (e.g., ulcerative colitis, Crohn's disease), thereby modulating the disease.

Gut microbiota dysbiosis is associated with the pathogenesis of IBD (Said et al., 2014). Increased stimulation from the gut microbiota can result in inflammation and alter a patient's immune response. In humans, the oral microbiota comprises over 700 species or phylotypes of bacteria (Said et al., 2014). Ingested oral bacteria do not typically colonize the healthy intestine (Chen et al., 2016; Bik et al., 2010; U.S. Provisional Application No. 62/415,759, TH1 Cell Stimulatory Bacteria Colonizing in Human Oral Cavity). However, bacteria of oral origin may be increased in the gut microbiota of patients with IBD (Gevers et al., 2014; Atarashi et al., 2017). Oral microbiota dysbiosis is observed in patients with IBD and could contribute to disease etiology (Said et al., 2014).

IBDs, such as Crohn's disease (CD) and ulcerative colitis (UC), can cause diarrhea, malabsorption of nutrients, malnutrition, anemia, and weight loss. Severe intestinal inflammation can extend beyond the mucosa of the intestines and cause ulceration, bleeding, toxic megacolon, strictures, and fistulas. In addition, chronic inflammation is associated with colon cancer. Extraintestinal complications include, but are not limited to, arthritis, skin rashes, liver disease, and eye disorders such as episcleritis and uveitis.

According to the Crohn's & Colitis Foundation of America, "there is no single ideal therapy" for IBD. Dietary restriction alone has not been shown to ameliorate IBD. For many patients, surgical intervention is necessary. Even with the currently available IBD treatments, many patients experience IBD flares between periods of remission. Thus, there is significant unmet need for effective, reliable, and long-term treatment and/or prevention of IBD.

The disclosure provides bacteriophage compositions and therapeutic uses thereof. In specific embodiments, the disclosure provides lytic bacteriophages that are capable of lysing one or more *Klebsiella* species, strains, or sub strains, such as *Klebsiella pneumoniae* (e.g., *Klebsiella pneumoniae* 2H7 strain, "KP2" or "KP2H7" herein) that are associated with IBD. The disclosure provides methods for modulating IBD. The disclosure also provides methods for selecting patients to be treated with the methods provided herein.

BRIEF DESCRIPTION OF THE SEVERAL VIEWS OF THE DRAWINGS

FIG. 1 shows the results of the host range analysis of bacteriophage isolated against wild-type KP2 bacteria, clinical KP2 variants and mutant KP2 bacteria resistant to infection by particular KP2 bacteriophage. "S" indicates susceptibility (10 plaques or more to full clearing) and "R" indicates resistance (less than 10 plaques)

FIG. 2 shows percent homology between the bacteriophage genomes in each taxonomic group. Percent homology between the phage genomes is determined by combining all non-overlapping BLASTN alignment segments (BLAST HSPs), summing the values of their "Number of identical matches" and dividing this sum by the length of the query sequence. In some embodiments, this results in a non-symmetrical matrix.

FIG. 10 shows in vitro infection of KP2 with bacteriophage compositions containing 3 phage (black solid line) or 4 phage (gray dashed line) and no phage control (gray solid line) in liquid, as further described in Example 14.

FIG. 14 shows that bacterial mutants which developed resistance (R) to certain phage are sensitive to at least two other phage (S). Gray shaded boxes indicate resistance to the particular phage against which the bacterial mutant was raised. For example, Colon1_1 11_S83 and Colon1_1 38_S110 are resistant to and raised against colon1. Genomic modifications which affect phage infection (i.e., modifications found in a phage-resistant mutant bacteria that arose in a culture containing a specific phage capable of infecting a specific bacteria) are shown in Table 2.

FIG. 15 shows host range analysis of six phage isolated against KP2 on other *Klebsiella pneumonia* strains as indicated and activity of commercial phage on KP2 and other *Klebsiella pneumonia* strains. Activity was measured at two phage titers—$1 \times 10^9$ PFU/mL and $1 \times 10^6$ PFU/mL. S— sensitive, R— resistant, NT—not tested, PFU—plaque forming units. FIG. 15 shows that the commercial phage isolated against KP4 does not recognize KP2 and phage isolated against KP2 do not recognize commercial *Klebsiella pneumonia* strains except for recognition of KP4 by KP2-5-1, at high titer ($10^9$ PFU/mL).

FIGS. 16a-c, 16f: CT-141-1, FIG. 16d: CT-123-1, FIG. 16e, 16g-j: KP2.

FIG. 17 presents TH1 induction by KP2H7 clinical isolates. Analysis of TH1 (CD4+IFNγ+ T cells) in colonic lamina propria of mono-associated ex-GF (germ free) wild type or IL10−/− mice 3 and 2 weeks post-colonization, respectively. Clinical KP2H7 isolates tested induced a higher percentage of TH1 cells in the colonic lamina propria of monocolonized mice compared to the non-colonized animals. The designation "****" between two groups represents p-value less than 0.0001 (Holm-Sidak).

Figure 3:
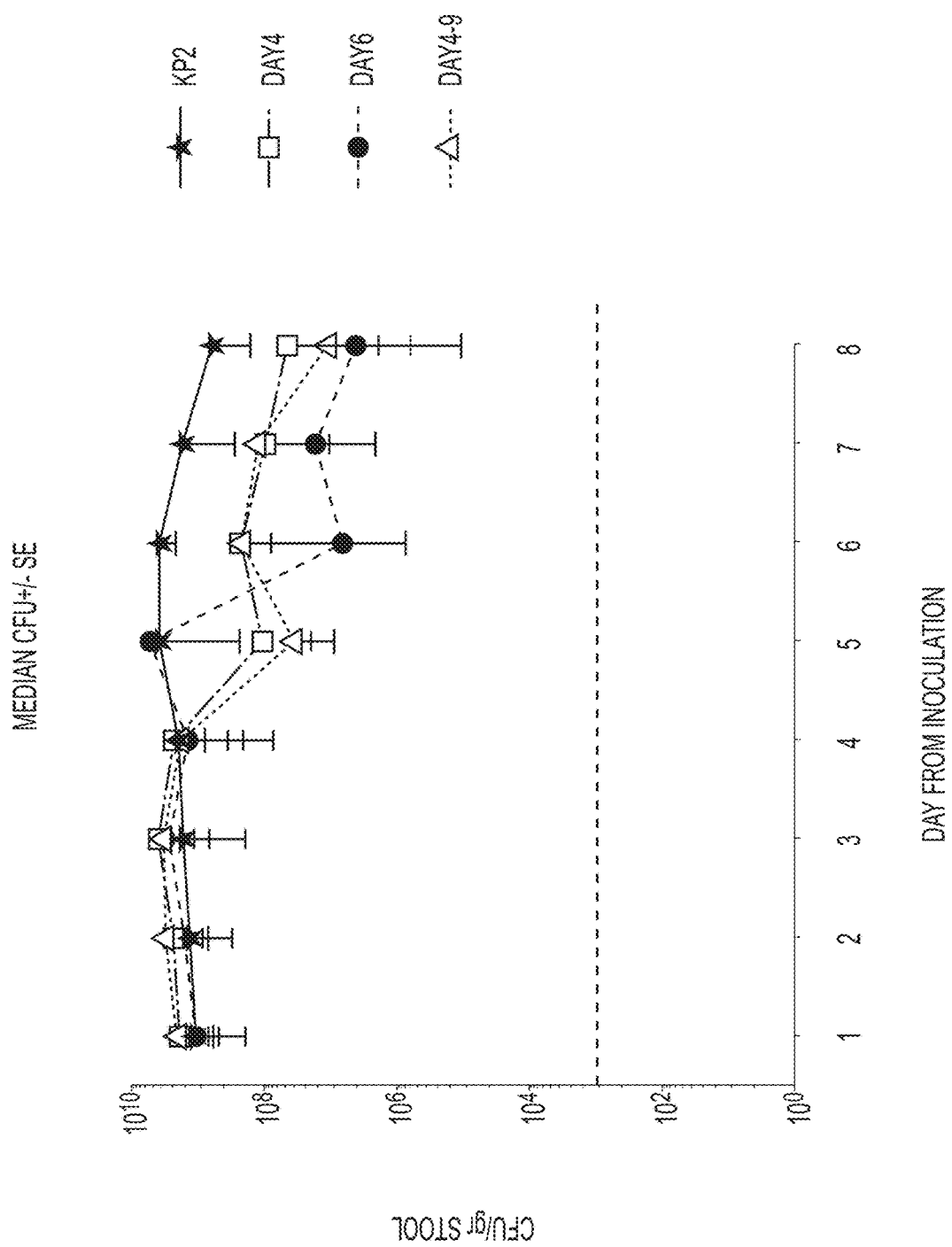
FIG. 3 shows KP2 CFU in stool for four groups of mice previously colonized by KP2 and then treated in one of following ways: 1) vehicle control administered daily starting on day 4 post KP2 administration (KP2); 2) a single dose of phage cocktail administered on day 4 post KP2 administration (Day 4); 3) daily phage cocktail doses administered starting on day 4 post KP2 administration (Day 4-6); 4) a single dose of phage cocktail administered on day 6 post KP2 administration (Day 6). The phage cocktail was comprised of the phages 1.2-2, 1.2-3s, and 1.2-3b. The dashed line represents the limit of detection ($10^3$ CFU/g stool).

Sequences of Exemplary bacteriophage of the disclosure and Exemplary bacteria against which such phage were tested are disclosed in Table 1. The KP2 genome has been sequenced and is known in the art, see, e.g., GenBank BDQR01000001.1, GenBank GCA_002260905.1, BioSample: SAMD00083910, BioProject PRJDB5883, and Atarashi et al., Ectopic colonization of oral bacteria in the intestine drives TH1 cell induction and inflammation, Science (2017). In some embodiments, a genomic sequence, e.g., a KP2 genomic sequence, may encompass minor sequencing differences, e.g., less than 0.5%, less than 1%, less than 1.5%, less than 2%, less than 2.5%, or less than 3% as compared to another genomic sequence of the same bacterium, and the sequencing differences should not result in functional differences, e.g., bacteriophage infectivity, of the bacterium.

Where more than one SEQ ID NO is associated with a bacteriophage named in Table 1, the bacteriophage may be represented by either sequence. For example, SEQ ID NO: 1 may represent Bacteriophage 1.2-4br and SEQ ID NO: 132 may represent Bacteriophage 1.2-4br.

TABLE 1

Brief Description of the Sequences

| SEQ ID NO: | Sequence Name |
|---|---|
| 1, 132 | 1.2-4br Bacteriophage Sequence |
| 2, 133 | 1.2-4s Bacteriophage Sequence |
| 3, 168 | colon-11 Bacteriophage Sequence |
| 4, 167 | colon1 Bacteriophage Sequence |
| 5, 128 | colon-6 Bacteriophage Sequence |
| 127 | PKP-55 Bacteriophage Sequence |
| 129 | 1.2-2 Bacteriophage Sequence |
| 130 | 1.2-3b Bacteriophage Sequence |
| 131 | 1.2-3s Bacteriophage Sequence |
| 134 | 8M-1 Bacteriophage Sequence |
| 135 | 8M-7 Bacteriophage Sequence |
| 136 | 8M-8 Bacteriophage Sequence |
| 140 | KP2-5-1 Bacteriophage Sequence |
| 160 | MCoc5c Bacteriophage Sequence |
| 6, 169 | colon-14 Bacteriophage Sequence |
| 7, 137 | colon-14-15 Bacteriophage Sequence |
| 8, 138 | colon-36 Bacteriophage Sequence |
| 21, 147 | KP2-14 Bacteriophage Sequence |
| 22, 170 | KP2-15-1 Bacteriophage Sequence |
| 23, 148 | KP2-15-2-1 Bacteriophage Sequence |
| 24, 149 | KP2-16-1 Bacteriophage Sequence |

TABLE 1-continued

Brief Description of the Sequences

| SEQ ID NO: | Sequence Name |
| --- | --- |
| 25, 145 | KP2-8c Bacteriophage Sequence |
| 26, 150 | KP2-5 Bacteriophage Sequence |
| 27, 142 | KP2-7-1c Bacteriophage Sequence |
| 28, 144 | KP2-8a Bacteriophage Sequence |
| 29, 143 | KP2-7c Bacteriophage Sequence |
| 31, 139 | KP2-4a Bacteriophage Sequence |
| 33, 152 | M16-4a Bacteriophage Sequence |
| 34, 141 | KP2-5a Bacteriophage Sequence |
| 35, 146 | KP2-9a Bacteriophage Sequence |
| 36, 157 | M16-9a Bacteriophage Sequence |
| 37, 151 | M16-3-2c Bacteriophage Sequence |
| 38, 153 | M16-5c Bacteriophage Sequence |
| 39, 154 | M16-6c Bacteriophage Sequence |
| 40, 155 | M16-7a Bacteriophage Sequence |
| 44, 166 | Mcoc3c Bacteriophage Sequence |
| 45, 162 | Mcoc7c Bacteriophage Sequence |
| 46, 161 | MCoc6c Bacteriophage Sequence |
| 47, 159 | MCoc4c Bacteriophage Sequence |
| 48, 156 | M16-9-1c Bacteriophage Sequence |
| 49, 164 | MCoc9-1c Bacteriophage Sequence |
| 50, 165 | MCoc9-2c Bacteriophage Sequence |
| 51, 158 | MCoc15c Bacteriophage Sequence |
| 52, 163 | MCoc8a Bacteriophage Sequence |
| 53 | KP2-Mcoc1 Bacteria Sequence |
| 54 | KP2-Mcoc1 Bacteria Sequence |
| 55 | KP2-Mcoc1 Bacteria Sequence |
| 56 | KP2-Mcoc1 Bacteria Sequence |
| 57 | KP2-Mcoc1 Bacteria Sequence |
| 58 | KP2-Mcoc1 Bacteria Sequence |
| 82 | KP2-Mcoc1 Bacteria Sequence |
| 59 | KP2-Mcoc1 Bacteria Sequence |
| 60 | KP2-Mcoc1 Bacteria Sequence |
| 61 | KP2-Mcoc1 Bacteria Sequence |
| 62 | KP2-Mcoc1 Bacteria Sequence |
| 63 | KP2-Mcoc1 Bacteria Sequence |
| 64 | KP2-Mcoc1 Bacteria Sequence |
| 65 | KP2-Mcoc1 Bacteria Sequence |
| 66 | KP2-Mcoc1 Bacteria Sequence |
| 67 | KP2-Mcoc1 Bacteria Sequence |
| 68 | KP2-Mcoc1 Bacteria Sequence |
| 69 | KP2-Mcoc1 Bacteria Sequence |
| 70 | KP2-Mcoc1 Bacteria Sequence |
| 71 | KP2-Mcoc1 Bacteria Sequence |
| 72 | KP2-Mcoc1 Bacteria Sequence |
| 73 | KP2-Mcoc1 Bacteria Sequence |
| 74 | KP2-Mcoc1 Bacteria Sequence |
| 75 | KP2-Mcoc1 Bacteria Sequence |
| 76 | KP2-Mcoc1 Bacteria Sequence |
| 77 | KP2-Mcoc1 Bacteria Sequence |
| 78 | KP2-Mcoc1 Bacteria Sequence |
| 79 | KP2-Mcoc1 Bacteria Sequence |
| 80 | KP2-Mcoc1 Bacteria Sequence |
| 81 | KP2-Mcoc1 Bacteria Sequence |
| 83 | KP2-Mcoc1 Bacteria Sequence |
| 84 | KP2-Mcoc1 Bacteria Sequence |
| 85 | KP2-Mcoc1 Bacteria Sequence |
| 86 | KP2-Mcoc1 Bacteria Sequence |
| 87 | KP2-Mcoc1 Bacteria Sequence |
| 88 | KP2-Mcoc1 Bacteria Sequence |
| 89 | KP2-Mcoc1 Bacteria Sequence |
| 90 | KP2-Mcoc1 Bacteria Sequence |
| 91 | KP2-Mcoc1 Bacteria Sequence |
| 92 | KP2-Mcoc1 Bacteria Sequence |
| 93 | KP2-Mcoc1 Bacteria Sequence |
| 94 | KP2-Mcoc1 Bacteria Sequence |
| 95 | KP2-Mcoc1 Bacteria Sequence |
| 96 | KP2-Mcoc1 Bacteria Sequence |
| 97 | KP2-Mcoc1 Bacteria Sequence |
| 98 | KP2-Mcoc1 Bacteria Sequence |
| 99 | KP2-Mcoc1 Bacteria Sequence |
| 100 | KP2-Mcoc1 Bacteria Sequence |

TABLE 1-continued

Brief Description of the Sequences

| SEQ ID NO: | Sequence Name |
|---|---|
| 101 | KP2-Mcoc1 Bacteria Sequence |
| 102 | KP2-Mcoc1 Bacteria Sequence |
| 103 | KP2-Mcoc1 Bacteria Sequence |
| 104 | KP2-Mcoc1 Bacteria Sequence |
| 105 | KP2-Mcoc1 Bacteria Sequence |
| 106 | KP2-Mcoc1 Bacteria Sequence |
| 107 | KP2-Mcoc1 Bacteria Sequence |
| 108 | KP2-Mcoc1 Bacteria Sequence |
| 109 | KP2-Mcoc1 Bacteria Sequence |
| 110 | KP2-Mcoc1 Bacteria Sequence |
| 111 | KP2-Mcoc1 Bacteria Sequence |
| 112 | KP2-Mcoc1 Bacteria Sequence |
| 113 | KP2-Mcoc1 Bacteria Sequence |
| 114 | KP2-Mcoc1 Bacteria Sequence |
| 115 | KP2-Mcoc1 Bacteria Sequence |
| 116 | KP2-Mcoc1 Bacteria Sequence |
| 117 | KP2-Mcoc1 Bacteria Sequence |
| 118 | KP2-Mcoc1 Bacteria Sequence |
| 119 | KP2-Mcoc1 Bacteria Sequence |
| 120 | KP2-Mcoc1 Bacteria Sequence |
| 121 | KP2-Mcoc1 Bacteria Sequence |
| 122 | KP2-Mcoc1 Bacteria Sequence |
| 123 | KP2-Mcoc1 Bacteria Sequence |
| 124 | KP2-Mcoc1 Bacteria Sequence |
| 125 | KP2-Mcoc1 Bacteria Sequence |
| 126 | KP2-Mcoc1 Bacteria Sequence |

DESCRIPTION OF SPECIFIC EMBODIMENTS OF THE INVENTION

The disclosure relates to bacteriophage, pharmaceutical compositions thereof, methods of modulating IBD (Jostins et al., 2012), and methods of selecting patients that are responsive to treatment by the methods set forth herein. In some embodiments, the bacteriophage described herein is capable of lysing *Klebsiella* bacterial that are or have been associated with IBD. IBD patients demonstrate elevated systemic antibodies against certain bacterial capsular types (e.g., K2, K17, K26, K36, K50, and K21 found in KP2) compared to controls and other pathologic conditions. These findings suggest the involvement of *Klebsiella* in IBD, but do not explain how *Klebsiella* may be actively involved in the pathogenesis of the disease and do not provide strain-specific resolution as different strains share similar capsular types. Strains of *Klebsiella* isolated from the salivary microbiota "are strong inducers of T helper 1 (TH1) cells when they colonize in the gut" and "elicit a severe gut inflammation in the context of a genetically susceptible host." See Atarashi et al., 2017.

Definitions

In order that the disclosure may be more readily understood, certain terms are first defined. These definitions should be read in light of the remainder of the disclosure and as understood by a person of ordinary skill in the art. Unless defined otherwise, all technical and scientific terms used herein have the same meaning as commonly understood by a person of ordinary skill in the art. Additional definitions are set forth throughout the detailed description.

As used herein, the terms "treat" and "modulate" and their cognates refer to an amelioration of IBD or at least one discernible symptom thereof. In some embodiments, "treat" and "modulate" and their cognates refer to an amelioration of at least one measurable physical parameter, not necessarily discernible by the patient. In some embodiments, "treat" and "modulate" and their cognates refer to inhibiting or reducing or slowing the progression of IBD, either physically (e.g., stabilization of a discernible symptom), physiologically (e.g., stabilization of a physical parameter), or both, relative to an untreated control. In certain embodiments, "treat" and "modulate" and their cognates refer to slowing the progression or reversing the progression of IBD relative to an untreated control. As used herein, "prevent" and its cognates refer to delaying the onset or reducing the risk of acquiring IBD or a symptom associated with IBD relative to an untreated control.

In certain embodiments, the bacteriophage described herein is administered to ameliorate an IBD in a subject and results in one or more symptoms or physical parameters of the condition or disorder to improve by at least about 10%, 20%, 30%, 40%, 50%, 60%, 70%, 80%, 90%, 95%, or more as compared to levels in an untreated or control subject. In some embodiments, the improvement is measured by comparing the symptom or physical parameter in a subject before and after administration of the bacteriophage. In some embodiments, the measurable physical parameter is a reduction in bacterial CFU in the stool.

The measurable physical parameter may be any suitable clinical parameter known in the art, e.g., for Crohn's disease (Sandborn et al., 2013; Best et al., 1976; Warrel—Oxford Textbook of Medicine, 5th edition) or for ulcerative colitis (Tursi et al., 2010; Warrel—Oxford Textbook of Medicine, 5th edition). Crohn's disease parameters include but are not limited to assessment of clinical remission using Crohn's Disease Activity Index (CDAI) (CDAI score of ≤150 points) and CDAI-100 response (≥100-point decrease in the CDAI score from the baseline); inflammation reduction as measured by decrease in serum levels of C-reactive protein, differential blood count and serum albumin levels; reduced levels of fecal calprotectin and improvement in the appearance of the mucosal layer in terminal ileum and rectum as evaluated by microscopic examination of the biopsies collected during endoscopic procedures (e.g., reduction in neutrophil, macrophage and other immune cell infiltration, granuloma size and number, reduction in the number and size of ulcers, edematous mucosa). In addition the improvement of the disease may be evaluated based on the assessment of the clinical symptoms including diarrhea, abdominal pain, weight loss, fever, vomiting, colic, rectal bleeding, anemia, extraintestinal manifestations (hypersensitivity rash to sulphasalazine, erythema nodosum, pyoderma gangrenosum, oral aphthous ulcers, sore tongue, angular stomatitis, episcleritis or an anterior uveitis, arthritis, acute arthropathy, low back pain, sacroiliitis, ankylosing spondylitis, liver diseases: minor elevations of alkaline phosphatase or transaminases, primary sclerosing cholangitis, chronic liver disease ranging from an autoimmune hepatitis to the classic picture of concentric periductular fibrosis with obliteration of bile ducts, pericarditis with or without an effusion, autoimmune hemolytic anaemia, amyloid, rapidly progressing bronchiectasis).

Ulcerative colitis disease parameters include but not limited to improvement in the ulcerative colitis disease activity index (UCDAI) (UCDAI decrease of 50% or more from the baseline), activity of relapsing UC; remission, considered as UCDAI ≤2; improvement in hemoglobin levels, serum albumin levels, decrease in C-reactive protein levels; improvement in neutrophil leukocytosis (blood differential count); improvement in endoscopic scores (reduction in the edematous mucosa area, reduction in neutrophil, macrophage and other immune cell infiltration, reduction in the number and size of ulcers, edematous mucosa; improvement in the clinical symptoms: rectal bleeding, fever, stool frequency, diarrhea, the passage of mucus, abdominal pain, constipation, anorexia, nausea, weight loss, malaise, lassitude, symptoms of chronic iron deficiency, minor perianal disease, such as a fissure, extraintestinal manifestations described above, and additionally oral candidiasis, finger clubbing.

Those in need of treatment may include individuals already having IBD, as well as those at risk of having, or who may ultimately acquire the disease. The need for treatment is assessed, e.g., by the presence of one or more risk factors associated with the development of IBD, the presence or progression of IBD, or likely receptiveness to treatment of a subject having IBD. For example, "treating" IBD may encompass reducing or eliminating associated symptoms, and does not necessarily encompass the elimination of the underlying disease etiology, e.g., a genetic instability locus.

In some embodiments, an individual with IBD is in remission and/or presently asymptomatic, and the bacteriophage described herein may be administered during the remission period to reduce the potential for a flare-up. In some embodiments, the individual in remission and/or presently asymptomatic for IBD is undergoing treatment, e.g., antibiotics and/or steroids, and the bacteriophage described herein may be co-administered with such treatment to reduce the potential for a flare-up.

*Klebsiella* is a genus of bacteria belonging to the Enterobacteriaceae family. *Klebsiella* are gram-negative, nonmotile, and rod-shaped. In some embodiments, the species of *Klebsiella* may be associated with human disease, e.g., *Klebsiella pneumoniae*. As used herein, *Klebsiella* includes bacteria that are currently classified, were previously classified, or will be reclassified as *Klebsiella* bacteria. In some embodiments, *Klebsiella* refers to *Klebsiella pneumoniae*. In some embodiments, *Klebsiella* refers to naturally occurring *Klebsiella*. In some embodiments, *Klebsiella* refers to a naturally occurring, variant or mutant *Klebsiella* (e.g., antibiotic resistant, phage resistant, nosocomial). In some embodiments, the variant or mutant *Klebsiella* is resistant to at least 1, at least 2, at least 3, at least 4, or at least 5 antibiotics. In some embodiments, a mutant bacterial strain may arise in the presence of a bacteriophage and become resistant to said bacteriophage.

As used herein, a "strain" of bacteria refers to a genetic variant or subtype of bacteria. In some embodiments, a "strain" of bacteria comprises descendants from a single isolation in a pure culture of said bacteria. As used herein, a "strain" of bacteria may refer to one or more genetic variants or subtypes of said bacteria. For example, as used herein, a "strain" of *Klebsiella pneumoniae* may refer to one or more genetic variants or subtypes of *Klebsiella pneumoniae*, including but not limited to KP1 (ATCC BAA-2552; also referred to as *Klebsiella* variicola), KP2 (*Klebsiella pneumoniae* strain 2H7 described herein), KP4 (ATCC 23356), KP5 (ATCC 13882), KP6 (ATCC BAA-1705), KP7 (ATCC 700603), and KP8 (ATCC 700721). Similarly, as used herein, a bacteriophage that is capable of lysing a "strain" of *Klebsiella pneumoniae* refers to a bacteriophage that is capable of lysing one or more genetic variants or subtypes of *Klebsiella pneumoniae*, including but not limited to KP1, KP2, KP4, KP5, KP6, KP7, and KP8. In some embodiments, a bacteriophage that is capable of lysing a "strain" of *Klebsiella pneumoniae* refers to a bacteriophage that is capable of lysing one or more genetic variants or subtypes of *Klebsiella pneumoniae* KP2, KP4, KP5, KP6, KP7, and KP8. In some embodiments, the KP2 bacteriophage described herein is capable of lysing a KP2 strain of *Klebsiella pneumoniae*.

The term "KP2" when used in reference to a bacterium and without a further qualifier (e.g., "mutant", "variant", "wild-type", etc.) is used herein, in the alternative, to refer to either a wild-type strain of *Klebsiella pneumoniae* that has been designated as "KP2" or "KP2H7", or to a bacterium that may be either such wild-type strain or a mutant thereof. It should be readily apparent to one of ordinary skill in the art, which of the two alternate meanings is intended by the context in which the term is used. If the context does not unambiguously inform one of ordinary skill in the art which definition is intended, then the term "KP2" shall be interpreted to mean a bacterium that may be either such wild-type strain or a mutant thereof.

The term "a strain of KP2 bacterium" as used herein refers to a wild-type strain of *Klebsiella pneumoniae* that has been designated as "KP2" or "KP2H7".

In some embodiments, as used herein, a "mutant" bacterium refers to a bacterium that comprises greater than about 85%, greater than about 90%, greater than about 95%, greater than about 97%, or greater than about 99% homology to a corresponding wild-type bacterial strain. For example, a mutant KP2 bacterium comprises greater than about 85%, greater than about 90%, greater than about 95%, greater than about 97%, or greater than about 99% homology to a wild-type KP2 bacterium. The terms "mutant KP2 bacterium" and "KP2 mutant" are used interchangeably and both terms include such bacterium isolated from human or animal patients ("clinical isolates" or "clinical variants"), such bacterium isolated from the environment ("environmental isolates"), and such bacterium produced in a laboratory setting (e.g., though genetic engineering or through selection pressure). The terms "mutant KP2 bacterium" and "KP2 mutant" also encompass "KP2-variants" (as defined below).

In some embodiments, a KP2 bacterium, e.g., a strain of KP2 bacterium, and/or a mutant KP2 bacterium, e.g., an environmental and/or clinical isolate as described herein, is positive for a genomic region that may be identified by PCR using the following primers: 5'AGCACTAGCGGCTGTGGTAT3' (SEQ ID NO: 287) and 5'ACTTACTCGGGCCCTTGATT3' (SEQ ID NO: 288). See, e.g., Atarashi et al., 2017.

In some embodiments, the mutant KP2 bacterium, e.g., an environmental and/or clinical isolate identified using said primers, comprises greater than about 95%, greater than about 96%, greater than about 97%, greater than about 98%, or greater than about 99% homology to the wild-type KP2 bacterium, e.g., % homology as calculated by ANI (Average Nucleotide Identity). See, e.g., Han et al., ANItools web: a web tool for fast genome comparison within multiple bacterial strains (2016). In some embodiments, the mutant KP2 bacterium, e.g., an environmental and/or clinical isolate identified using said primers, comprises greater than about 95%, greater than about 96%, greater than about 97%, greater than about 98%, or greater than about 99% homology to the coding regions of the wild-type KP2 bacterium. In some embodiments, a mutant KP2 bacterium identified by said primers and is at least about 99% homologous to the wild-type KP2 bacterium is referred to as "KP2-variant" herein. In some embodiments, the mutant and/or KP2-variant bacterium is capable of being lysed by at least one of the KP2 bacteriophage disclosed herein. In some embodiments, a KP2 bacterium, e.g., a strain of KP2 bacterium, and/or a mutant KP2 bacterium, e.g., an environmental and/or clinical isolate as described herein comprises a genome with greater than about 95%, greater than about 96%, greater than about 97%, greater than about 98%, or greater than about 99% homology to reference sequences as further detailed in Example 1. In some embodiments, a KP2 bacterium, e.g., a strain of KP2 bacterium, and/or a mutant KP2 bacterium, e.g., an environmental and/or clinical isolate as described herein comprises a multi-locus sequence type (MLST) of type 323.

As used herein, "bacteriophage" and "phage" are used interchangeably and refer to an isolated virus that is capable of infecting a bacterium. In some embodiments, the phage comprises a DNA or an RNA genome. A phage may be isolated from a natural or human-made environment. In some embodiments, the phage is selected from Myoviridae, Podoviridae, and Siphoviridae. As used herein, a "KP bacteriophage" is intended to refer to a bacteriophage that is capable of lysing a *Klebsiella pneumoniae* bacterium. For example, a "KP2 bacteriophage" refers to a bacteriophage that is capable of lysing a *Klebsiella pneumoniae* strain KP2 bacterium, including wild-type and, in some instances, one or more mutant KP2 bacterium or KP2 variant.

It is known that different isolates of a given bacteriophage may vary at the nucleic acid sequence level. In some embodiments, bacteriophages are considered to be "functionally equivalent" as long as they exhibit similar phenotypes, e.g., similar host range, similar lytic ability, and/or threshold sequence similarity (e.g., greater than about 85%, greater than about 90%, greater than about 95%, greater than about 97%, or greater than about 99%). As used herein, the term "bacteriophage" encompasses a parent bacteriophage as well as its progeny or derivatives.

As used herein, "host range" refers to the bacteria that are susceptible to infection by a particular phage. The host range of a phage may include, but is not limited to, a strain, a species, a genus, or multiple genera of bacteria. The term encompasses phage adsorbable, non-productive infection (e.g., restrictive, abortive, lysogenic), and productive infections. In some embodiments, a phage may recognize two or more strains. In some embodiments, a phage may recognize and lyse both wild-type strains and mutant strains of a particular bacteria (i.e., KP2).

Different phage isolates may be prepared and phenotyped using methods known in the art, e.g., a plaque assay, liquid media assay, solid media assay. In some embodiments, the solid media assays to quantify and isolate phage are based on plaque assays (Abedon & Yin, 2009), ranging from efficiency of plating (EOP) (Kutter, 2009) to spot testing (Hyman & Abedon, 2010). In some embodiments, the plate format used for the plaque assay can be modified, e.g., from a petri dish to a 48-well plate.

In some embodiments, a double-layer plaque assay (also termed double agar overlay plaque assay) is used to phenotype bacteriophage isolates. For example, a starter culture of 4 mL BHIS may be inoculated with 5-10 colonies from a plate. This culture may be incubated at 37° C. for 1.5-2 hours. A volume of 100 µL of this culture may be mixed with 100 µL of a phage-containing sample (or medium only control) and incubated for 15 minutes. Thereafter, 3 mL of BHIS top agar (pre-molten 0.4% agar BHIS supplemented with 1 mM $Ca^{2+}$ and $Mg^{2+}$ ions) may be added, and the mixture may be poured over a BHIS bottom agar plate (1.5% agar BHIS). The plates may be left to gel at room temperature, and then incubated for 2-3 hours at 37° C. until plaques are identified.

In some embodiments, a modified spot drop assay is used to phenotype bacteriophage isolates. For example, a starter culture of 4 mL BHIS may be inoculated with 5-10 colonies from a plate. This culture may be incubated at 37° C. for 1.5-2 hours. A volume of 100 µL of this culture may be mixed with 3 mL of BHIS top agar (pre-molten 0.4% agar BHIS supplemented with 1 mM $Ca^{2+}$ and $Mg^{2+}$ ions), and 100 µL of this mixture may be dispensed per well of a Nunc 48-well plate already containing 1 mL per well of BHIS bottom agar. After solidifying at room temperature, the plates may be incubated for 30 minutes at 37 degrees. At this stage, 10 µL of samples containing phage or media only controls may be dropped in the middle of the well, left to absorb, and then may be incubated for 2-3 hours until plaques are visible for counting.

In some embodiments, a liquid media assay is used to phenotype the bacteriophage. In some embodiments, liquid-based phage infection assays follow the time-course of infection and can provide more than quantitative end-points of infection as compared to the solid-phase plaque assays. In some embodiments, by mixing phage with bacteria in liquid medium, then following the turbidity of the culture over time, one can discern finer differences (e.g., a delay in the time of cell lysis) between how different bacterial strains interact with the phage. In some embodiments, the liquid media assay allows for high-throughput measurements by using 96-well plates and reading optical density in a plate reader.

For example, a bacterial strain may be grown for 1.5-2 hours until an OD600 of about 1.7-2. This culture may then be diluted using BHIS medium to a starting optical density, typically between 0.05 and 0.2 OD600. A volume of 200 µL of culture may then be dispensed into the wells of a Nunclon flat-bottomed 96-well plate. 10 µL of a sample containing phage or 10 µL of medium as control may be added to each well. The wells may be covered with 50 µL of mineral oil to limit evaporation, and a thin sterile optically transparent polyester film may be added to keep the culture sterile. Optical density measurements may be carried out every 15 minutes, e.g., in a Tecan Infinite M200 plate reader connected to a Tecan EVO75 robot. Between measurements, the plate may be incubated while shaking at 37° C., e.g., inside the EVO75 incubator.

In some embodiments, a biofilm assay may be used to identify phage that are capable of penetrating KP2 biofilm and/or reducing the number of viable bacteria found therein. For example, KP2 may be grown at 37° C. with agitation to an OD600 of about 1.5 and diluted in LB medium supplemented with 1% glucose to an OD600 of about 0.1. For biofilm formation, 200 µl may be added to 96 well plates and incubated for 24 hrs at 37° C., e.g., to enable growth to approximately $4\times10^8$ cells per well. 180 µl may be discarded to remove planktonic cells and 50 µl of the individual phage or cocktails may be applied at MOI of 0.01 ($4\times10^6$ total phage particles). Phage buffer may be added to untreated wells as a negative control. 150 µl of LB supplemented with 1% glucose and 1 mM MMC ions may be added and incubated at 37° C. At set time points, the liquid may be removed and the biofilm scraped rigorously from the bottom of the wells. 100 µl PBS may be added to the wells, mixed and moved to sterile eppendorfs with 900 µl PBS. Samples may be vortexed for 1 minute and washed 3 times by centrifuging at 4° C. for 5 minutes at 6000×g. After the last wash, 200 µl PBS may be added and samples may be serially diluted by 10 fold in PBS. A 5 µl drop of each dilution may be plated on BHIS agar plates. Plates may be incubated overnight at 37° C. after which bacterial concentration may be determined by viable count.

In some embodiments, infectivity is determined by the plaque presence in a solid assay only. In some embodiments, infectivity is determined by the decrease in the bacterial culture optical density in a liquid assay only. In some embodiments, infectivity is determined by the decrease in the bacterial culture optical density and plaque presence in both the liquid assay and the solid assay.

As used herein, a "lytic" bacteriophage refers to a virulent bacteriophage that in the course of infection attaches to a bacterial host, inserts its genetic material into the bacterial host cell and ultimately lyses the host. Phage usually follows one of two life cycles, lytic (virulent) or lysogenic (temperate). Lytic phages take over the machinery of the cell to make phage components. They then destroy, or lyse, the cell, releasing new phage particles. Lysogenic phages incorporate their nucleic acid into the chromosome of the host cell and replicate with it as a unit without destroying the cell. Under certain conditions lysogenic phages can be induced to follow a lytic cycle. In some embodiments, following the infection, new bacteriophage particles are released. In some embodiments, following the infection, the host bacterial cells are lysed and destroyed. In some embodiments, less than 90% of the host bacterial cells are lysed and destroyed. See, e.g., Abedon et al., 2011; Sulakvelidze et al., 2001; Green et al., 2017.

In some embodiments, the % lysis is measured by methods known in the art and described herein, e.g., by optical density (OD) or qPCR.

In some embodiments, the infection of bacterial host by the phage reduces the growth rate of the host population. Growth rate reduction may be measured by methods known in the art and described herein, e.g., by optical density (OD) or qPCR. For example, two bacterial samples of identical composition (duplicates) may be cultured with two different phage or phage cocktails starting at same time point. The OD of each sample is taken at certain time points and the OD readings compared. The bacterial population in a sample with lower OD has an average lower growth rate up till that time point.

As used herein, "% homology" refers to the level of nucleic acid sequence identity or amino acid sequence identity between a first nucleic acid or amino acid sequence when aligned to a second nucleic acid or amino acid sequence using a sequence alignment program. When a position in the first and the second sequences is occupied by the same nucleic acid or amino acid (e.g., if a position in the first nucleic acid sequence and the second nucleic acid sequence is occupied by cytosine), then the first and the second sequences are homologous at that position.

In general, homology between two sequences is calculated from the number of matching or homologous positions shared by the two sequences over the total number of positions compared. In some embodiments, the first and the second sequences are aligned in a manner to maximize % homology. In some embodiments, % homology refers to the % identity over the shorter of two sequences. In some embodiments, the % homology for a nucleic acid sequence includes intergenic regions. Exemplary levels of % homology include, but are not limited to, 80, 81, 82, 83, 84, 85, 86, 87, 88, 89, 90, 91, 92, 93, 94, 95, 96, 97, 98, 99% or more sequence identity between a first and a second sequence.

Exemplary sequence alignment programs that may be used to determine % homology between two sequences include, but are not limited to, the FASTA package (including rigorous (SSEARCH, LALIGN, GGSEARCH and GLSEARCH) and heuristic (FASTA, FASTX/Y, TFASTX/Y and FASTS/M/F) algorithms, the EMBOSS package (Needle, stretcher, water and matcher), the BLAST programs (including, but not limited to BLASTN, BLASTX, TBLASTX, BLASTP, TBLASTN), megablast and BLAT. In some embodiments, the sequence alignment program is BLASTN. For example, 95% homology refers to 95% sequence identity determined by BLASTN, by combining all non-overlapping alignment segments (BLAST HSPs), summing their numbers of identical matches and dividing this sum with the length of the shorter sequence.

In some embodiments, the sequence alignment program is a basic local alignment program, e.g., BLAST. In some embodiments, the sequence alignment program is a pairwise global alignment program. In some embodiments, the pairwise global alignment program is used for protein-protein alignments. In some embodiments, the pairwise global alignment program is Needle. In some embodiments, the sequence alignment program is a multiple alignment program. In some embodiments, the multiple alignment program is MAFFT. In some embodiments, the sequence alignment program is a whole genome alignment program. In some embodiments, the whole genome alignment is performed using BLASTN. In some embodiments, BLASTN is utilized without any changes to the default parameters.

As used herein, a "pharmaceutical composition" refers to a preparation of the bacteriophage of the invention with other components such as a physiologically suitable carrier and/or excipient.

"Physiologically acceptable carrier" and "pharmaceutically acceptable carrier" are used interchangeably herein to refer to a carrier or a diluent that does not cause significant irritation to an organism and does not abrogate the biological activity and properties of the administered bacteriophage composition. An adjuvant is included under these phrases.

The term "excipient" refers to an inert substance added to a pharmaceutical composition to further facilitate administration of an active ingredient. Examples include, but are not limited to, calcium bicarbonate, calcium phosphate, various sugars and types of starch, cellulose derivatives, gelatin, vegetable oils, polyethylene glycols, and surfactants, including, e.g., polysorbate 20.

The terms "therapeutically effective dose" and "therapeutically effective amount" are used to refer to an amount of a compound that results in prevention, delay of onset of symptoms, or amelioration of symptoms of IBD compared to an untreated control. A therapeutically effective amount may, for example, be sufficient to treat, prevent, reduce the severity, delay the onset, and/or reduce the risk of occurrence of one or more symptoms of IBD compared to an untreated control.

As used herein, "gastrointestinal tract" encompasses the organs, glands, tracts, and systems that are responsible for the transfer and digestion of food, absorption of nutrients, and excretion of waste. In humans, the "gastrointestinal tract" starts at the mouth and ends at the anus, and additionally comprises the esophagus, stomach, small intestine, and large intestine. The upper gastrointestinal tract comprises the mouth, esophagus, stomach, and duodenum of the small intestine. The lower gastrointestinal tract comprises the remainder of the small intestine, i.e., the jejunum and ileum, and all of the large intestine, i.e., the cecum, colon, rectum, and anal canal. Bacteria can be found throughout the intestine.

In some embodiments, different portions of the gastrointestinal tract may be associated with disease. In CD, for example, the bacteriophage may be formulated to target bacteria present in the small intestine, colon, ileum, ileocecal junction, esophagus, mouth, and/or anus. In UC, for example, the bacteriophage may be formulated to target bacteria present in the colon, rectum, anus, and large intestine of a mammal.

The articles "a" and "an" as used herein, should be understood to mean "at least one," unless clearly indicated to the contrary.

The phrase "and/or", when used between elements in a list, is intended to mean either (1) that only a single listed element is present, or (2) that more than one element of the list is present. For example, "A, B, and/or C" indicates that the selection may be A alone; B alone; C alone; A and B; A and C; B and C; or A, B, and C. The phrase "and/or" may be used interchangeably with "at least one of" or "one or more of" the elements in a list.

All ranges include end points. All references cited are incorporated by reference in their entireties for any purpose (specification controls where there are inconsistencies).

Singular form includes plural.

Bacteriophage

The bacteriophage and bacteriophage cocktails described herein are capable of lysing one or more *Klebsiella* bacterial strains that are associated with IBD, e.g., ulcerative colitis, Crohn's disease. In some embodiments, the bacteriophage and bacteriophage cocktails are capable of lysing one or more *Klebsiella pneumoniae* bacterial strains that are associated with IBD. In some embodiments, the bacteriophage and bacteriophage cocktails are capable of modulating IBD by lysing the one or more *Klebsiella* bacteria in a mammal. In some embodiments, the bacteriophage and bacteriophage cocktails are capable of modulating IBD by lysing the one or more *Klebsiella* bacteria in the gastrointestinal tract of a mammal. In some embodiments, the bacteriophage and bacteriophage cocktails are capable of modulating IBD by lysing the one or more *Klebsiella* bacteria in the mouth of a mammal. In some embodiments, the bacteriophage and bacteriophage cocktails are capable of modulating IBD by lysing the one or more *Klebsiella* bacteria in the small intestine of a mammal. In some embodiments, the bacteriophage and bacteriophage cocktails are capable of modulating IBD by lysing the one or more *Klebsiella* bacteria in the stomach of a mammal.

In some embodiments, the bacteriophage and bacteriophage cocktails are capable of modulating IBD associated with proton pump inhibitor (PPI) therapy (Juillerat et al., 2012) by lysing the one or more *Klebsiella* bacteria. In some embodiments, the bacteriophage and bacteriophage cocktails are capable of modulating IBD associated with primary sclerosing cholangitis (Hirschfield et al., 2013; Palmela et al., 2017) by lysing the one or more *Klebsiella* bacteria.

In some embodiments, a bacteriophage may be classified as a member of a particular bacteriophage family by methods or combinations of methods known in the art and disclosed herein. Non-limiting examples of bacteriophage families include Myoviridae Type 2 (e.g., phages T4 or RB43), Podoviridae Type 3 (e.g., phages phiYeO3-12, T3 or T7) and Siphoviridae Type 1 (e.g., phages T1, TLS or RTP).

In some embodiments, bacteriophage may be sequenced and reads may be assembled, e.g., using SPAdes. See, e.g., Bankevich et al., 2012. In some embodiments, prediction of open reading frames and translation into amino acid sequences may be performed on the assembled bacteriophage genomes, e.g., using Prokka. See, e.g., Seemann 2014.

In some embodiments, bacteriophage are classified as members of a family by analyzing the phage structural genes, e.g., using VIRFAM. See, e.g., Lopes et al. 2014.

In some embodiments, bacteriophage are classified as members of a family by analyzing the assembled phage genome, e.g., as compared to phage genome in the NCBI Reseq database, e.g., with BLAST. See, e.g., O'Leary et al. 2016; Camacho et al. 2009. In some embodiments, the BLAST cutoff for % identity is at least about 50%, 60%, 70%, 80%, or 90%. In some embodiments, the BLAST cutoff for % identity is about 80%. In some embodiments, the BLAST cutoff for query coverage is at least about 50%, 60%, 70%, 80%, or 90%. In some embodiments, the BLAST cutoff for query coverage is about 70%. In some embodiments, the BLAST cutoff for % identity is 80%, and the BLAST cutoff for query coverage is about 70%. In some embodiments, the taxonomic annotation of the best hit from the BLAST search is used.

In some embodiments, bacteriophage are classified as members of a family by analyzing the phage protein sequences, e.g., as compared to phage proteomes in the NCBI Refseq database, e.g., with BLAST. See, e.g., O'Leary et al. 2016; Camacho et al. 2009. In some embodiments, the BLAST cutoff for % identity is at least about 30%, 40%, 50%, 60%, or 70%. In some embodiments, the BLAST cutoff for % identity is about 50%. In some embodiments, the BLAST cutoff for query coverage is at least about 30%, 40%, 50%, 60%, or 70%. In some embodiments, the BLAST cutoff for query coverage is about 50%. In some embodiments, the BLAST cutoff for % identity is 50%, and the BLAST cutoff for query coverage is about 50%. In some embodiments, a reference genome is determined for the phage by the protein sequences in the BLAST search with highest homology. In some embodiments, the taxonomic annotation of the phage may be inferred from the taxonomic annotation of the reference genome, optionally in addition to other genomes with over 40% homology to the reference sequence.

The taxonomy annotation obtained from the methods disclosed herein may be generally consistent with one another. In the event of discrepancies, discrepancies may be resolved by using the International Committee on Taxonomy of Viruses (ICTV) specific taxon threshold.

In some embodiments, the bacteriophage is capable of lysing at least one, two, three, four, or five bacteria selected from KP2 (ACCESSION NO. DSM 33048), CT-141-1 (ACCESSION NO. DSM 33052), CT-123-1 (ACCESSION NO. DSM 33051), MKP2_2161_1 (ACCESSION NO. DSM 33055), MKP2_251_B (ACCESSION NO. DSM 33053), MKP2_251_C (ACCESSION NO. DSM 33054), and 8M-all (ACCESSION NO. DSM 33050).

In some embodiments, the bacteriophage is selected from 1.2-2 (ACCESSION NO. DSM 33068), colon-11, PKP-55 (ACCESSION NO. DSM 33064), or any other member of the family Myoviridae, subfamily Tevenvirinae, genus Kp15virus that is capable of infecting at least two of *Klebsiella pneumoniae* strains KP2, CT-123-1, MKP2_2161_1, and MKP2_251_B. In some embodiments, the bacteriophage is selected from 1.2-2, colon-11, and PKP-55. The bacteriophage identified in this paragraph may be referred to as "Group 1" bacteriophage and may be capable of infecting the bacterial strains described in this paragraph. In some embodiments, Group 1 consists of 1.2-2, colon-11, and PKP-55.

In some embodiments, the bacteriophage is selected from M16-7a, KP2-4a, M16-4a, colon-36, KP2-5-1 (ACCESSION NO. DSM 33067), 1.2-4br, 1.2-4s, M16-6c, KP2-9a, M16-9a, KP2-5a, colon-14-15, colon-6, colon1, M16-3-2c, M16-5c, or any other member of the family Myoviridae, subfamily Tevenvirinae, genus T4virus that is capable of infecting at least two of *Klebsiella pneumoniae* strains KP2, CT-123-1, MKP2_2161_1, and MKP2_251_B. In some embodiments, the bacteriophage is selected from M16-7a, KP2-4a, M16-4a, colon-36, KP2-5-1, 1.2-4br, 1.2-4s, M16-6c, KP2-9a, M16-9a, KP2-5-1, colon-14-15, colon-6, colon1, M16-3-2c, and M16-5c. The bacteriophage identified in this paragraph may be referred to as "Group 2" bacteriophage and may be capable of infecting the bacterial strains described in this paragraph. In some embodiments, Group 2 consists of M16-7a, KP2-4a, M16-4a, colon-36, KP2-5-1, 1.2-4br, 1.2-4s, M16-6c, KP2-9a, M16-9a, KP2-5-1, colon-14-15, colon-6, colon1, M16-3-2c, and M16-5c.

In some embodiments, the bacteriophage is selected from KP2-15-2-1, KP2-14, KP2-15-1, colon-14, 1.2-3b (ACCESSION NO. DSM 330066), KP2-8c, KP2-7c, KP2-7-1c, KP2-8a, KP2-5, KP2-16-1, or any other member of the family Podoviridae, subfamily Autographivirinae, genus T7virus that is capable of infecting *Klebsiella pneumoniae* strains KP2 and MKP2_251_B. In some embodiments, the bacteriophage is selected from KP2-15-2-1, KP2-14, KP2-15-1, colon-14, 1.2-3b, KP2-8c, KP2-7c, KP2-7-1c, KP2-8a, KP2-5, and KP2-16-1. The bacteriophage identified in this paragraph may be referred to as "Group 3" bacteriophage and may be capable of infecting the bacterial strains described in this paragraph. In some embodiments, Group 3 consists of KP2-15-2-1, KP2-14, KP2-15-1, colon-14, 1.2-3b, KP2-8c, KP2-7c, KP2-7-1c, KP2-8a, KP2-5, and KP2-16-1.

In some embodiments, the bacteriophage is selected from MCoc4c, MCoc6c, Mcoc7c, MCoc3c, MCoc5c (ACCESSION NO. DSM 33069), MCoc15c, MCoc8a, MCoc9-2c, M16-9-1c, MCoc9-1c, or any other member of the family Podoviridae, subfamily Autographivirinae, genus Kp34virus that is capable of infecting at least three of *Klebsiella pneumoniae* strains CT-141-1, CT-123-1, MKP2_2161_1, and MKP2_251_C.

In some embodiments, the bacteriophage is selected from MCoc4c, MCoc6c, Mcoc7c, MCoc3c, MCoc5c, MCoc15c, MCoc8a, MCoc9-2c, M16-9-1c, and MCoc9-1c. The bacteriophage identified in this paragraph may be referred to as "Group 4" bacteriophage and may be capable of infecting the bacterial strains described in this paragraph. In some embodiments, Group 4 consists of MCoc4c, MCoc6c, Mcoc7c, MCoc3c, MCoc5c, MCoc15c, MCoc8a, MCoc9-2c, M16-9-1c, and MCoc9-1c.

In some embodiments, the bacteriophage is selected from 8M-8 (ACCESSION NO. DSM 33071) or any other member of the family Myoviridae, subfamily Vequintavirinae, genus ScIvirus that is capable of infecting *Klebsiella pneumoniae* strains CT-123-1, MKP2_2161_1, and 8M-all. In some embodiments, the bacteriophage is 8M-8. The bacteriophage identified in this paragraph may be referred to as "Group 5" bacteriophage and may be capable of infecting the bacterial strains described in this paragraph. In some embodiments, Group 5 consists of 8M-8.

In some embodiments, the bacteriophage is selected from 8M-1 (ACCESSION NO. DSM 33072), 8M-7 (ACCESSION NO. DSM 33070), 1.2-3s (ACCESSION NO. DSM 33065) or any other member of the family Siphoviridae that is capable of infecting at least two of *Klebsiella pneumoniae* strains KP2, CT-123-1, MKP2_2161_1, MKP2_251_B, and 8M-all. In some embodiments, the bacteriophage is selected from 8M-1, 8M-7, and 1.2-3s. The bacteriophage identified in this paragraph may be referred to as "Group 6" bacteriophage and may be capable of infecting the bacterial strains described in this paragraph. In some embodiments, Group 6 consists of 8M-1, 8M-7, and 1.2-3s.

In some embodiments, the bacteriophage is capable of lysing KP2 and at least one bacteria, at least two bacteria, at least three bacteria, at least four bacteria, or at least five bacteria selected from CT-141-1, CT-123-1, MKP2_2161_1, MKP2_251_B, MKP2_251_C and 8M-all.

As used herein, a bacteriophage "cocktail" refers to a composition comprising at least two different isolates of bacteriophage, e.g., lytic bacteriophage, as described herein.

As used herein, "a" or "one" bacteriophage refers to an isolate or type of bacteriophage and is not necessarily intended to refer to a single bacteriophage particle.

In some embodiments, the bacteriophage cocktail comprises at least two different KP2 bacteriophages described herein and is capable of infecting wild-type KP2 bacteria.

In some embodiments, the cocktail comprises at least two different KP2 bacteriophages described herein and is capable of infecting mutant KP2 bacteria. In some embodiments, the cocktail comprises at least two different KP2 bacteriophages described herein and is capable of infecting wild-type KP2 bacteria and mutant KP2 bacteria.

In some embodiments, the cocktail comprises at least three different KP2 bacteriophages described herein and is capable of infecting wild-type KP2 bacteria. In some embodiments, the cocktail comprises at least three different KP2 bacteriophages described herein and is capable of infecting mutant KP2 bacteria. In some embodiments, the cocktail comprises at least three different KP2 bacteriophages described herein and is capable of infecting wild-type KP2 bacteria and mutant KP2 bacteria.

In some embodiments, the cocktail comprises at least four different KP2 bacteriophages described herein and is capable of infecting wild-type KP2 bacteria. In some embodiments, the cocktail comprises at least four different KP2 bacteriophages described herein and is capable of infecting mutant KP2 bacteria. In some embodiments, the cocktail comprises at least four different KP2 bacteriophages described herein and is capable of infecting wild-type KP2 bacteria and mutant KP2 bacteria.

In some embodiments, the cocktail comprises bacteriophage selected from at least three of the following groups: Group 1, Group 2, Group 3, Group 4, Group 5, and Group 6 as described herein. In some embodiments, the cocktail comprises bacteriophage selected from at least four of the following groups: Group 1, Group 2, Group 3, Group 4, Group 5, and Group 6 as described herein. In some embodiments, the cocktail comprises at least one bacteriophage selected from Group 1, Group 5, and Group 6 and at least one bacteriophage selected from Group 2, Group 3, and Group 4 as described herein. In some embodiments, the cocktail is capable of lysing at least one, two, three, four, five, six or seven bacteria selected from KP2, CT-141-1, CT-123-1, MKP2_2161_1, MKP2_251_B, MKP2_251_C, and 8M-all. In some embodiments, the cocktail is capable of lysing KP2 and at least one bacteria, at least two bacteria, at least three bacteria, at least four bacteria, at least five bacteria, or at least six bacteria selected from CT-141-1, CT-123-1, MKP2_2161_1, MKP2_251_B, MKP2_251_C and 8M-all. In some embodiments, the cocktail is capable of lysing each of KP2, CT-141-1, CT-123-1, MKP2_2161_1, MKP2_251_B, MKP2_251_C and 8M-all.

In some embodiments, the cocktail comprises bacteriophage selected from:

(a) 1.2-2, colon-11, PKP-55, or any other bacteriophage having at least 90%, 91%, 92%, 93%, 94%, 95%, 96%, 97%, 98%, or 99% nucleotide sequence homology to any of the foregoing and that is capable of infecting at least two of *Klebsiella pneumoniae* strains KP2, CT-123-1, MKP2_2161_1, and MKP2_251_B. The bacteriophage identified in this paragraph may be referred to as "Group A" bacteriophage and may be capable of infecting the bacterial strains described in this paragraph. In some embodiments, Group A consists of 1.2-2, colon-11, and PKP-55.

(b) M16-7a, KP2-4a, M16-4a, colon-36, KP2-5-1, 1.2-4br, 1.2-4s, M16-6c, KP2-9a, M16-9a, KP2-5a, colon-14-15, colon-6, colon1, M16-3-2c, M16-5c, or any other bacteriophage having at least 90%, 91%, 92%, 93%, 94%, 95%, 96%, 97%, 98%, or 99% nucleotide sequence homology to any of the foregoing and that is capable of infecting at least two of *Klebsiella pneumoniae* strains KP2, CT-123-1, MKP2_2161_1, and MKP2_251_B. The bacteriophage identified in this paragraph may be referred to as "Group B" bacteriophage and may be capable of infecting the bacterial strains described in this paragraph. In some embodiments, Group B consists of M16-7a, KP2-4a, M16-4a, colon-36, KP2-5-1, 1.2-4br, 1.2-4s, M16-6c, KP2-9a, M16-9a, KP2-5a, colon-14-15, colon-6, colon1, M16-3-2c, and M16-5c.

(c) KP2-15-2-1, KP2-14, KP2-15-1, colon-14, 1.2-3b, KP2-8c, KP2-7c, KP2-7-1c, KP2-8a, KP2-5, KP2-16-1, or any other bacteriophage having at least 90%, 91%, 92%, 93%, 94%, 95%, 96%, 97%, 98%, or 99% nucleotide sequence homology to any of the foregoing and that is capable of infecting *Klebsiella pneumoniae* strains KP2 and MKP2_251_B. The bacteriophage identified in this paragraph may be referred to as "Group C" bacteriophage and may be capable of infecting the bacterial strains described in this paragraph. In some embodiments, Group C consists of KP2-15-2-1, KP2-14, KP2-15-1, colon-14, 1.2-3b, KP2-8c, KP2-7c, KP2-7-1c, KP2-8a, KP2-5, and KP2-16-1.

(d) MCoc4c, MCoc6c, Mcoc7c, MCoc3c, MCoc5c, MCoc15c, MCoc8a, MCoc9-2c, M16-9-1c, MCoc9-1c, or any other bacteriophage having at least 90%, 91%, 92%, 93%, 94%, 95%, 96%, 97%, 98%, or 99% nucleotide sequence homology to any of the foregoing and that is capable of infecting at least three of *Klebsiella pneumoniae* strains: CT-141-1, CT-123-1, MKP2_2161_1, and MKP2_251_C. The bacteriophage identified in this paragraph may be referred to as "Group D" bacteriophage and may be capable of infecting the bacterial strains described in this paragraph. In some embodiments, Group D consists of MCoc4c, MCoc6c, Mcoc7c, MCoc3c, MCoc5c, MCoc15c, MCoc8a, MCoc9-2c, M16-9-1c, and MCoc9-1c.

(e) 8M-8, or any other bacteriophage having at least 90%, 91%, 92%, 93%, 94%, 95%, 96%, 97%, 98%, or 99% nucleotide sequence homology to the foregoing and that is capable of infecting *Klebsiella pneumoniae* strains CT-123-1, MKP2_2161_1, and 8M-all. The bacteriophage identified in this paragraph may be referred to as "Group E" bacteriophage and may be capable of infecting the bacterial strains described in this paragraph. In some embodiments, Group E consists of 8M-8.

(f) 8M-1, or any other bacteriophage having at least 90%, 91%, 92%, 93%, 94%, 95%, 96%, 97%, 98%, or 99% nucleotide sequence homology to the foregoing and is capable of infecting *Klebsiella pneumoniae* strains: KP2, CT-123-1, MKP2_2161_1, MKP2_251_B, and 8M-all. The bacteriophage identified in this paragraph may be referred to as "Group F" bacteriophage and may be capable of infecting the bacterial strains described in this paragraph. In some embodiments, Group F consists of 8M-1.

(g) 8M-7, or any other bacteriophage having at least 90%, 91%, 92%, 93%, 94%, 95%, 96%, 97%, 98%, or 99% nucleotide sequence homology to the foregoing and is capable of infecting *Klebsiella pneumoniae* strains: CT-123-1 and 8M-all. The bacteriophage identified in this paragraph may be referred to as "Group G" bacteriophage and may be capable of infecting the bacterial strains described in this paragraph. In some embodiments, Group G consists of 8M-7.

(h) 1.2-3s or any other bacteriophage having at least 90%, 91%, 92%, 93%, 94%, 95%, 96%, 97%, 98%, or 99% nucleotide sequence homology to the foregoing and is capable of infecting *Klebsiella pneumoniae* strains: KP2, CT-123-1, MKP2_2161_1, and 8M-all. The bacteriophage identified in this paragraph may be referred to as "Group H" bacteriophage and may be capable of infecting the bacterial strains described in this paragraph. In some embodiments, Group H consists of 1.2-3s.

In some embodiments, the cocktail comprises bacteriophage selected from at least three of the following groups: Group A, Group B, Group C, Group D, Group E, Group F, and Group H, as described herein. In some embodiments, the cocktail comprises bacteriophage selected from at least four of the following groups: Group A, Group B, Group C, Group D, Group E, Group F, and Group H, as described herein. In some embodiments, the cocktail comprises at least one bacteriophage selected from Group A, Group E, Group F, Group G, and Group H and at least one bacteriophage selected from Group B, Group C, and Group D as described herein. In some embodiments, the cocktail is capable of lysing at least one, two, three, four, five, six or seven bacteria selected from KP2, CT-141-1, CT-123-1, MKP2_2161_1, MKP2_251_B, MKP2_251_C, and 8M-all. In some embodiments, the cocktail is capable of lysing KP2 and at least one, two, three, four, five, or six bacteria selected from CT-141-1, CT-123-1, MKP2_2161_1, MKP2_251_B, MKP2_251_C and 8M-all. In some embodiments, the cocktail is capable of lysing each of KP2, CT-141-1, CT-123-1, MKP2_2161_1, MKP2_251_B, MKP2_251_C and 8M-all.

In some embodiments, for example during phage infection, mutant bacterial strains arise that are resistant to the phage. In some embodiments, it is beneficial for a phage to target the mutant bacteria. To produce said phage, bacteria may be incubated with one or more phage(s) disclosed herein to generate mutant bacterial strains. Environmental and clinical samples may then be screened for phage that are capable of infecting the mutant bacterial strains in order to identify the new phage. Then the titer of the phage(s) is selected to allow for efficient attachment, penetration, amplification and release of new phage(s) from the bacterial cells. Exemplary mutant KP2 strains are described herein. See, e.g., Table 2. In some embodiments, the mutant bacterial strain mirrors mutations that are likely to occur in vivo when a subject is treated with the phage disclosed herein. In some embodiments, a bacteriophage may be generated that is capable of infecting and lysing the mutant bacterial strain. Thus, in some embodiments, the bacteriophages provided herein are capable of treating unmodified KP2 bacteria, as well as resistant KP2 mutants.

In some embodiments, the bacterial cell surface receptors used by different phage may be identified. For example, mutant bacteria resistant to a particular bacteriophage may be isolated and characterized to detect the genomic modifications responsible for resistance. Such modified genes, particularly if they encode components of or proteins responsible for the synthesis and/or assembly of a bacterial surface protein, can indicate what surface component is responsible for infection by the particular bacteriophage. See, e.g., Avrani et al., 2011. The phage route of infection may be analyzed by infection using any one of KP2, KP2-Mcoc1 (ACCESSION NO. DSM 33049), or 8M-all, followed by selection and sequencing of infection-resistant mutant bacteria that arise in the presence of the specific bacteriophage. Mutant and native bacterial genomes may be compared to determine mutations responsible for the infection mechanism, e.g., using reference control genomes and breseq to identify mutations. See, e.g., Barrick et al. 2009, Deatherage and Barrick 2014. In some embodiments, non-silent mutations with frequency >80% may be analyzed. In some embodiments, mutations with frequency between 20-80% may be analyzed if located outside a mutation hot-spot. In some embodiments, proteins with mutations of interest may be profiled for activity, pathway, and relevance to known phage receptors.

The identification of such mutants is important in that they may potentially arise in the gastrointestinal tract and maintain their ability to cause IBD. Such mutants should be able to be lysed by at least one bacteriophage in a composition of the invention for improved efficacy.

Non-limiting examples of genomic modifications which affect phage infection (i.e., modifications found in a phage-resistant mutant bacteria that arose in a culture containing a specific phage capable of infecting a specific bacteria) which we have identified are shown in Table 3.

In some embodiments, the cocktail comprises bacteriophage selected from at least three or four bacteriophage that in toto lyse: (a) *Klebsiella pneumoniae* strain KP2; (b) a mutant *Klebsiella pneumoniae* strain KP2 that is characterized by a mutation in a gene involved in synthesizing LPS; (c) a mutant *Klebsiella pneumoniae* strain KP2 that is characterized by a mutation in a gene involved in iron uptake; (d) a mutant *Klebsiella pneumoniae* strain KP2 that is characterized by at least one of a mutation in a gene involved in cobalamin uptake or a mutation in a gene involved in maltose transport. In some embodiments, the cocktail comprises bacteriophage selected from at least one bacteriophage that infects and/or lyses (a) *Klebsiella pneumoniae* strain KP2; and at least one, two, or three bacteriophage that in toto lyse (b) a mutant *Klebsiella pneumoniae* strain KP2 that is characterized by a mutation in a gene involved in synthesizing LPS; (c) a mutant *Klebsiella pneumoniae* strain KP2 that is characterized by a mutation in a gene involved in iron uptake; (d) a mutant *Klebsiella pneumoniae* strain KP2 that is characterized by at least one of a mutation in a gene involved in cobalamin uptake or a mutation in a gene involved in maltose transport. In some embodiments, the cocktail is capable of lysing at least one, two, three, four, five, six or seven bacteria selected from KP2, CT-141-1, CT-123-1, MKP2_2161_1, MKP2_251_B, MKP2_251_C, and 8M-all. In some embodiments, the cocktail is capable of lysing KP2 and at least one, two, three, four, five, or six bacteria selected from CT-141-1, CT-123-1, MKP2_2161_1, MKP2_251_B, MKP2_251_C and 8M-all. In some embodiments, the cocktail is capable of lysing each of KP2, CT-141-1, CT-123-1, MKP2_2161_1, MKP2_251_B, MKP2_251_C and 8M-all.

In some embodiments, the cocktail comprises bacteriophage selected from at least three or four bacteriophage that in toto lyse: (a) *Klebsiella pneumoniae* strain KP2; (b) a mutant *Klebsiella pneumoniae* strain KP2 that is characterized by a mutation in one or more of rfaQ and grcA genes; (c) a mutant *Klebsiella pneumoniae* strain KP2 that is characterized by a mutation in one or more of rfaG, wbaP, and tyrosineK genes; (d) a mutant *Klebsiella pneumoniae* strain KP2 that is characterized by a mutation in one or more of mfpsA, wecA, and fhuA genes; (e) a mutant *Klebsiella pneumoniae* strain KP2 that is characterized by a mutation in one or more of fepA, tonB and LamB genes; (f) a mutant *Klebsiella pneumoniae* strain KP2 that is characterized by a mutation in a HBAD gene; and (g) a mutant *Klebsiella pneumoniae* strain KP2 that is characterized by a mutation in a 1pxM gene. In some embodiments, the cocktail comprises bacteriophage selected from at least one bacteriophage that infects and/or lyses (a) *Klebsiella pneumoniae* strain KP2; and at least one, two, or three bacteriophage that in toto lyse (b) a mutant *Klebsiella pneumoniae* strain KP2 that is characterized by a mutation in one or more of rfaQ and grcA genes; (c) a mutant *Klebsiella pneumoniae* strain KP2 that is characterized by a mutation in one or more of rfaG, wbaP, and tyrosineK genes; (d) a mutant *Klebsiella pneumoniae* strain KP2 that is characterized by a mutation in one or more of mfpsA, wecA, and fhuA genes; (e) a mutant *Klebsiella pneumoniae* strain KP2 that is characterized by a mutation in one or more of fepA, tonB and LamB genes; (f) a mutant *Klebsiella pneumoniae* strain KP2 that is characterized by a mutation in a HBAD gene; and (g) a mutant *Klebsiella pneumoniae* strain KP2 that is characterized by a mutation in a 1pxM gene. In some embodiments, the cocktail is further capable of lysing at least one, two, three, four, five, six or seven bacteria selected from KP2, CT-141-1, CT-123-1, MKP2_2161_1, MKP2_251_B, MKP2_251_C, and 8M-all. In some embodiments, the cocktail is further capable of lysing KP2 and at least one, two, three, four, five, or six bacteria selected from CT-141-1, CT-123-1, MKP2_2161_1, MKP2_251_B, MKP2_251_C and 8M-all. In some embodiments, the cocktail is further capable of lysing each of KP2, CT-141-1, CT-123-1, MKP2_2161_1, MKP2_251_B, MKP2_251_C and 8M-all.

In some embodiments, the cocktail comprises bacteriophage that in toto lyse at least three, four, five, or six bacteria selected from (a) a mutant *Klebsiella pneumoniae* strain KP2 that is characterized by a mutation in a rfaQ gene; (b) a mutant *Klebsiella pneumoniae* strain KP2 that is characterized by a mutation in a grcA gene; (c) a mutant *Klebsiella pneumoniae* strain KP2 that is characterized by a mutation in a rfaG gene; (d) a mutant *Klebsiella pneumoniae* strain KP2 that is characterized by a mutation in a wbaP gene; (e) a mutant *Klebsiella pneumoniae* strain KP2 that is characterized by a mutation in both a tyrosineK and a wbaP gene; (f) a mutant *Klebsiella pneumoniae* strain KP2 that is characterized by a mutation in a wecA gene; (g) a mutant *Klebsiella pneumoniae* strain KP2 that is characterized by a mutation in a mfps gene; (h) a mutant *Klebsiella pneumoniae* strain KP2 that is characterized by a mutation in both a fhuA and a wecA gene; (i) a mutant *Klebsiella pneumoniae* strain KP2 that is characterized by a mutation in a fepA gene; (j) a mutant *Klebsiella pneumoniae* strain KP2 that is characterized by a mutation in both a tonB gene and a LamB gene; (k) a mutant *Klebsiella pneumoniae* strain KP2 that is characterized by a mutation in a HBAD gene; (1) a mutant *Klebsiella pneumoniae* strain KP2 that is characterized by a mutation in a 1pxM gene; and (m) a mutant *Klebsiella pneumoniae* strain KP2 that is characterized by a mutation in a fhuA gene. In some embodiments, the cocktail is further capable of lysing at least one, two, three, four, five, six or seven bacteria selected from KP2, CT-141-1, CT-123-1, MKP2_2161_1, MKP2_251_B, MKP2_251_C, and 8M-all. In some embodiments, the cocktail is further capable of lysing KP2 and at least one, two, three, four, five, or six bacteria selected from CT-141-1, CT-123-1, MKP2_2161_1, MKP2_251_B, MKP2_251_C and 8M-all. In some embodiments, thecocktail is further capable of lysing each of KP2, CT-141-1, CT-123-1, MKP2_2161_1, MKP2_251_B, MKP2_251_C and 8M-all.

In some embodiments, the cocktail comprises bacteriophage Mcoc-5c and 8M-7. In some embodiments, the cocktail comprises bacteriophage Mcoc-5c and 8M-7; and at least one bacteriophage selected from 1.2-3b, 1.2-2, and 1.2-3s. In some embodiments, the cocktail comprises bacteriophage Mcoc-5c and 8M-7; at least one bacteriophage selected from 1.2-3b, 1.2-2, and 1.2-3s; and at least one bacteriophage selected from KP2-5-1 and PKP-55. In some embodiments, the cocktail comprises bacteriophage Mcoc-5c, 8M-7, 1.2-2, 1.2-3s. In some embodiments, the cocktail comprises bacteriophage Mcoc-5c, 8M-7, 1.2-2, 1.2-3b. In some embodiments, the cocktail comprises bacteriophage Mcoc-5c, 8M-7, KP2-5-1, 1.2-3s, PKP-55. In some embodiments, the cocktail comprises bacteriophage consisting of Mcoc-5c, 8M-7, 1.2-2, 1.2-3s. In some embodiments, the cocktail comprises bacteriophage consisting of Mcoc-5c, 8M-7, 1.2-2, 1.2-3b. In some embodiments, the cocktail comprises bacteriophage consisting of Mcoc-5c, 8M-7, KP2-5-1, 1.2-3s, PKP-55.

In some embodiments, the cocktail comprises bacteriophage 1.2-3b, 1.2-2, and 1.2-3s. In some embodiments, the cocktail comprises bacteriophage 1.2-3b, 1.2-2, 1.2-3s, and Mcoc-5c. In some embodiments, the cocktail comprises bacteriophage 1.2-3b, 1.2-2, 1.2-3s, and 8M-1. In some embodiments, the cocktail comprises bacteriophage 1.2-3b, 1.2-2, 1.2-3s, Mcoc-5c, and 8M-1.

In some embodiments, the bacteriophage or cocktail does not significantly affect the subject's microbiota (other than specifically lysing IBD-causing *Klebsiella*). In some embodiments, the bacteriophage or cocktail does not significantly affect the subject's commensal bacteria. In some embodiments, the bacteriophage or cocktail does not significantly affect the subject's probiotic bacteria. In some embodiments, a bacteriophage or cocktail is not naturally capable of affecting the microbiota, commensal bacteria, or probiotic bacteria, because the bacteriophage's natural host range is limited, e.g., to KP2.

In some embodiments, a bacteriophage that is specific for a bacterium is capable of recognizing specific receptors and/or attachment sites expressed by said bacterium. In some embodiments, the KP2 bacteriophage is "specific" for KP2 bacteria. For example, the KP2 bacteriophage is capable of infecting and/or productively creating more virions in the KP2 bacteria than in a bacteria that is not the KP2 bacteria in an in vitro or in vivo assay, e.g., in a plaque assay, an OD assay, a phage-adsorption assay, or any other assay showing that the bacteriophage can enter, reproduce, and exit the bacteria.

Bacterial Lysis

In some embodiments, the bacteriophage provided herein is capable of lysing deleterious *Klebsiella* bacteria that induce immune and/or inflammatory response(s). In some embodiments, the bacteriophage provided herein is capable of lysing deleterious *Klebsiella* bacteria that disrupt the balance of immune homeostasis in the intestine, e.g., by enhancing the pro-inflammatory activity, ultimately resulting in chronic intestinal inflammation. In some embodiments, the bacteriophage provided herein is capable of lysing deleterious *Klebsiella* bacteria that induce a T helper 1 (TH1) cell response. In some embodiments, the *Klebsiella* bacteria to be lysed by the bacteriophage provided herein are in the lumen. In some embodiments, the *Klebsiella* bacteria to be lysed by the bacteriophage provided herein are associated with the mucosa or epithelium. In some embodiments, the *Klebsiella* bacteria to be lysed by the bacteriophage provided herein are in between the mucosal and submucosal layer in the ileum, e.g., in Crohn's disease (Chiodini et al., 2015).

In some embodiments, the bacteriophage provided herein is capable of lysing deleterious KP2 bacteria that are associated with IBD, e.g., ulcerative colitis or Crohn's disease, and may be administered to ameliorate the disease or at least one symptom thereof. In some embodiments, there is a higher incidence of KP2 bacteria associated with Crohn's disease as compared to ulcerative colitis. However, in embodiments where a subject has ulcerative colitis associated with KP2 bacterial presence, the bacteriophage provided herein may be administered to lyse those bacteria and ameliorate the ulcerative colitis or at least one symptom thereof.

Drugs that inhibit gastric acid secretion, e.g., proton pump inhibitors, and primary sclerosing cholangitis (PSC) may alter the course of IBD. In some embodiments, the bacteriophage provided herein is capable of lysing KP2 bacteria that are more prevalent in a subject receiving proton pump inhibitor therapy or suffering from PSC and may be administered to ameliorate at least one symptom of IBD associated with proton pump inhibitor therapy or PSC.

Pharmaceutical Compositions

Pharmaceutical compositions comprising the bacteriophage or cocktails described herein may be used to modulate IBD. Pharmaceutical compositions comprising the bacteriophage or cocktails, alone or in combination with prophylactic agents, therapeutic agents, and/or and pharmaceutically acceptable carriers are provided. In certain embodiments, the pharmaceutical composition comprises one bacteriophage described herein. In alternate embodiments, the pharmaceutical composition comprises two or more bacteriophages, e.g., a cocktail of bacteriophage, described herein.

In some embodiments, the pharmaceutical composition comprises bacteriophage selected from at least three of the following groups: Group 1, Group 2, Group 3, Group 4, Group 5, and Group 6 as described herein. In some embodiments, the pharmaceutical composition comprises bacteriophage selected from at least four of the following groups:

Group 1, Group 2, Group 3, Group 4, Group 5, and Group 6 as described herein. In some embodiments, the pharmaceutical composition comprises at least one bacteriophage selected from Group 1, Group 5, and Group 6 and at least one bacteriophage selected from Group 2, Group 3, and Group 4 as described herein.

In some embodiments, the pharmaceutical composition comprises bacteriophage selected from at least three of the following groups: Group A, Group B, Group C, Group D, Group E, Group F, and Group H, as described herein. In some embodiments, the pharmaceutical composition comprises bacteriophage selected from at least four of the following groups: Group A, Group B, Group C, Group D, Group E, Group F, and Group H, as described herein. In some embodiments, the pharmaceutical composition comprises at least one bacteriophage selected from Group A, Group E, Group F, Group G, and Group H and at least one bacteriophage selected from Group B, Group C, and Group D as described herein.

In some embodiments, the pharmaceutical composition comprises bacteriophage selected from at least three or four bacteriophage that in toto lyse: (a) *Klebsiella pneumoniae* strain KP2; (b) a mutant *Klebsiella pneumoniae* strain KP2 that is characterized by a mutation in a gene involved in synthesizing LPS; (c) a mutant *Klebsiella pneumoniae* strain KP2 that is characterized by a mutation in a gene involved in iron uptake; (d) a mutant *Klebsiella pneumoniae* strain KP2 that is characterized by at least one of a mutation in a gene involved in cobalamin uptake or a mutation in a gene involved in maltose transport.

In some embodiments, the pharmaceutical composition comprises bacteriophage selected from at least one bacteriophage that infects and/or lyses (a) *Klebsiella pneumoniae* strain KP2; and at least one, two, or three bacteriophage that in toto lyse (b) a mutant *Klebsiella pneumoniae* strain KP2 that is characterized by a mutation in a gene involved in synthesizing LPS; (c) a mutant *Klebsiella pneumoniae* strain KP2 that is characterized by a mutation in a gene involved in iron uptake; (d) a mutant *Klebsiella pneumoniae* strain KP2 that is characterized by at least one of a mutation in a gene involved in cobalamin uptake or a mutation in a gene involved in maltose transport. In some embodiments, the pharmaceutical composition is further capable of lysing at least one, two, three, four, five, six or seven bacteria selected from KP2, CT-141-1, CT-123-1, MKP2_2161_1, MKP2_251_B, MKP2_251_C, and 8M-all. In some embodiments, the pharmaceutical composition is further capable of lysing KP2 and at least one, two, three, four, five, or six bacteria selected from CT-141-1, CT-123-1, MKP2_2161_1, MKP2_251_B, MKP2_251_C and 8M-all. In some embodiments, the pharmaceutical composition is further capable of lysing each of KP2, CT-141-1, CT-123-1, MKP2_2161_1, MKP2_251_B, MKP2_251_C and 8M-all.

In some embodiments, the pharmaceutical composition comprises bacteriophage selected from at least three or four bacteriophage that in toto lyse: (a) *Klebsiella pneumoniae* strain KP2; (b) a mutant *Klebsiella pneumoniae* strain KP2 that is characterized by a mutation in one or more of rfaQ and grcA genes; (c) a mutant *Klebsiella pneumoniae* strain KP2 that is characterized by a mutation in one or more of rfaG, wbaP, and tyrosineK genes; (d) a mutant *Klebsiella pneumoniae* strain KP2 that is characterized by a mutation in one or more of mfpsA, wecA, and fhuA genes; (e) a mutant *Klebsiella pneumoniae* strain KP2 that is characterized by a mutation in one or more of fepA, tonB and LamB genes; (f) a mutant *Klebsiella pneumoniae* strain KP2 that is characterized by a mutation in a HBAD gene; and (g) a mutant *Klebsiella pneumoniae* strain KP2 that is characterized by a mutation in a 1pxM gene. In some embodiments, the pharmaceutical composition is further capable of lysing at least one, two, three, four, five, six or seven bacteria selected from KP2, CT-141-1, CT-123-1, MKP2_2161_1, MKP2_251_B, MKP2_251_C, and 8M-all. In some embodiments, the pharmaceutical composition is further capable of lysing KP2 and at least one, two, three, four, five, or six bacteria selected from CT-141-1, CT-123-1, MKP2_2161_1, MKP2_251_B, MKP2_251_C and 8M-all. In some embodiments, the pharmaceutical composition is further capable of lysing each of KP2, CT-141-1, CT-123-1, MKP2_2161_1, MKP2_251_B, MKP2_251_C and 8M-all.

In some embodiments, the pharmaceutical composition comprises bacteriophage selected from at least one bacteriophage that infects and/or lyses (a) *Klebsiella pneumoniae* strain KP2; and at least one, two, or three bacteriophage that in toto lyse (b) a mutant *Klebsiella pneumoniae* strain KP2 that is characterized by a mutation in one or more of rfaQ and grcA genes; (c) a mutant *Klebsiella pneumoniae* strain KP2 that is characterized by a mutation in one or more of rfaG, wbaP, and tyrosineK genes; (d) a mutant *Klebsiella pneumoniae* strain KP2 that is characterized by a mutation in one or more of mfpsA, wecA, and fhuA genes; (e) a mutant *Klebsiella pneumoniae* strain KP2 that is characterized by a mutation in one or more of fepA, tonB and LamB genes; (f) a mutant *Klebsiella pneumoniae* strain KP2 that is characterized by a mutation in a HBAD gene; and (g) a mutant *Klebsiella pneumoniae* strain KP2 that is characterized by a mutation in a 1pxM gene. In some embodiments, the pharmaceutical composition is further capable of lysing at least one, two, three, four, five, six or seven bacteria selected from KP2, CT-141-1, CT-123-1, MKP2_2161_1, MKP2_251_B, MKP2_251_C, and 8M-all. In some embodiments, the pharmaceutical composition is further capable of lysing KP2 and at least one, two, three, four, five, or six bacteria selected from CT-141-1, CT-123-1, MKP2_2161_1, MKP2_251_B, MKP2_251_C and 8M-all. In some embodiments, the pharmaceutical composition is further capable of lysing each of KP2, CT-141-1, CT-123-1, MKP2_2161_1, MKP2_251_B, MKP2_251_C and 8M-all.

In some embodiments, the pharmaceutical composition comprises bacteriophage that in toto lyse at least three, four, five, or six bacteria selected from (a) a mutant *Klebsiella pneumoniae* strain KP2 that is characterized by a mutation in a rfaQ gene; (b) a mutant *Klebsiella pneumoniae* strain KP2 that is characterized by a mutation in a grcA gene; (c) a mutant *Klebsiella pneumoniae* strain KP2 that is characterized by a mutation in a rfaG gene; (d) a mutant *Klebsiella pneumoniae* strain KP2 that is characterized by a mutation in a wbaP gene; (e) a mutant *Klebsiella pneumoniae* strain KP2 that is characterized by a mutation in both a tyrosineK and a wbaP gene; (f) a mutant *Klebsiella pneumoniae* strain KP2 that is characterized by a mutation in a wecA gene; (g) a mutant *Klebsiella pneumoniae* strain KP2 that is characterized by a mutation in a mfps gene; (h) a mutant *Klebsiella pneumoniae* strain KP2 that is characterized by a mutation in both a fhuA and a wecA gene; (i) a mutant *Klebsiella pneumoniae* strain KP2 that is characterized by a mutation in a fepA gene; (j) a mutant *Klebsiella pneumoniae* strain KP2 that is characterized by a mutation in both a tonB gene and a LamB gene; (k) a mutant *Klebsiella pneumoniae* strain KP2 that is characterized by a mutation in a HBAD gene; (l) a mutant *Klebsiella pneumoniae* strain KP2 that is characterized by a mutation in a 1pxM gene; and (m) a mutant *Klebsiella pneumoniae* strain KP2 that is characterized by a mutation in a fhuA gene. In some embodiments, the pharmaceutical composition is further capable of lysing at least one, two, three, four, five, six or seven bacteria selected from KP2, CT-141-1, CT-123-1, MKP2_2161_1, MKP2_251_B, MKP2_251_C, and 8M-all. In some embodiments, the pharmaceutical composition is further capable of lysing KP2 and at least one, two, three, four, five, or six bacteria selected from CT-141-1, CT-123-1, MKP2_2161_1, MKP2_251_B, MKP2_251_C and 8M-all. In some embodiments, the pharmaceutical composition is further capable of lysing each of KP2, CT-141-1, CT-123-1, MKP2_2161_1, MKP2_251_B, MKP2_251_C and 8M-all.

In some embodiments, the pharmaceutical composition comprises bacteriophage Mcoc-5c and 8M-7. In some embodiments, the pharmaceutical composition comprises bacteriophage Mcoc-5c and 8M-7; and at least one bacteriophage selected from 1.2-3b, 1.2-2, and 1.2-3s. In some embodiments, the pharmaceutical composition comprises bacteriophage Mcoc-5c and 8M-7; at least one bacteriophage selected from 1.2-3b, 1.2-2, and 1.2-3s; and at least one bacteriophage selected from KP2-5-1 and PKP-55. In some embodiments, the pharmaceutical composition comprises bacteriophage Mcoc-5c, 8M-7, 1.2-2, 1.2-3s. In some embodiments, the pharmaceutical composition comprises bacteriophage Mcoc-5c, 8M-7, 1.2-2, 1.2-3b. In some embodiments, the pharmaceutical composition comprises bacteriophage Mcoc-5c, 8M-7, KP2-5-1, 1.2-3s, PKP-55. In some embodiments, the pharmaceutical composition comprises bacteriophage consisting of Mcoc-5c, 8M-7, 1.2-2, 1.2-3s. In some embodiments, the pharmaceutical composition comprises bacteriophage consisting of Mcoc-5c, 8M-7, 1.2-2, 1.2-3b. In some embodiments, the pharmaceutical composition comprises bacteriophage consisting of Mcoc-5c, 8M-7, KP2-5-1, 1.2-3s, PKP-55.

In some embodiments, the pharmaceutical composition comprises bacteriophage 1.2-3b, 1.2-2, and 1.2-3s. In some embodiments, the pharmaceutical composition comprises bacteriophage 1.2-3b, 1.2-2, 1.2-3s, and Mcoc-5c. In some embodiments, the pharmaceutical composition comprises bacteriophage 1.2-3b, 1.2-2, 1.2-3s, and 8M-1. In some embodiments, the pharmaceutical composition comprises bacteriophage 1.2-3b, 1.2-2, 1.2-3s, Mcoc-5c, and 8M-1.

In some embodiments, the pharmaceutical composition is capable of lysing at least one, two, three, four, five, six or seven bacteria selected from KP2, CT-141-1, CT-123-1, MKP2_2161_1, MKP2_251_B, MKP2_251_C, and 8M-all. In some embodiments, the pharmaceutical composition is capable of lysing KP2 and at least one bacteria, at least two bacteria, at least three bacteria, at least four bacteria, at least five bacteria, or at least six bacteria selected from CT-141-1, CT-123-1, MKP2_2161_1, MKP2_251_B, MKP2_251_C and 8M-all. In some embodiments, the pharmaceutical composition is capable of lysing each of KP2, CT-141-1, CT-123-1, MKP2_2161_1, MKP2_251_B, MKP2_251_C and 8M-all.

The pharmaceutical compositions described herein may be formulated in a conventional manner using one or more physiologically acceptable carriers comprising excipients and auxiliaries, which facilitate processing of the active ingredients into compositions for pharmaceutical use. Methods of formulating pharmaceutical compositions are known in the art (see, e.g., "Remington's Pharmaceutical Sciences," Mack Publishing Co., Easton, PA). In some embodiments, the pharmaceutical compositions are subjected to tableting, lyophilizing, direct compression, conventional mixing, dissolving, granulating, levigating, emulsifying, encapsulating, entrapping, or spray drying to form tablets, granulates, nanoparticles, nanocapsules, microcapsules, microtablets, pellets, or powders, which may be enterically coated or uncoated. Appropriate formulation depends on the route of administration.

The bacteriophage described herein may be formulated into pharmaceutical compositions in any suitable dosage form (e.g., liquids, capsules, sachet, hard capsules, soft capsules, tablets, enteric coated tablets, suspension powders, granules, or matrix sustained release formations for oral administration) and for any suitable type of administration (e.g., oral, topical, injectable, immediate-release, pulsatile-release, delayed-release, or sustained release). In some embodiments the bacteriophage are formulated for administration as an oral rinse, a lozenge, a toothpaste, an orally dissolving strip, an orally dissolving tablet, or a gum. The composition may be administered once or more daily, weekly, or monthly.

The bacteriophage may be formulated into pharmaceutical compositions comprising one or more pharmaceutically acceptable carriers, thickeners, diluents, buffers, buffering agents, surface active agents, neutral or cationic lipids, lipid complexes, liposomes, penetration enhancers, carrier compounds, and other pharmaceutically acceptable carriers or agents. For example, the pharmaceutical composition may include, but is not limited to, the addition of calcium bicarbonate, sodium bicarbonate, calcium phosphate, various sugars and types of starch, cellulose derivatives, gelatin, vegetable oils, polyethylene glycols, and surfactants, including, for example, polysorbate 20. In some embodiments, the bacteriophage may be formulated in a solution of sodium bicarbonate, e.g., 1 molar solution of sodium bicarbonate (to buffer an acidic cellular environment, such as the stomach, for example). The bacteriophage may be administered and formulated as neutral or salt forms. Pharmaceutically acceptable salts include those formed with anions such as those derived from hydrochloric, phosphoric, acetic, oxalic, tartaric acids, etc., and those formed with cations such as those derived from sodium, potassium, ammonium, calcium, ferric hydroxides, isopropylamine, triethylamine, 2-ethylamino ethanol, histidine, procaine, etc.

The bacteriophage may be administered orally and formulated as tablets, pills, dragees, capsules, liquids, gels, syrups, slurries, suspensions, etc. Pharmacological compositions for oral use can be made using a solid excipient, optionally grinding the resulting mixture, and processing the mixture of granules, after adding suitable auxiliaries if desired, to obtain tablets or dragee cores. Suitable excipients include, but are not limited to, fillers such as sugars, including lactose, sucrose, mannitol, or sorbitol; cellulose compositions such as maize starch, wheat starch, rice starch, potato starch, gelatin, gum tragacanth, methyl cellulose, hydroxypropylmethyl-cellulose, sodium carbomethylcellulose; and/or physiologically acceptable polymers such as polyvinylpyrrolidone (PVP) or polyethylene glycol (PEG). Disintegrating agents may also be added, such as cross-linked polyvinylpyrrolidone, agar, alginic acid or a salt thereof such as sodium alginate.

In some embodiments, the bacteriophage is formulated for delivery to a mammalian mouth. In some embodiments, the pharmaceutical composition comprises the bacteriophage and a pharmaceutically acceptable excipient, wherein the bacteriophage and the pharmaceutically acceptable excipient do not occur together in nature. In some embodiments, the pharmaceutical composition comprises the bacteriophage and a pharmaceutically acceptable excipient, wherein the pharmaceutically acceptable excipient is a non-naturally occurring excipient.

In some embodiments, the bacteriophage is formulated for delivery to a mammalian intestine. In some embodiments, the pharmaceutical composition comprises the bacteriophage and a pharmaceutically acceptable excipient, wherein the bacteriophage and the pharmaceutically acceptable excipient do not occur together in nature. In some embodiments, the pharmaceutical composition comprises the bacteriophage and a pharmaceutically acceptable excipient, wherein the pharmaceutically acceptable excipient is a non-naturally occurring excipient.

Tablets or capsules can be prepared by conventional means with pharmaceutically acceptable excipients such as binding agents (e.g., pregelatinized maize starch, polyvinylpyrrolidone, hydroxypropyl methylcellulose, carboxymethylcellulose, polyethylene glycol, sucrose, glucose, sorbitol, starch, gum, kaolin, and tragacanth); fillers (e.g., lactose, microcrystalline cellulose, or calcium hydrogen phosphate); lubricants (e.g., calcium, aluminum, zinc, stearic acid, polyethylene glycol, sodium lauryl sulfate, starch, sodium benzoate, L-leucine, magnesium stearate, talc, or silica); disintegrants (e.g., starch, potato starch, sodium starch glycolate, sugars, cellulose derivatives, silica powders); or wetting agents (e.g., sodium lauryl sulphate). The tablets may be coated by methods well known in the art. A coating shell may be present, and common membranes include, but are not limited to, polylactide, polyglycolic acid, polyanhydride, other biodegradable polymers, alginate-polylysine-alginate (APA), alginate-polymethylene-co-guanidine-alginate (A-PMCG-A), hydroxymethylacrylate-methyl methacrylate (HEMA-MMA), multilayered HEMA-MMA-MAA, polyacrylonitrilevinylchloride (PAN-PVC), acrylonitrile/sodium methallylsulfonate (AN-69), polyethylene glycol/poly pentamethylcyclopentasiloxane/polydimethylsiloxane (PEG/PD5/PDMS), poly N,N-dimethyl acrylamide (PDMAAm), siliceous encapsulates, cellulose sulphate/sodium alginate/polymethylene-co-guanidine (CS/A/PMCG), cellulose acetate phthalate, calcium alginate, k-carrageenan-locust bean gum gel beads, gellan-xanthan beads, poly(lactide-co-glycolides), carrageenan, starch poly-anhydrides, starch polymethacrylates, polyamino acids, and enteric coating polymers.

In some embodiments, the bacteriophage is enterically coated for release into the gut or a particular region of the gut. The typical pH profile from the stomach to the colon is about 1-4 (stomach), 5.5-6 (duodenum), 7.3-8.0 (ileum), and 5.5-6.5 (colon). In some diseases, the pH profile may be modified. In some embodiments, the coating is degraded in specific pH environments in order to specify the site of release.

Liquid preparations for oral administration may take the form of solutions, syrups, suspensions, or a dry product for constitution with water or other suitable vehicle before use. Such liquid preparations may be prepared by conventional means with pharmaceutically acceptable agents such as suspending agents (e.g., sorbitol syrup, cellulose derivatives, or hydrogenated edible fats); emulsifying agents (e.g., lecithin or acacia); non-aqueous vehicles (e.g., almond oil, oily esters, ethyl alcohol, or fractionated vegetable oils); and preservatives (e.g., methyl or propyl-p-hydroxybenzoates or sorbic acid). The preparations may also contain buffer salts, flavoring, coloring, and sweetening agents as appropriate. Preparations for oral administration may be suitably formulated for slow release, controlled release, or sustained release of the bacteriophage.

In certain embodiments, the bacteriophage may be orally administered, for example, with an inert diluent or an assimilable edible carrier. The compound may also be enclosed in a hard- or soft-shell gelatin capsule, compressed into tablets, or incorporated directly into the subject's diet. For oral therapeutic administration, the compounds may be incorporated with excipients and used in the form of ingestible tablets, buccal tablets, troches, capsules, elixirs, suspensions, syrups, wafers, and the like. To administer a compound by other than parenteral administration, it may be necessary to coat the compound with, or co-administer the compound with, a material to prevent its inactivation. In some embodiments, the bacteriophage is orally administered for delivery to the mouth and is capable of lysing bacteria present in the mouth. In some embodiments, the bacteriophage is orally administered for delivery to the intestine and is capable of lysing bacteria present in the intestine.

In some embodiments, the composition is formulated for intraintestinal administration, intrajejunal administration, intraduodenal administration, intraileal administration, gastric shunt administration, or intracolic administration, via nanoparticles, nanocapsules, microcapsules, or microtablets, which are enterically coated or uncoated. The pharmaceutical compositions may also be formulated in rectal compositions such as suppositories or retention enemas, using, e.g., conventional suppository bases such as cocoa butter or other glycerides. The compositions may be suspensions, solutions, or emulsions in oily or aqueous vehicles, and may contain suspending, stabilizing and/or dispersing agents.

In some embodiments, the pharmaceutically acceptable composition is in single dosage form. Single dosage forms may be in a liquid or a solid form. Single dosage forms may be administered directly to a patient without modification or may be diluted or reconstituted prior to administration. In certain embodiments, a single dosage form may be administered in bolus form, e.g., single injection, single oral dose, including an oral dose that comprises multiple tablets, capsule, pills, etc. In alternate embodiments, a single dosage form may be administered over a period of time, e.g., by infusion. Single dosage forms of the pharmaceutical composition may be prepared by portioning the pharmaceutical composition into smaller aliquots, single dose containers, single dose liquid forms, or single dose solid forms, such as tablets, granulates, nanoparticles, nanocapsules, microcapsules, microtablets, pellets, or powders, which may be enterically coated or uncoated. A single dose in a solid form may be reconstituted by adding liquid, typically sterile water or saline solution, prior to administration to a patient.

In other embodiments, the composition can be delivered in a controlled release or sustained release system. In one embodiment, a pump may be used to achieve controlled or sustained release. In another embodiment, polymeric materials can be used to achieve controlled or sustained release of the therapies of the present disclosure (see, e.g., U.S. Pat. No. 5,989,463). Examples of polymers used in sustained release formulations include, but are not limited to, poly(2-hydroxy ethyl methacrylate), poly(methyl methacrylate), poly(acrylic acid), poly(ethylene-co-vinyl acetate), poly (methacrylic acid), polyglycolides (PLG), polyanhydrides, poly(N-vinyl pyrrolidone), poly(vinyl alcohol), polyacrylamide, poly(ethylene glycol), polylactides (PLA), poly(lactide-co-glycolides) (PLGA), and polyorthoesters. The polymer used in a sustained release formulation may be inert, free of leachable impurities, stable on storage, sterile, and biodegradable. In some embodiments, a controlled or sustained release system can be placed in proximity of the prophylactic or therapeutic target, thus requiring only a fraction of the systemic dose. Any suitable technique known to one of skill in the art may be used.

Dosage regimens may be adjusted to provide a therapeutic response. Dosing can depend on several factors, including severity and responsiveness of the disease, route of administration, time course of treatment (days to months to years), and time to amelioration of the disease. For example, a single bolus may be administered at one time, several divided doses may be administered over a predetermined period of time, or the dose may be reduced or increased as indicated by the therapeutic situation.

In some embodiments, the ingredients are supplied either separately or mixed together in unit dosage form. The pharmaceutical compositions may be packaged in a hermetically sealed container such as an ampoule or sachet indicating the quantity of the agent. In one embodiment, one or more of the pharmaceutical compositions is supplied as a dry sterilized lyophilized powder or water-free concentrate in a hermetically sealed container and can be reconstituted (e.g., with water or saline) to the appropriate concentration for administration to a subject. In an embodiment, one or more of the prophylactic or therapeutic agents or pharmaceutical compositions is supplied as a dry sterile lyophilized powder in a hermetically sealed container and reconstituted prior to administration. Cryoprotectants can be included for a lyophilized dosage form, principally 0-10% sucrose (optimally 0.5-1.0%). Other suitable cryoprotectants include trehalose and lactose. Other suitable bulking agents include glycine and arginine, either of which can be included at a concentration of 0-0.05%, and polysorbate-80 (optimally included at a concentration of 0.005-0.01%). Additional surfactants include but are not limited to polysorbate 20 and BRIJ surfactants. The pharmaceutical composition may be prepared as an injectable solution and can further comprise an agent useful as an adjuvant, such as those used to increase absorption or dispersion, e.g., hyaluronidase.

Method of Treatment

Methods of treating IBD in a mammal using a bacteriophage, a bacteriophage cocktail, and/or a pharmaceutical composition comprising a bacteriophage or a bacteriophage cocktail are provided. In some embodiments, a method of treating IBD comprises administering to a subject the KP2 bacteriophage, cocktail, and/or pharmaceutical composition described herein. In some embodiments, a method of treating Crohn's disease comprises administering to a subject the bacteriophage, cocktail, and/or pharmaceutical composition described herein. In some embodiments, a method of treating ulcerative colitis comprises administering to a subject the bacteriophage, cocktail, and/or pharmaceutical composition described herein. In some embodiments, a method of treating IBD associated with primary sclerosing cholangitis comprises administering to a subject the bacteriophage, cocktail, and/or pharmaceutical composition described herein. In some embodiments, IBD may be associated with proton pump inhibitor therapy, and a subject may be administered the bacteriophage, cocktail, and/or pharmaceutical composition described herein before, during, or after proton pump inhibitor therapy.

In some embodiments, the bacteriophage, the bacteriophage cocktail, and/or the pharmaceutical composition thereof may be used in a method of treatment. In some embodiments, the bacteriophage and/or the pharmaceutical composition thereof to be administered comprises bacteriophage selected from at least three of the following groups: Group 1, Group 2, Group 3, Group 4, Group 5, and Group 6 as described herein. In some embodiments, the bacteriophage and/or the pharmaceutical composition thereof to be administered comprises bacteriophage selected from at least four of the following groups: Group 1, Group 2, Group 3, Group 4, Group 5, and Group 6 as described herein. In some embodiments, the bacteriophage and/or the pharmaceutical composition thereof to be administered comprises at least one bacteriophage selected from Group 1, Group 5, and Group 6 and at least one bacteriophage selected from Group 2, Group 3, and Group 4 as described herein.

In some embodiments, the bacteriophage and/or the pharmaceutical composition thereof to be administered comprises bacteriophage selected from at least three of the following groups: Group A, Group B, Group C, Group D, Group E, Group F, and Group H, as described herein. In some embodiments, the bacteriophage and/or the pharmaceutical composition thereof to be administered comprises bacteriophage selected from at least four of the following groups: Group A, Group B, Group C, Group D, Group E, Group F, and Group H, as described herein. In some embodiments, the bacteriophage and/or the pharmaceutical composition thereof to be administered comprises at least one bacteriophage selected from Group A, Group E, Group F, Group G, and Group H and at least one bacteriophage selected from Group B, Group C, and Group D as described herein.

In some embodiments, the bacteriophage and/or the pharmaceutical composition thereof to be administered comprises bacteriophage selected from at least three or four bacteriophage that in toto lyse: (a) *Klebsiella pneumoniae* strain KP2; (b) a mutant *Klebsiella pneumoniae* strain KP2 that is characterized by a mutation in a gene involved in synthesizing LPS; (c) a mutant *Klebsiella pneumoniae* strain KP2 that is characterized by a mutation in a gene involved in iron uptake; (d) a mutant *Klebsiella pneumoniae* strain KP2 that is characterized by at least one of a mutation in a gene involved in cobalamin uptake or a mutation in a gene involved in maltose transport. In some embodiments, the bacteriophage and/or the pharmaceutical composition thereof to be administered comprises bacteriophage selected from at least one bacteriophage that infects and/or lyses (a) *Klebsiella pneumoniae* strain KP2; and at least one, two, or three bacteriophage that in toto lyse (b) a mutant *Klebsiella pneumoniae* strain KP2 that is characterized by a mutation in a gene involved in synthesizing LPS; (c) a mutant *Klebsiella pneumoniae* strain KP2 that is characterized by a mutation in a gene involved in iron uptake; (d) a mutant *Klebsiella pneumoniae* strain KP2 that is characterized by at least one of a mutation in a gene involved in cobalamin uptake or a mutation in a gene involved in maltose transport. In some embodiments, the bacteriophage and/or pharmaceutical composition is further capable of lysing KP2 and at least one, two, three, four, five, or six bacteria selected from CT-141-1, CT-123-1, MKP2_2161_1, MKP2_251_B, MKP2_251_C and 8M-all. In some embodiments, the bacteriophage and/or pharmaceutical composition is further capable of lysing each of KP2, CT-141-1, CT-123-1, MKP2_2161_1, MKP2_251_B, MKP2_251_C and 8M-all. In some embodiments, the bacteriophage and/or pharmaceutical composition is further capable of lysing each of KP2, CT-141-1, CT-123-1, MKP2_2161_1, MKP2_251_B, MKP2_251_C and 8M-all.

In some embodiments, the bacteriophage and/or the pharmaceutical composition thereof to be administered comprises bacteriophage selected from at least three or four bacteriophage that in toto lyse: (a) *Klebsiella pneumoniae* strain KP2; (b) a mutant *Klebsiella pneumoniae* strain KP2 that is characterized by a mutation in one or more of rfaQ and grcA genes; (c) a mutant *Klebsiella pneumoniae* strain KP2 that is characterized by a mutation in one or more of rfaG, wbaP, and tyrosineK genes; (d) a mutant *Klebsiella*

*pneumoniae* strain KP2 that is characterized by a mutation in one or more of mfpsA, wecA, and fhuA genes; (e) a mutant *Klebsiella pneumoniae* strain KP2 that is characterized by a mutation in one or more of fepA, tonB and LamB genes; (f) a mutant *Klebsiella pneumoniae* strain KP2 that is characterized by a mutation in a HBAD gene; and (g) a mutant *Klebsiella pneumoniae* strain KP2 that is characterized by a mutation in a 1pxM gene. In some embodiments, the bacteriophage and/or the pharmaceutical composition thereof to be administered comprises bacteriophage selected from at least one bacteriophage that infects and/or lyses (a) *Klebsiella pneumoniae* strain KP2; and at least one, two, or three bacteriophage that in toto lyse (b) a mutant *Klebsiella pneumoniae* strain KP2 that is characterized by a mutation in one or more of rfaQ and grcA genes; (c) a mutant *Klebsiella pneumoniae* strain KP2 that is characterized by a mutation in one or more of rfaG, wbaP, and tyrosineK genes; (d) a mutant *Klebsiella pneumoniae* strain KP2 that is characterized by a mutation in one or more of mfpsA, wecA, and fhuA genes; (e) a mutant *Klebsiella pneumoniae* strain KP2 that is characterized by a mutation in one or more of fepA, tonB and LamB genes; (f) a mutant *Klebsiella pneumoniae* strain KP2 that is characterized by a mutation in a HBAD gene; and (g) a mutant *Klebsiella pneumoniae* strain KP2 that is characterized by a mutation in a 1pxM gene. In some embodiments, the bacteriophage and/or pharmaceutical composition is further capable of lysing KP2 and at least one, two, three, four, five, or six bacteria selected from CT-141-1, CT-123-1, MKP2_2161_1, MKP2_251_B, MKP2_251_C and 8M-all. In some embodiments, the bacteriophage and/or pharmaceutical composition is further capable of lysing each of KP2, CT-141-1, CT-123-1, MKP2_2161_1, MKP2_251_B, MKP2_251_C and 8M-all. In some embodiments, the bacteriophage and/or pharmaceutical composition is further capable of lysing each of KP2, CT-141-1, CT-123-1, MKP2_2161_1, MKP2_251_B, MKP2_251_C and 8M-all.

In some embodiments, the bacteriophage and/or the pharmaceutical composition thereof to be administered comprises bacteriophage that in toto lyse at least three, four, five, or six bacteria selected from (a) a mutant *Klebsiella pneumoniae* strain KP2 that is characterized by a mutation in a rfaQ gene; (b) a mutant *Klebsiella pneumoniae* strain KP2 that is characterized by a mutation in a grcA gene; (c) a mutant *Klebsiella pneumoniae* strain KP2 that is characterized by a mutation in a rfaG gene; (d) a mutant *Klebsiella pneumoniae* strain KP2 that is characterized by a mutation in a wbaP gene; (e) a mutant *Klebsiella pneumoniae* strain KP2 that is characterized by a mutation in both a tyrosineK and a wbaP gene; (f) a mutant *Klebsiella pneumoniae* strain KP2 that is characterized by a mutation in a wecA gene; (g) a mutant *Klebsiella pneumoniae* strain KP2 that is characterized by a mutation in a mfps gene; (h) a mutant *Klebsiella pneumoniae* strain KP2 that is characterized by a mutation in both a fhuA and a wecA gene; (i) a mutant *Klebsiella pneumoniae* strain KP2 that is characterized by a mutation in a fepA gene; (j) a mutant *Klebsiella pneumoniae* strain KP2 that is characterized by a mutation in both a tonB gene and a LamB gene; (k) a mutant *Klebsiella pneumoniae* strain KP2 that is characterized by a mutation in a HBAD gene; (l) a mutant *Klebsiella pneumoniae* strain KP2 that is characterized by a mutation in a 1pxM gene; and (m) a mutant *Klebsiella pneumoniae* strain KP2 that is characterized by a mutation in a fhuA gene. In some embodiments, the bacteriophage and/or pharmaceutical composition is further capable of lysing KP2 and at least one, two, three, four, five, or six bacteria selected from CT-141-1, CT-123-1, MKP2_2161_1, MKP2_251_B, MKP2_251_C and 8M-all. In some embodiments, the bacteriophage and/or pharmaceutical composition is further capable of lysing each of KP2, CT-141-1, CT-123-1, MKP2_2161_1, MKP2_251_B, MKP2_251_C and 8M-all. In some embodiments, the bacteriophage and/or pharmaceutical composition is further capable of lysing each of KP2, CT-141-1, CT-123-1, MKP2_2161_1, MKP2_251_B, MKP2_251_C and 8M-all.

In some embodiments, the bacteriophage and/or the pharmaceutical composition thereof to be administered comprises bacteriophage Mcoc-5c and 8M-7. In some embodiments, the bacteriophage and/or the pharmaceutical composition thereof to be administered comprises bacteriophage Mcoc-5c and 8M-7; and at least one bacteriophage selected from 1.2-3b, 1.2-2, and 1.2-3s. In some embodiments, the bacteriophage and/or the pharmaceutical composition thereof to be administered comprises bacteriophage Mcoc-5c and 8M-7; at least one bacteriophage selected from 1.2-3b, 1.2-2, and 1.2-3s; and at least one bacteriophage selected from KP2-5-1 and PKP-55. In some embodiments, the bacteriophage and/or the pharmaceutical composition thereof to be administered comprises Mcoc-5c, 8M-7, 1.2-2, 1.2-3s. In some embodiments, the bacteriophage and/or the pharmaceutical composition thereof to be administered comprises bacteriophage Mcoc-5c, 8M-7, 1.2-2, 1.2-3b. In some embodiments, the bacteriophage and/or the pharmaceutical composition thereof to be administered comprises bacteriophage Mcoc-5c, 8M-7, KP2-5-1, 1.2-3s, PKP-55. In some embodiments, the bacteriophage and/or the pharmaceutical composition thereof to be administered comprises bacteriophage consisting of Mcoc-5c, 8M-7, 1.2-2, 1.2-3s. In some embodiments, the bacteriophage and/or the pharmaceutical composition thereof to be administered comprises bacteriophage consisting of Mcoc-5c, 8M-7, 1.2-2, 1.2-3b. In some embodiments, the bacteriophage and/or the pharmaceutical composition thereof to be administered comprises bacteriophage consisting of Mcoc-5c, 8M-7, KP2-5-1, 1.2-3s, PKP-55.

In some embodiments, the bacteriophage and/or the pharmaceutical composition thereof to be administered comprises bacteriophage 1.2-3b, 1.2-2, and 1.2-3s. In some embodiments, the bacteriophage and/or the pharmaceutical composition thereof to be administered comprises bacteriophage 1.2-3b, 1.2-2, 1.2-3s, and Mcoc-5c. In some embodiments, the bacteriophage and/or the pharmaceutical composition thereof to be administered comprises bacteriophage 1.2-3b, 1.2-2, 1.2-3s, and 8M-1. In some embodiments, the bacteriophage and/or the pharmaceutical composition thereof to be administered comprises bacteriophage 1.2-3b, 1.2-2, 1.2-3s, Mcoc-5c, and 8M-1.

In some embodiments, the bacteriophage and/or the pharmaceutical composition thereof to be administered is capable of lysing at least one, two, three, four, five, six or seven bacteria selected from KP2, CT-141-1, CT-123-1, MKP2_2161_1, MKP2_251_B, MKP2_251_C, and 8M-all. In some embodiments, the bacteriophage and/or the pharmaceutical composition thereof to be administered is capable of lysing KP2 and at least one bacteria, at least two bacteria, at least three bacteria, at least four bacteria, at least five bacteria, or at least six bacteria selected from CT-141-1, CT-123-1, MKP2_2161_1, MKP2_251_B, MKP2_251_C and 8M-all. In some embodiments, the bacteriophage and/or the pharmaceutical composition thereof to be administered is capable of lysing each of KP2, CT-141-1, CT-123-1, MKP2_2161_1, MKP2_251_B, MKP2_251_C and 8M-all.

In some embodiments, a method of treating IBD comprises administering to a mammal determined to be infected with *Klebsiella* bacteria the bacteriophage, the bacteriophage cocktail, and/or the pharmaceutical composition comprising a bacteriophage or a bacteriophage cocktail described herein. In some embodiments, a method of treating IBD comprises administering to a mammal determined to be infected with *Klebsiella pneumoniae* bacteria the bacteriophage, the bacteriophage cocktail, and/or the pharmaceutical composition comprising a bacteriophage, or a bacteriophage cocktail described herein. In some embodiments, a method of treating IBD comprises administering to a mammal determined to be infected with *Klebsiella pneumoniae* KP2 mutant the bacteriophage, the bacteriophage cocktail, and/or the pharmaceutical composition comprising a bacteriophage, or a bacteriophage cocktail described herein.

In some embodiments, the bacteriophage and the method of treatment is used prophylactically. For example, the method comprises administering to a mammal determined to be susceptible to IBD the bacteriophage, the bacteriophage cocktail, and/or the pharmaceutical composition comprising a bacteriophage or a bacteriophage cocktail described herein.

In some embodiments, susceptibility to IBD is measured by the genetic susceptibility to acquire IBD, as determined by the presence of mutations in the genes or loci associated with the immune function in the intestine including loci and genes involved in inflammation and immunoregulation, tissue remodeling, tumorigenesis and apoptosis (for example, NOD2, HLA-27, ATG16L1, interleukins, CCL and CCR genes, SOD genes, MMPs, JAK, STAT, TIMP genes and many others as described in Suzuki et al., 2012) and genes associated with autophagy (Jostins et al., 2012); presence of other immune conditions (sibling diseases) such as autoimmune disorder, Behcet's disease, graft versus host disease, systemic lupus erythematosus, dermatomyositis, polymyositis, auto-immune chronic active hepatitis, pemphigus vulgaris, polyarteritis nodosa, auto-immune hemolytic anaemia, idiopathic thrombocytopenic purpura, myasthenia gravis, lupus nephritis, platelet transfusion refractoriness type 1 diabetes, ankylosing spondylitis, multiple sclerosis, psoriasis, psoriatic arthritis, asthma, and rheumatoid arthritis (Suzuki et al., 2012); acute gastroenteritis (Raposo et al., 2017); dietary constituents that have been shown to affect the immune response and the inflammatory status, through the modulation of the microbiota, for example high carbohydrate and animal fat diet, high intake of red meat and processed meat, protein, alcoholic beverages, sulfur, and sulfate, processed food (Raposo et al., 2017); lifestyle habits (Western hygiene standards and improved sanitary conditions); medications (antibiotics and steroids) especially when used in childhood leading to the alterations in the microbiome composition (Raposo et al., 2017); epigenetic mechanisms dependent on the nutrients e.g. folates and selenium (DNA methylation (Raposo et al., 2017); pollutants, sedentary lifestyle and tobacco-smoking (Raposo et al., 2017); geography (Hold at al., 2014); history of the IBD in the family (Baumgart and Sandborn, 2012; Neurath, 2014).

In some embodiments, the bacteriophage is administered more than once to achieve a desired therapeutic effect. For example, when a host bacterium is destroyed, the bacteriophage that infected said bacterium can no longer multiply because its host has been eradicated and may be eliminated from the digestive tract, and the bacteriophage may need to be re-administered, e.g., at least twice daily, at least daily, at least every other day, at least every three days, at least weekly, or at least monthly.

In some embodiments, the phage described herein may be administered in combination with one or more known and suitable medicaments for IBD, including anti-inflammatory drugs, dietary therapy, probiotics, etc. In some embodiments, the phage described herein may be administered in combination with one or more substances for modulating the pH of the stomach, e.g., a proton pump inhibitor, a histamine H2 antagonist, and/or bicarbonate.

The medicament or substance for modulating the pH of the stomach may be administered prior to, concurrently with, or after administration of the phage.

Methods of Determining a Subject to be Treated with Phage

Methods of selecting subjects that are responsive to treatment are provided herein.

In some embodiments, the method of selecting a subject that is responsive to treatment by the methods set forth herein comprises (1) obtaining a biological sample, e.g., from the intestine or mouth of the subject, (2) culturing the bacteria obtained from the biological sample, (3) inoculating the cultured bacteria with a bacteriophage described herein, and (4) determining the amount of cultured bacteria that are lysed by the bacteriophage. In some embodiments, the lysis is determined by a liquid media assay and/or a solid media assay as described herein. In some embodiments, the amount of lysis using the bacteria cultured from the intestinal sample is compared to a control, e.g., a sample obtained from a different, uninfected subject or a sample from the same subject prior to infection. In some embodiments, the phage described herein is suitable for treating KP infection if any lysis is mediated by the phage in vitro and/or in vivo. In some embodiments, a subject is determined to be infected with *Klebsiella* if a detectable portion of bacteria cultured from the subject are lysed by the bacteriophage. In some embodiments, a subject is determined to be infected with *Klebsiella* pneumoniaeKP2 if a detectable portion of the cultured bacteria are lysed by a KP2 bacteriophage.

In some embodiments, the biological sample is an oral sample or expectorate, a biopsy, or stool. In some embodiments, determining the amount of cultured bacteria that are lysed by the bacteriophage comprises performing a KP2-specific qPCR of the bacterial sample and/or a direct test for phage sensitivity using the plaque assay or liquid OD method described herein. In some embodiments, a positive sample or subject to be treated is determined by the presence of plaque in a plaque assay. In some embodiments, a positive sample or subject to be treated is determined by a reduction in OD in a liquid OD assay. In some embodiments, serotype-based screening is performed using an assay, e.g., an immunoassay, an ELISA, to determine the presence of antibodies against KP2 and/or their capsular types. In some embodiments, the phage is labeled with a detectable marker, e.g., a luminescent marker, and the infection of the bacteria is determined by detecting an increase in the marker, e.g., in a luminescence assay.

Deposit Accession Numbers

Deposits at The Leibniz Institute DSMZ-German Collection of Microorganisms and Cell Cultures GmbH, and The Polish Collection of Microorganisms (PCM): KP2 bacteria (ACCESSION NO. DSM 33048, deposited on Feb. 27, 2019), KP2-Mcoc1 bacteria (ACCESSION NO. DSM 33049, deposited on Feb. 27, 2019), KP2 8M-all bacteria (ACCESSION NO. DSM 33050, deposited on Feb. 27, 2019), CT-123-1 bacteria (ACCESSION NO. DSM 33051, deposited on Feb. 27, 2019), CT-141-1 bacteria (ACCESSION NO. DSM 33052, deposited on Feb. 27, 2019), MKP2_251B bacteria (ACCESSION NO. DSM 33053, deposited on Feb. 27, 2019), MKP2_251C bacteria (AC- CESSION NO. DSM 33054, deposited on Feb. 27, 2019), MKP2_2161_1 bacteria (ACCESSION NO. DSM 33055, deposited on Feb. 27, 2019), 8M-1 bacteriophage (ACCESSION NO. DSM 33072, deposited on Feb. 27, 2019), 8M-8 bacteriophage (ACCESSION NO. DSM 33071, deposited on Feb. 27, 2019), 8M-7 bacteriophage (ACCESSION NO. DSM 33070, deposited on Feb. 27, 2019), MCoc5c bacteriophage (ACCESSION NO. DSM 33069, deposited on Feb. 27, 2019), 1.2-2 bacteriophage (ACCESSION NO. DSM 33068, deposited on Feb. 27, 2019), KP2-5-1 bacteriophage (ACCESSION NO. DSM 33067, deposited on Feb. 27, 2019), 1.2-3b bacteriophage (ACCESSION NO. DSM 33066, deposited on Feb. 27, 2019), 1.2-3s bacteriophage (ACCESSION NO. DSM 33065, deposited on Feb. 27, 2019), PKP-55 bacteriophage (ACCESSION NO. DSM 33064), colon-11 bacteriophage (ACCESSION NO. F/00143, deposited on Feb. 26, 2020), colon-14-15 bacteriophage (ACCESSION NO. F/00144, deposited on Feb. 26, 2020), KP2-15-2-1 bacteriophage (ACCESSION NO. F/00145, deposited on Feb. 26, 2020), MCoc8a bacteriophage (ACCESSION NO. F/00146, deposited on Feb. 26, 2020), MCoc9-1c bacteriophage (ACCESSION NO. F/00147, deposited on Feb. 26, 2020).

EXAMPLES

Example 1: Isolation of KP2 Clinical Variants

10 µl of stool suspended in buffer was cultured in 4 ml Pepton water (M028, Hylabs) overnight at 37° C. 10 µl of the culture was streaked onto MacConkey and Chromagar orientation plates. Colonies with the ability to grow on the MacConkey plate which presented a pink, mucoid colony morphology or with the ability to grow on the Chromagar plate and with a blue appearance, were tested for motility and ability to form indole gas using UMI agar tubes (TT-147, Hylabs). Colonies were further analyzed by full genome Nextera-based sequencing using next generation paired-end Illumina technology and the resultant sequences were analyzed as detailed below. Each *Klebsiella pneumoniae* isolate was sequenced using Illumina Nextera sequencing of 150 bp paired-end reads.

Adapter removal and quality trimming was done using Trimgalore and cutadapt (Martin, 2011). Positions with phred scores below 30 were deleted from a read and reads shorter than 55 bp after removing low quality nucleotides were discarded entirely. Assembly was performed using SPAdes (Bankevich et al., 2012). Validation of *K. pneumoniae* taxonomy was done using Kleborate which genotypes assemblies and determines whether they are indeed *K. pneumoniae*. Results were obtained by comparing the contigs of an assembly to known *klebsiella* species genomes hosted at: bigsdb.pasteur. Comparisons were done using BLAST (Altschul, 1990) and the *Klebsiella* species was determined from a phylogenetic tree derived from identities between known *Klebsiella* species, where the distance metric is mash (Ondov et al., 2016). KP2 variants were positively identified by two separate methods:
  A. Multi-locus sequence type (MLST): *K. pneumoniae* strains that were determined as sequence type 323 (Diancourt et al., 2005) by Kleborate (run with default parameters) were defined as KP2 strains.
  B. Whole-genome similarity to reference KP2 strains: Reference KP2 (see table below) were obtained, and each new KP strain isolated was compared to these references using fastANI (Jain et al., 2018). Isolated strains with FastANI scores of 99.9% or greater compared to any of these reference genomes were defined as KP2 strains.

If either of these conditions (MLST or whole-genome similarity) was fulfilled, the strain was defined as a KP2 clinical variant. When two of the strains isolated and identified in this manner as KP2 clinical variant were tested for their pro-inflammatory activity in wild type mice and IL10 KO mice which spontaneously develop a chronic inflammatory bowel disease as described in Atarashi et. al 2017 for KP2H7 (Atarashi K, et al. Ectopic colonization of oral bacteria in the intestine drives T(H)1 cell induction and inflammation. Science. 358:359-365, 2017), they were found to exhibit TH1 immune activation capabilities (as shown in FIG. 16).

| Reference KP2 sequence |
| --- |
| GenBank BDQR01000001.1 |
| GenBank GCA_002260905.1 |
| BioSample: SAMD00083910 |
| BioProject PRJDB5883 |
| Ectopic colonization of oral bacteria in the intestine drives TH1 cell induction and inflammation (Atarashi et al., 2017) |

The KP2 bacterial genome has been sequenced and is known in the art, see, e.g., GenBank BDQRO1000001.1, GenBank GCA_002260905.1, BioSample: SAMD00083910, BioProject PRJDB5883, and Atarashi et al., Ectopic colonization of oral bacteria in the intestine drives TH1 cell induction and inflammation, Science (2017). When KP2 mutants were obtained, such as in mutant analyses for phage resistant bacteria described below, 16S analysis was performed. Global homology above 98% to reference KP2 16S sequences confirmed that the subsequent strains were pure. See, e.g., NCBI BLAST (Altschul et al. 1997) and the Ribosomal Database Project (Cole et al. 2014). An in-silico 16S PCR was run on the KP2 resulting in amplicons that both NCBI BLAST (Altschul et al. 1997) and the Ribosomal Database Project (Cole et al. 2014) matched to the 16S of *Klebsiella pneumoniae*.

Example 2: Bacteriophage Sources

Sewage was obtained from the National Virology Center at Sheba Hospital. Dental sewage was collected from the dental clinic at Poria Hospital. Fecal samples were provided from healthy donors or IBD patients at Ichilov Hospital. Batches of sewage comprised of 5-6 samples obtained from different places at different times were centrifuged and the supernatant was filtered (Merck Millipore glass fiber prefilters APFD, APFB followed by Express plus PES 47 mm disks 0.45 µm filters) using a vacuum filtration system. During this process 400 mL of 5-6 samples were mixed into one pool. The pooled sewage sample mix was concentrated by the Pellicon filter system (from 2 L to 20 mL). Concentrated sewage sample was filtered with 0.45 µM filter, passed to barcoded tube and stored at 4° C. Thus, each sewage phage isolate in the bank is comprised of phages from 5-6 samples of different geographical origins.

Dental sewage samples of 4-5 different donors were processed in a similar way to regular sewage, except that the starting volume of the batches was lower than 400 mL. Each concentrated dental sewage sample was filtered with 0.45 µM filter, passed to barcoded tube and stored at 4° C.

Fecal samples were processed individually as follows: 5 g of each fecal sample of an individual donor was weighed and inserted into a BagMixer plastic bag together with SM buffer (50 mM Tris, 200 mM NaCl, 10 mM $MgSO_4$, 0.01% Gelatin). The fecal matter was re-suspended by 2 cycles of 2 minutes in a BagMixer 400P stomacher. The resulting suspension was centrifuged, the remaining supernatant was filtered by 0.45 μm filter to remove the bacterial fraction and kept at 4° C.

Example 3: Screening Environmental and Clinical Samples for Phage that Recognize K. pneumoniae 10 dental sewage samples, 41 sewage samples and 70 fecal samples were used to assemble mini-mixes of mostly 3-samples each (total 39 mixes). Screening was performed by applying 10 μL of each mix to a KP2 bacterial lawn, in 48 well plates by drop plaque assay (Bacteriophages methods and protocols MRJ Clokie AM Kropinsky). Plates were incubated for 2-3 hrs (37° C.) in aerobic conditions, after which plaques became visible on the bacterial lawns. One plaque was picked up (using a sterile 20 μL tip) into phage buffer (Tris-HCl pH 7.5 50 mM, NaCl 100 mM, $MgCl_2 \cdot 6H_2O$ 5 mM, $MnCl_2 \cdot 4H_2O$ 0.1 mM in DDW) and re-isolated in the same manner an additional two times for a total of 3 rounds. A single phage, KP2-5, was isolated in this manner.

The above samples were also used to assemble 6-sample mixes (total 21 mixes). 100 μL of each mix was added to a liquid KP2 culture followed by incubating for 3 hrs at 37° C. Following incubation, the tubes were centrifuged, the supernatant was filtered by 0.45 μm syringe filter and tubes were kept at 4° C. Screening of the supernatants was performed by testing 10 μL of each on KP2 bacterial lawns in 48 well plates by drop plaque assay. Plates were incubated for 2-3 hrs at 37° C., at aerobic conditions, after which plaques became visible on the bacterial lawn. Plaques were picked up (using a sterile 20 μL tip) into phage buffer and re-isolated as detailed above. The phage isolated in this manner are KP2-5-1, KP2-14. KP2-15-1, KP2-15-2-1 and KP2-16-1.

Following accumulation of additional environmental and clinical samples, another round of phage isolation was carried out as described above. 19 dental sewage, 58 sewage and 100 fecal samples were used to assemble 65 mini-mixes (average of three samples per mini-mix) that were afterwards combined to 8 mega mixes (8 mini-mixes=mega mix). 100 μL of each mix was added to a liquid KP2 culture and the supernatants obtained as above.

Supernatants were used for screening via plate reader as follows: 0.2 mL of KP2 (OD=1.2) was dispensed into a 96 well plate. 10 uL of the supernatants were added in duplicates (8×2). Control wells (KP2 with no phage; blank wells) were also prepared. The plate was incubated overnight at 37° C. with agitations in a robotic plate reader (Freedom EVO 75, Tecan) and OD was measured every 15 minutes.

For supernatants which showed a decrease in the growth curve of KP2 (4 out of the 8 mega mixes), screening was performed by testing 10 μL of each supernatant on KP2 bacterial lawns by drop plaque assay. Plates were incubated overnight at 37° C., in aerobic conditions, after which plaques became visible on the bacterial lawn and were isolated as above. The following phage were isolated in this manner: 1.2-2, 1.2-3b, 1.2-3s, 1.2-4br, 1.2-4s.

Example 4: Generating KP2 Mutants

In order to derive resistant mutant strains, KP2 was cultured with KP2-16-1 alone or a cocktail of KP2-5-1, KP2-14. KP2-15-1, KP2-15-2-1 and KP2-16-1, at phage titers of $1 \times 10^6$ PFU/mL in 4 mL BHIS, at 37° C. with shaking to OD600 nm=1.5. Then the culture was diluted with liquid BHIS to OD=0.2 and dispensed (200 μL/well) into 96 wells plate. A volume of 10 μL of KP2-16-1 or the cocktail was added. Absorbance (600 nm) was monitored in a plate reader every 15 min for 24 hrs. as above. Analysis of the growth curves of KP2 alone, or KP2 exposed to KP2 16-1, or to cocktail, revealed mutant candidates. The contents of the wells containing mutant candidates were plated on BHIS agar plates and incubated overnight at 37° C. Single colonies were isolated and propagated in liquid BHIS. The candidates were verified as Klebsiella pneumoniae by 16S and whole genome sequencing analysis as detailed above followed by confirmation of resistance to the respective phages by drop assay. The resistant mutant strains generated in this way are MKP2_2161_1 following exposure to KP2-16-1 and KP2-Mcoc1 following exposure to the cocktail. Mutant strains underwent whole genome sequencing.

Example 5: Isolation of Phage to Resistant Mutants

To isolate phages capable of infecting the resistant KP2 mutants, MKP2_2161_1 and KP2-Mcoc1, 19 dental sewage, 58 sewage and 100 fecal samples were used to assemble 7-9 sample mixes (total 19 mixes). Mixes were cultured with each of the mutants for 3 hours at 37° C. and supernatants obtained by centrifuging and filtering with 0.0.45 μm syringe filter, following which they were kept at 4° C. Screening of supernatants was performed by testing 10 μL on KP2, MKP2_2161_1 and KP2-Mcoc1 bacterial lawns, using 48 well plates by drop plaque assay. Plates were incubated for 2-3 hours at 37° C., at aerobic conditions, after which plaques became visible on bacterial lawn and were isolated.

The phage isolated in this manner are: M16-3-2c, M16-4a, MCoc3c, MCoc5c, KP2-4a, MCoc4c, M16-5c, KP2-5a, KP2-5, M16-6c, MCoc6c, KP2-7c, KP2-7-1c, M16-7a, KP2-8c, KP2-8a, MCoc8a, M16-9-1c, MCoc9-1c, MCoc9-2c, KP2-9a, M16-9a, MCoc15c and Mcoc7c.

8M-all is a KP2 phage resistant mutant that was isolated in the in vivo study of Example 16. The mutant was resistant to all the KP2 phages previously isolated.

A bacterial culture of 8M-all was diluted 1:100 in liquid BHIS supplemented with 1 mM final concentration MMC ($Mg^{2+}$, $Mn^{2+}$, $Ca^{2+}$ ions and divided into a 24-well plate (1 mL in each well). 50 μL from a combined sewage sample originating in 8 individual sewage samples was added, and the samples were incubated overnight at 37° C. Next, 200 μL of each sample was transferred to a 96-well filter plate, and centrifuged for 10 min at 4500×g. A drop plaque assay was performed by testing 5 μL of each supernatant on an 8M-all bacterial lawn grown on a BHIS agar petri plate. Plates were incubated overnight at 37° C. in aerobic conditions, after which plaques became visible and were isolated as above. The phage isolated in this manner are 8M-1, 8M-7 and 8M-8.

Example 6: Phage Amplification and Determination of Phage Titers

Phage were amplified from liquid broth or from soft agar by double agar overlay plaque assay. Amplification from liquid broth was performed by diluting 50 μL of isolated phage sample into 4 mL log phase host culture at OD=1.7, or into 4 mL log phase culture at OD=0.5, and incubating at 37° C., overnight. Tubes were centrifuged, the supernatant was filtered by 0.45 μm syringe filter, and 1 mM of the divalent ions $Ca^{2+}$ and $Mg^{2+}$ were added.

Phage titers were determined by drop plaque assay as follows: host culture was prepared by inoculating 4 mL liquid BHIS (BACTOTM Brain Heart Infusion BHI, Yeast extract 0.5% and Resazurin) with 5-10 colonies of the host and incubating at 37° C., until OD was 1.7 (1.5-2 hrs). 100 μL of host culture were added to 4 mL of molten top agar (BHIS top agar: BHIS media, 0.4% Agarose) with divalent ions $Ca^{2+}$ and $Mg^{2+}$ and dispensed (100 μL/well) to 48 well plate with underlay of bottom agar (BHIS bottom agar: BHIS media, 1.6% Agarose). Plate was incubated for 30 minutes (37° C.), and then dilutions of phage sample were dropped (10 μL). Plate was incubated for 2-3 hrs before counting plaques (10-50 plaques) and determination of phage titer (number of plaques×10× reciprocal of counted dilution=PFU/mL).

Amplification of phage from soft agar was performed in cases where titers of phage that were produced from liquid BHIS were lower than $1\times10^9$ PFU/mL. Log phase host culture at OD=1.7, was diluted to OD=1, and aliquots of 100 μL diluted host culture were added to 100 μL of phage at a titer that is sufficient to result in production of confluent plaques, and incubated at room temperature for 15 minutes. Then each host-phage mixture was diluted with 3 mL soft molten agar and poured on top of BHIS bottom agar. Plates were left to harden, and then incubated at 37° C. for 2-3 hrs or until complete lysis. Plates were scraped from the top agar with a spreader and agar was transferred to sterile tubes with BHIS and 10 μL of chloroform. Tubes were left to stand for 30 minutes to enable phage to elute from the soft agar. Tubes were centrifuged, and supernatant was filtered with 0.45 μM syringe filter to eliminate residual agar. Divalent ions $Ca^{2+}$ $Mg^{2+}$ at concentration of 1 mM were added to tubes which were stored at 4° C.

Example 7: Host Range Analysis of Initially Isolated Phage

Host range analysis for phage isolated on KP2, as well as for the commercial phage (ATCC 23356-B1) was performed on six *K. pneumoniae* strains from ATCC: BAA-2552 (KP1), 23356 (KP4), 13882 (KP5), BAA-1705 (KP6), 700603 (KP7) and 700721 (KP8). Each phage was added (10 μL) to bacterial lawns of the *K. pneumoniae* strains in 48 well plates by drop assay. Plates were incubated for 2-3 hrs (37° C.) in aerobic conditions, after which plaques became visible on the bacterial lawns. Plates with bacterial lawns of KP2 and their respective phage served as positive control. Host range was performed for each of the phage with two phage titers; $1\times10^6$ PFU/mL and $1\times10^9$ PFU/mL.

Results of the host range analysis are presented in FIG. 15, where "S" (dark gray) indicates susceptibility (10 plaques or more to full clearing) and "R" (light gray) indicates resistance (less than 10 plaques). All phages exhibited high specificity to the corresponding hosts on which they were isolated with. This was the case for both titers tested. The exception to this observation was for phage KP2-5-1 which infected 23356 strain when applied at a high titer of $1\times10^9$ PFU/mL, however no plaques were observed for KP2-5-1 on 23356 at a lower titer of $1\times10^6$ PFU/mL.

Thus, it was shown that phages isolated on KP2 host bacteria are specific to their host, recognizing specific receptors/attachment sites expressed by this bacterial strain. Moreover, the commercial phage ATCC 23356-B1 did not recognize KP2, but only the strain KP4 on which it was isolated, suggesting a it recognizes different host receptors/attachment sites.

Example 8: Isolation of Phage to KP2 Clinical Variants

In order to obtain phage that target KP2 as well as the KP2 clinical variants that were isolated and the resistant mutant KP2 strains, sewage samples were sequentially exposed to these different targets. A combined sewage sample originating from 50 individual samples was inoculated with $10^3$ total PFU of phages (1.2-2, 1.2-3b, 1.2-3s, KP2-7-1c and MCoc5c), and filtered through a 0.45 μm PES syringe filter. The filtrate was stored at 4° C. until use.

Bacterial strain KP2 was cultured in 5 mL BHIS supplemented with 1 mM $Ca^{2+}$, $Mg^{2+}$ and $Mn^{2+}$ ions (MMC ions), at 37° C., until OD of 0.2-0.4. To this, 0.5 mL of the combined sewage sample filtrate was added and incubated for 4 hrs. Next, the culture was centrifuged at 4500×g for 5 minutes at room temperature and filtered using a 0.45 μm PES syringe filter.

The resulting supernatant was exposed to a mix of 14 KP2 clinical variants isolated from stool as described in Example 1 and the 2 mutant strainsMKP2_2161_1 and KP2-Mcoc1 following which it was once again centrifuged and filtered for testing on a KP2 lawn. Plaques which appeared were isolated as described above. This process led to isolation of PKP-55.

Example 9: Phage Isolation on Tissues

KP2 colonized colon tissues were obtained from the in vivo animal studies described in Examples 15, 16 and 17. Phage that infect KP2 colonized tissues were isolated in one of two ways:
A) Three KP2 colonized colon tissue segments, from three mice, were chopped and placed together into 40 mL of phage buffer (50 mM Tris-HCl, 100 mM NaCl, 5 mM $MgCl_2$, 0.1 mM $MnCl_2$ PH=7.5) with 40 μL of 1M MMC ions and 4 mL of liquid BHIS. The solution was divided into a 48-well plate (1 mL at each well). 30 sewage samples were tested. 10 μL of each sewage sample was added to individual wells, and the samples were incubated at 37° C. After 2 and 6 h of incubation, 100 μL from each well was transferred to 96-well filter plate and centrifuged for 10 min at 4500×g. Drop plaque assay was performed by testing 5 μL of each supernatant on a KP2 bacterial lawn. Plaques were isolated as described above. Phage isolated in this manner are colon1, colon-6, colon-36 and colon-14-15.
B) 66 sewage samples, 24 dental sewage samples and 57 clinical stool samples were combined, resulting in 48 mixes. Five colon segments from five mice colonized with KP2 were cut horizontally in an anaerobic chamber and washed in petri dishes filled with PBS. The colons were chopped into 96 pieces that were distributed into two 96 well plates. Plates with colon pieces were centrifuged for 5 min at 300×g, excess PBS was removed and 50 μL of the phage containing mixes plus MMC ions was added. 200 μL of BHIS +2 mM MMC ions were then added to one of the two plates that was then incubated at 37° C. After 3 and 6 hours, 50 μL of supernatant was obtained from each sample of one the two duplicate plates by filtering with a 0.45 um 96-well filter plate and centrifuging for 10 min at 4500×g.

For the remaining plates, the phage containing mix was removed after 45 minutes by centrifuging for 5 min at 300×g., carrying out a PBS wash and adding 200 µL of BHIS+1 mM MMC ions to each well. After incubation at 37° C. for 6 hours, 50 µL of each sample was filtered by transferring into a 0.45 um 96-well filter plate which was centrifuged for 10 min at 4500×g.

All supernatants obtained as described above were applied on a KP2 bacterial lawn to obtain plaques that were picked into 100 µL phage buffer (Tris-HCl pH 7.5 50 mM, NaCl 100 mM, $MgCl_2 \cdot 6H_2O$ 5 mM, $MnCl \cdot 4H_2O$ 0.1 mM in DDW) and re-isolated, as described above, a total of 3 times to ensure phage purity. Phage isolated in this manner are colon-11 and colon-14.

Example 10: Phage Taxonomy

Bacteriophages were sequenced and reads assembled using SPAdes 3.9.0. (Bankevich et al., 2012). Prediction of open reading frames and translation to amino acid sequences was performed on all assembled phage genomes using Prokka version 1.13.3. (Seemann 2014). Three approaches were used to taxonomically classify each phage:
1) Phage structural genes were analyzed using VIRFAM. See, e.g., Lopes et al. 2014. VIRFAM clustered these into 3 different families: Myoviridae Type 2 (e.g., phages T4 or RB43), Podoviridae Type 3 (e.g., phages phiYeO3-12, T3 or T7) and Siphoviridae Type 1 (e.g., phages T1, TLS or RTP).
2) Assembled phage genomes were compared to phage genomes in the NCBI Refseq database (O'Leary et al. 2016) with BLAST+version 2.6.0 (Camacho et al. 2009). The cutoff used was 80% identity and 70% query coverage. Taxonomic annotation of the best hit from the BLAST search results was noted.
3) Phage protein sequences were compared to phage proteomes in the NCBI Refseq database (O'Leary et al. 2016) with BLAST+version 2.6.0 (Camacho et al. 2009). The cutoff used was 50% identity and 50% query protein coverage. The reference genome (RF) was determined for each phage by the protein sequences in the BLAST search with highest homology. The taxonomic annotation of the phages was inferred from the taxonomic annotation of the reference genome, in addition to other genomes with over 40% homology to the RE.

Overall the taxonomy annotation obtained by the three methods is consistent. Nonetheless, discrepancies may be resolved by the International Committee on Taxonomy of Viruses (ICTV) specific taxon threshold. The taxonomy annotation is presented in FIG. 1 and the percent homology between phage in the different taxonomic groups and within the groups is shown in FIG. 2.

Example 11: Mechanism of Action—Resistant Mutants Creation

To identify the bacterial cell surface receptors used by different phages, resistant mutant bacteria were isolated and characterized to detect the genomic modifications responsible for the resistance. The putative mechanism of action (MOA) of several bacteriophages was analyzed in a multi-step process involving infection of KP2, KP2-Mcoc1 and 8M-all, followed by selection and sequencing of resistant mutants. Differences between pre-infection and mutated DNA were analyzed to determine the phage infection mechanism (Avrani et al., 2011).

For each phage-host pair, frozen samples of host were thawed from −80° C. stock, plated on BHIS agar plates and incubated overnight at 37° C. Next, single colonies were isolated and propagated in liquid BHIS. 0.1 ml of each culture was collected and frozen at −20° C. for DNA extraction (pre-infection DNA). 0.1 ml of $10^9$ PFU/ml of the selected phage was added to 0.1 ml of each culture and the samples were incubated for 15 min at 37° C. to allow phage attachment to host. Next, the samples were added to top agar, plated and incubated overnight at 37° C. Multiple single colonies were isolated from each phage-host combination and resuspended in liquid BHIS. Each sample was divided into two parts, one was frozen at −20° C. for DNA extraction and the other used for mutant validation.

Mutant validation was performed by adding 5 ul of $10^6$ PFU/ml of the relevant phage to a strip containing the host mutant grown in a BHIS plate. Mutant colonies resistant to the selected phage (no plaques observed) were frozen at −80° C. DNA of selected mutant colonies and pre-infection DNA was extracted following the manufacturer's protocol (geneJET Genomic DNA purification Kit, Thermo scientific). Table 2 below shows phage-host combinations used in the procedure described above.

TABLE 2

| phage | host |
| --- | --- |
| 1.2-3s | KP2 |
| 1.2-2 | KP2 |
| 1.2-3b | KP2 |
| colon1 | KP2 |
| MCoc5c | KP2-Mcoc1 |
| 8M-1 | 8M-all |

Example 12: Mechanism of Action—DNA Assembly and Mutations Analysis

Mutant and original bacterial genomes were compared to determine mutations responsible for infection mechanism. The DNA isolated pre-infection was used as an original sample in each biological replicate. Short read sequences of original samples (Illumina 250 paired-end) in combination with minION long reads (MinION; Madoui et al. 2015) were assembled into reference original genomes by Unicycler (Wick et al. 2017).

Mutant DNA and original sequences were compared using the breseq tool (Barrick et al. 2009, Deatherage and Barrick 2014) to identify relevant mutations. Breseq was used in default settings with the polymorphism option, which identifies polymorphism(s) between the mutant and the reference sequence. The discovered genomic modifications are presented in Table 3 below. From this table it can be seen that different phage appear to utilize different surface components for bacterial attachment. Phage utilizing different phage attachment elements are likely to be complementary in their ability to lyse common target bacteria.

TABLE 3

| Bacterial strain (phage to which developed resistance) | Mechanism or Bacterial Surface Component (gene) | Mutant sequence | Original sequence |
|---|---|---|---|
| Colon1_1 11_S83 (colon1) | LPS (rfaQ) | MTPETLSRGPLNPARILVIKLRHH GDMLLITPLIHALKQQYPAASVDV LLYEETRDMLAANPDIHHIYGLDR RWKKQGKRYQLKMQWQLIQTLRQQ RYDMVLNLADQWPSAVISKLTGAA TRIGFDFPKRRHPVWRYCHTALAS TQQHNQLHTVQQNLSILAPLGLQL NDAPARMGYSEADWAASRALLPED FREHYIVIQPTSRWFFKCWREDRM SALINALSAEGYAVVLTSGPDARK KKMVDTIIAGCPQARLHSLAGQLT LRQLAAVIDHARLFIGVDSVPMHM AAALGTPLVALFGPSKLTFWRPWQ AKGEVIWAGDFGPLPDPDAINTNT DERYLDLIPTDAVIAAAKKVLA | MTPETLSRGPLNPARILVIKLRHHGDMLL ITPLIHALKQQYPAASVDVLLYEETRDML AANPDIHHIYGLDRRWKKQGKRYQLKMQW QLIQTLRQQRYDMVLNLADQWPSAVISKL TGAATRIGFDFPKRRHPVWRYCHTALAST QQHNQLHTVQQNLSILAPLGLQLNDAPAR MGYSEADWAASRALLPEDFREHYIVIQPT SRWFFKCWREDRMSALINALSAEGYAVVL TSGPDAREKKMVDTIIAGCPQARLHSLAG QLTLRQLAAVIDHARLFIGVDSVPMHMAA ALGTPLVALFGPSKLTFWRPWQAKGEVIW AGDFGPLPDPDAINTNTDERYLDLIPTDA VIAAAKKVLA |
| Colon1_1 39_S111 (colon1) | LPS(grcA) | MITGIQITKAANDDLLNSFWLLDS EKGEARCLCAKGGFAEDDVVAVSK LGEIEYREIPVDKPEVRVEGGQH LNVNVLRRETL[V/Q]DAVKHPEK YPQLTIRVSGYAVRFNSLTPEQR DVIARTFTESL | MITGIQITKAANDDLLNSFWLLDSEKGEA RCLCAKGGFAEDDVVAVSKLGEIEYREIP VDVKPEVRVEGGQHLNVNVLRRETLLDAV EHPEKYPQLTIRVSGYAVRFNSLTPEQQR DVIARTFTESL |
| Mcoc_5C_1 (MCoc5c) | LPS (rfaG) | MSKFRLALVRQKYRPDGGAERFVS RALEALDSSHLQLNVITREWQGPV KPDWQIHICNPRKWGRISRERGFA NAARELWQRESFDLVQSHERIPGC DLYRAGDGVHRRWLQQRSRILPAW KSRLLFADRYHRYVMQAEREMYED SHLRGVICNAEMIKREIIEDFGLP AEKIHVIYNAIDNQRFLPPDEETF AALRAKWQLPLQATCLIYVGSGFE RKGLAAAIRAIAPTDRYLLVVGKD KDQPRYQALAKSLNCEARVRFFGM QSERLPFYQMADGLLLPTLYDPFP NVILEAMACGLPVITTTGCGGAEF IVDGHNGYVCDALDIPALQQAVMA LPARALGSAEGGHARERIMACTSE RLSTQLLSLYQDLVK | MSKFRLALVRQKYRPDGGAERFVSRALEA LDSSHLQLNVITREWQGPVKPDWQIHICN PRKWGRISRERGFANAARELWQRESFDLV QSHERIPGCDLYRAGDGVHRRWLQQRSRI LPAWKSRLLFADRYHRYVMQAEREMYEDS HLRGVICNAEMIKREIIEDFGLPAEKIHV IYNAIDNQRFLPPDEETFAALRAKWQLPL QATCLIYVGSGFERKGLAAAIRAIAPTDR YLLVVGKDKDQPRYQALAKSLNCEARVRF FGMQSETLPFYQMADGLLLPTLYDPFPNV ILEAMACGLPVITTTGCGGAEFIVDGHNG YVCDALDIPALQQAVMALPARALGSAEGG HARERIMACTSERLSTQLLSLYQDLVK |
| Mcoc_5C_4 (MCoc5c) | LPS (wcaJ or wbaP) | MSRLARNFWTSILLAISDFTGFTV AIVFAIFFVKSFMNDGGHIIANSN INDWVILHTCLGICCVAWYSIRLR HYFYRKTFWFELKEILRTLVIFAI IEIAVLSFAYWDFSRYILAVTWIF VLFFVPTFRMLTKKCLNFLDYGSV KQ | MSRLARNFWTSILLAISDFTGFTVAIVFA IFFVKSFMNDGGHIIANSNINDWVILHTC LGICCVAWYSIRLRHYFYRKTFWFELKEI LRTLVIFAIIEIAVLSFAYWDFSRYILAV TWIFVLFFVPTFRMLIKKCLNFFGLWKRE TIIIGDGNNAVEAWKAINSESNLGFNVTS FVSSTSKDHLKNHINDIPVISLNPKEVTK HFDKRTQFIVALETSESSIRNDWLREFLI NGFRYVSVIPTLRGVPLDSTDMSFIFSHE VMIFRVQQNLAKLSSRILKRLFDIIGSLT IILVSSPLLIYIALKVKKDHGPAIYGHER IGNGGRPFKCLKFRSMVVNSKEVLEQLLN TDPAARKEWDATFKLKDDPRITDIGKFLR KTSLDELPQLFNVLKGEMSLVGPRPIITA ELERYSDEVDYYLLSKPGMTGLWQVSGRS DVDYETRVYLDAWYVKNWSMWNDIAILFK TISVVLRKDGAY |
| Mcoc_5C_7 (MCoc5c) | LPS (tyrosineK) | MSSLKNKPENKDADEIDLSRLYGE LIDHRKLIISVTAFFTLIALVYSL FSTPIYQADSLIQVEQKQANAILS NLSQMLPDSQPQSAPEITLLQSRM ILGKTVDDLNLQAKIKQNYFPILG RGFSRLSGDKPGIINVSRLYLPKT DDDIPELTLTVIDANKFTIQTDSF EAEVKVGELFEKNNISLKVDEIQA KPGTSFTVEYLSKLKAINDLRDVL TVSDQGKDTGMLTLSLTGDDPVQI RKILDSISNNYLMQNIDRQAAQDA KSLEFLNRQLPQVRHDLDISEDKL NKYRQQKDSVDLSLEAKAVLDQIV NVDNQLNELTIRESEVSQHFTKEH PTYKALMEKRVTLLEEKAKLNKRV SAMPETQQEVLRLSRDVDSGRAVY | MSSLKNKPENKDADEIDLSRLYGELIDHR KLIISVTAFFTLIALVYSLFSTPIYQADS LIQVEQKQANAILSNLSQMLPDSQPQSAP EITLLQSRMILGKTVDDLNLQAKIKQNYF PILGRGFSRLSGDKPGIINVSRLYLPKTD DDIPELTLTVIDANKFTIQTDSFEAEVKV GELFEKNNISLKVDEIQAKPGTSFTVEYL SKLKAINDLRDVLTVSDQGKDTGMLTLSL TGDDPVQIRKILDSISNNYLMQNIDRQAA QDAKSLEFLNRQLPQVRHDLDISEDKLNK YRQQKDSVDLSLEAKAVLDQIVNVDNQLN ELTIRESEVSQHFTKEHPTYKALMEKRVT LLEEKAKLNKRVSAMPETQQEVLRLSRDV DSGRAVYMQLLNRQQELNIAKSSAIGNVR VIDEAVTQPRPVAPKKILIVIGGIIFGLI VSVAIIALRVFLRRGIESPEQLEVLGINV |

TABLE 3-continued

| Bacterial strain (phage to which developed resistance) | Mechanism or Bacterial Surface Component (gene) | Mutant sequence | Original sequence |
|---|---|---|---|
| | | MQLLNRQQELNIAKSSAIGNVRVI DEAVTQPRPVAPKKILIVIGGIIF GLIVSVAIIALRVFLRRGIESPEQ LEVLGINVYASIPVSETFAKNITK GLKSNKKKSLEYDEFLAIQNPADL AIEAIRGLRTSLHFAMMEARNNIL MISGASPNAGKTFVSSNLAAIISQ TGKKVLFLDADLRKGYTHKLFNVS NENGLSDYLAGKVDIKNCVKQIKT AGFDFISRGMVPPNPAELLMHSRF QNLLSWASDNYDLVIVDTPPILAV TDAAIIGNYAGTTLLVARF | YASIPVSETFAKNITKGLKSNKKKSLEYD EFLAIQNPADLAIEAIRGLRTSLHFAMME ARNNILMISGASPNAGKTFVSSNLAAIIS QTGKKVLFLDADLRKGYTHKLFNVSNENG LSDYLAGKVDIKNCVKQIKTAGFDFISRG MVPPNPAELLMHSRFQNLLSWASDNYDLV IVDTPPILAVTDAAIIGNYAGTTLLVARF EQNTVKEIEVSAKRFEQSGVMIKGCILNG VVKKASSYYGYGYSHYGYSYSNKE |
| Mcoc_5C_7 (MCoc5c) | LPS (wcaJ or wbaP) | MSRLARNFWTSILLAISDFTGFTV AIVFAIFFVKSFMNDGGHIIANSN INDWVILHTCLGICCVAWYSIRLR HYFYRKTFWFELKEILRTLVIFAI IEIAVLSFAYWDFSRYILAVTWIF VLFFVPTFRMLTKKCLNFFWIMEA | MSRLARNFWTSILLAISDFTGFTVAIVFA IFFVKSFMNDGGHIIANSNINDWVILHTC LGICCVAWYSIRLRHYFYRKTFWFELKEI LRTLVIFAIIEIAVLSFAYWDFSRYILAV TWIFVLFFVPTFRMLTKKCLNFFGLWKRE TIIIGDNNAVEAWKAINSESNLGFNVTS FVSSTSKDHLKNHINDIPVISLNPKEVTK HFDKRTQFIVALETSESSIRNDWLREFLI NGFRYVSVIPTLRGVPLDSTDMSFIFSHE VMIFRVQQNLAKLSSRILKRLFDIIGSLT IILVSSPLLIYIALKVKKDHGPAIYGHER IGNGGRPFKCLKFRSMVVNSKEVLEQLLN TDPAARKEWDATFKLKDDPRITDIGKFLR KTSLDELPQLFNVLKGEMSLVGPRPIITA ELERYSDEVDYYLLSKPGMTGLWQVSGRS DVDYETRVYLDAWYVKNWSMWNDIAILFK TISVVLRKDGAY |
| 1.2-3b_2 27_S99 (1.2-3b) | LPS (mfpsA) | MNGMYSIDSINEIKKSWGDILPQE EMFIFSAAGPTALRDCENHPRSVA ATLARELAIANINPDVVFIINFYE GFDDSYTVSIPQTTVPWKTVCVCH DLIPLLNKERYLGEPNFRQYYYDK LAQYERADAIFAISRSSMQEVIDY TSIPAEKIINISSGVSDSFKIKDY THDEIKDLRNKYHLPQEFILSLAM IEPRKNIEALIHAYSLLPHALQQS YPLVLAYKISTDEKERLYRVAENY GLSRNQLIFTGFLNDSDLIALYNL CKIFVFPSIHEGFGLPPLEAMRCG AATLGSNVTSLPEVIGMEEALFNP LDVPDICRVMQRALTDSEFYSALK AHAPAQAAKFTWDHTAQLALKGFE RLVDKASASEPLDITSFTAHTINR IKNIAELSETERLQTAWAIARNSF ATHQRKLLVDISVLVEHDAKTGIQ RVSRSILSELLKSGVAGYTVSAVY YRPGECYRYANEYLNTHFNGAFGP DVPVLFTKDDILVATDLTAHLFPE LTVQLDFIRLSGAKVCFVVHDILP LRRPEWSDEGMQRVFPIWLSCIAQ HADRLICVSASVAEDVKAWIAENS HWVKPNPLLTVSNFHLGADLDASV PSTGMPDNA | MNGMYSIDSINEIKKSWGDILPQEEMFIF SAAGPTALRDCENHPRSVAATLARELAIA NINPDVVFIINFYEGFDDSYTVSIPQTTV PWKTVCVCHDLIPLLNKERYLGEPNFRQY YYDKLAQYERADAIFAISRSSMQEVIDYT SIPAEKIINISSGVSDSFKIKDYTHDEIK DLRNKYHLPQEFILSLAMIEPRKNIEALI HAYSLLPHALQQSYPLVLAYKISTDEKER LYRVAENYGLSRNQLIFTGFLNDSDLIAL YNLCKIFVFPSIHEGFGLPPLEAMRCGAA TLGSNVTSLPEVIGMEEALFNPLDVPDIC RVMQRALTDSEFYSALKAHAPAQAAKFTW DHTAQLALKGFERLVDKASASEPLDITSF TAHTINRIKNIAELSETERLQTAWAIARN SFATHQRKLLVDISVLVEHDAKTGIQRVS RSILSELLKSGVAGYTVSAVYYRPGECYR YANEYLNTHFNGAFGPDVPVLFTKDDILV ATDLTAHLFPELTVQLDFIRLSGAKVCFV VHDILPLRRPEWSDEGMQRVFPIWLSCIA QHADRLICVSASVAEDVKAWIAENSHWVK PNPLLTVSNFHLGADLDASVPSTGMPDNA QALLAAMAAAPSFIMVGTMEPRKGHAQTL AAFEELWLQGKNYNLFIIGKQGWHVDDLC ERLRHHPQLNKKLFWLQNISDEFLTKLYS QSSALIFASLGEGFGLPLIEAAQKKLPVI IRDIPVFKEIAQEHAWYFSGEAPSDIAKA VEDWLALYEQNAHPRSENINWLTWKQSAE FLLKNLPIIAPAAKQ |
| 1.2-3b_8 29_S101 (1.2-3b) | LPS (wecA) | MNLLTAITELISIFLFTTLFIFVA RKVAKKIGLVDKPNYRKRHQGLIP LVGGISVYAGICFTAIADYYIPH ASLYLACAGVLVLVGALDDRFDIS VKIRAVIQAAIAVIMMMAGNLHLS SLGFIFGSWELVLGPFGFFLTLFA VWAAINAFNMVDGIDGLLGGLSSV SFAATGIILWFDGQYSLAMWCFAM IAAILPYILLNLGALGRRYKVFMG | MNLLTAITELISIFLFTTLFIFVARKVAK KIGLVDKPNYRKRHQGLIPLVGGISVYAG ICFTAIADYYIPHASLYLACAGVLVLVG ALDDRFDISVKIRAVIQAAIAVIMMMAGN LHLSSLGFIFGSWELVLGPFGFFLTLFAV WAAINAFNMVDGIDGLLGGLSSVSFAATG IILWFDGQYSLAMWCFAMIAAILPYILLN LGALGRRYKVFMGDAGSTMIGFTIIWILL ETTQGKTHPISPVTALWIIAIPLMDMVAI |

TABLE 3-continued

| Bacterial strain (phage to which developed resistance) | Mechanism or Bacterial Surface Component (gene) | Mutant sequence | Original sequence |
|---|---|---|---|
| | | DAGSTMIGFTIIWILLETTQGKTH PISPVTALWIIAIPLMDMVAIMYR RLRKGMSPFSPDRQHIHHLIMRAG FTSRQAFVLITLAASPAGAGWRRG GIHPHCAGMGDVNSLFGSLLSLWL LY | MYRRLRKGMSPFSPDRQHIHHLIMRAGFT SRQAFVLITLAAALLALVGVVAETYRIVP EWVMLILFLVAFFLYGYCIKRAWKVARLV KRIRRRIRRHSGNNPKLTK |
| 1.2-3b_7 12_S84 (1.2-3b) | Iron uptake (fhuA) | MARPKTAQPNHSLRKVAAVVATAV SGMSVYAQAAEQPKQEETITVVAA PAAQESAWGPAPTIAAKRSATATK TDTPIEKTPQSVSVVTRQEMEMRQ PTTVKEALSYTPSVFSTRGSSTTY DVVTIRGFTTSTTVNTNQYLDGMK LQGNNYSEVSMDPYFLERVEVMRG PTSVLYGNSNPGGIVSMVSKRPTT EPLKEVQFKMGTDNLWQTGFDFSD AIDDAGVWSYRLTGLGRSQDAQQQ MAKSTRYAVAPSFSWRPDDKTDFT FLSNFQNDPDAGYYGWLPREGTVV PYYDANGKAHKLPTDFNEGESDNK ISRRQKMVGYSFSHQFDDTFTVRQ NLRYADVHTLYRSVYGNGYVAPGY MNRAYVRSDEHLNTFRYPAAV | MARPKTAQPNHSLRKVAAVVATAVSGMSV YAQAAEQPKQEETITVVAAPAAQESAWGP APTIAAKRSATATKTDTPIEKTPQSVSVV TRQEMEMRQPTTVKEALSYTPSVFSTRGS STTYDVVTIRGFTTSTTVNTNQYLDGMKL QGNNYSEVSMDPYFLERVEVMRGPTSVLY GNSNPGGIVSMVSKRPTTEPLKEVQFKMG TDNLWQTGFDFSDAIDDAGVWSYRLTGLG RSQDAQQQMAKSTRYAVAPSFSWRPDDKT DFTFLSNFQNDPDAGYYGWLPREGTVVPY YDANGKAHKLPTDFNEGESDNKISRRQKM VGYSFSHQFDDTFTVRQNLRYADVHTLYR SVYGNGYVAPGYMNRAYVRSDEHLNTFTV DTQLQSDFATGAVSHTLLTGVDYSRMRND VDADYGTADPISMSNPQYGNPNIQVTFPY AVLNRMEQTGLYAQDQMEWDKWVMTLGGR YDYATTSTLTRATNSLAENHDQQFSWRGG INYLFDNGISPYFSYSESFEPVSGSNSRG QPFDPSRGKQYEAGVKYVPKDMPVVTAA VYQLTKDKNLTADPANQAFSIQTGEIRSR GLELEAKAAVNANINVTAAYSYTDAEYTH DTVFNGKRPAEVPRNMASLWADYTFHETA LSGLTIGAGARYIGSTVSYYKNDTSTGKK NDAFSVAGYALMDATVKYDLARFGLPGSS VGVNVNNLFDREYVSSCYSEYACYWGAGR QVVATATFRF |
| | LPS (wecA) | MNLLTAITELISIFLFTTLFIFVA RKVAKKIGLVDKPNYRKRHQGLIP LVGGISVYAGICFTFAIADYYIPH ASLYLACAGVLVLVGALDDRFDIS VKIRAVIQAAIAVIMMMAGNLHLS SLGFIFGSWELVLGPFGFFLTLFA VWAAINAFNMVDGIDGLLGGLSSV SFAATGIILWFDGQYSLAMWCFAM IAAILPYILLNLGALGRRYKVFMG DAGSTMIGFTIIWILLETTQGKTH PISPVTALWIIAIPLMDMVAIMYR RLRKGMSPFSPDRQHIHHLIMRAG FTSRQAFVLITLAASPAGAGWRRG GIHPHCAGMGDVNSLFGSLLSLWL LY | MNLLTAITELISIFLFTTLFIFVARKVAK KIGLVDKPNYRKRHQGLIPLVGGISVYAG ICFTFAIADYYIPHASLYLACAGVLVLVG ALDDRFDISVKIRAVIQAAIAVIMMMAGN LHLSSLGFIFGSWELVLGPFGFFLTLFAV WAAINAFNMVDGIDGLLGGLSSVSFAATG IILWFDGQYSLAMWCFAMIAAILPYILLN LGALGRRYKVFMGDAGSTMIGFTIIWILL ETTQGKTHPISPVTALWIIAIPLMDMVAI MYRRLRKGMSPFSPDRQHIHHLIMRAGFT SRQAFVLITLAAALLALVGVVAETYRIVP EWVMLILFLVAFFLYGYCIKRAWKVARLV KRIRRRIRRHSGNNPKLTK |
| 8M1_1 (8M-1) | Iron uptake (fepA) | MNNRIKSLALLVNLGIYGVAFPLS AAETATDDKNSAAEETMVVTAAEQ NLQAPGVSTITADEIRKRPPARDV SEIIRTMPGVNLTGNSTSGQRGNN RQIDIRGMGPENTLILIDGKPVTS RNSVRLGWRGERDTRGDTSWVPPE IIERIEVIRGPAAARYGNGAAGGV VNIITKKTGDEWRGSWNTYMNAPE HKDEGSTKRTNFSLSGPLGGDFSF RLFGNLDKTQADAWDINQGHQSER TGIYADTLPAGREGVKNKNIDGLV RWEFAPMQSLEFEAGYSRQGNLYA GDTQNTNSNDLVKENYGKETNRLY RNTYSVTWNGAWDNGVTTSNWAQY ERTRNSRKGEGLAGGTEGIFNSNQ FTDIDLADVMLHSEVSIPFDYLVN QNLTGSEWNQQRMKDNASNTQAL SGGEIPGYDSTGRSPYSQAEIFSL FAENNMELTDTTMLTPALRFDHHS IVGNNWSPSLNLSQGLWDDFTLKM GIARAYKAPSLYQTNPNYILYSKG QGCYASKDGCYLQGNDDLKAETSI NKEIGLEFKRDGWLAGVTWFRNDY RNKIEAGYAPVYQNNKGTDLYQWE NVPKAVVEGLEGTLNVPVSETVNW | MNNRIKSLALLVNLGIYGVAFPLSAAETA TDDKNSAAEETMVVTAAEQNLQAPGVSTI TADEIRKRPPARDVSEIIRTMPGVNLTGN STSGQRGNNRQIDIRGMGPENTLILIDGK PVTSRNSVRLGWRGERDTRGDTSWVPPEI IERIEVIRGPAAARYGNGAAGGVVNIITK KTGDEWRGSWNTYMNAPEHKDEGSTKRTN FSLSGPLGGDFSFRLFGNLDKTQADAWDI NQGHQSERTGIYADTLPAGREGVKNKNID GLVRWEFAPMQSLEFEAGYSRQGNLYAGD TQNTNSNDLVKENYGKETNRLYRNTYSVT WNGAWDNGVTTSNWAQYERTRNSRKGEGL AGGTEGIFNSNQFTDIDLADVMLHSEVSI PFDYLVNQNLTGSEWNQQRMKDNASNTQ ALSGGEIPGYDSTGRSPYSQAEIFSLFAE NNMELTDTTMLTPALRFDHHSIVGNNWSP SLNLSQGLWDDFTLKMGIARAYKAPSLYQ TNPNYILYSKGQGCYASKDGCYLQGNDDL KAETSINKEIGLEFKRDGWLAGVTWFRND YRNKIEAGYAPVYQNNKGTDLYQWENVPK AVVEGLEGTLNVPVSETVNWTNNITYMLQ SKNKETGDRLSIIPEYTLNSTLSWQVRDD VSLQSTFTWYGKQEPKKYNYKGQPVTGSE KNEVSPYSILGLSATWDVTKYVSLTGGVD NVFDKRHWRAGNAQTTGGATGTMYAGAE |

TABLE 3-continued

| Bacterial strain (phage to which developed resistance) | Mechanism or Bacterial Surface Component (gene) | Mutant sequence | Original sequence |
|---|---|---|---|
| | | TNNITYMLQSKNKETGDRLSIIPE YTLNSTLSWQVRDDVSLQSTFTWY GKQEPKKYNYKGQPVTGSEKNDG | TYNESGRTWYLSVNTHF |
| 8M1_6 (8M-1) | Cobalamin uptake (tonB)- | MTLDLPRRFPWPTLLSVAIHGAVV AGLLYTSVHQVIEQPSPTQPIEIT MVAPADLEPPPAAQPVVEPVVEPE PEPEPEVVEPPPKEAPVVIHKPEP KPKPKPKPKLSLSRRKRLNSRSGK | MTLDLPRRFPWPTLLSVAIHGAVVAGLLY TSVHQVIEQPSPTQPIEITMVAPADLEPP PAAQPVVEPVVEPEPEPEPEVVEPPPKEA PVVIHKPEPKPKPKPKPKPKPKPEKKVEQ PKREVKPAAEPRPASPFENNNTAPARTAP STSTAAAKPTVTAPSGPRAISRVQPSYPA RAQALRIEGTVRVKFDVSPDGRIDNLQIL SAQPANMFEREVKSAMRRWRYEQGRPGTG VTMTIKFRLNGVEIN |
| | maltose and maltodextrin transport (LamB)- | VLSHTNDDSGVNKVILRYSDNSDN SVYNKTDALTTVYASFEGSHKFTQ QAQIEYLLAFHDYDNGKDNTDNRK NYGAIVRPMYFWNDVHSTWLEAGY QRVDYDQGG | VLSHTNDDSGVNKVILRYSDNSDNSVYNK TDDLTTVYASFEGSHKFTQQAQIEYLLAF HDYDNGKDNTDNRKNYGAIVRPMYFWNDV HSTWLEAGYQRVDYDQGG |
| 1.2-2_2 20_S92 (1.2-2) | LPS (HBAD) | MSNRLSVVMIAKNAADLLPDCLDS VSWADEIIVLDSGSTDSTVELARR LGAQVYTHTDWRGYGIQRQRAQDY ATGDWVLMIDTDERVTPELRQAIL KVLDAPQRGAIYSIACRNYFLGRF MRHSGWYPDRVLRLYERARYRYND NLVHESLDSLGAEVIPLTGDLLHL TCRDFAGFQQKQLAYAAAWALERH QKGKKTSMAGIFSHTLGAFLKTLL LRGGVLDGKQGWLLAMVNAQYTFT KYTELWALSHGYSEKESS | MSNRLSVVMIAKNAADLLPDCLDSVSWAD EIIVLDSGSTDSTVELARRLGAQVYTHTD WRGYGIQRQRAQDYATGDWVLMIDTDERV TPELRQAILKVLDAPQRGAIYSIARRNYF LGRFMRHSGWYPDRVLRLYERARYRYNDN LVHESLDSLGAEVIPLTGDLLHLTCRDFA GFQQKQLAYAAAWALERHQKGKKTSMAGI FSHTLGAFLKTLLLRGGVLDGKQGWLLAM VNAQYTFTKYTELWALSHGYSEKESS |
| 1.2-2 21 or 22 (1.2-2) | LPS (HBAD) | MSNRLSVVMIAKNAADLLPDCLDS VSWADEIIVLDSGSTDSTVELARR LGAQVYTHTDWRGYGIQRQRAQDY ATGDWVLMIDTDERVTPELRQAIL KVLDAPQRGAIYSIACRNYFLGRF MRHSGWYPDRVLRLYERARYRYND NLVHESLDSLGAEVIPLTGDLLHL TCRDFAGFQQKQLAYAAAWALERH QKGKKTSMAGIFSHTLGAFLKTLL LRGGVLDGKQGWLLAMVNAQYTFT KYTELWALSHGYSEKESS | MSNRLSVVMIAKNAADLLPDCLDSVSWAD EIIVLDSGSTDSTVELARRLGAQVYTHTD WRGYGIQRQRAQDYATGDWVLMIDTDERV TPELRQAILKVLDAPQRGAIYSIARRNYF LGRFMRHSGWYPDRVLRLYERARYRYNDN LVHESLDSLGAEVIPLTGDLLHLTCRDFA GFQQKQLAYAAAWALERHQKGKKTSMAGI FSHTLGAFLKTLLLRGGVLDGKQGWLLAM VNAQYTFTKYTELWALSHGYSEKESS |
| 1.2-3S_6 (1.2-3s) | LPS (IpxM) | MKKNNIEFIPKFEKSFLLPRYWGA WLGVFAFAGIALTPPSFRDPLLGK LGRLVGRLAKSSRRRAQINLLYCF PEKSEYEREAIIDAMYASAPQAMV MMAELGLRDPQKILARVDWQGKAI IDEMQRNNEKVIFLVPHAWGVDIP AMLMASGGQKMAAMFHNQGNPVFD YVWNTVRRRFGGRMHARNDGIKPF IQSVRQGYWGYYLPDQDHGAEHSE FVDFFATYKATLPAIGRLMKVCRP RVVPLFPVYDGKTHRLTVLRPPM DDLLDADDTTIARRMNEEVEVFVK PHTEQYTWILKLLKTRKPGEIEPY KRKELFPKKK | MKKNNIEFIPKFEKSFLLPRYWGAWLGVF AFAGIALTPPSFRDPLLGKLGRLVGRLAK SSRRRAQINLLYCFPEKSEYEREAIIDAM YASAPQAMVMMAELGLRDPQKILARVDWQ GKAIIDEMQRNNEKVIFLVPHAWGVDIPA MLMASGGQKMAAMFHNQGNPVFDYVWNTV RRRFGGRMHARNDGIKPFIQSVRQGYWGY YLPDQDHGAEHSEFVDFFATYKATLPAIG RLMKVCRARVVPLFPVYDGKTHRLTVLVR PPMDDLLDADDTTIARRMNEEVEVFVKPH TEQYTWILKLLKTRKPGEIEPYKRKELFP KKK |
| 1.2-3s 24 (1.2-3s) | LPS (wcaJ or wbaP) | deletion mutation- no proteins | MSRLARNFWTSILLAISDFTGFTVAIVFA IFFVKSFMNDGGHIIANSNINDWVILHTC LGICCVAWYSIRLRHYFYRKTFWFELKEI LRTLVIFAIIEIAVLSFAYWDFSRYILAV TWIFVLFFVPTFRMLTKKCLNFFGLWKRE TIIIGDGNNAVEAWKAINSESNLGFNVTS FVSSTSKDHLKNHINDIPVISLNPKEVTK HFDKRTQFIVALETSESSIRNDWLREFLI NGFRYVSVIPTLRGVPLDSTDMSFIFSHE VMIFRVQQNLAKLSSRILKRLFDIIGSLT IILVSSPL / MSNTNANFEMTGILLGQEARKRKTPQEKI AIIQQTMEPGMNVSHVARLHGIQPSLLFK WKKQYQEGSLTAVAAGEEVVPASELTAAL KQVRELQRLLGKKTMEVEILKEAVEYGQS RKWIAHAPLLPKDGE / |

TABLE 3-continued

| Bacterial strain (phage to which developed resistance) | Mechanism or Bacterial Surface Component (gene) | Mutant sequence | Original sequence |
|---|---|---|---|
| | | | MDSARALVAKGRGIALVSRTMGVSRAQLS LRINRSADWQDKRCNRRNDEADEEILSAI LDIISDMPSYGYRRVWGILRKQRRTEGQP PVNAKRLYRIMSEHNLLLLHDKPERPKRE HKGKIAVAESDMRWCSDGFEFGCDNGEKL RVTFALDCCDREAIDWAASTGGYDSSTVQ DVMLRSVEKRFGDRLPDTAVQWLTDNGSA YTAYETWRFARELNLEPCTTAVSSPQSNG MAERFVKTMKEDYIAFMPKPDVRTALRNL AVAFTHYNENHPHSALGYHSPREYRRQRT SLT |
| 1.2-3s 25 or 26 (1.2-3s) | Iron uptake (fhuA) | MARPKTAQPNHSLRKVAAVVATAV SGMSVYAQAAEQPKQEETITVVAA PAAQESAWGPAPTIAAKRSATATK TDTPIEKTPQSVSVVTRQEMEMRQ PTTVKEALSYTPSVFSTRGSSTTY DVVTIRGFTTSTTVNTNQYLDGMK LQGNNYSEVSMDPYFLERVEVMRG PTSVLYGNSNPGGIVSMVSKRPTT EPLKEVQFKMGTDNLWQTGFDFSD AIDDAGVWSYRLTGLGRSQDAQQQ MAKSTRYAVAPSFSWRPPLAGVRT IKPTSPS | MARPKTAQPNHSLRKVAAVVATAVSGMSV YAQAAEQPKQEETITVVAAPAAQESAWGP APTIAAKRSATATKTDTPIEKTPQSVSVV TRQEMEMRQPTTVKEALSYTPSVFSTRGS STTYDVVTIRGFTTSTTVNTNQYLDGMKL QGNNYSEVSMDPYFLERVEVMRGPTSVLY GNSNPGGIVSMVSKRPTTEPLKEVQFKMG TDNLWQTGFDFSDAIDDAGVWSYRLTGLG RSQDAQQQMAKSTRYAVAPSFSWRPDDKT DFTFLSNFQNDPDAGYYGWLPREGTVVPY YDANGKAHKLPTDFNEGESDNKISRRQKM VGYSFSHQFDDTFTVRQNLRYADVHTLYR SVYGNGYVAPGYMNRAYVRSDEHLNTFTV DTQLQSDFATGAVSHTLLTGVDYSRMRND VDADYGTADPISMSNPQYGNPNIQVTFPY AVLNRMEQTGLYAQDQMEWDKWVMTLGGR YDYATTSTLTRATNSLAENHDQQFSWRGG INYLFDNGISPYFSYSESFEPVSGSNSRG QPFDPSRGKQYEAGVKYVPKDMPVVVTAA VYQLTKDKNLTADPANQAFSIQTGEIRSR GLELEAKAAVNANINVTAAYSYTDAEYTH DTVFNGKRPAEVPRNMASLWADYTFHETA LSGLTIGAGARYIGSTVSYYKNDTSTGKK NDAFSVAGYALMDATVKYDLARFGLPGSS VGVNVNNLFDREYVSSCYSEYACYWGAGR QVVATATFRF |

Non-silent mutations with frequencies above 80% were analyzed, while mutations with a frequency between 20-80% were only analyzed if located outside a mutation hot-spot (e.g., area that shows large polymorphism in control samples grown without phage). Proteins carrying mutations of interest were profiled for their activity, pathway and relevance to known phage receptors as shown in Table 2. The sensitivity of the mutant bacteria to phage other than the phage to which they have developed resistance is shown in FIG. 14. FIG. 14 shows that bacterial mutants which developed resistance (R) to certain phage are sensitive to at least two other phage (S). Gray shaded boxes indicate resistance to the particular phage against which the bacterial mutant was raised. For example, Colon1_1 11_S83 and Colon1_1 38_S110 are resistant to and raised against colon1. Genomic modifications which affect phage infection (i.e., modifications found in a phage-resistant mutant bacteria that arose in a culture containing a specific phage capable of infecting a specific bacteria) are shown in Table 2.

Example 13: Comparative Host Range Analysis of all Phage

Host range analysis of all isolated phage was performed on different KP2 phage resistant mutants isolated as described above. In addition, the host range of phages was examined on all 14 KP2 clinical variants isolated from clinical stool samples as described in Example 1 in order to ascertain the ability of isolated phage to target clinical variants originating in different individuals. All KP2 clinical variants were found to be sensitive to plurality of the KP2 targeting phage and two patterns of sensitivity, represented by the phage sensitivities of KP2 clinical variants CT-123-1 and CT-141-1 were observed. Each of the phage were added (10 μL) to bacterial lawns of the different K. pneumoniae strains, in 48 well plates by drop assay. Plates were incubated for 2-3 hrs (37° C.) in aerobic conditions, after which plaques become visible on the bacterial lawns. Host range was carried out for each of the phage at a titer of $1\times10^6$ PFU/mL as determined on the original bacteria on which that phage was isolated. FIG. 1 shows the results of the host range analysis of bacteriophage isolated against wild-type KP2 bacteria, clinical KP2 variants and mutant KP2 bacteria resistant to infection by particular KP2 bacteriophage. "S" indicates susceptibility (10 plaques or more to full clearing) and "R" indicates resistance (less than 10 plaques) The results demonstrate that the infectivity pattern of phage largely follow their taxonomic classification. Thus, for example, all three phage classified as Myoviridae Tevenvirinae Kp15 have identical infectivity patterns on KP2, KP2 clinical variants and KP2 mutants as do all the eleven phage of the classification Podoviridae Autographvirinae T7virus. Among the 16 phage of the classification Myoviridae Tevenvirinae T4 virus, the infectivity pattern is identical on six hosts and only varies on one representative host. Among the ten phages of classification Podoviridae Autographivirinae Kp34virus, only 2 have a different infectivity pattern on two of the ten representative hosts. The only phage classified as Myoviridae Vequintavirineae Scivirus has a unique infectivity pattern. Two of the three Siphoviridae phage are also very similar in their infectivity pattern, differing only in their ability to target one of the seven bacterial hosts.

Example 14: Liquid Dynamic Behavior of Phage Combinations

A total of 12 phage were selected for compiling 10 phage cocktails for further characterization in liquid dynamics study. In this study, the rate of bacterial lysis and the time to appearance of resistant mutant bacteria, as reflected by alternations in the culture OD was examined. The 12 phage that were used are: M16-6c, M16-9a, KP2-5a, KP2-5-1, KP2-8a, KP2-8c, MCoc4c, MCoc5c, KP2-4c, 1.2-2, 1.2-3b, and colon1. The cocktails are set forth below:

| Cocktail number | Member phages | | | | |
|---|---|---|---|---|---|
| 30 | KP2-5a | Mcoc5c | KP2-8a | colon1 | 1.2-3b |
| 40 | KP2-5-1 | Mcoc4c | KP2-8c | colon1 | 1.2-3b |
| 50 | 1.2-2 | Mcoc5c | KP2-8a | colon1 | 1.2-3b |
| 16 | M16-9a | Mcoc4c | KP2-8c | colon1 | 1.2-3b |
| 52 | 1.2-2 | Mcoc4c | KP2-8c | colon1 | 1.2-3b |
| 49 | 1.2-2 | Mcoc4c | KP2-8a | colon1 | 1.2-3b |
| 54 | 1.2-2 | KP2-4c | KP2-8c | colon1 | 1.2-3b |
| 51 | 1.2-2 | KP2-4c | KP2-8a | colon1 | 1.2-3b |
| 10 | M16-6c | KP2-4c | KP2-8a | colon1 | 1.2-3b |
| 2 | M16-6c | Mcoc4c | KP2-8a | colon1 | 1.2-3b |

Liquid dynamics of the 10 cocktails was explored in the following manner. KP2 was grown at 37° C. with agitation to OD 1.5, diluted 1:1000 in BHIS medium and cultured at 37° C. with agitation. The culture OD was monitored until it reached OD 0.2 at which time MMC ions (1 mM final concentration) were added to the culture and 200 µl was dispensed per well in a 96 well plate. Each phage was diluted from the phage stock to $10^8$ PFU/mL and added to the desired cocktail at a final concentration of $10^6$ PFU/well. 10 µl of each cocktail ($10^4$ total phage particles) was added to the wells, in duplicates. BHIS media served as the blank sample and host bacteria without any phage served as control. 50p L of mineral oil was added to each well to limit evaporation of the sample, followed by a thin sterile optically transparent polyester film to keep the culture sterile. Plates were incubated overnight at 37° C. with agitation in a robotic plate reader (Freedom EVO 75, Tecan) and OD600 was measured every 15 minutes. The performance of the cocktails was followed for up till 20 hours.

Figure 9:
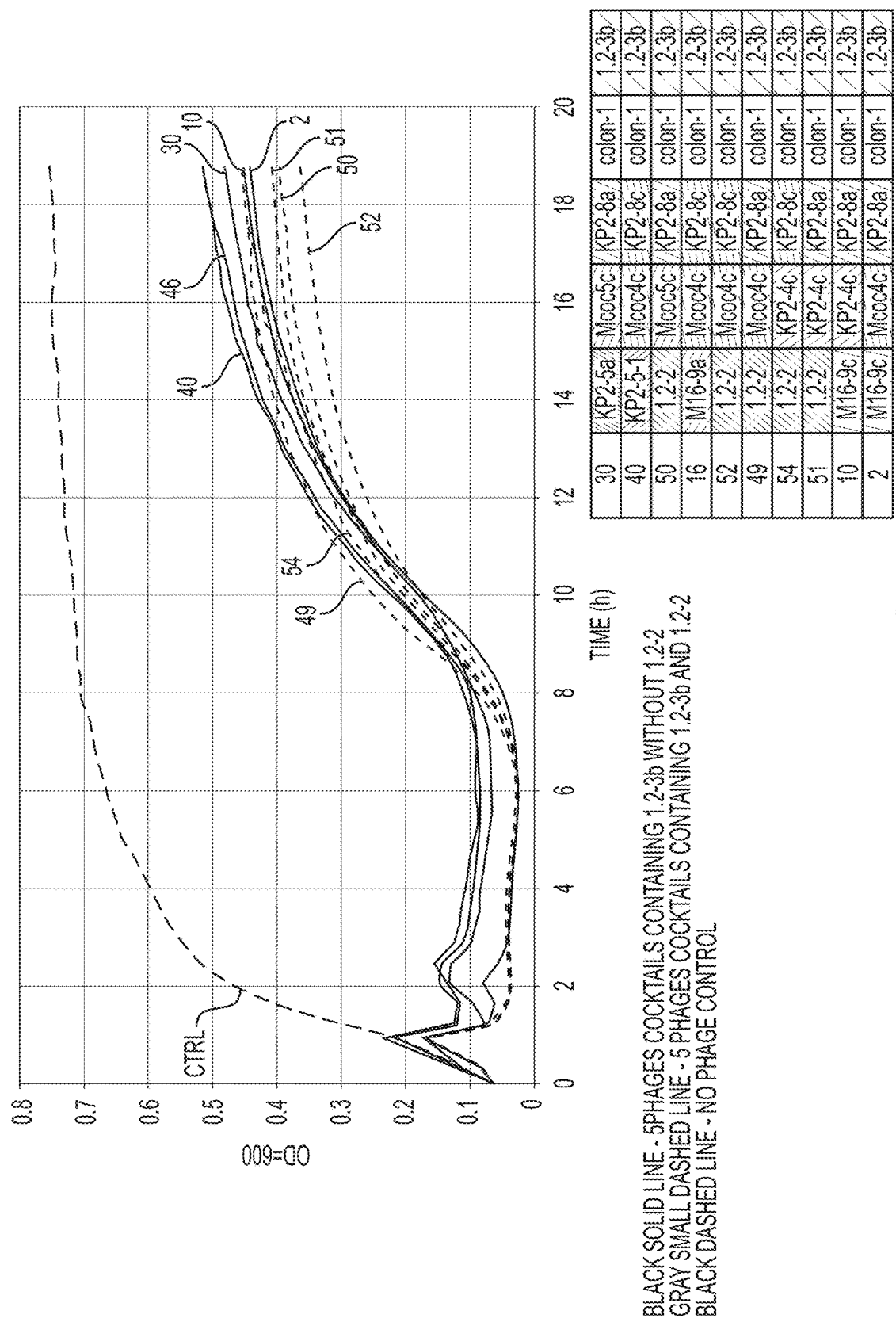
FIG. 9 presents growth curves of in vitro liquid infection of KP2 with bacteriophage compositions (cocktails): five-phage compositions without 1.2-2 (black solid line); five-phage compositions containing 1.2-2 (gray small dashed line); and control (no phage) (black dashed line), as further described in Example 14.

FIG. 9 presents growth curves of in vitro infection of KP2 with bacteriophage compositions (cocktails) all of which included phage 1.2-3b: five-phage compositions without 1.2-2 (black solid line); five-phage compositions containing 1.2-2 (gray small dashed line); and control (no phage; black dashed line). Most of the cocktail compositions that included 1.2-2 as well 1.2-3b appeared to bring about speedier and more complete collapse of the KP2 growth curve immediately after introduction and slower appearance of mutants beginning about 7 hours later as compared to most compositions that did not include phages 1.2-2. Additional cocktails were designed to examine the contribution of these phage to eradication dynamics in combination with phages from different taxonomic classifications.

The two phage, 1.2-2 (group Myoviridae/Tevenvirinae/Kp15virus) and 1.2-3b (group Podoviridae/Autographivirinae/T7virus) whose contribution to cocktail efficacy in vitro was discussed above, were combined in various combinations with representative phage from other taxonomic groups as shown below, to comprise cocktails for additional analysis. Table 4 shows phages included in the cocktails and their respective taxonomic classifications.

TABLE 4

| Group | Podoviridae/ Autographivirinae/ T7virus (PAT) | Podoviridae/ Autographivirinae/ Kp34virus (PAK) | Myoviridae/ Tevenvirinae/ T4virus (MTT) | Myoviridae/ Tevenvirinae/ Kp15virus (MTK) | Siphoviridae/ T5virus (ST) |
|---|---|---|---|---|---|
| Phage | 1.2-3b | Mcoc5c | colon1 | 1.2-2 | 1.2-3s |

Three and four phage cocktails were designed based on combinations involving members from different taxonomic classifications. All combinations included either both 1.2-2 and 1.2-3b or just 1.2-3b. The cocktails were:

| Cocktail name | Phage 1 | Phage 2 | Phage 3 | Phage 4 |
|---|---|---|---|---|
| 3.1 | 1.2-3b | 1.2-2 | 1.2-3s | |
| 3.2 | 1.2-3b | 1.2-2 | colon1 | |
| 3.3 | 1.2-3b | 1.2-2 | MCoc5c | |
| 3.4 | 1.2-3b | 1.2-3s | colon1 | |
| 3.5 | 1.2-3b | 1.2-3s | MCoc5c | |
| 3.6 | 1.2-3b | colon1 | MCoc5c | |
| 4.1 | 1.2-3b | 1.2-2 | 1.2-3s | colon1 |
| 4.2 | 1.2-3b | 1.2-2 | 1.2-3s | MCoc5c |
| 4.3 | 1.2-3b | 1.2-2 | colon1 | MCoc5c |
| 4.4 | 1.2-3b | 1.2-3s | colon1 | MCoc5c |

The corresponding group combinations are:

| Cocktail name | Group combination |
|---|---|
| 3.1 | PAT/MTK/ST |
| 3.2 | PAT/MTK/MTT |
| 3.3 | PAT/MTK/PAK |
| 3.4 | PAT/ST/MTT |
| 3.5 | PAT/ST/PAK |
| 3.6 | PAT/MTT/PAK |
| 4.1 | PAT/MTK/ST/MTT |
| 4.2 | PAT/MTK/ST/PAK |
| 4.3 | PAT/MTK/MTT/PAK |
| 4.4 | PAT/ST/MTT/PAK |

Figure 16A:
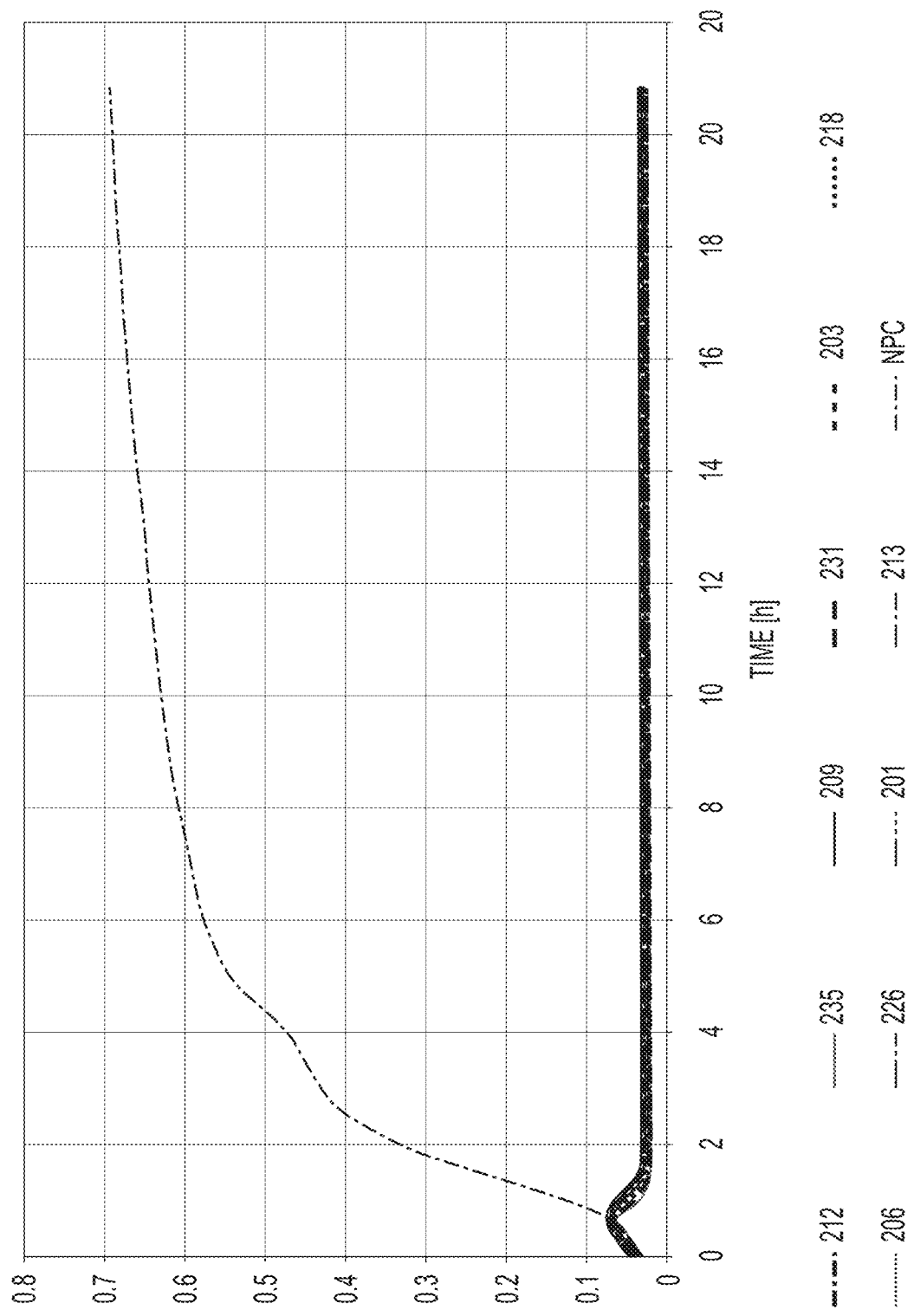
FIGS. 16a, 16b, 16c, 16d, 16e, 16f, 16g, 16h, 16i and 16j present growth curves of in vitro liquid infection of KP2 variants with different bacteriophage compositions (cocktails) as further specified in table 5 and non-phage control (NPC). Host bacteria used.
Figure 16B:
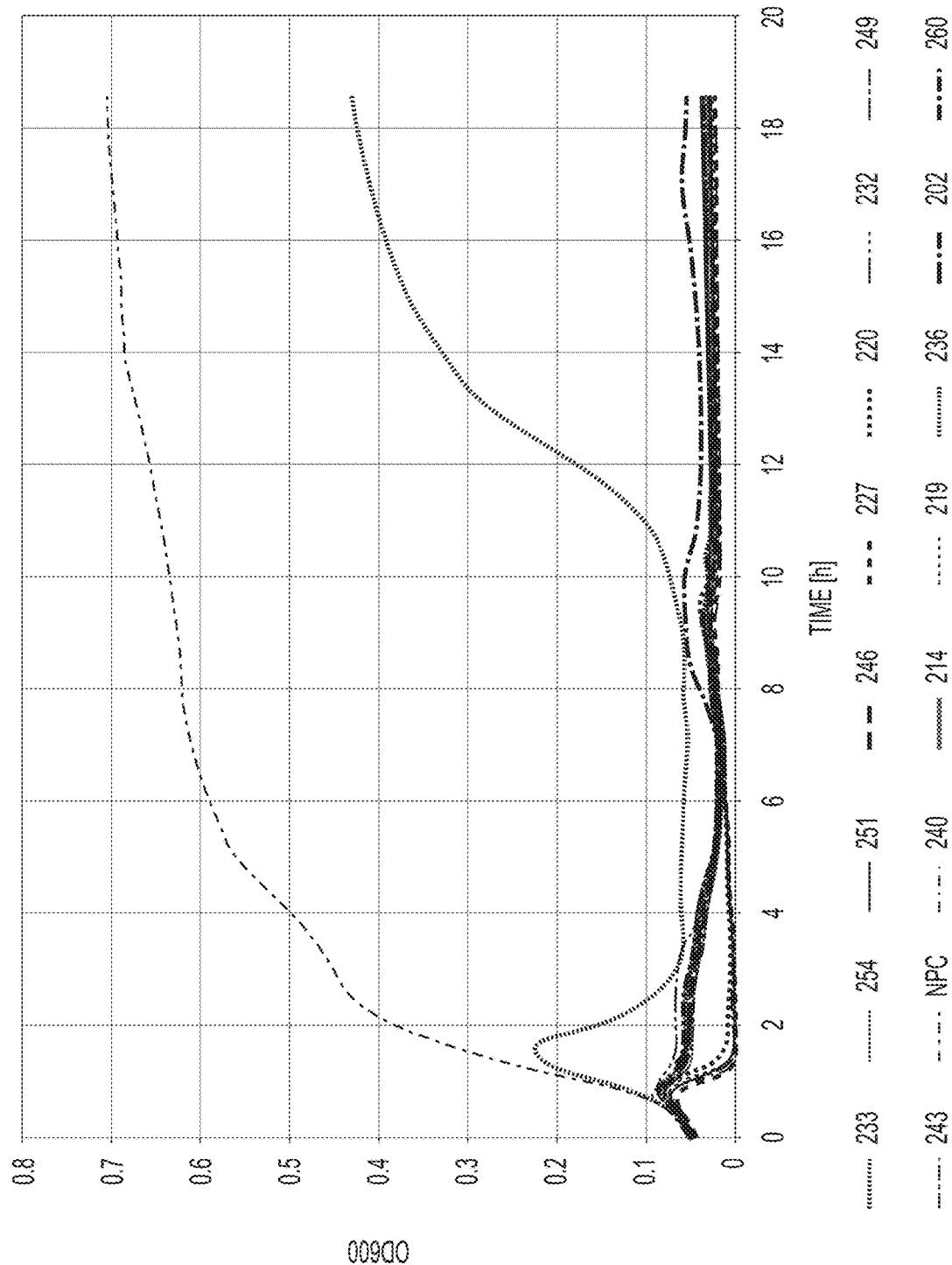
Figure 16C:
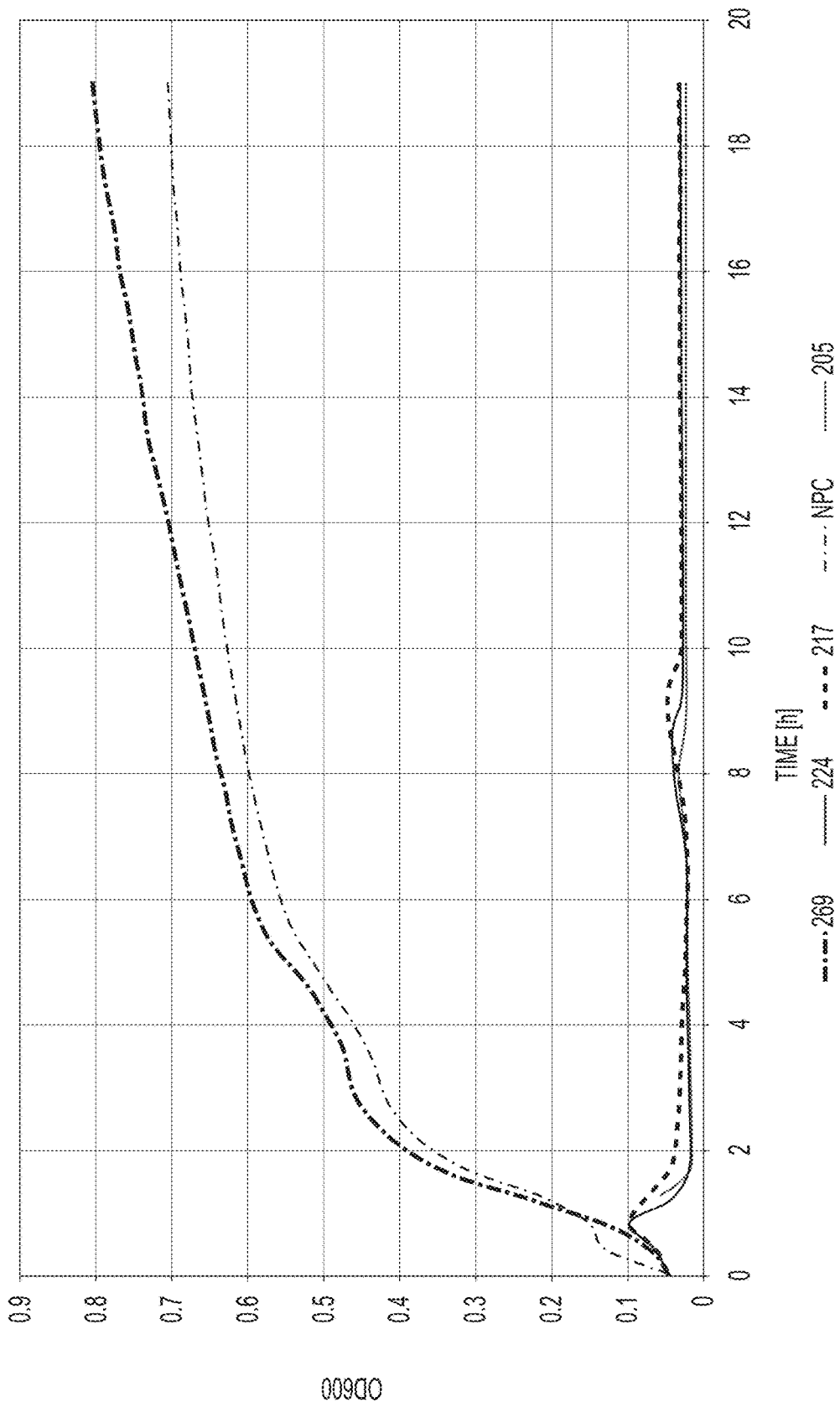
Figure 16D:
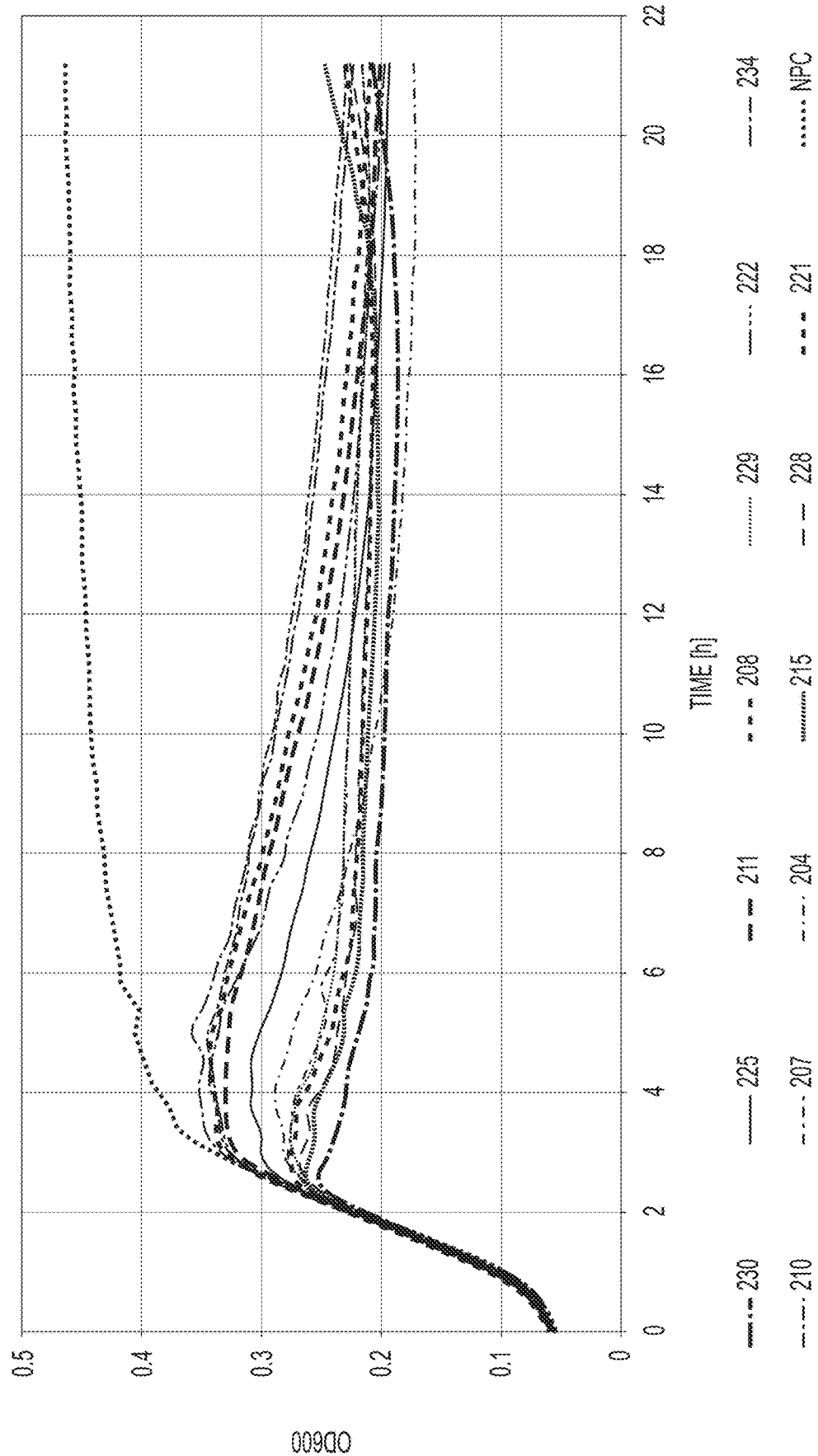
Figure 16E:
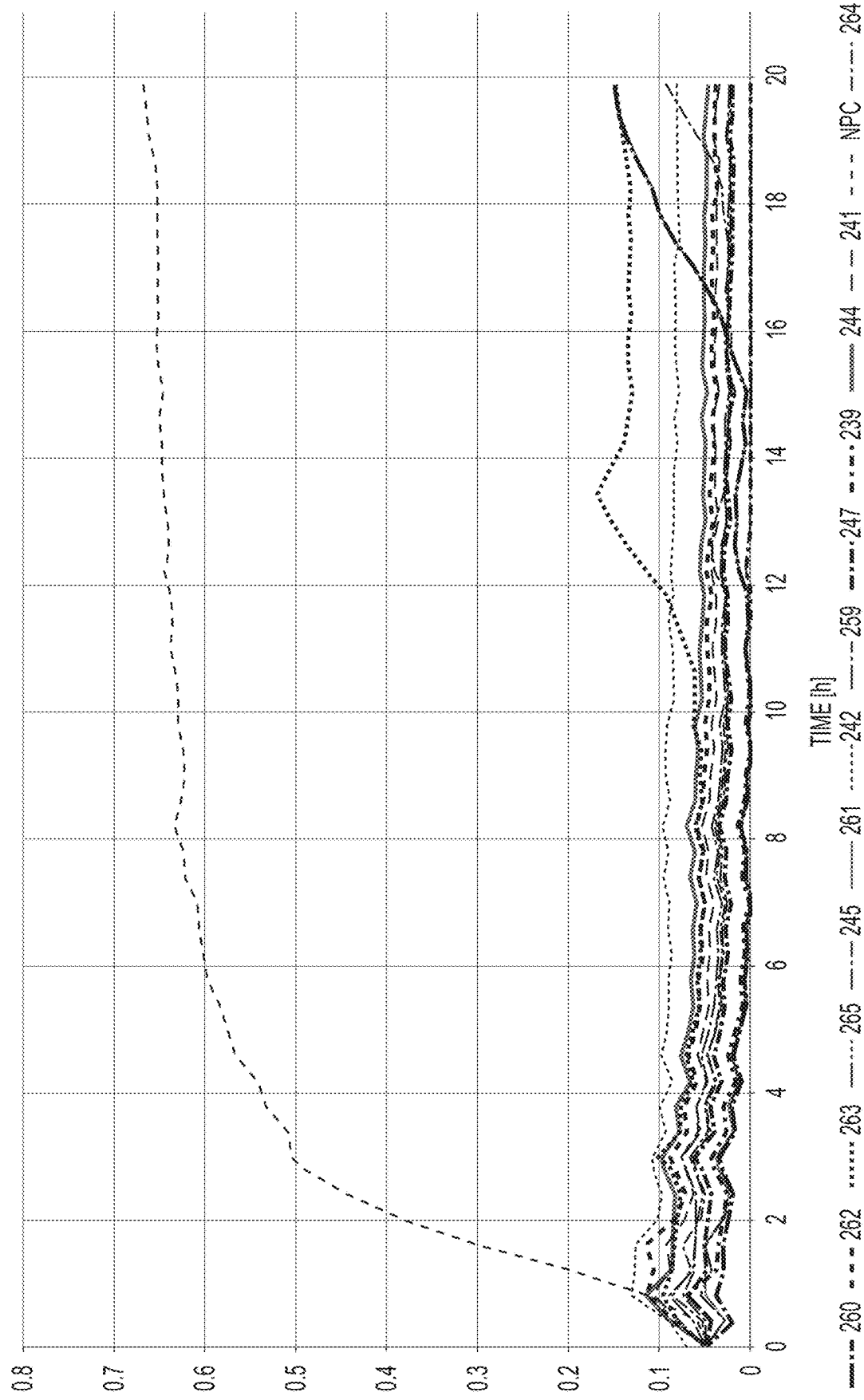
Figure 16F:
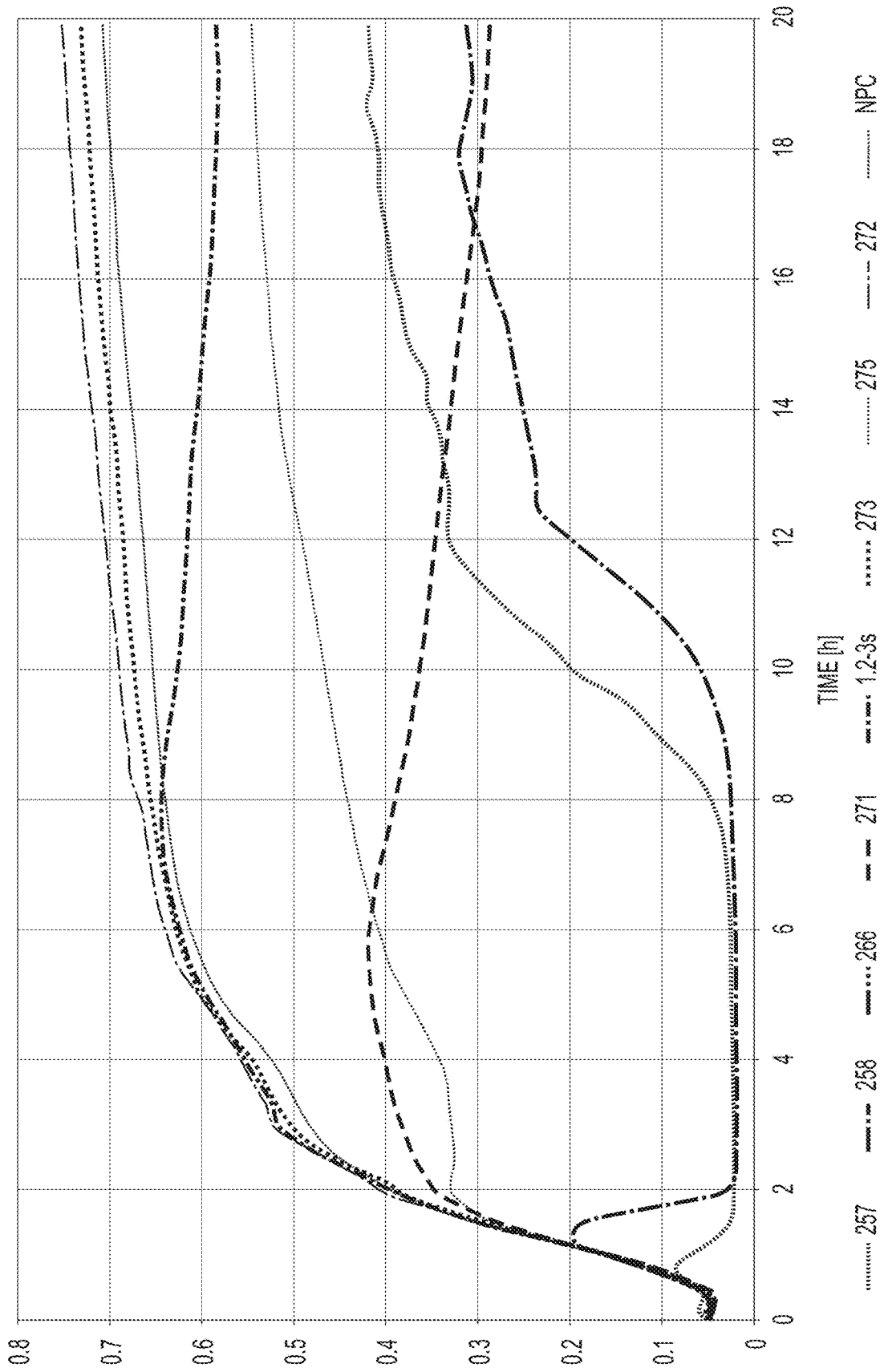
Figure 16G:
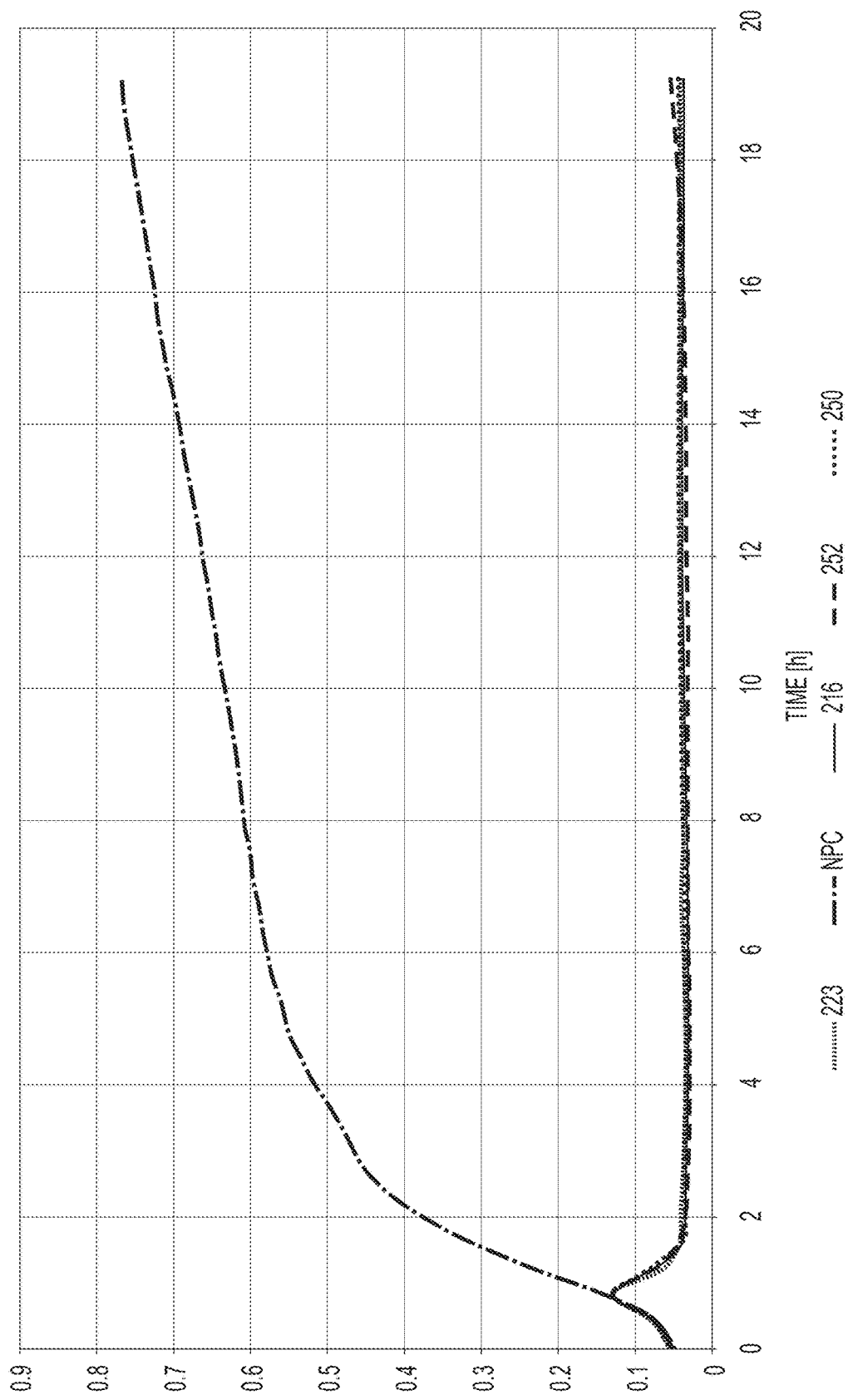
Figure 16H:
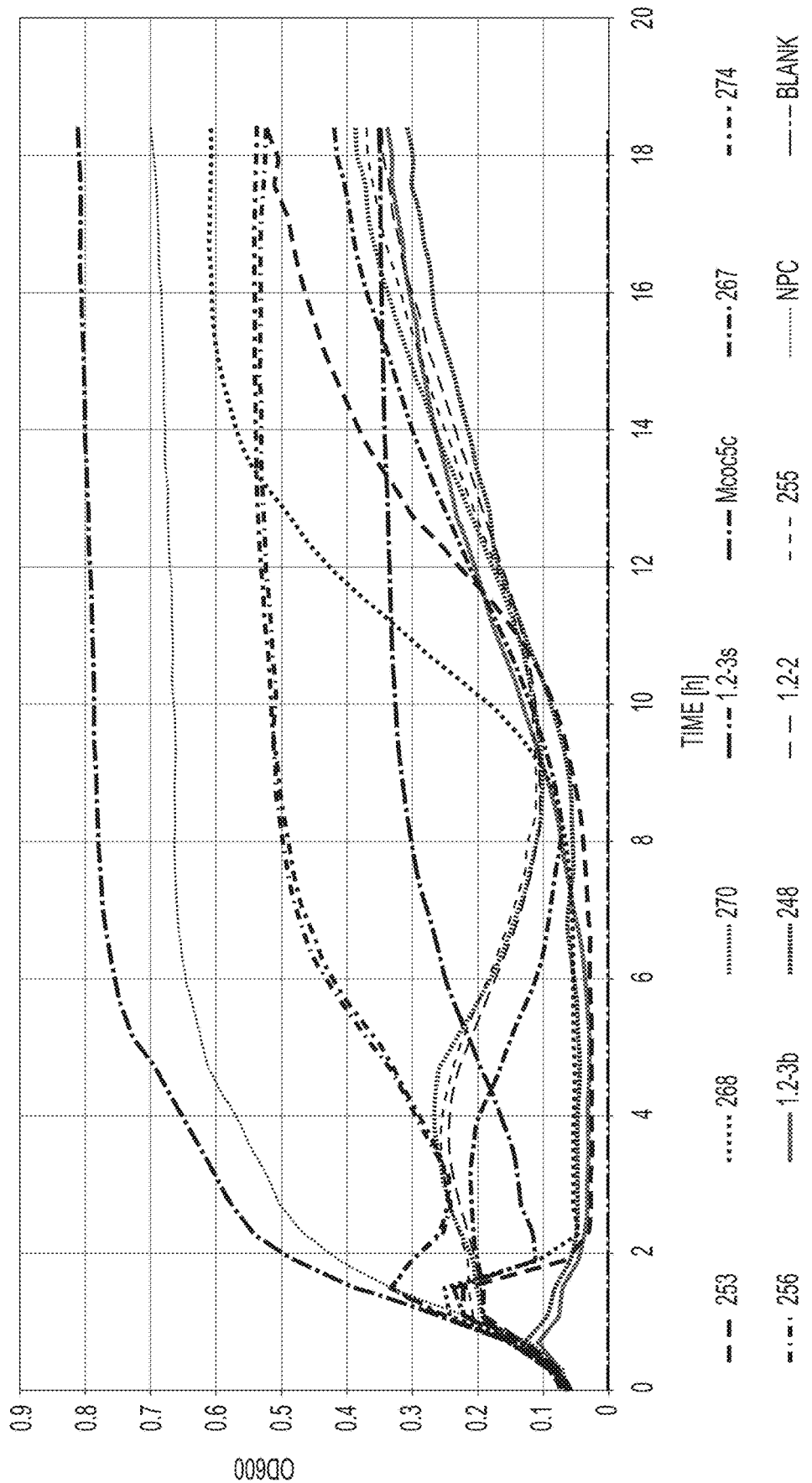
Figure 16I:
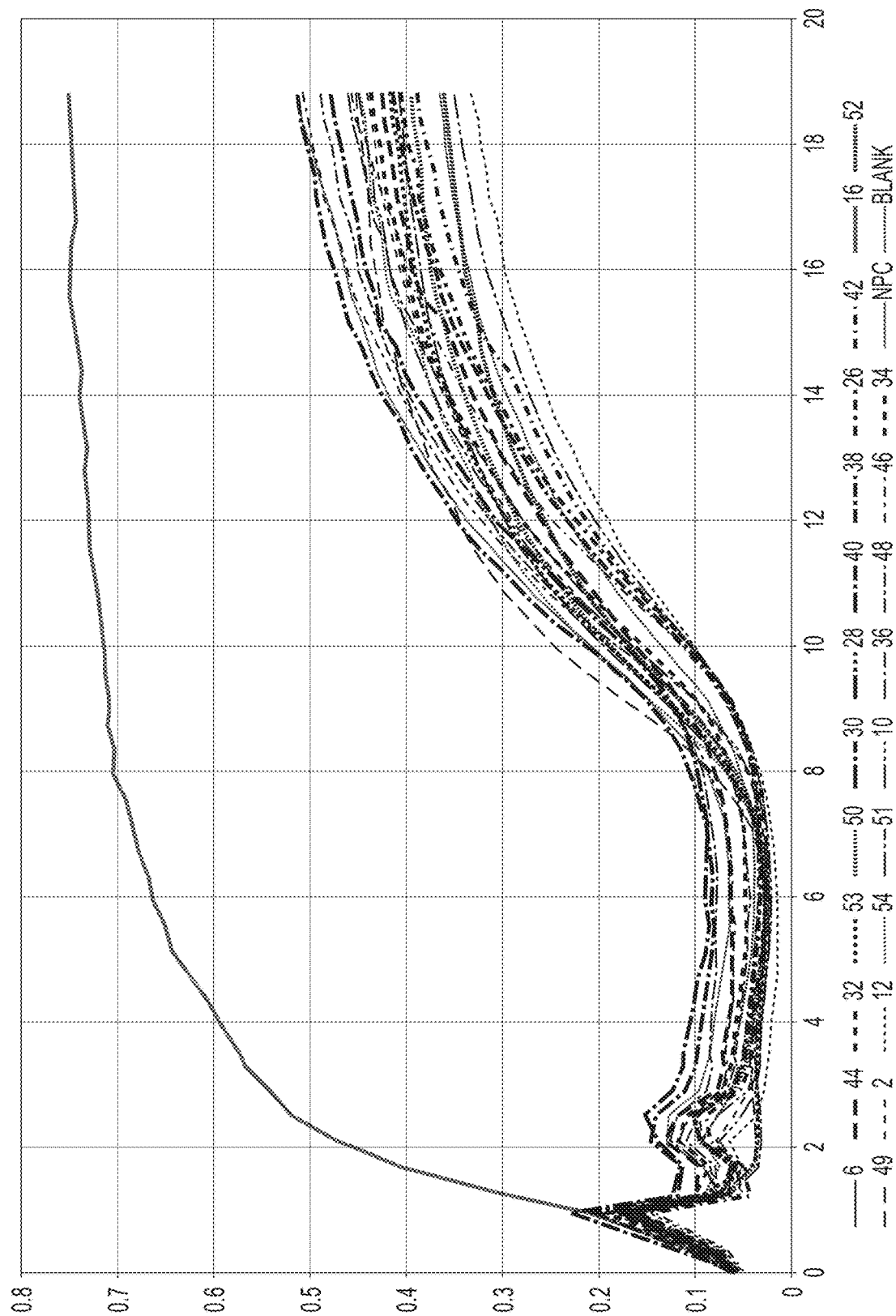
Figure 16J:
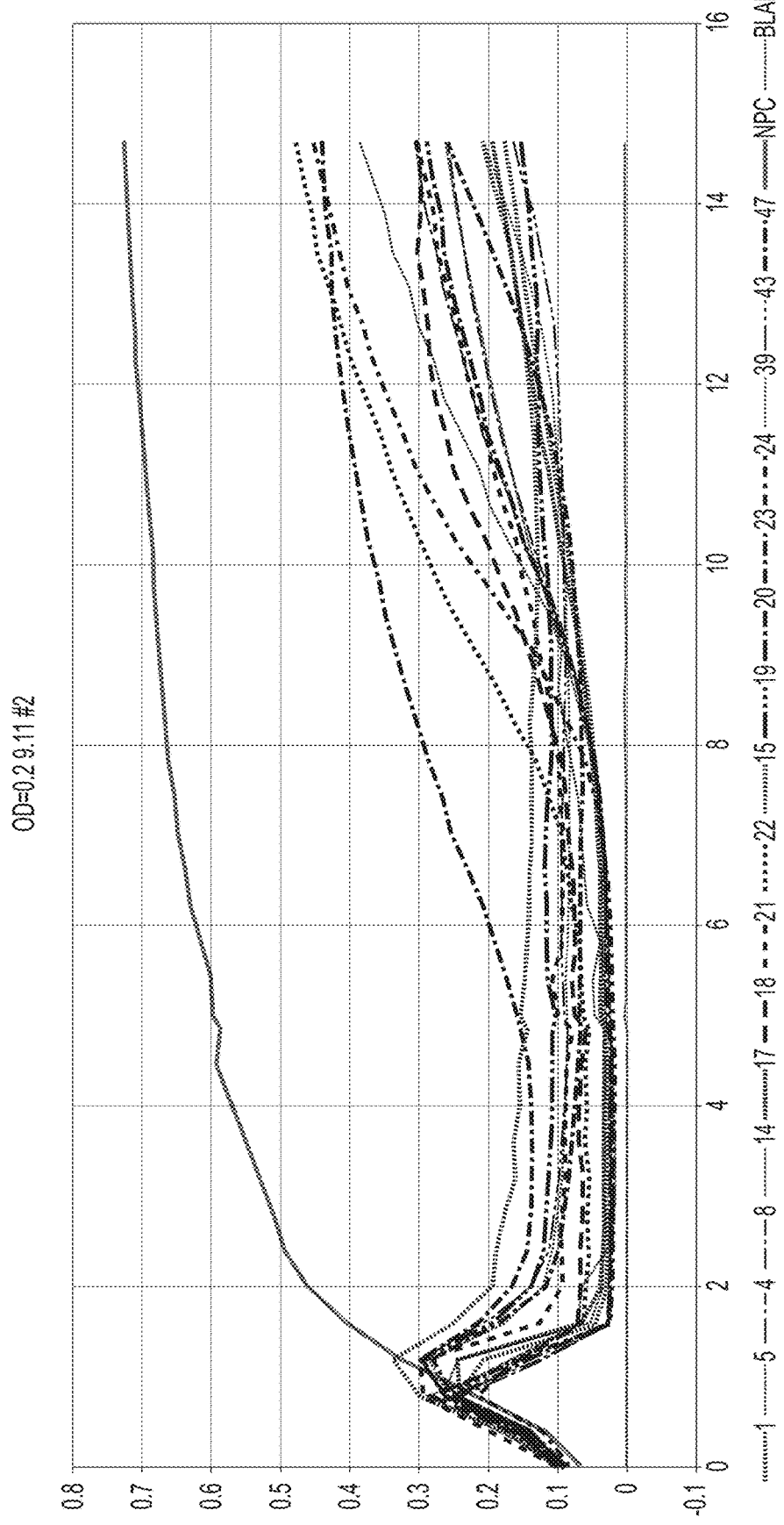

The results for various 3 and 4 phage cocktails are shown in FIG. 10 and FIG. 16e. FIG. 10 shows in vitro infection of KP2 with bacteriophage compositions containing 3 phage (black solid line) or 4 phage (gray dashed line) and no phage control (gray solid line) in liquid. The KP2 growth curve without phage treatment is represented by the solid gray line, KP2 growth curves with combinations of 3 phages are represented by the black solid lines, and KP2 growth curves with combinations of 4 phages are illustrated by the gray dashed lines.

The combination of the 3 phage cocktail composed of 1.2-3s, 1.2-3b, and 1.2-2 prevented the appearance of mutants up to 20 hours, until the end of the study (lowest black solid line).

Further studies were carried out to compare the efficacy of the three phage cocktail 3.1 described above to that of two additional cocktails. The three combinations that were tested were:

Composition 1: 1.2-2+1.2-3s+1.2-3b (groups: MTK/ST/PAT)
Composition 2: Composition 1+Mcoc-5c (groups: MTK/ST/PAT/PAK)
Composition 3: Composition 2+8M-1 (groups: MTK/ST/PAT/PAK/S)

Figure 11:
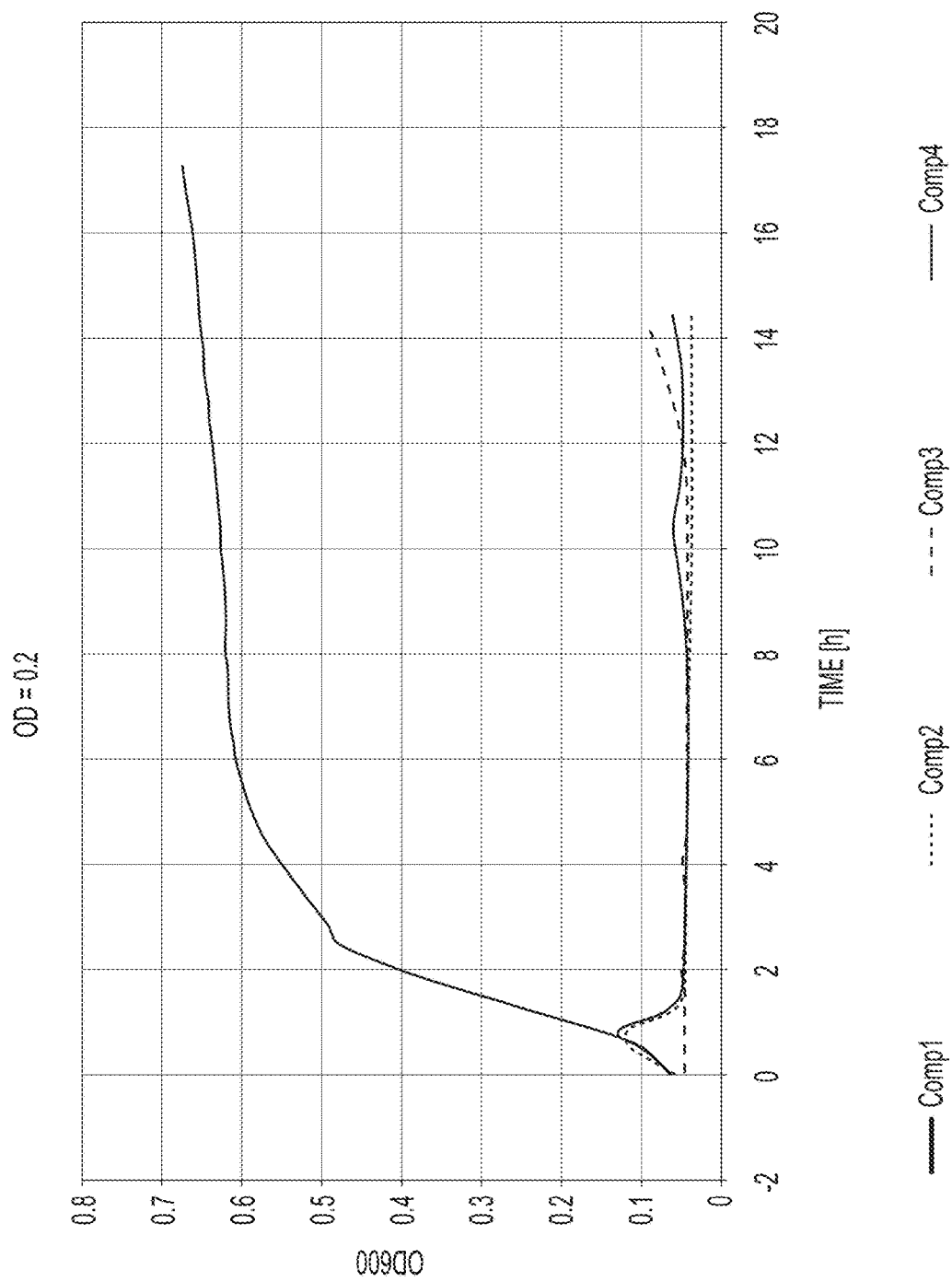
FIG. 11 shows in vitro infection of KP2 with bacteriophage cocktails: Composition 1 (1.2-2, 1.2-3s, 1.2-3b, solid black line), Composition 2 (Composition 1+Mcoc-5c, dashed gray line), Composition 3 (Composition 2+8M-1, dashed black line), and no phage control (solid gray line).

FIG. 11 shows KP2 growth curves for the different phage combinations. The KP2 growth curve without phage is illustrated by the solid gray line. There were no significant differences between the three cocktails Additionally, no mutants appeared up to the time of the end of study (15 hrs).

Table 5 below lists phage combinations with respective liquid dynamics presented in FIGS. 16a-j. FIGS. 16a-j present growth curves of in vitro liquid infection of KP2 variants with different bacteriophage compositions (cocktails). Host bacteria used: FIGS. 16a-c, 16f: CT-141-1, FIG. 16d: CT-123-1, FIG. 16e, g-j: KP2. Experimental procedure used was as described above. Index numbers 1-20 in Table 5 header represent the following phage: [1: 1.2-2], [2: 1.2-3b], [3: 1.2-3s], [4: 1.2-4br], [5: 8M-1], [6: 8M-7], [7: 8M-8], [8: colon1], [9: KP2-4c], [10: KP2-5], [11: KP2-5-1], [12: KP2-5a], [13: KP2-7-1c], [14: KP2-8a], [15: KP2-8c], [16: M16-6c], [17: M16-9a], [18: Mcoc4c], [19: MCoc5c], [20: PKP-55].

TABLE 5

| Additional phage combinations | | | | | | | | | | | | | | | | | | | | | |
|---|---|---|---|---|---|---|---|---|---|---|---|---|---|---|---|---|---|---|---|---|---|
| Combination number | FIG. | 1 | 2 | 3 | 4 | 5 | 6 | 7 | 8 | 9 | 10 | 11 | 12 | 13 | 14 | 15 | 16 | 17 | 18 | 19 | 20 |
| 201 | 16a | X | X | X | X | X | X | | | | | | | | | | | | | | | |
| 202 | 16b | X | X | X | X | X | | | | | | | | | | | | | | | | |
| 203 | 16a | X | X | X | X | | X | | | | | | | | | | | | | | | |
| 204 | 16d | X | X | X | X | | | X | | | | | | | | | | | | | | |
| 205 | 16c | X | X | X | X | | | | | | | | | | | | | | | | | |
| 206 | 16a | X | X | X | | X | X | | | | | | | | | | | | | | | |
| 207 | 16d | X | X | X | | X | | X | | | | | | | | | | | | | | |
| 208 | 16d | X | X | X | | X | | | | | | | | | | | | | | | | |
| 209 | 16a | X | X | X | | | X | | | | | | | | | | | | | | | |
| 210 | 16d | X | X | X | | | | X | | X | | | | | | | | | | | | |
| 211 | 16d | X | X | X | | | | X | | | | | | | | | | | | | | |
| 44 | 16i | X | X | X | | | | | X | | | | X | | | | | | | | | |
| 42 | 16i | X | X | X | | | | | X | | | | | | | X | | | | | | |
| 212 | 16a | X | X | X | | | | | | | | | | | | | | | | | | |
| 213 | 16a | X | X | | X | X | X | | | | | | X | | | | | | | | | |
| 214 | 16b | X | X | | X | X | X | | | | | | | | | | | | | | | |
| 215 | 16d | X | X | | X | X | | X | | | | | | | | | | | | | | |
| 216 | 16g | X | X | | X | X | | | | | X | | | | | | | | | | | |
| 216 | 16g | X | X | | X | X | | | | | X | | | | | | | | | | | |
| 217 | 16c | X | X | | X | X | | | | | | | | | | | | | | | | |
| 218 | 16a | X | X | | X | | X | | | | | | X | | | | | | | | | |
| 219 | 16b | X | X | | X | | X | | | | | | | | X | | | | | | | |
| 220 | 16b | X | X | | X | | X | | | | | | | | | | | | | | | |
| 221 | 16d | X | X | | X | | | X | | X | | | | | | | | | | | | |
| 222 | 16d | X | X | | X | | | X | | | | | | | | | | | | | | |
| 223 | 16g | X | X | | X | | | | | X | X | | | | | | | | | | | |
| 223 | 16g | X | X | | X | | | | | X | X | | | | | | | | | | | |
| 224 | 16c | X | X | | X | | | | | | | | | | | | | | | | | |
| 225 | 16d | X | X | | X | | | | | | | | | | | | | | | | | |
| 226 | 16a | X | X | | | X | X | | | | | | X | | | | | | | | | |
| 227 | 16b | X | X | | | X | X | | | | | | | | | | | | | | | |
| 228 | 16d | X | X | | | X | | X | | X | | | | | | | | | | | | |
| 229 | 16d | X | X | | | X | | X | | | | | | | | | | | | | | |
| 279 | 16j | X | X | | | X | | | X | | | | X | | | | | | | | | |
| 41 | 16i | X | X | | | X | | | X | | | | | | | X | | | | | | |
| 230 | 16d | X | X | | | X | | | | | | | | | | | | | | | | |
| 231 | 16a | X | X | | | | X | | | | | | X | | | | | | | | | |
| 232 | 16b | X | X | | | | X | | | | | | | | X | | | | | | | |
| 233 | 16b | X | X | | | | X | | | | | | | | | | | | | | | |
| 234 | 16d | X | X | | | | | X | | X | | | | | | | | | | | | |
| 235 | 16a | X | X | | | | | | | | | | X | | | | | | | | | |
| 236 | 16b | X | | | X | X | X | X | | | | | | | | | | | | | | |
| 239 | 16e | X | | | X | X | X | | | | | | | | | | | | | | | |
| 239 | 16e | X | | | X | X | X | | | | | | | | | | | | | | | |
| 240 | 16b | X | | | X | X | | X | | | | | | | | | | | | | | |
| 241 | 16e | X | | | X | X | | | | X | | | | | | | | | | | | |
| 241 | 16e | X | | | X | X | | | | X | | | | | | | | | | | | |
| 242 | 16e | X | | | X | X | | | | | | | | | | | | | | | | |
| 242 | 16e | X | | | X | X | | | | | | | | | | | | | | | | |
| 243 | 16b | X | | | X | | X | X | | | | | | | | | | | | | | |
| 53 | 16i | X | | | X | | X | | | X | | | X | | | | | | | | | |
| 50 | 16i | X | | | X | | X | | | X | | | | | X | | | | | | | |
| 244 | 16e | X | | | X | | X | | | X | | | | | | | | | | | | |
| 244 | 16e | X | | | X | | X | | | X | | | | | | | | | | | | |
| 245 | 16e | X | | | X | | X | | | | | | | | | | | | | | | |
| 245 | 16e | X | | | X | | X | | | | | | | | | | | | | | | |

TABLE 5-continued

Additional phage combinations

| Combination number | FIG. | 1 | 2 | 3 | 4 | 5 | 6 | 7 | 8 | 9 | 10 | 11 | 12 | 13 | 14 | 15 | 16 | 17 | 18 | 19 | 20 |
|---|---|---|---|---|---|---|---|---|---|---|---|---|---|---|---|---|---|---|---|---|---|
| 246 | 16b | X |   | X |   |   | X |   |   |   |   |   |   |   |   |   |   |   |   |   |   |
| 32 | 16b | X |   | X |   |   |   |   | X |   |   |   | X |   |   |   | X |   |   |   |   |
| 282 | 16j | X |   | X |   |   |   |   | X |   |   |   | X |   |   |   |   |   |   | X |   |
| 283 | 16j | X |   | X |   |   |   |   | X |   |   |   | X |   |   |   |   |   |   |   | X |
| 30 | 16i | X |   | X |   |   |   |   | X |   |   |   |   |   |   | X | X |   |   |   |   |
| 285 | 16j | X |   | X |   |   |   |   | X |   |   |   |   |   |   | X |   |   |   | X |   |
| 6 | 16i | X |   | X |   |   |   |   | X |   |   |   |   |   |   | X |   |   |   |   | X |
| 247 | 16e | X |   | X |   |   |   |   | X |   |   |   |   |   |   |   |   |   |   |   |   |
| 247 | 16e | X |   | X |   |   |   |   | X |   |   |   |   |   |   |   |   |   |   |   |   |
| 248 | 16h | X |   | X |   |   |   |   |   |   |   |   |   |   |   |   |   |   |   |   |   |
| 249 | 16b | X |   |   | X | X | X |   |   |   |   |   |   |   |   |   |   |   |   |   |   |
| 250 | 16g | X |   |   | X | X |   |   |   |   |   | X |   | X |   |   |   |   |   |   |   |
| 250 | 16g | X |   |   | X | X |   |   |   |   |   | X |   | X |   |   |   |   |   |   |   |
| 251 | 16b | X |   |   | X |   | X |   |   |   |   |   |   |   |   |   |   |   |   |   |   |
| 252 | 16g | X |   |   | X |   |   |   |   | X | X |   | X |   |   |   |   |   |   |   |   |
| 252 | 16g | X |   |   | X |   |   |   |   | X | X |   | X |   |   |   |   |   |   |   |   |
| 253 | 16h | X |   |   | X |   |   |   |   |   |   |   |   |   |   |   |   |   |   |   |   |
| 254 | 16b | X |   |   |   | X | X |   |   |   |   |   |   |   |   |   |   |   |   |   |   |
| 31 | 16i | X |   |   |   | X |   |   | X |   |   |   | X |   |   |   | X |   |   |   |   |
| 296 | 16j | X |   |   |   | X |   |   | X |   |   |   | X |   |   |   |   |   |   | X |   |
| 7 | 16i | X |   |   |   | X |   |   | X |   |   |   | X |   |   |   |   |   |   |   | X |
| 29 | 16i | X |   |   |   | X |   |   | X |   |   |   |   |   |   | X | X |   |   |   |   |
| 299 | 16j | X |   |   |   | X |   |   | X |   |   |   |   |   |   | X |   |   |   | X |   |
| 300 | 16j | X |   |   |   | X |   |   | X |   |   |   |   |   |   | X |   |   |   |   | X |
| 255 | 16h | X |   |   |   | X |   |   |   |   |   |   |   |   |   |   |   |   |   |   |   |
| 256 | 16h | X |   |   |   |   |   |   | X |   |   |   |   |   |   |   |   |   |   |   |   |
| 257 | 16f | X |   |   |   |   |   |   |   |   |   |   |   |   |   |   |   |   |   |   |   |
| 48 | 16i |   | X | X |   |   |   |   | X |   |   |   | X |   |   |   |   | X |   |   |   |
| 40 | 16i |   | X | X |   |   |   |   | X |   |   |   | X |   |   |   |   |   | X |   |   |
| 40 | 16i |   | X | X |   |   |   |   | X |   |   |   | X |   |   |   |   |   | X |   |   |
| 46 | 16i |   | X | X |   |   |   |   | X |   |   |   |   |   |   | X |   | X |   |   |   |
| 38 | 16i |   | X | X |   |   |   |   | X |   |   |   |   |   |   | X |   | X |   |   |   |
| 308 | 16j |   | X |   |   | X |   |   | X |   |   |   | X |   |   |   |   | X |   |   |   |
| 309 | 16j |   | X |   |   | X |   |   | X |   |   |   | X |   |   |   |   |   | X |   |   |
| 45 | 16i |   | X |   |   | X |   |   | X |   |   |   |   |   |   | X |   | X |   |   |   |
| 37 | 16i |   | X |   |   | X |   |   | X |   |   |   |   |   |   | X |   | X |   |   |   |
| 258 | 16f |   | X |   |   |   |   |   |   |   |   |   |   |   |   |   |   |   |   |   |   |
| 259 | 16e |   |   | X | X | X |   |   | X |   |   |   |   |   |   |   |   |   |   |   |   |
| 259 | 16e |   |   | X | X | X |   |   | X |   |   |   |   |   |   |   |   |   |   |   |   |
| 260 | 16b |   |   | X | X | X |   |   |   |   |   |   |   |   |   |   |   |   |   |   |   |
| 260 | 16e |   |   | X | X | X |   |   |   |   |   |   |   |   |   |   |   |   |   |   |   |
| 260 | 16e |   |   | X | X | X |   |   |   |   |   |   |   |   |   |   |   |   |   |   |   |
| 261 | 16e |   |   | X | X |   |   |   | X |   |   |   |   |   |   |   |   |   |   |   |   |
| 261 | 16e |   |   | X | X |   |   |   | X |   |   |   |   |   |   |   |   |   |   |   |   |
| 262 | 16e |   |   | X | X |   |   |   |   |   |   |   |   |   |   |   |   |   |   |   |   |
| 54 | 16i |   |   | X |   | X |   |   | X |   |   |   | X |   |   |   |   | X |   |   |   |
| 54 | 16i |   |   | X |   | X |   |   | X |   |   |   | X |   |   |   |   | X |   |   |   |
| 52 | 16i |   |   | X |   | X |   |   | X |   |   |   | X |   |   |   |   |   | X |   |   |
| 52 | 16i |   |   | X |   | X |   |   | X |   |   |   | X |   |   |   |   |   | X |   |   |
| 51 | 16i |   |   | X |   | X |   |   | X |   |   |   |   |   |   | X |   | X |   |   |   |
| 51 | 16i |   |   | X |   | X |   |   | X |   |   |   |   |   |   | X |   | X |   |   |   |
| 49 | 16i |   |   | X |   | X |   |   | X |   |   |   |   |   |   | X |   |   | X |   |   |
| 49 | 16i |   |   | X |   | X |   |   | X |   |   |   |   |   |   | X |   |   | X |   |   |
| 263 | 16e |   |   | X |   | X |   |   | X |   |   |   |   |   |   |   |   |   |   |   |   |
| 263 | 16e |   |   | X |   | X |   |   | X |   |   |   |   |   |   |   |   |   |   |   |   |
| 264 | 16e |   |   | X |   | X |   |   |   |   |   |   |   |   |   |   |   |   |   |   |   |
| 36 | 16i |   |   | X |   |   |   |   | X |   |   |   | X |   |   |   | X | X |   |   |   |
| 28 | 16i |   |   | X |   |   |   |   | X |   |   |   | X |   |   |   | X |   | X |   |   |
| 314 | 16j |   |   | X |   |   |   |   | X |   |   |   | X |   |   |   |   | X | X |   |   |
| 12 | 16i |   |   | X |   |   |   |   | X |   |   |   | X |   |   |   |   | X |   |   | X |
| 16 | 16i |   |   | X |   |   |   |   | X |   |   |   | X |   |   |   |   |   | X | X |   |
| 16 | 16i |   |   | X |   |   |   |   | X |   |   |   | X |   |   |   |   |   | X | X |   |
| 317 | 16j |   |   | X |   |   |   |   | X |   |   |   | X |   |   |   |   |   | X |   | X |
| 34 | 16i |   |   | X |   |   |   |   | X |   |   |   |   |   |   | X | X | X |   |   |   |
| 26 | 16i |   |   | X |   |   |   |   | X |   |   |   |   |   |   | X | X |   | X |   |   |
| 320 | 16j |   |   | X |   |   |   |   | X |   |   |   |   |   |   | X |   | X | X |   |   |
| 10 | 16i |   |   | X |   |   |   |   | X |   |   |   |   |   |   | X |   | X |   |   | X |
| 10 | 16i |   |   | X |   |   |   |   | X |   |   |   |   |   |   | X |   | X |   |   | X |
| 322 | 16j |   |   | X |   |   |   |   | X |   |   |   |   |   |   | X |   |   | X | X |   |
| 2 | 16i |   |   | X |   |   |   |   | X |   |   |   |   |   |   | X |   |   | X |   | X |
| 2 | 16i |   |   | X |   |   |   |   | X |   |   |   |   |   |   | X |   |   | X |   | X |
| 266 | 16f |   |   | X |   |   |   |   |   |   |   |   |   |   |   |   |   |   |   |   |   |
| 267 | 16h |   |   |   | X | X |   |   |   |   |   |   |   |   |   |   |   |   |   |   |   |
| 268 | 16h |   |   |   | X |   |   |   | X |   |   |   |   |   |   |   |   |   |   |   |   |
| 269 | 16c |   |   |   | X |   |   |   |   |   |   |   |   |   |   |   |   |   |   |   |   |

TABLE 5-continued

Additional phage combinations

| Combination number | FIG. | 1 | 2 | 3 | 4 | 5 | 6 | 7 | 8 | 9 | 10 | 11 | 12 | 13 | 14 | 15 | 16 | 17 | 18 | 19 | 20 |
|---|---|---|---|---|---|---|---|---|---|---|---|---|---|---|---|---|---|---|---|---|---|
| 35 | 16i | | | | | X | | | X | | | | X | | | | X | X | | | |
| 27 | 16i | | | | | X | | | X | | | | X | | | | X | | X | | |
| 333 | 16j | | | | | X | | | X | | | | X | | | | | X | | X | |
| 11 | 16i | | | | | X | | | X | | | | X | | | | | X | | | X |
| 335 | 16j | | | | | X | | | X | | | | X | | | | | | X | X | |
| 3 | 16i | | | | | X | | | X | | | | X | | | | | | X | | X |
| 33 | 16i | | | | | X | | | X | | | | | | | X | X | X | | | |
| 25 | 16i | | | | | X | | | X | | | | | | | X | X | | X | | |
| 339 | 16j | | | | | X | | | X | | | | | | | X | | X | | X | |
| 9 | 16i | | | | | X | | | X | | | | | | | X | | X | | | X |
| 13 | 16i | | | | | X | | | X | | | | | | | X | | | X | X | |
| 342 | 16j | | | | | X | | | X | | | | | | | X | | | X | | X |
| 270 | 16h | | | | | X | | | X | | | | | | | | | | | | |
| 271 | 16f | | | | | X | | | | | | | | | | | | | | | |
| 272 | 16f | | | | | | X | | | | | | | | | | | | | | |
| 273 | 16f | | | | | | | X | | | | | | | | | | | | | |
| 274 | 16h | | | | | | | | X | | | | | | | | | | | | |
| 275 | 16f | | | | | | | | | X | | | | | | | | | | | |

Example 15: In Vivo Study to Examine Bacterial Load Reduction by KP2-Specific Phage Cocktail Administered at Different Time Points The bacterial load reduction efficacy of treatment with Composition 1 from Example 14 was explored in mice by studying the cocktail administration at different time points. C57BL/6 mice, 6-8 weeks of age, were utilized. Bacterial colonization of mice intestine was achieved by treatment with a daily antibiotic regimen, for 8 days (n=28 mice). Daily Tylosin (0.5 gr/L) was administered to the mice for 4 days prior to KP2 administration, after which, the mice continued on daily Ampicillin (200 mg/L) for an additional 4 days. The KP2 strain was cultured at a density of $10^{10}$ CFU/mL. 0.1 ml of bacterial suspension, containing $10^9$ CFU was administered to each animal.

The 28 mice were divided into 4 groups of seven. All mice received a single dose of KP2. One group was treated with a phage cocktail, administered daily starting on day 4 post KP2 administration through day 9. Another group, used as the vehicle control for the phage cocktail, was administered the vehicle, starting on day 4 post KP2 administration. Two additional groups were treated with the phage cocktail once, at different time points (day 4 and day 6 post KP2 administration). The phage cocktail was provided in phage buffer at a titer of $5 \times 10^9$ PFU/mL. 0.2 ml of this suspension ($10^9$ phages total) was administered per mouse. Both KP2 and the phage cocktail were administered by oral gavage.

Colonization of KP2 was determined by bacterial load in stool samples, when comparing the experimental and control groups. Stool collection for bacterial counts (CFU/gr) was carried out on day−4, daily from days 0 to 5 and on days 7 to 9. The study was terminated 10 days post KP2 administration. Intestines were collected from all mice for CFU counts. Intestines were weighed and put in PBS, at 0° C. for mucosal CFU determination.

The stools were processed for KP2 bacterial count, with approximately 50 mg of stool collected and weighed from each individual mouse. The stool was suspended in 5 mL PBS and a stomacher was used. A 1 mL sample was transferred into an Eppendorf tube and centrifuged for 5 min at 2,000×g. The pellet was re-suspended with 1 mL PBS and centrifuged for 5 min, at 2,000×g. The supernatant was discarded and the procedure repeated. Next, the stool pellet was re-suspended with 1 mL PBS and diluted in a 4-fold dilution series (7 times).

Each diluted sample (5 μL) was added to BHIS (Brain Heart Infusion Salt) agar plates supplemented with 4 antibiotics (selective plates for KP2). Plates were incubated at 37° C. for 24 hours, and KP2 colonies were counted for all samples. The number of colony forming units was calculated per gram of stool sample (no. colonies×dilution×200× 1000/X mg to have CFU/gr stool). At termination, animals were sacrificed, and their intestines were harvested, weighed and processed for CFU counts as described for stool samples.

Figure 4:
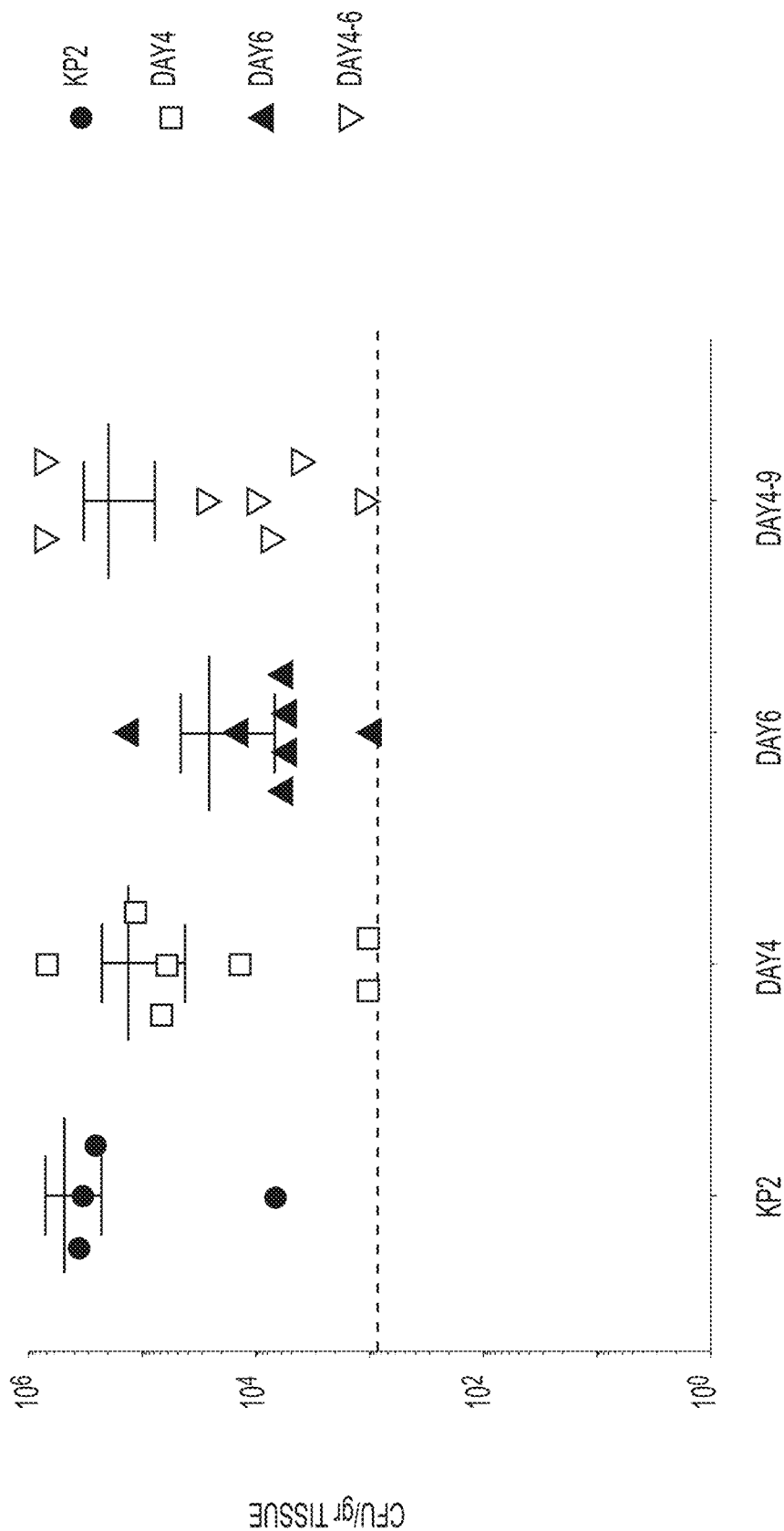
FIG. 4 shows KP2 CFU in mucosa for four groups of mice: 1) vehicle control administered daily starting on day 4 post KP2 administration (KP2); 2) a single dose of phage cocktail administered on day 4 post KP2 administration (Day 4); 3) daily phage cocktail doses administered starting on day 4 post KP2 administration (Day 4-6); 4) a single dose of phage cocktail administered on day 6 post KP2 administration (Day 6). The dashed line represents the limit of detection ($10^3$ CFU/g tissue).

As seen in FIG. 3, some reduction in bacterial load was observed in the stool of all treated animals compared to control. This was the case for all administration regimens. The reduction in comparison with control was more apparent when the mucosal associated bacterial load was examined (FIG. 4.) and appeared to be greatest for animals treated with phage on day 6.

Example 16: In Vivo Study to Determine Treatment Efficacies of KP2-Specific Phage Cocktails with Different Compositions The bacterial load reduction efficacy of compositions 1, 2 and 3 from Example 14 was studied by administrating different regimens, once or multiple times at 3 day intervals. C57BL/6 mice, 6-8 weeks of age, were utilized. Bacterial colonization of mice intestine was achieved by treatment with a daily antibiotic regimen, for 8 days (n=30 mice). Daily Tylosin (0.5 gr/L) was administered to the mice for 4 days prior to KP2 administration, after which, the mice continued on daily Ampicillin (200 mg/L) for an additional 4 days.

The 30 mice were divided into 5 groups of six. All mice were administered a single dose of KP2. Two groups were treated with one composition of phage cocktail (tested in the above in vivo study). One group received the cocktail once, and the second group received it 3 times, on days 6, 9 and 12. Two additional groups received other compositions of phage cocktails, 3 times, on days 6, 9 and 12. The residual colonization of KP2 was determined by the bacterial load in stool samples. The bacterial load in the experimental groups was compared with that of the control group receiving vehicle 3 times, on days 6, 9 and 12. CFU/gr was measured for stool 5 times after phage administration and at study termination.

KP2 strain was cultured at a density of $10^{10}$ CFU/mL. 0.1 ml of bacterial suspension containing $10^9$ CFU was administered to each animal. The study was terminated 14 days post KP2 administration. Intestines and stool were collected from all mice for CFU count. Intestines were weighed and put in PBS, at 0° C. for mucosal CFU determination.

KP2 specific phage cocktails were provided at the following titers: Composition 1: $5 \times 10^9$ PFU/mL, 200 μL of this suspension ($10^9$ phages total) per mouse. Composition 2: $6.3 \times 10^9$ PFU/mL, 200 μL of this suspension ($1.2 \times 10^9$ phages total) per mouse. Composition 3: $7.6 \times 10^9$ PFU/mL, 200 μL of this suspension ($1.5 \times 10^9$ phages total) per mouse. 0.2 ml of the vehicle (phage buffer) was administered per mouse At termination, animals were sacrificed, and their intestines were harvested., weighed and processed for CFU counts as described for stool samples.

Figure 5:
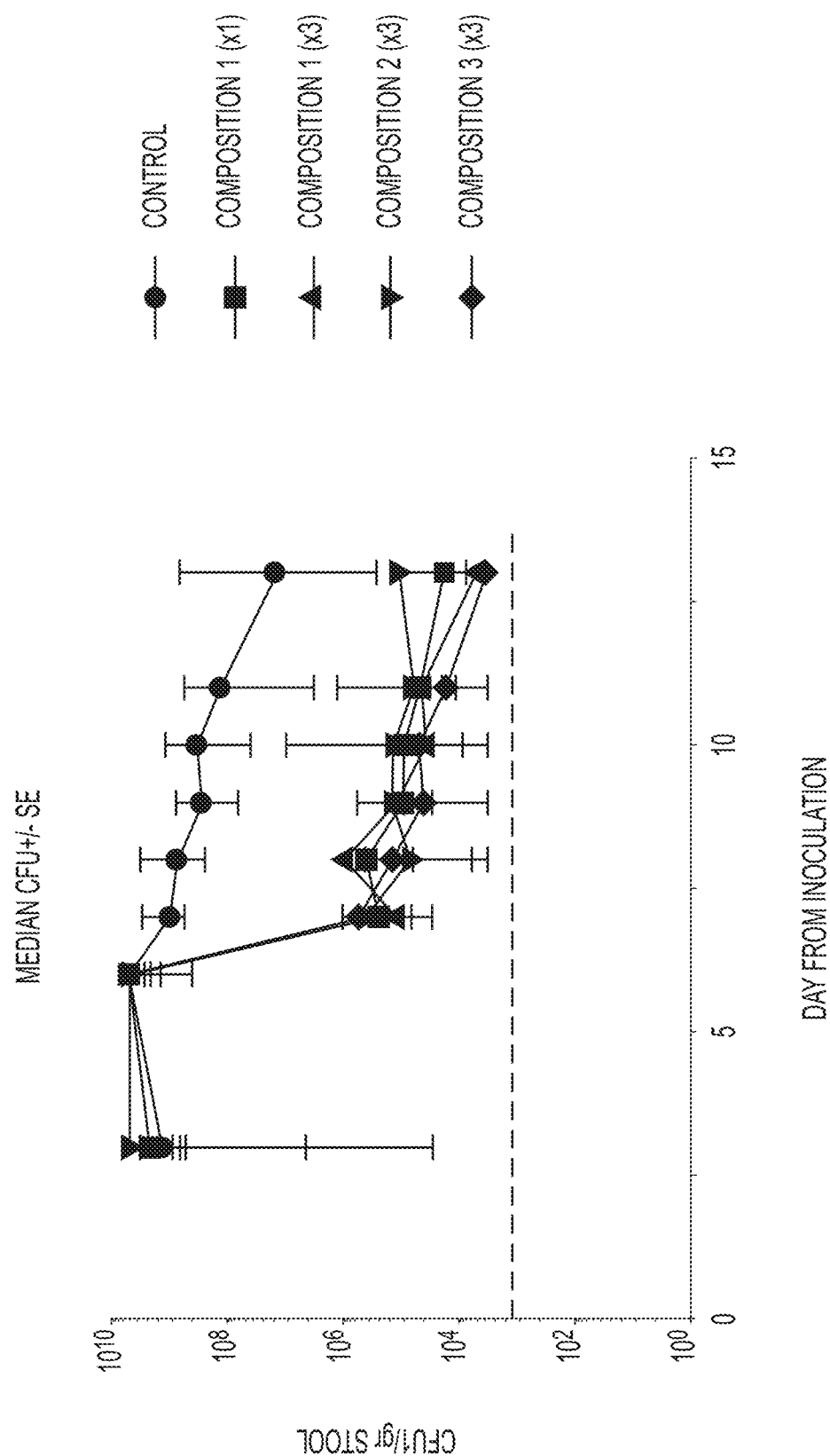
FIG. 5 shows KP2 CFU in stool for five groups of mice: 1) Control; 2) Composition 1 (1.2-2, 1.2-3s, 1.2-3b), administered once; 3) Composition 1, administered 3 times on days 6, 9 and 12 post KP2 administration; 4) Composition 2 (1.2-2, 1.2-3s, 1.2-3b, MCoc5c), administered 3 times on days 6, 9 and 12 post KP2 administration; 5) Composition 3 (1.2-2, 1.2-3s, 1.2-3b, MCoc5c, 8M-1), administered 3 times on days 6, 9 and 12 post KP2 administration. The dashed line represents the limit of detection ($10^3$ CFU/g stool).

FIG. 5 shows KP2 CFU in stool for five groups of mice colonized with KP2: 1) Control; 2) Composition 1 (1.2-2, 1.2-3s, 1.2-3b), administered once; 3) Composition 1, administered 3 times on days 6, 9 and 12 post KP2 administration; 4) Composition 2 (1.2-2, 1.2-3s, 1.2-3b, MCoc5c), administered 3 times on days 6, 9 and 12 post KP2 administration; 5) Composition 3 (1.2-2, 1.2-3s, 1.2-3b, MCoc5c, 8M-1), administered 3 times on days 6, 9 and 12 post KP2 administration. The dashed line represents the limit of detection ($10^3$ CFU/g stool).

As also seen in FIG. 5, all the phage compositions and administration protocols induced a significant log reduction in bacterial load in the colon. The 5 phage cocktail performed the best in reducing the bacterial load in the colon as measured by CFU/gr stool and reached a level below the limit of detection (1000 CFU KP2/g stool) by the end of the study on Day 13. This is also seen in Table 6 below which shows the CFU values per gram of stool for individual mice in groups 1M to 5M at the time of termination of the study along with average and median values. While a single administration of Composition 1 (Group 2M) brought about a large reduction in stool bacterial load relative to the untreated animals, the reduction was even greater following 3 administrations of the same phage cocktail (Group 3 M). Three administrations of Composition 3 (Group 5 M) resulted in a bacterial load below the level of detection (1000 CFU KP2/g stool, shown here as 0) for all the animals treated with this composition.

TABLE 6

| | mouse no. | day 13 |
|---|---|---|
| 1M Control | 1 | 4.1E+08 |
| | 2 | 8.71E+08 |
| | 3 | 3.47E+07 |
| | 4 | 4.98E+06 |
| | 5 | 3.19E+05 |
| | 6 | 1.98E+06 |
| | AVG | 2.21E+08 |
| | Median | 1.98E+07 |
| 2M composition 1 × 1 dose | 7 | 1.02E+05 |
| | 8 | 1.83E+04 |
| | 9 | 0E+00 |
| | 10 | 2.55E+04 |
| | 11 | 3.1E+04 |
| | 12 | 1.11E+04 |
| | AVG | 3.14E+04 |
| | Median | 2.19E+04 |

TABLE 6-continued

| | mouse no. | day 13 |
|---|---|---|
| 3M composition 1 × 3 dose | 13 | 0E+00 |
| | 14 | 0E+00 |
| | 15 | 0E+00 |
| | 16 | 4.63E+04 |
| | 17 | 3.37E+04 |
| | 18 | 9.58E+03 |
| | AVG | 1.49E+04 |
| | Median | 4.79E+03 |
| 4M composition 2 × 3 dose | 19 | 2.63E+05 |
| | 20 | 2.14E+05 |
| | 21 | 1.94E+05 |
| | 22 | 3.99E+04 |
| | 23 | 2.24E+04 |
| | 24 | 8.76E+03 |
| | AVG | 1.24E+05 |
| | Median | 1.17E+05 |
| 5M composition 3 × 3 dose | 25 | 0E+00 |
| | 26 | 0E+00 |
| | 27 | 0E+00 |
| | 28 | 0E+00 |
| | 29 | 0E+00 |
| | 30 | 0E+00 |
| | AVG | 0E+00 |
| | Median | 0E+00 |

Figure 6:
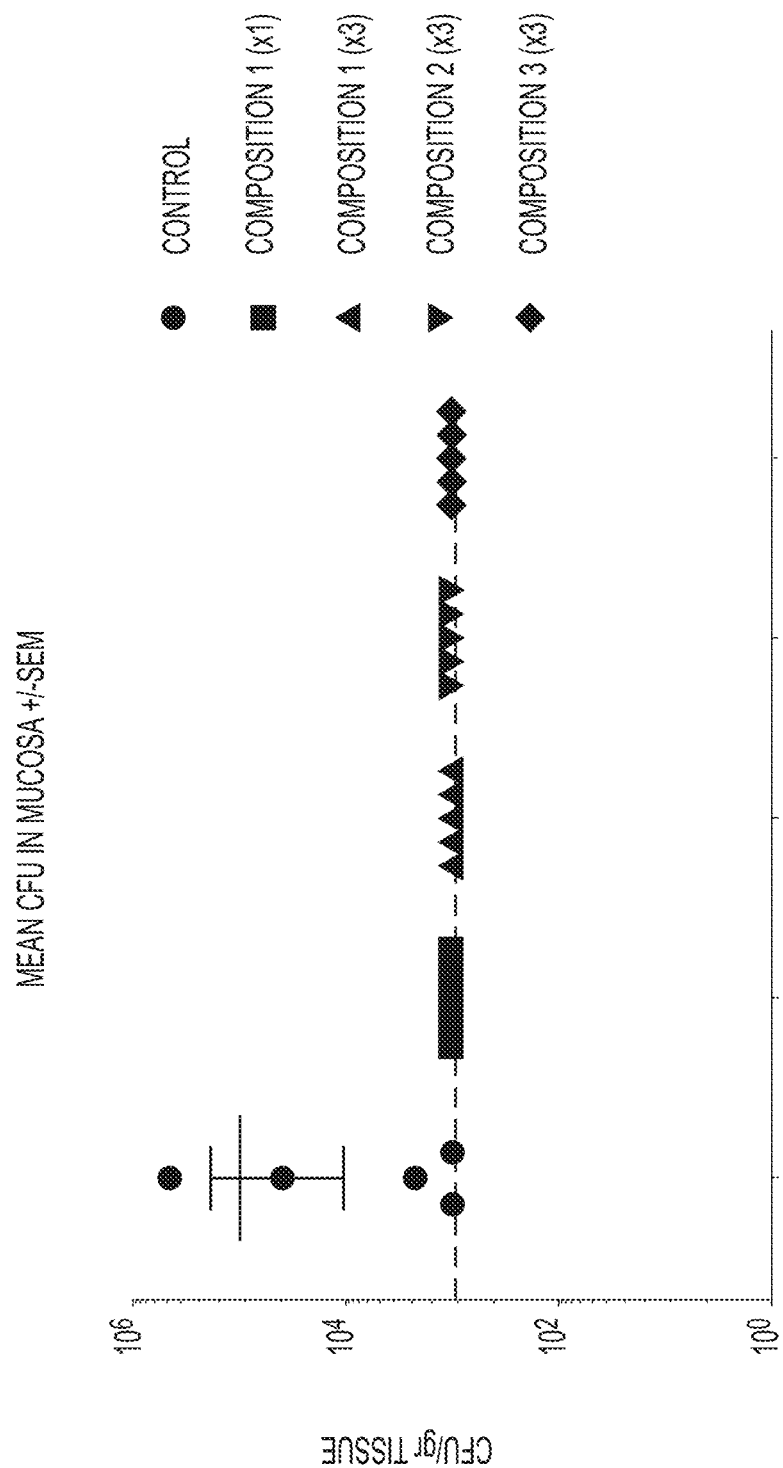
FIG. 6 shows KP2 CFU in mucosa for five groups of mice: 1) Control; 2) Composition 1 (1.2-2, 1.2-3s, 1.2-3b), administered once; 3) Composition 1, administered on days 6, 9 and 12 post KP2 administration; 4) Composition 2 (1.2-2, 1.2-3s, 1.2-3b, MCoc5c), administered on days 6, 9 and 12 post KP2 administration; 5) Composition 3 (1.2-2, 1.2-3s, 1.2-3b, MCoc5c, 8M-1), administered on days 6, 9 and 12 post KP2 administration. The dashed line represents the limit of detection ($10^3$ CFU/g tissue).

FIG. 6 shows KP2 CFU in mucosa for the same five groups of mice: 1) Control; 2) Composition 1 (1.2-2, 1.2-3s, 1.2-3b), administered once; 3) Composition 1, administered on days 6, 9 and 12 post KP2 administration; 4) Composition 2 (1.2-2, 1.2-3s, 1.2-3b, MCoc5c), administered on days 6, 9 and 12 post KP2 administration; 5) Composition 3 (1.2-2, 1.2-3s, 1.2-3b, MCoc5c, 8M-1), administered on days 6, 9 and 12 post KP2 administration. The dashed line represents the limit of detection ($10^3$ CFU/g tissue). As seen in FIG. 6, all 3 compositions and treatment regimens resulted in a reduction of bacterial load in the mucosa to below detection limit (1000 CFU KP2/g stool).

Example 17: In Vivo Study to Determine Efficacy of Phage Cocktails with 3, 4 and 5 KP2-Specific Phages on a KP2 Clinical Variant In order to verify the efficacy in vivo of the KP2 phage on KP2 clinical variants, the efficacy of phage cocktails, containing 3 to 5 phage was tested on mice colonized with the KP2 clinical variant CT-141-1.

Phage cocktails consisted of the following phage:
Composition 1 (comp 1) phages Mcoc-5c, 8M-7, 1.2-3b;
Composition 2 (comp 2) phages Mcoc-5c, 8M-7, 1.2-2, 1.2-3s;
Composition 3 (comp 3) phages Mcoc-5c, 8M-7, 1.2-2, 1.2-3b Composition 4 (comp 4) phages Mcoc-5c, 8M-7, KP2-5-1, 1.2-3s, PKP-55; and
Composition 5 (comp 5) phages Mcoc-5c, 8M-7, 1.2-2, 1.2-3s, 1.2-3b Bacterial colonization with CT-141-1 was achieved by treatment with a daily antibiotic regimen, for 8 days (n=30 mice). Daily Tylosin (0.5 gr/L) was administered to the mice for 4 days prior to KP2 administration, after which, the mice continued on daily Ampicillin (200 mg/L) for an additional 4 days.

C57BL/6 mice, 6-8 weeks of age, were utilized. Mice were divided into 6 groups of five. All groups were administered a single dose of the KP2 clinical variant CT-141-1 ($10^9$ CFU/mouse).

Group 1 served as a control and was treated with the vehicle of the phage cocktail on days 6, 9 and 12 after CT-141-1 administration. Group 2 received composition 1 on days 6, 9, and 12. Group 3 received composition 2 on days 6, 9 and 12. Group 4 received composition 3 on days 6, 9 and 12. Group 5 received composition 4 on days 6, 9 and 12. Group 6 received composition 5 on days 6, 9 and 12. All treatments were administered by oral gavage.

The KP2 clinical variant was cultured at a density of $10^{10}$ CFU/mL. 0.1 ml of bacterial suspension, containing $10^9$ CFU, was administered to each animal by oral gavage.

Stool was collected daily from day 6, including at termination (except on day 12). The study was terminated 14 days post KP2 clinical strain administration. Intestines were collected from all mice for CFU determination. Intestines were weighed and put in PBS, at 0° C., for mucosal CFU determination.

Phage cocktails were formulated in phage buffer (50 mM Tris-HCl, 100 mM NaCl, 5 mM $MgCl_2$, 0.1 mM $MnCl_2$ pH=7.5). 0.2 ml of the vehicle or phage was administered per mouse, All phage compositions were at a concentration of $5\times10^9$ PFU/mL, and 200 μL of this suspension ($10^9$ PFU total) was administered per mouse at each administration point. At termination, animals were sacrificed and their intestines were harvested, weighed and processed for CFU counts as described for stool samples.

The residual colonization of CT-141-1 was determined by the bacterial load in stool samples. The bacterial load in the experimental and control groups, receiving KP2-specific phage cocktails or vehicle on days 6, 9 and 12, were compared.

Figure 7:
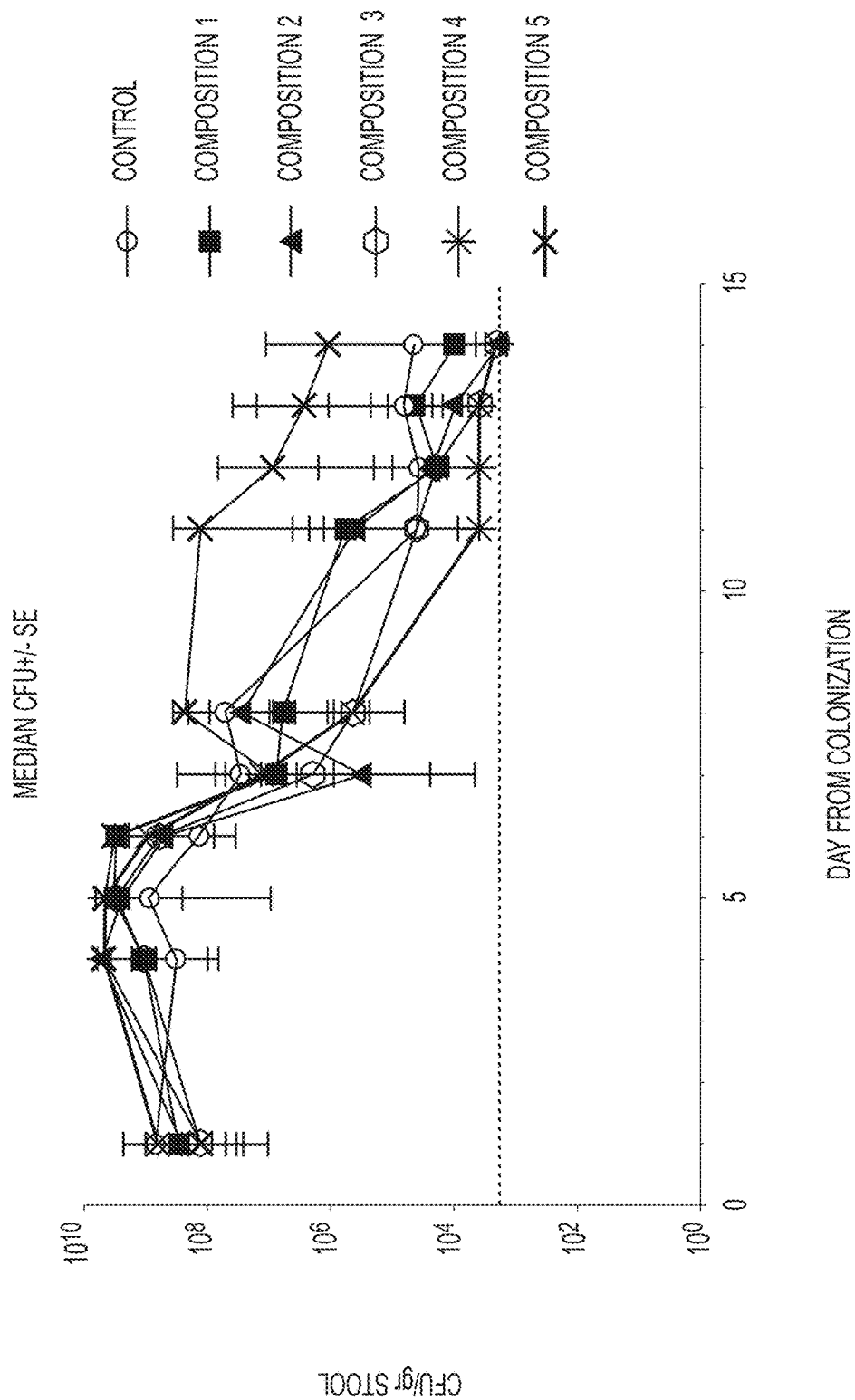
FIG. 7 shows CT-141-1 CFU ratio of treated/control in stool for the five groups of mice who received: 1) Composition 1 (Mcoc-5c, 8M-7, 1.2-3b); 2) Composition 2 (Mcoc-5c, 8M-7, 1.2-2, 1.2-3s); 3) Composition 3 (Mcoc-5c, 8M-7, 1.2-2, 1.2-3b); 4) Composition 4 (Mcoc-5c, 8M-7, KP2-5-1, 1.2-3s, PKP-55); 5) Composition 5 (Mcoc-5c, 8M-7, 1.2-2, 1.2-3s, 1.2-3b). All compositions were administered on days 6, 9 and 12 post KP2 administration. The dashed line represents the ratio of the two values equaling 1.

FIG. 7 shows CT-141-1 CFU ratio of treated/control in stool for the five groups of mice who received: 1) Composition 1 (Mcoc-5c, 8M-7, 1.2-3b); 2) Composition 2 (Mcoc-5c, 8M-7, 1.2-2, 1.2-3s); 3) Composition 3 (Mcoc-5c, 8M-7, 1.2-2, 1.2-3b); 4) Composition 4 (Mcoc-5c, 8M-7, KP2-5-1, 1.2-3s, PKP-55); 5) Composition 5 (Mcoc-5c, 8M-7, 1.2-2, 1.2-3s, 1.2-3b). All compositions were administered on days 6, 9 and 12 post KP2 administration. The dashed line represents the ratio of the two values equaling 1.

As seen in FIG. 7, while compositions 1 and 5 led to little or no reduction in bacterial load as compared to the control mice, treatment of the CT-141-1 colonized mice with compositions 2, 3 or 4 led to a 2 log reduction in the stool bacterial load by the end of the study period (FIG. 7).

Figure 8:
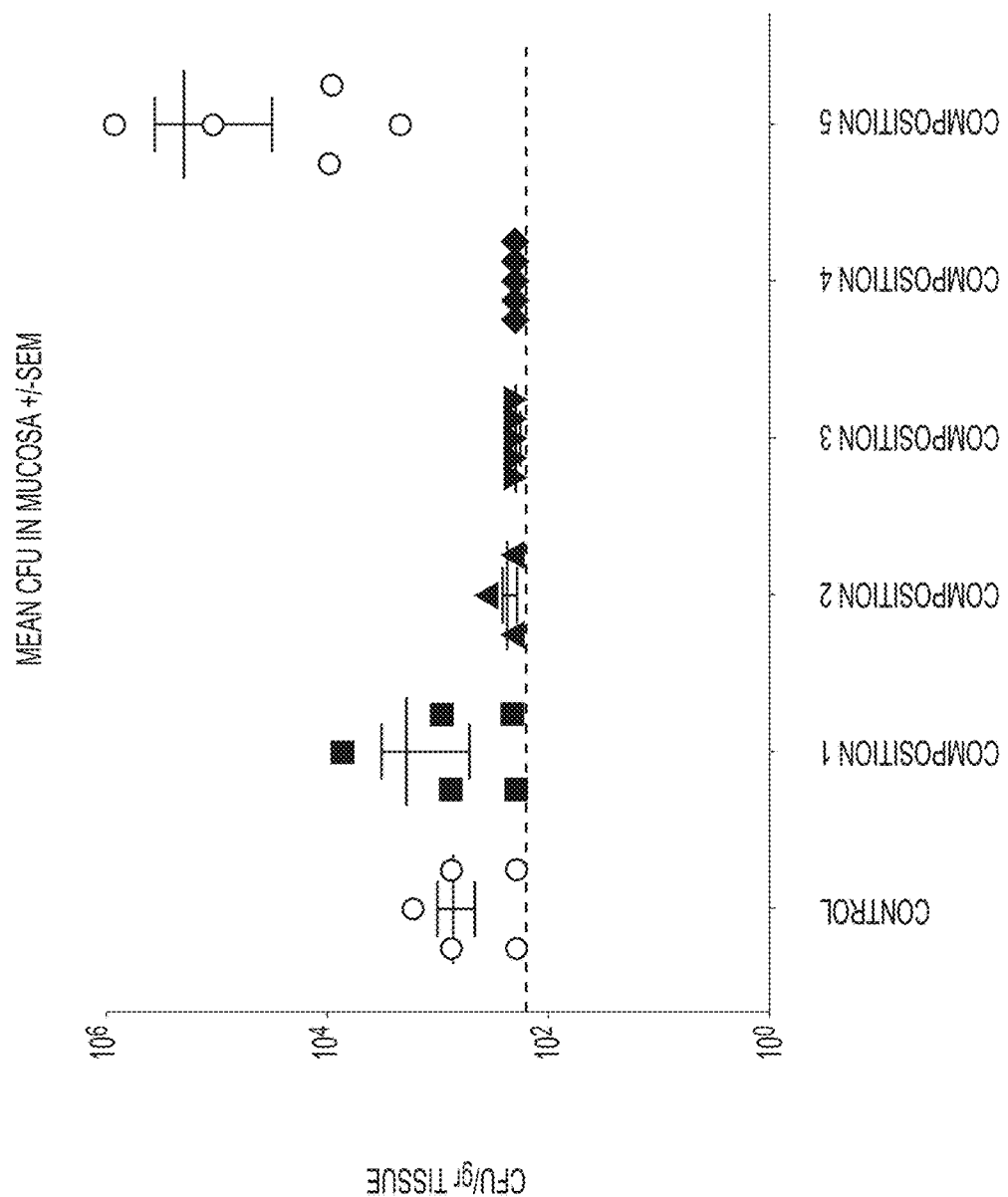
FIG. 8 shows CFU in mucosa of the five groups of mice who received: 1) Composition 1 (Mcoc-5c, 8M-7, 1.2-3b); 2) Composition 2 (Mcoc-5c, 8M-7, 1.2-2, 1.2-3s); 3) Composition 3 (Mcoc-5c, 8M-7, 1.2-2, 1.2-3b); 4) Composition 4 (Mcoc-5c, 8M-7, KP2-5-1, 1.2-3s, PKP-55); 5) Composition 5 (Mcoc-5c, 8M-7, 1.2-2, 1.2-3s, 1.2-3b). All compositions were administered on days 6, 9 and 12 post KP2 administration. The dashed line represents the limit of detection ($10^3$ CFU/g tissue).

The same compositions were effective in reducing bacterial load in the mucosa as seen in FIG. 8, that shows CFU in mucosa of the five groups of mice who received: 1) Composition 1 (Mcoc-5c, 8M-7, 1.2-3b); 2) Composition 2 (Mcoc-5c, 8M-7, 1.2-2, 1.2-3s); 3) Composition 3 (Mcoc-5c, 8M-7, 1.2-2, 1.2-3b); 4) Composition 4 (Mcoc-5c, 8M-7, KP2-5-1, 1.2-3s, PKP-55); 5) Composition 5 (Mcoc-5c, 8M-7, 1.2-2, 1.2-3s, 1.2-3b). All compositions were administered on days 6, 9 and 12 post KP2 administration. The dashed line represents the limit of detection ($10^3$ CFU/g tissue). For all of these three phage cocktails, the levels of CFU in the mucosa were reduced to below the LOD while detectable levels were observed following treatment with compositions 1 or 5. Thus, Compositions 2, 3 and 4 are particularly effective in reducing bacterial load of CT-141-1 in colonized mice.

Example 18: Biofilm Reduction Capabilities of KP2 Phages

To examine phage ability to penetrate KP2 biofilms and reduce the number of viable bacteria found within, KP2 was grown at 37° C. with agitation to $OD_{600}$ 1.5 and diluted in LB medium supplemented with 1% glucose to $OD_{600}$ 0.1.

For biofilm formation, 200 μl of the resulting culture was added to 96 well plates and incubated for 24 hrs at 37° C., which enabled growth to approximately $4\times10^8$ cells per well. 180 μl was discarded to remove planktonic cells and 50 μl of the individual phages (1.2-3b, 1.2-3s, 1.2-2, 8M-1) or one of the three cocktails (Composition 1, 2 and 3) as detailed in Example 14 was applied at a MOI of 0.01 ($4\times10^6$ total phage particles). Phage buffer was added to untreated wells as a negative control. 150 μl of LB supplemented with 1% glucose and 1 mM MMC ions was added and incubated at 37° C. At set time points, the liquid was removed, and the biofilm was scraped rigorously from the bottom of the wells. 100 μl PBS was added to the wells, mixed and moved to sterile eppendorfs with 900 μl PBS. Samples were vortexed for 1 minute and washed 3 times by centrifuging at 4° C. for 5 minutes at 6000×g. After the last wash, 200 μl of PBS was added and samples were serially diluted by 10 fold in PBS. A 5 μl drop of each dilution was plated on BHIS agar plates. Plates were incubated overnight at 37° C. after which bacteria concentration was determined by viable count.

Figure 12:
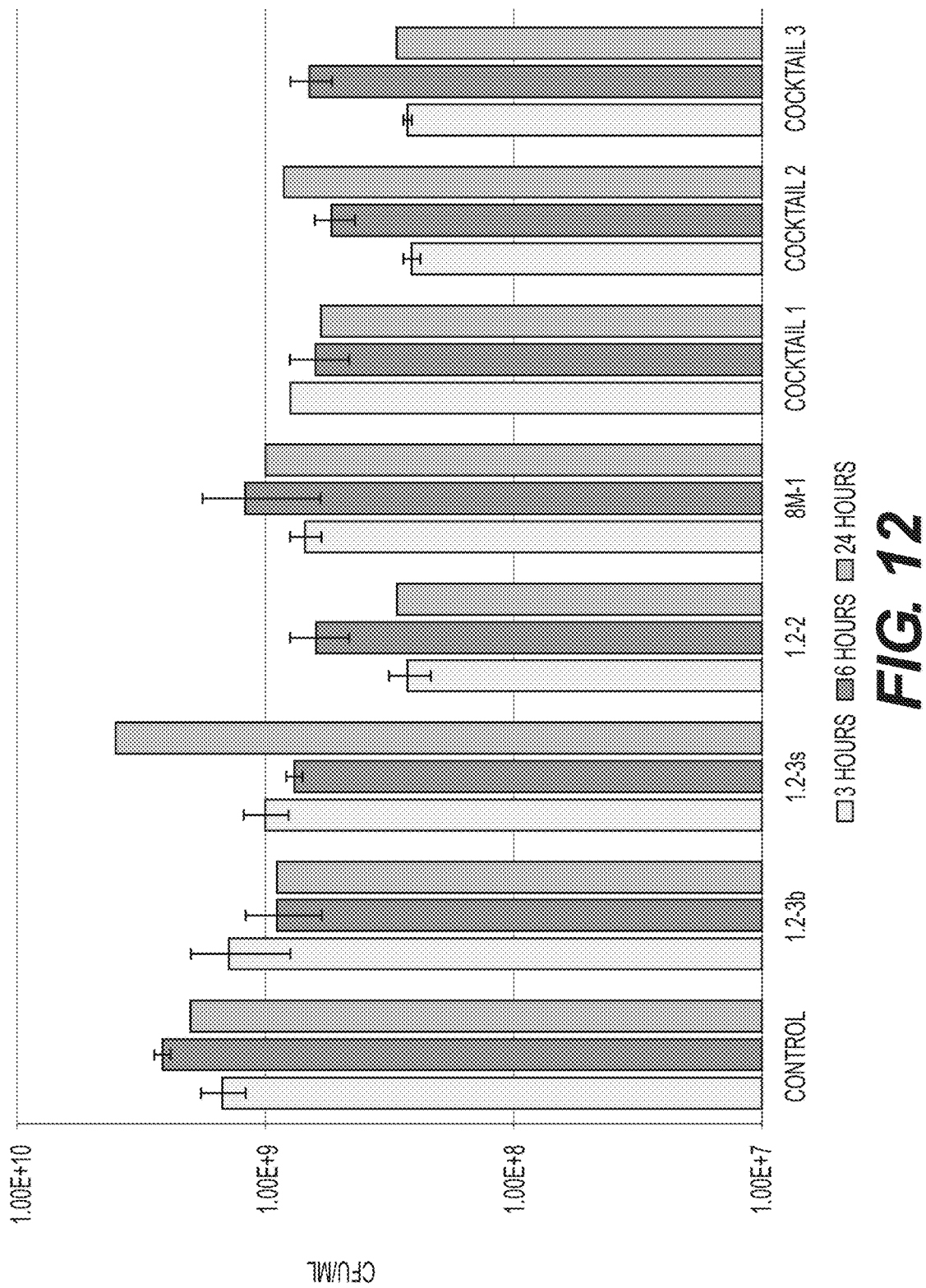
FIG. 12 shows CFU counts post phage treatment of KP2 biofilm in multiwell biofilm assay, with control, various individual phage or phage cocktails.
Figure 13:
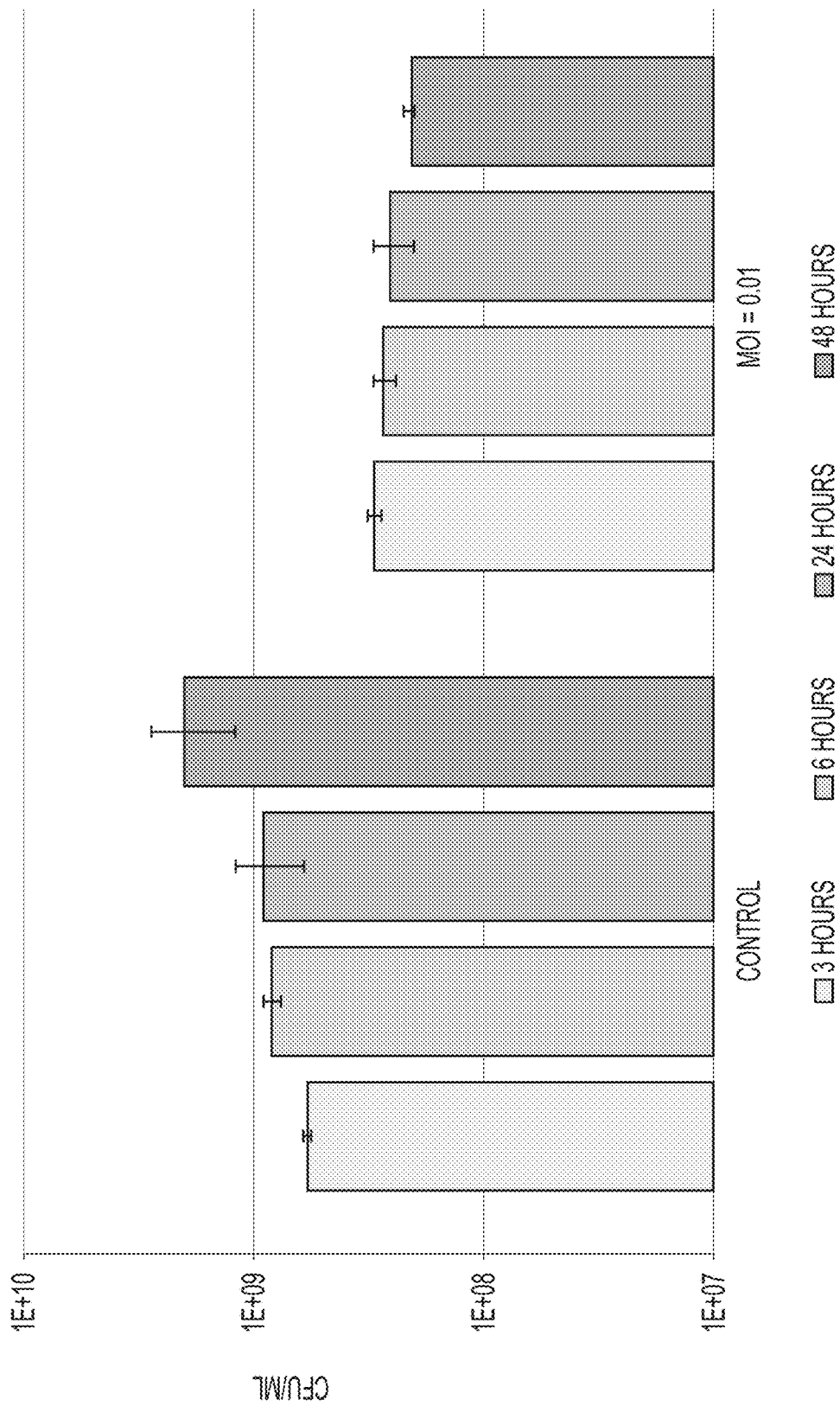
FIG. 13 shows CFU counts post phage 1.2-2 treatment of KP2 biofilm in multiwell biofilm assay.

FIG. 12 shows CFU counts post phage treatment of KP2 biofilm. Of the individual phage, phage 1.2-2 showed the greatest activity on biofilm with nearly a 1 log reduction in CFU counts as compared to the control after a treatment period of 24 hours. A similar almost 1 log reduction at this time point was also observed with Cocktail 3. Similar results The individual phage 1.2-3b and 8M-1 gave weaker results, as did Cocktails 1 and 2. In a subsequent experiment focusing on phage 1.2-2 and in which the treatment period was extended to 48 hours (FIG. 13), a full one log reduction in viable bacteria extracted from biofilm was observed after phage treatment for 48 hours.

Example 19: Compiling Phage Cocktails for Optimized Infectivity Performance

The phage or phage cocktail's infection of a bacterial host ("infectivity profile") may be characterized by different aspects. Among those aspects are the infected host range, i.e. the range of different hosts the phage can infect, the effect of the cocktail on the growth rate of the host population as examined at a certain time point from first mix of phage and host in vitro (as can be measured e.g. by $OD_{600}$ due to lysis of bacterial cells in vitro) and the elongation of the time to the appearance of phage resistant mutants (Time to Mutant or TTM). The phage disclosed above may be combined to form cocktails with improved infectivity profile, at least for one characteristic, compared to the infectivity profile of each member phage alone. In this example, the method of compiling cocktails with expected improved infectivity profile is demonstrated. Those cocktails may then be tested in vitro and in vivo according to the experimental methods detailed above.

In certain embodiments, it is wished to produce a cocktail with longer time to mutant (TTM) with relation to certain host, compared to each member phage. For example, referring to FIG. 1, in case it is desired to compile a cocktail with longer TTM for KP2, different combinations of phage are elected from the group of phage discovered to infect KP2. Such resulting cocktails are further detailed in Example 14 where cocktails with improved TTM are achieved.

Genetically diverse phage that infect the same host may utilize different attack mechanisms (Bertozzi et. al, 2016) and therefore, according to certain embodiments, the candidate cocktails are created by electing member phage that are likely to differ in their mechanism of action because they belong to different taxonomical groups. For example, as was further detailed in Example 14, a cocktail based on combination of the three phage 1.2-3s, 1.2-3b, and 1.2-2 from groups PAT, MTK, ST, respectively was found to prevent the appearance of mutants for at least 20 hours and outperform the TTM of each member phage alone. According to certain embodiments, the candidate cocktails are created by electing member phage having relatively distant genomic sequence. In some embodiments, the BLAST cutoff for % identity between each two members is no more than about 0%, 10%, 20%, 30%, 40% or 50%. For example, referring to FIG. 2. And to the cocktail based on combination of the three phage 1.2-3s, 1.2-3b, and 1.2-2, the % identity between each two members are essentially 0%. According to certain embodiments, the candidate cocktails are created by electing member phage with different mechanism of action, having different corresponding bacterial host surface proteins, as further detailed in example 12.

In certain embodiments, it is wished to produce a cocktail with extended host range compared to each member phage. For example, referring to FIG. 1, it may be desired to compile a cocktail that infects both CT-141-1 and MKP2_251_B. By analyzing the data in FIG. 1, two subgroups of phage, one infecting CT-141-1 and the other infecting MKP2_251_B, are defined. The first group includes 10 phage, and the second, 19 phage. Out of the potential 190 combinations to be tested, some are likely to have an improved infectivity profile than others when additional aspects are considered, such as the respective TTM or the decreased host growth rate following infection onset. Such aspects may be measured in liquid dynamic experiments when analyzing the resulting growth curves as presented in FIG. 16a-j.

According to certain embodiments, given the phage disclosed in the present invention, the following steps may be implemented for electing a cocktail: Consider all possible two phage combinations. For example, for a phage collection of 44 specific phage isolates there are ((44×44)−44)/2=946 potential two phage combinations. This number is well suited for high-throughput in vitro assay screening, for example, as detailed in Examples 7 and 14. Moreover, according to certain embodiments, it may be efficient to start by testing representative two phage cocktails that combine the most diverse phage based on taxonomical annotation or genomic sequence % identity. The infectivity performance of the two phage cocktails e.g. with respect to TTM and/or required host range may be compared and best candidates elected. If desired, a third phage member may then be added to leading two phage cocktails. Then, the in vitro screen process is repeated as in the previous round. According to certain embodiments, it may be efficient to compile triplets by adding a third member phage that is the most diverse compare to the already elected two member phage, based on taxonomical annotation or genomic sequence % identity. According to certain embodiments, this process may continue with further rounds of election leading to cocktails with more phage and improved infectivity profile. Eventually the process results in best performing cocktails with varying number of member phage in each. The in vitro testing of such candidate cocktails is demonstrated in Example 14 and 18, and further in vivo testing is demonstrated in Examples 15-17.

Example 20: Targeted Isolation of Phage Based on Known Target Sequence and Available Bacterial Host According to embodiments of the present invention there are provided representative phage sequences, representing phage that are capable of infecting and lysing KP2 variants. Each disclosed phage sequence is a representative of related functionally equivalent phage group having a sequence with homology above 80%, 85%, 90% or 95% identity to the representative phage sequence. In some embodiments, bacteriophages are considered to be "functionally equivalent" as long as they exhibit similar phenotypes, e.g., similar host range, similar lytic ability, and/or threshold sequence similarity (e.g., greater than about 85%, greater than about 90%, greater than about 95%, greater than about 97%, or greater than about 99%).

According to embodiments of the present invention, once the phage with certain sequence is desired it is isolated from an environmental or clinical sample, when the host bacteria (e.g. KP2) is available and the particular desired phage genome sequence is known (e.g. KP2-4a). According to some embodiments, First, the host bacteria is used to screen the environmental or clinical sample for phage that recognizes the KP2 host strain e.g. as detailed in Example 3. The genomic sequence of the isolated phage may be retrieved using NGS sequencing as detailed above. According to other embodiments, the isolated phage may be screened using PCR in order to test if the isolated phage genome includes the required sequence. According to certain embodiments, once a close enough genomic sequence is found, additional genomic alternations may be introduced according to methods taught in the prior art such as homologous recombination technique, Bacteriophage Recombineering of Electroporated DNA (BRED). According to certain other embodiments, the desired phage may be produced by synthesizing the genome according to methods taught in the prior art and rebooting the phages using assembled phage genomic DNA via in vitro translation transcription (TXTL) (Yibao chen et. al 2019; Jonghyeon Shin et. al; U.S. Pat. No. 9,617,522, "Tuning Bacteriophage Host Range", Lu et al.)

REFERENCES

1. Abedon, S. T., & Yin, J. (2009). Bacteriophage plaques: theory and analysis. Methods in molecular biology (Clifton, N.J.), 501, 161-74. doi:10.1007/978-1-60327-164-6_17
2. Altschul et al., 1997. Gapped BLAST and PSI-BLAST: a new generation of protein database search programs, Nucleic Acids Res. 25:3389-3402.
3. Atarashi et al., 2017. Ectopic colonization of oral bacteria in the intestine drives TH1 cell induction and inflammation. Science, 358(6361):359-365.
4. Baym et al. (2015. Inexpensive multiplexed library preparation for megabase-sized genomes. PLoS ONE, 10(5), 1-15)
5. Bertozzi Silva, J., Storms, Z., & Sauvageau, D. (2016). Host receptors for bacteriophage adsorption. *FEMS Microbiology Letters*, 363(4). https://doi(dot)org/10.1093/femsle/fnw002
6. Y. Chen et al., Dysbiosis of small intestinal microbiota in liver cirrhosis and its association with etiology. Scientific reports 6, 34055 (Sep. 30, 2016).
7. Cole et al. 2014. Ribosomal Database Project: data and tools for high throughput rRNA analysis Nucl. Acids Res. 42:D633-D642
8. A. Davin-Regli, J. M. Pages, *Enterobacter aerogenes* and *Enterobacter cloacae*; versatile bacterial pathogens confronting antibiotic treatment. Frontiers in microbiology 6, 392 (2015).
9. Diene et al. The rhizome of the multidrug-resistant *Enterobacter aerogenes* genome reveals how new "killer 10. D. Gevers et al., The treatment-naive microbiome in new-onset Crohn's disease. Cell host & microbe 15, 382 (Mar. 12, 2014).
11. J. H. Grose et al., Understanding the enormous diversity of bacteriophages: the tailed phages that infect the bacterial family Enterobacteriaceae. Virology 0, 421 (November 2014).
12. K. E. Holt et al., Genomic analysis of diversity, population structure, virulence, and antimicrobial resistance in *Klebsiella pneumoniae*, an urgent threat to public health. Proceedings of the National Academy of Sciences of the United States of America 112, E3574 (Jul. 7, 2015).
13. Hyman, P., & Abedon, S. T. (2010). Bacteriophage host range and bacterial resistance. Advances in applied microbiology (1st ed., Vol. 70, pp. 217-48). Elsevier Inc. doi:10.1016/50065-2164(10)70007-1
14. Kazutaka Katoh, Daron M. Standley; MAFFT Multiple Sequence Alignment Software Version 7: Improvements in Performance and Usability. Mol Biol Evol 2013; 30 (4): 772-780
15. Kutter, E. (2009). Phage host range and efficiency of plating. Methods in molecular biology (Clifton, N.J.), 501, 141-9. doi:10.1007/978-1-60327-164-6_14
16. C. A. Lozupone et al., Alterations in the gut microbiota associated with HIV-1 infection. Cell host & microbe 14, 329 (Sep. 11, 2013).
17. S. Mondot et al., Highlighting new phylogenetic specificities of Crohn's disease microbiota. Inflammatory bowel diseases 17, 185 (January, 2011).
18. E. G. Pamer, Resurrecting the intestinal microbiota to combat antibiotic-resistant pathogens. Science 352, 535 (Apr. 29, 2016).
19. N. Qin et al., Alterations of the human gut microbiome in liver cirrhosis. Nature 513, 59 (Sep. 4, 2014).
20. Altschul, S. (1990) Basic Local Alignment Search Tool. J. Mol. Biol.
21. Bankevich, A., Nurk, S., Antipov, D., et al. (2012) SPAdes: a new genome assembly algorithm and its applications to single-cell sequencing. J. Comput. Biol., 19, 455-477.
22. Diancourt, L., Passet, V., Verhoef, J., Grimont, P. A. D. and Brisse, S. (2005) Multilocus sequence typing of *Klebsiella pneumoniae* nosocomial isolates. J. Clin. Microbiol., 43, 4178-4182.
23. Jain, C., Rodriguez-R, L. M., Phillippy, A. M., Konstantinidis, K. T. and Aluru, S. (2018) High throughput ANI analysis of 90K prokaryotic genomes reveals clear species boundaries. Nat. Commun., 9, 5114.
24. Martin, M. (2011) Cutadapt removes adapter sequences from high-throughput sequencing reads. EMBnet. J., 17, 10-12.
25. Ondov, B. D., Treangen, T. J., Melsted, P., Mallonee, A. B., Bergman, N. H., Koren, S. and Phillippy, A. M. (2016) Mash: Fast genome and metagenome distance estimation using MinHash. Genome Biol.
26. Yibao Chen, Himanshu Batra, Junhua Dong, Cen, Venigalla B. Rao and Pan Tao1. Genetic Engineering of Bacteriophages Against Infectious Diseases. Front. Microbiol., 3 May 2019.
27. Jonghyeon Shin, Paul Jardine, Vincent Noireaux. Genome Replication, Synthesis, and Assembly of the Bacteriophage T7 in a Single Cell-Free Reaction. ACS Synthetic Biology 2012 1 (9), 408-413
28. H. S. Said et al., Dysbiosis of salivary microbiota in inflammatory bowel disease and its association with oral immunological biomarkers. DNA research: an international journal for rapid publication of reports on genes and genomes 21, 15 (February, 2014).
29. C. L. Sears, W. S. Garrett, Microbes, microbiota, and colon cancer. Cell host & microbe 15, 317 (Mar. 12, 2014).
30. E. S. Snitkin et al., Tracking a hospital outbreak of carbapenem-resistant *Klebsiella pneumoniae* with whole-genome sequencing. Science translational medicine 4, 148ra116 (Aug. 22, 2012).
31. Y. Taur, E. G. Pamer, The intestinal microbiota and susceptibility to infection in immunocompromised patients. Current opinion in infectious diseases 26, 332 (August, 2013).
32. Tindall et al. *Enterobacter aerogenes* Hormaeche and Edwards 1960 (Approved Lists 1980) and *Klebsiella mobilis* Bascomb et al. 1971 (Approved Lists 1980) share the same nomenclatural type (ATCC 13048) on the Approved Lists and are homotypic synonyms, with consequences for the name *Klebsiella mobilis* Bascomb et al. 1971 (Approved Lists 1980). Int J Syst Evol Microbiol. 2017 February; 67(2):502-504. PubMed PMID: 27902205.
33. I. Vujkovic-Cvijin et al., Dysbiosis of the gut microbiota is associated with HIV disease progression and tryptophan catabolism. Science translational medicine 5, 193ra91 (Jul. 10, 2013).
34. Zhou et al. 2011 PHAST: A Fast Phage Search Tool. Nucl. Acids Res. 39 suppl. 2: W347-W352.
35. U.S. Pat. No. 9,415,079. Composition for inducing proliferation or accumulation of regulatory T cells.

SEQUENCE LISTING (170 sequences)

SEQ ID NO: 1 - DNA, 177973 bp, Unknown
  source: /note="Description of Unknown: 1.2-4br Bacteriophage Sequence"
aattgtgttatcatcaacgtcaagatacgtatcttgactttcgcagataaacagtttgcgtttttcttctccatatgcgaagtagatactgaacgattccatacgatgacggtcgaccgtgatggtttccacttcaacctttggatctttgttcagttcatctaacacaccctgaatgatgtgcagcatgttcggcttgatgatagtcgggtgactggtaataactcgatgtgatgtgctcataatttaatcctcaatagttggtacacacataataaaaaagcccctgcgaaattgcaagggctttttatcagataatgcgtttttcttctaacagcttcgcggtatggttaaccatgcgagcgtaatcacgggcttctttctttgaatacttgaatcccgcgttgtaactcgccagcgcctttttcaagtcgcctttgtggtaatcaagccagtattccagttcgtgaagtgcatacttggaaccaccccgaagggtttcgagcttattgattactacgcgtttggaatatgatttatccattcgtgcggacgcgctacgggctgttacttgaaaacaaccataagcatgatgattctttttgcctttccctacgttctcacatgcgcgagactcgatccaggcaatagccgctaaatgatatcccaaacgtttcgatgtttccgattcaactggctttgcagttttgcgatcgtactcatttccgatcctgaaagcgtactccaaaacctttttctgctttggtgtaatatcatccaattccttaacatagctgggggcattggctggcgctttcttcattactgttgcttgttgtagcggtaaagttgacttcacagcggggagtgtttggataaactctcctaacggatcagtcgccgcgttgccagaaaaagagcataagaaaatgctggcagcaaagataattttcttcattgtaatacctatttgtaacaagagagggctatgataccctcgtcttattatttatgcaaccattttaaatggttttcgcatcgctcagtttgttctcgatgaattcagcaagattatagttcgaaattgatacgttcggatcgtatagtgcaacgatttcatcgaacgacaccataacagcccgtttaaagtaaacgctccagctagtcgtaaagatttcgctgtgatcaaatccacaattaggactgaacaaggcgcggtattggtatccgctgtatttggtcagacggcttgtgctgtgcgcgttactggtgatcaggaatttccctgtgtgagtctcaaccacgaagaaataacccagacgttctttattgtccagcatcgtttcaaacttacgattgttttcttcgcggtcaacacgggtttcgatcatcttccagacctgttcatattcaggccaatcatgctcgacaacaaccccttttatgggttctttgccttgctctttacgatagcgatcaattttattcactaccgcagagagaagcagtttgtcgctatcacttaacgcggcatcaatatccgcatatttaaacactgcataacgttcttcgcgtttcatactactacatccttatcacagaccggacaccggatcacacgatacacatcacgaccgccagtgtaatcggttgataccttttctttgacatcctgtgcagtgtatgacaggacagcaccacaacgacaggtagtttgttttggggtaatgcttacaacttgtaccataataacctcacaagaatagtttcacttcgctaccacatttcgggcagacgatatgttttttcacgatgtaatcagcagcacggaagaaaccattataaaacgcttcggttctcttctgtacatcagacagttcatactctaacccacttttgcagttagcgcaaacggtaattagctttggactaacaataacgctgatcatgtatacctcacgaaaaagggggccgaagcccccttaattaaaagttctcttcgacgaatgcagccagtcgcccacgatatacggtatccaggatcacatgacttgaatgaccgtactctttaagtttttcaaccgcatacacaaagccgttgttaacagcagtgttgcgcgggttgtcaatctgtttaatgttcccgcatagtatcagaagggtgttctcaccgcaacgggaaataatggatttgatttcgtgattgctcaagttttgacattcatcaacaatcagaaccgaacctttacccggatcaggatgcccgattgagcgcccacggaagtaatacaggctagggaactggacaacgtttttctccagcagcccttctacatatttgtcaacttccggttgatccttaaacagaatgttcaggctcgtaatacatggttctacagcaggacgcagtttttcgcccagagtaccaggtaagaacccgatttcgcccgacagaggactatccgatttaacatacatcaggtttgcaaagtgtccggcgttaaccaggtgcattgcaccagcaacagccagcattgttttacctgaaccagcagcgcccatgatggtcaccacatcggtatttttatccataattgcatcaatgaatgacgcttgcagtgcatcgcgaggctgaattgttttcatcagcttacgcttcatcgcggattcgtgtttgattggtaagagttcaagctgatactctccagcagccactacacgccctacgagttcaccatccgacagaatgtattggttcgggtaataatcgccgtcaggaagcgaggaatagcttatttgggctacttcgccaacatatcctaacacctcgacatcatcccagaatccagggatatcgacatagccagaatacaacacatcgctatctttcagcgagtcatcgcccgtgtattgttcaacaggacagcccttagacatcgcgatcaacagcatgttaatatcgcgggtgatcagggttgcgttttcctgcatacaggtagcgataattcgcgcatcttgtttatcaagcgggaactcttctaaaccgatataatcaacgatacggagtttcacgctttccggcagtgctgggttcgtcaggttcaacgaaacccctgtttgggtaattgcttcgtacttctgccccaggattactttagacaggaggcggatcgccaatcgtgcttcatgagcggttcgctctttacttttcaggtgatccagttcttccattgtcgcagaggtgataatgatttcagtacccgcctcaacgaatgagaagattgaatatgggttcgagattaaaacgttggtatctagaacatatttcatagaagttttcctgttaattgcggggtacgcggattcgcaccccgcgcactgcaattacatacccaaacggataatatggatatatgggaacggatgaagatgacttgaacgcatacacaaggtcagcgtttttgccagttcaaaccgttcgtcgatcgtcgtgtcacattcatcgaaaatcaggttgattgcctgatacttgatcgtttgtccacggaaaatggaagtcagatcttgacgtttcgacagaatgaaagacgaatcagcgcccttatccagtccatgttctaccgcagcacaaatacccatctgctttgtcggtgcaacgtagatattcagtgtccctttagactgcttgatgatatcgaaagccgctttggttttacccgacatccgacccatatccagcgcagtttcgaagatagacacaccgccgcattcttgcccccaacgcccatcaacgattcgcgcaaggtgcaggttacgtgactgctttacagcgtcaacatagaattgtgaaatcatattgtcgccttatgcaagttcaacgtgtggtgcgtcgataaatttcgtttcaatcggaaggttcggatcgttcttccagttgatgccgtagcgcagttttacacccagttcatcagcggcttgtttcactgcattcaggacaggcaaccacactttcgggttagtctgccagccagcagggagaacgctaggatacagatccacagcatcaccagtgatgtgttttgagttcatggtctgggaaacacccttgcggacgttctcgcgctgttgctctacggtgcgcagaccttcgcgtacaccaaaatcaacaggcgagagttccagagcacgttttaccaccttaaccagttccggcttcacgccttgcaggttgttcaggcttttctgactaaatttaaacatacatacctctttatgaaaataccctatgggctacacagggtatttacggtttaagaggcgcaacgttttacatgtaaccccaaattgcatcttccgcgcgatcgcgtttccagcgaatcgtcatttcaacactctcctgtttgtcatcaggaggaagtttatcattattgatttgttcaatatatgcttgcgcatctgcttcgctacggaacaacgcatggaaattataatggttgcgcccagttacgttacgatcatccagagagaattgacctttattttcccaatcatcatacacagtgattccgttaacaaacagccccagcccacgatgttcacgcgggaagccagtgatgatatgttttcgacccatctgtgccttttcaccagtgatactgattacttcgtacaggattgcgccaggtttgatatctttcaggacagcacgtttttcaaaagcgttcataatgtattcctcacaattagttttcatatacagattaccacaatctgttttgatgtcaacaaggtctatcgtttttatttgggaaagttaacgtgaacaggcgatcgtgtaatgcttcgatccgttcatacgcttgtttcaggatcgtcttatcttctgggttcgttgtctcgatgcagatcagttcgtccgagtcgatagcaatcacatcatccatcagtgaagcgaatacgttcacgtcagggtgagtcaattcctttatctccgcttccatcccgtcatgctgggataacagttcgatgatatcgcgctgtaaatctccctggtacgggaatccggtttgaagatggttgataattctttctgctttggtcatatttcacctacaaaaaagcccctttcggggctgggattaaatgtctttgcactggcaaacaccgtatttggtgaaaggcttgtcaccgctcaggtaagaccagaaatcacaagcctgttcagcggtttcgaagattgcagcatcatagaagccgtgttcttcgttaccgtctttattgaggaacacaggaagccagctttgcggtttgaagcagtcagtaacaactacccaaccttctttcgctttcattgcttctttgttcgcttcaaccatttccagcatttcgttcagtaagttcattttaatccccttgtttatctgtttcgttgtctacgagagagatattatcacaacggggattagtgtcaacagttattcgaaacgaattgtgctatttttgaaaaacattccagagcacacagatcctttgatctgcttgccgttcacaccagttgcttcgaatccggttgaatatgtgtctttttcggaacacgcaaaccacttgtaacccgtgaactggatgttcgtataaccctgtgcttccaggatacgctgtgcctctttctcgtcagtacagcttgactgcaagaacacaacaacgacaaccatcaaaatacacacaacaattttccacataatttatactcttttaaggttagttttgctggcttcgatccagcctgaatagttcggggagaaatcctccgccatacccaaacaaacggtagtatgtcctaatgggttcggtgtcgttactttactattgggattgatcggaagttcactagccccaacactggttgcaaacaccataccaccagttacgtaaatggtttgaatatgcccgtaagcgtcaccaggccacttgaaacggtattcagtgttccagaccttgacgttatacacgtcatattcatcgaagaggggatcgttgccctttgtcgcttcgtaaagcgcaccgcgccattcaactaaatccgcttcgatatcacttacacaaaactcttcttttgcgctcagtttatcaagcatcatttcaatagtgcggatagccatgcttaattcacgatcgagtttcataatcaatttccttaacaacggttaaatgtttttccgttcttagtctgaataattccagcgcttcttctggggttcttccatcgtattggatagtatgaataccagatttaaaagtcaacggaacccagaaaaacccaaatactcgtttctctaacttgtatgttctttcaggaacccatccaggcgtatgaacttcaactacccgaattttcatacaataccctcttcttcgagcacttcccagatcaggcgatccaggtgcatcaggttccacataacggagtcatacgaacccagcgagcgggagtaaatcactccccatgaacgataagccttttggaatgattcagcactgttttcatcgtgcggcatatcgtcacccgaagcgatcagcagtttcagaaccatcaggctattgagcgcctttggcgtgaattcctgttcgcttaacttcatcgcgtaccgttcgatgatcgcgattgacttcggatctttaatacgcccatctgtacgacgcgttttaaacgcgctcattaattcatcaactacggcggcacacttcatatgcttcatccttttcctgtgcagacatccgattatagcggatctcttcgcgctgttcaacttctctcacggcttcggctttcttttcagcggtcagtatgtgatgtactacagcgtttcggattccccagagatattcaatcatctgcatatcttcaacggtgtgataacctttcgtatcacattcaaatacaatttcatcgcgttctgccattgccacctgtgcggtagaaggacaaataaccattccagagtatttttcaatcaacgattccagtgtacgcggttttgttggaatgtcaatagataccggaaccattcgcatcgttgaatcattatgggattgataaatcatcagaatgtgatctccgcaaactgcattctacgctcaatcgcatggatagcgttatcacgctgttctttgttttcatatccagcccaggtaatcggggttgaacagatcaggtgaaaagtgattgctgggtgtctcttcccttcaacaacgattgttgcatcatcttcgatccaggttacgtgatccagattcaccggatagtttcttacggtaacagtttcaccaaccataggcgacacatccagaatatcacgatcacgaacgtatgatttaatacgagatacgattaacattatttcaactccactgcatatacatcggtttcaggggctttgtgtacgcgcatatctttaccacataccgcataagccggacagttacggcaaccgttatgatccttgttgcccgtcagttctttacggaactgttttgttttcgggtgttcccagatatccttcacaaaatcttcggcttccagaacatccagaccttcttcccagccaccttcaacccaacgttcggtaaacgagcaagggaagaactgaccacgttcattaatgtaagagctaaacatcgtcgcttcacagtcttcggcgtattgcttgtactgttcgaagttcgggtgtccctccatcgcttcaacgaaagcgggggctgaacagctatcgaatccaaatcctacaccagaatcgaggcaatattcaacaagttttttatattgttcgcgggtaacggtgtcccagttcttaccgcgtcctttttgtttcagtcccaggaacacgatcgcgtttacttgtttcaggcgcggatcattcttcacggcatcaaccacgttaaacgcgtcatcataggttttcgagctaaccatgaagtgaaggttgatttgctgttgtccggcttctgtcaggttcgctactgagtcgaaagcgacatcaaaaccagcgtgtttataaaccgataccgcaacagccccagcaaccgccgctaaacgcgctgcaacgtcttttgatacgtcagcaatggtaaggttcggcacaatgcctttagaacgcgcatacgccatcatatcgaacatatcggggtttgtttgcccctgtgcatcagcaccgagtgcgcattgagtaagccagggcattttgtcgatgatttttttgaagttggcaagatccatgttgaacccgttcgggttattggacttgtagcagaacccgcagagtttacccgctggcccgttgcatttggtagtgatctcgatatcgagaatttcggggaatggtgcgtattctggatcgtgggaatatgttgcaccccagcgagcgaattcaccagtatcaacgttgaaattatagttgtagaacttcgagcgagcgaagcgcatattgccgtgttgatagatgaacagggacggcgctttgatgctggtaacgatatcgacagttttcataatataattctcaaaatttaacatgggattggaagacagcgcgagcaaggctttcattgtcgaacggtatcgactggtgtttctctttgctgtcaatgttaacgcgccagaactcactcgaaccgtttttggtggagtaatgcatcagcgttaccgttttattcttttccaggaaagtacgtttgtcaatctctgttttgatttcgtgctgcatcattttacactccgtttcagtttacgttcgtcagccagttcttttttgtacagtttaatgtacttcccgttaagggtgcgaagctgttggaaaaccttgttgcacaaagcacgtttcgctttgtattccggcgtattgcggattgattcgatcgtcatacccatttcgtttttagggtaagcgcttaactccgcgccgatctctctgtaccagttgcttaactgatcacgctgtgctttgtactcttcaaaagttaacattataactgatctccgtaatctttcgctgcatcttcgggggttgcatccagtcggtaaagctcaacggctaacggactgggtttgatttcgcggttcaggatctcactgataccgcgaaggaattcgatataaggacggaatctcatttgatacgtaccgcgttaaaagcctggttgcgcagttcataagcctgttcaagctgttcagtagtgaacagagggctatcggtattagtggtgaaactgcaaatggttttgttgtcggcgttgacttcttcaacaacgatttcataaccccatgccccgctgtactcacatttcacgttccggtacttgatgtaaaccgctgcaacatcttcttttttgtagttccggcttttgtagatgatttccatgatatcctccttcgtttcgatgtgtgtacaataacagatcagggttatggagttttagcaattcgtgctaattatgccattttcttagcgattttccatgcggctttgaacgctggaacatcttcaacatcaacccagaaaccagaaccgaaaccatcgttgtagcaagggcaaccgtcgcagtagttttcccaggtcatcactttaccaccaacagaagcaccagtttccatcgcacgtaatgcatcttcaactttttccagtttttctgcattgtcgtcataaatgatgaagtaccatttgccgttgtattcgttacccagtttgattgcttcgcgaacaagtttcatgatgatttcctttttgtctgtttcgtttcgatgtgtgtaatataacaaaagcccctggcggttgcaaggggctttttaaacaaaaagtgctattttgtttcttcgaggattcgaaggatttcggcgcgggtgatcggatgttttgccagctcacggatcgcgtggtcaacgtgtatcttacacatcaaaaacttctccccgcacttgtcgcatgttgcatacatatcgccatgtatacgcccgatcccatcggttacggaatgatgcatccaggcgtaaggagttccccgcatccatccggtagcaacatgtttacattctcgttttcgtccgaacatattaccacccgttaggattgcggaaatgtgtttgccagtagcgcagttgttcgcggttcatgttttgggtatcaatcaccataccctgaatcatctgcaacatcatgcgggtttgattgacatcctccaggctcgctatacgctgttttaaggctttgttttcctcttctaactcaaccatacggttgtatgcgttgacgcgctccagaggcatatcagggcgctctttgaggacacgggcgcgggatacttcgcattcgtgatttgctttccagtgcgcggcttcattttctgctttttgcttatctcgcagcgccaatgacaggtcatcaaccagatccagaatagtttgcggatctacagtttcgagatattttccgagatcctcttcccagcttttaatctgtgtagggctgtcgccatatggaacaccatatgagaatgcgcgtttatactctttgcccctgaaaccatattcctgatttccctggatgcttaaattttcaacgagagtccacttactacccatcatagaagaaatcgaacgggctgatttttcaatttcttcaagtttttcacttgttactttcattttgtactccacaaatcatattgtgcgcgaaggatagcgtaaaggctaccgatattgattgaatcgaccggacactggaacaaatcagagcgcatcatattgaactcaatattgttctgttcaacgaagttaccgatcattgatgtccagcccatcaccaggttatatccgtcttcggataacccgtaagccaggttaaccctgatacaacgcttatcagccagttctacgctgatacagttacttgaatgcatagaattgcatgggaatttgctaggaaacttacggaacatctgggtaaggagtttagccgtttcaatgttgatcgcgcgttcctgatccctttgcgcctggttgtcatgaaggcgattcagatacttttccatttttgggttgagattcacatgttgcataatatattcctcacaggtttaaagcgttcttttccggttccattacatgaactgcatttcggagatcggtcgctatcatatcgccccgatccgttacatgcaacacatttccgtaatttccagccatacacgaaccgcatgtaataatcggttcgtgcggccttgcgttcgtggaagttcatactttgttgtaaacctgaaccagccacatttcgatgttcggcgcgtaagtaacgtttaccatcggcatagtgcggtatttgtaagcggctttgtacgcatcgagttcagtcggaacacagaaagagaaaccgttgtcataacgttctgcgttagaaacttcacaaccaactacagcggcaatgtttttgttcatgttcatgatgttttcctttctctgtttcgtttcgatgtgtgtaatataacaaagcccctgcatttctgcaagggcttttttcaagttattcgaaatttgttggcaactgatctacaattacctgagtttgatggatttcttcactcaatttatcgcggtaatgaaccagttcacgggttcttgatgcggaatagctaatgattttatcagcggtagcggtgtaaccgtaaccagcacatgcgatttccagttttgcgttatcgccattcggtacgcggatatgagcatacgtcagcaagtttttaaccgcttgtaacagttcatgatcttctttaccgatgataaactgatttggttctactgaatcaatgttcagttcttcgtctttgttcattttgcagccttatacatttcaaggacgcggttcatatgctcttgtgattgaggcacacccgcgaagttcagtttgatgaagaattccagacgatcctttttggtgcattcatccagccccagtgcaggtaatgacatattttcaaaggttcgctgttcgtgtcggggtagttcatgccagaataaacgggaaccgtccggcataggaagaccaatttcaccttcgtaaaatttgataatcgtcgtcaggcgttgtttaccgtcgatgacttctacccagtgagtttcattgaactggctatcaaccgcgatcgcgatgacaccacaagggaaccccgtcattaaggtagtcagaaacgcatcttgttctttctgcgtccacacgtaggggcgctgataagatggattcagatccagatcattatgcttccaccagttgagataactcccaaccatgatcgcatgatcgcgactacgaaaagttcggagttcccgaagtcggttatgaaccggaatatcatctttagacatgattcaccacccaacccaacaaaccagtattgatagccgcaacggtaaggcaaatcaccgcatacacccgcgcgttgtgaactttggttttcagttctgcgatctcctgatccttttcactttcgaactcttcgcgggttccatagtaaccaggatcagcagcggttgcgggacgaactgcatctttttcaacgatggttgcataaccactcgttacttgcgttgcgccgtaccagtcaccgcgatcggtgttgatgatcaagtgatcacccttcgcgttagctttatgcttcgacttgccaatgacaattacacgttcaccattcataatataatcactctttcacgttttgttgtaagaactctaacagctttccttcggcctgtaaagcataaagtttattcaactttgcgatgttttcaaagtctgatttttcgctgaacgaccagacaccatcatcggaaaccagcgcaccgattgatacgccagtttcaggatcacgcgtcaacgccagccccaggggatgcaggatatctttattgattttccataccagccccaattgagataaggtgttgaaatcaacgtgactcatttaggcaatgccccgaaagacagcagccccatacgatgatcgttatctgattcaccagtgctaaattcaaattcttcaccgctgatactgatagcgcggaaaccgtctttcaggtatggcaacagatacagagggatcagcatcatgtttgaatcgtcgctccacttacggaagcccagatttttcatttcttccagcgtcaaatcattcggatcgacgggttcgaaatcaggggaagcgtaaaggcgtccaggcagatcgcgaatatttttcacggtgaatgaatcaccccatgactgatacgcgataggttcagcggcgcgggttgcggtagccagaaggatcatttgacagatttgaaaagttgttgctttcatgatgtatatcccacaagtttagatagaagatgtcccatagtcttacgcgcatgatcgcggatctggctatacggaacatatttgaaaccgtccatttctgtgatggttcgcccgttcttcacgaacgttgacgcacagaagcatttatcggcttcggggtaattattgcctttatacacgaataagtaaagctcttttttactggtataatccagtcttccgaggctttccagttcgtgcggttcaacaagaactccagtttcttcgaagcactcacggatcgcagcgtgaataggttcttcgcctttttcgatatgcccctttgggatgtcccaatgaggcgtttcggttgcgtggcccattaaaacgctgccgttattcaggaagagaataccagcagaccgttccattactgtgctccgaacttacgatcgtatgctgccagcgctttatctgctgcatcaactgcctgagtgtgtttgttagcggatttctcgctgaacacttcgcggtaaatggcaacccagagggatcggcgggtctgttcgctttcttcattgacgcgagaagccgcaaaagcgttatgttctttgatcagttgtgcgaattcagcatcatgatcaatggtttgttgttgaatagctgtagaagtcataattcacctatttctttcagttcagttttgagtttttcgagagtcgattggtactgaatgccgttttctggatttggcagacgggcataatacagcgtaccagttttgttgatgtctgacaacacctcttgatcgagggtagccggatcgatgccaaaagccattttaaacatggtttccgcgtctggggcgaatccgtgagagaatacaaaccccagctttttatcaaactgcatcagggatactttgttacccattgatatcttattccccataatgttcttcgtaatcctcgcattctgggagataggtttcgcagaacatacacagcgtgaagaatgtaggctggcgaattccgatattatcgggtaagtacatccagaacgtgttagcaaacacgatgaacgttttcaggttttcaacggttacggtactgataccgtcataaccggattgagtaattgcgcgttccaggggaacagggtattgctcgcagtagttggcgtaatgttcgcttgtcaccagcgcattagccgcttttacgagatcggtaattttcattcaatatatccccaacgaatttttacgttatcttctgacgccggacttgtaggagttgggtatggataactttgcgcttcccacagataaacaatggcgtgttttgtcaattcttcgataacttcatcgaaagtaccgacactggtttgtaaaggcaacgagaaaggtttatcgttggtttctacttgagcgattggcccatctaccaagataacacgaaccgttgtgtgctcagacatatgagcatagattttgtttttcatgcgggtacatattccactttgacaggttttgcgataaggcgttctttagtgaagccttgcccgttacagatatcacaagtaacattgaagtcttccatctgatcaacccagccagaatccggtaagccagaaggatacgtgttaacacgtttgacttcgaaccctttaccctcgcatttcgggcatttgtgtgggtactgggatttaaccatactcagcagttgccccagcgttgttgaacgatcgaagcgttcgaccagtgccattacatcagcaatacgaatcgaaccagcatcaataacggtatacaggtttttcggtacatttgagcgcatagtatatttctcacttaaaaaattttttgatgaaagagaggaacaagccaccaccgaacatgatccagtatcccgcgccgtcaccgttaaacaggacatacacagcgacaccatagcaaaagatttccgcgatattcagtaagtttctcataactccctcctttgtctacaccaggtattttaccagaaagtagattactgtcaacaacaaagttttatcaacccacttatcaccagtcattagtaatcccctacaggttgagaagatgcaacgctcaggatacggaaagagcattcattccatttgcaataagttttcgcacagtgaacagtgcctttcattacaaacccgtttgagaacaccagccagtaaagtttcatgattgcctcctttgtttcgacacccctaatataacaaaagcccctgcacgaatgcaagggcttttttcaaatatttttcaacatgtgtagttgaggcggacaatcttttgaagcaatcaggcgatccaggcgtgacataacgcgtctgtagccgtcatactcgaacttgattttgggtgcgatgtagttcacatggatcgcgtttcgcgtgttcaggctcaacgtgtactcagggataacggttcggaatcgtacagcaatcactggtttttcgtgagcaaccgaatcatccatgttttcgaacatctggacggtgaacgcacaggcaaacactttgccattgatccggcgatatgcaatgacttcctgcataccttcgtttttcgctttcaccgcgtaatacagaacgttacacgaataatgtttagcgagactattaagaatttcactgtagatcgcaaagtcttttttgactgacgcggaacgatccaggaatcggtctgcgatgtgatctgtagtcattgaaacctttgtcacataccaatcacttaacgctttactgaaattttggttaacttctctgcgtaagttattgataacatacatcaatcgtgctctgttcataaatcacccattatgtttaaagtattcgatttgacgcagacgtttttccgctgcctctttcgaatcatattcaccaagttctttcgtgcgatcatggttcagtataacccacttatcgccgcgatgttcgatgtgctccgtgatgtcttcgactttcttatccagatccagcggttcagcatcttcctggatgatagtcaaatctacgggcaatgtcaacagtcttttaactccgctgatatcttcgatgcgggaatcatacgcgagggttacatgtggtttgtaatcgtcataatcgtatgttgctccagcatccattgcatctttgaagcggctatggagataatcagactccagaacacccacgatcgtattaccgtatttcgtttcccacttctccacgtcaaccagtcgggcaggttcagagataccggatgcagggaacagatcaaccgtcttacggctatacacaatcgttgtatgcagctttgcagcggaaacaggattctctacacccagaagtttttgcaccttcgcgagcgcttcacaggaagcctgatcgaacttcgcacacatatagatccccggatcaactacgggtttcgctacttcaataaaacttttcatgtgtactccaaatgaaaaaggggctttcgcccccagtggttaaacgcctaagcgttaattatgcttttgatgcatcaatcgcttcatcgtcgccagcggtttctgctgttgctggcagaagtgctttgatcgcgccgaccagggcatcaggggatacaccctgcgaaccgtcgatttccagaagactgcaaatttggcctacgagttgacggtgatttgccagttcttgttctttaccctgaatgatttcgttcaggtcgaatacacgggctttcaggatcaggacatcgttttgaagctgttgggtttggttttgttcagtcattgtttacactcttaaaagattgaatacattaagcacgttacgtttcaaatcgtctaacgtaccattatttaggattgtataatcactcaagccaggtgtcaacccttgctccgttgaatgattatcttcaataccagtttcacgttcaaggaacacaaagcgagtcccgaacttgctcaggtatttatattcatgcggttgacgcacatcggtaatgataaagtgatccgcgtaggatttcaacattttttgaagcgcaattgaagtccagatagacggatctattttacaaacaatatcagtcccgaacacctgcatcaaacggcgaatcgtccagggctggctgttttcttcgcaaattttatgagcgataacatctgcgttactcatgaagaacccgcgagaacttaattttttgataccgctagaaaacagcgcgtatgcatcgttattggacatcaccagcggggcttcacgatcaccctcatagaatgggttcttcgctgccagcgctcgcaattgcgtgttatcgtgatgttccatagaacgtttcaggatagctttgatttcgtcggctaacgcgataacttcaacattgcggaagttatgcacaaccatttgagcaacggtatctttacccgttcgctttttaccacaaataccataaatcatttttgcgttttccgtggagtaggcacgatcacccgtccgtcgatctcaatttccatgtgagcgaagttgaacatcgtcatacaggatacggcttcatccgaatcattggtatacataagctcaagctctccgaggttggagggccaagcgccatagaagcgaaatgtcgctacagtttttgactgcgagttatccaggatatgcaaagccattgcctgttgtggttcactccaacgcacggaatcgaaggtgttaaaatcgacagtaccgagcatccaaaggtaaaccccaagatacgatcgcagttcttcatcaacagcaaaacgaatagtcagtggatcgaactccattgcagatcctgggatcttccctcgaatcattgggttcagtgggacatccgtaattggaatgttgatagcaggtagtgtaacaccctgaacctgtagtttcaacccttttacataatcattgtcaggaatatctaacatgaagttagtaggtgaaatctggttcaggatcatagcagttgtattcatgatgatctccattttatagatatttagatcaagaccgtgagcgaagcgaacacacgaacgaagtgagtgttatgtacgatgtactgtttataatatttatattttatatatagagaaaacagtacatttccgtatactttttatacaatcgttaactatccgtcttcgcttcgcttgacggaactcgcttcgctcgcgatctaatttttagttgatatattcaataaataggtatactatacctatactttcaaaagagattgaaaacatgaaatcattcaaagaactactttctgaatctgttcagaacaaaaaatttgctaagaccgttgatctggttgaccgtggtaacgctgcaaaaggtcagattggtttcctgcattttgcacatggtgctgattacgatgtgtatgcgccggactcccacgatctcgcttacttcggtaaaggtgttgtccgcctgaaaggtaaaaccactggcaagactcaggcagcgtatattgactgggcgaaaggtactgtttcattctacagcggtgatcctgctgatgacctgaaattcgacaagccactgaaattcaaaggcgcttctctgtacaaagaagcagaagaaaacctggatctgtataatcagttggcggaagatttcgaaattgatctgcctctggatgaagcattggtgaaaggaaaggtgtacaagctcccaagtaacgatatgtgcttgctgtataccggacgtaccaaaaccaaagaaacaggtgaatacgccgtgtttacggttgtagatgcctctggtaagcctcgtctggtatcgggtaaacgttttacccaggaatacaaaggtgatgttctgtctaaactggttctagctgaatcagaagatttgaacgaagccgctaaagatattcgcgaaaaagttattgcggtgttggtgaaacgtgggtttaacgaaaaagacgcagaaaagatggttgataaaaacctgaaagatgcgatgaaggttcgacctggcgcaacccctggaaaactcgcggaaatcgtgagtaccctgtaaaaataaagccccttcctttcggttggggctttttgttaatatctgttccaaactttcttcgcgctgtatggttttcctttggactggaaagcctgtgtaggcaaccaaactgctttcgcccaatcttttggggcgatctctgcaagtggtgaacgtagatgggctggcaggtaggctttgatcatttgatcagccccgcgcattcccttcacgttgttccaattgattttcagtctggttttgttagaaagtcgatctgttgatccgtagccacgtttcaggagttcttctaaaaactcttgacgtgctcgcggtggcgcatagtgcaagttcagcccgtacagaaccaagttacccgctttcgaacgtcctgaacccaggaaaatgatcagcgggaaccgatcccagtatggaagggtgtctttgtatttcgcatcgtagatgaacgtatacaagcgacccgttgctggtttcgcaaccctgtgcgtcttaatgctggttttgatgaaatcaccaaaccaatcggtcgaatctttctgacgtttcgcagcggttacaccaacagtcattttcttcaaactgttgcggaaatcgtttacgatatcaaccgcgtgttttttacgatagtcattacgtttgcgtcgggcttcggtttctgctttacggcgttcgatttcatcatcaatctgctgcttatagcggtgcatagactttgtgaacgttgcgtatgcaatcccgttttcgtccgcgaactttttggctgtcatgccttttaattttgcgcgtcggaatttgataccaagttcaacccattcacccagctttcgcttcggtggcggttttggtttgtcttcttctgcgatgatctcgaactcaaaaataaaactcataattccctccgtttagggtatttattgccctttccatccgaacacacgtttcaacgtgtcctctgtgatgattttgaactcccagcccttttgttttgctgctgcattcgcggctttccatttgtcaatgtttaccgcataagtatacagcgcatcaacaaatttctttttgttgtgaacgttgttgttcgctggcttaggtgggggcaacgtttctttcatcggtttgacttcccaaaggtaggtcacaccgttatccatttcaacatagaaatccatgaagtagcgccgtcgctttccgtctgcgttgctgaaataagggatcacaacctcttcactgttccagcgtttcacatgcgggtttttatcaagccagttcataatatatttttcccagcttgaacgatacgttatctttcgcggatctcccttatatttctgtatgttctggggcataaaagaccccttgtatgtctgtcttccagccattttagatcctaaatatagtaaacattagataggggaaattacaatgttattttcgttctttccaccagttgattacaaaggcacaccaactactgatatctaccgcgattatcgtttttactttaaccgcgtgatcaggaattataagccgcgtacatatcaactgacaggttcattaagacccgaacaattagcggaaacgctatacggaaaccagcaatactactgggttatcctgatgcttaacgataattacgatccgttttacggatggattaccgatcaggaaacggcttatcaatgcgctatccagcgttattcaaaagcaggtggtgaacaggttctttatcatatggatggtaagggcaaccgttattacaatttggttgaagaccctacgaatcccggtcattggtatgacaaaggcgataagaacatgcgttatttgcagtaccagggaacattagtccctgtagatatttatgaagatgcggtgcttcaaaatgaagcaaaacgaaccatcaagattattaacccctctgatattcaatcgtttgtaagtgattatatcaaggaaatggaaaaggcaaacctatgaaatacggtggaaataaatactcccctttctttgagggggtggtcgaagaagtcgatgatcctcgtctattggggcgtgttcaggtgcgtgtattcggtgagcatccggcacagaaacaaaaatctgaaactatcggtattccggttgaggaattgccgtggatgatgcctattcaggatattcgcagcgccgctatttctggtgttggtttttccccgactggtatcacgcgcggtagtttcgttatcggttactggcgcgataaatggcaccaggacggcgttatactgggaacctttgctggtgagtaccgagagaagccggacacccagaaaggcttctgtgacccgtttggtgagtatcctcgttatgtaggtaacgatgtcaacgtactggctcgcggtggcgcagaggggcgcggttcttcgagcgtgattattcgtgatgctaacagttcgttagctgtcaatccagatgatcgcccacttgacgagatcccagaagataaccgtcctgatactggcgggttcactatcgaaaccatgcttaaacaggatgaaggtatccgcacaaaatggtatattgatagtgaaggttatccgactatcgggatcgggcatttgcttatcatggaaaaaacccgtgatactgcgaagattaacgccgcgatcagtaaagcagttggtcgagaagtaaccaatggaacgatcacagcagaagaagtttcaacgctgtttgctcaggatttggcaaaagtccggcaggggatcagcaacacttcaaacgttcgcgaagtatacgtgacgttaaaccgtcctcgtcaaatggcaatcgaaaacatgtgcttccagatgggtgttggtggtgttgccaaatttactaatgctctggctgctatgaagcgtcaggactggcaaaccgcttacaacgaactgcgaaactcaacatgggctaaccagacaccaggacgttcttcacgcgtatctaaaatcgtgctgacgggcaaccttgaatcatacggtgttcaggttccagatccagaagggcgttcattgagtgctgcatacaatgctgttgtgttggctgcatcaaacccagaagatccttttgttcctggtgatactcgcgtaatgttcgaggaacctaaatccgcatacaatgctgaatatccatacaacatggtattcgaatcccgttctggacacattcaggaattcgacgatacaccaggctttgaacgttacaaccgtgttcacccagcaggatcatacgaagaaattcgccctgatggaacccgtgttgttaaaatcgttggtgatgattatcaaatcgtcatgcaaggccgtaaattaaacgttaagggtaatttgcaggttgttatcgagggtgatgcgttcatttacaatatgggtaacgttcaacagaccgttgatggtaacgtgaccgagttcgttcgcggtaatgtaaatcaaaccgttgaaggtgaatatgtggggctgattaaaggcaacgcagaattaaccgttgaaaaagatgcaaccgtaaacgtgaatcagaatttaatggctaacgttaaacagaatgcaaccgttgccgtaacagaagatgcaacaattaccgcaaaaaatgctctgattgatattgagcaagatttggatattggcgcacgtaatatcaacatgcgagcatcgaataatactttcattgattccggcgcactgactaagatcactggcggtactgtacaggtaggctaaacatgatcatggattatgaaaccatcattgatgggattatgcaaaactttcagcatccttgcgatgctgagatccccgctggatattacagacgcgttatctggcagggacacacagaaaattaccctgctgttggggtagaatgggcgaccgaaatcatcccgatcggaactcacctgtatacgagttcccctttcgggcagaaaagcgatccgcttccggtggtgaactctccaaacgtacccacgaacccagacggaaccccaggggtttctactgacattctggttacgaagattggttactatttcgccagtcaagcggatattgatgcctatatcgcatctatcggggctactaagctcgcgggtaatgactggtacggggcggatctatcaaaagcgaatctgttcaagaaccctggcgaactcgcgatgtacaaggtggaaaactccggtggttacttgctgacttccggcccccgttgcgatcagcgaatccgacaggtatataaccagactacaggcgcgtttaccagcattgattactactggaatggtaatcgtattgcgtacatgaaacacgacgaatcccccgcgcaccagtgcaaatatacagggatgtcagtaaacacgaacgcagataccagcattcctccggttccccctgctctcccgtcaacgtatggggcgctaccgagtgaagccagattgttttctgctctctctggattgggctgtattccggcgaccgtagggttcccgtatacgaatatcagcgatgctatgctttccgcgtggaacgagactcgtaaaacgttcaagctggctttcgatatgctgacgggtacaattaaaaatggctctggtatcgcgacgatgtttgacgggctttcgatcgggatggaagaaatcacagcgggtgctctggcattgtcacagcaagcatggcaaaccgcaatgaaggtgttccggcagatcattagctctgcgtttaacatcgtgggtggggcatggagtctgatcaataacttcctcccgactgttgcgatcctgggtgttgcaatcaacatttacgatctggtgtttggtgatagttcggttcaatccctgaaagattctttccaggctctgattgactccggcgcacagacgtatgaaagcgtcataaacgcaatctacggggctataggcagttcttacaactacaccgttgaatatgtcaaggctggcgctcgcgaccttgtagacgcttgtagcgcgttatttgactggtgtttgactatgttccaaaacggttgcgttgctctggtggatttgtacgggcgtatgatgcagatctggtcaatgcctccagaaacaccaaacccgctttggtctgcggtgctggctatccgtaacatcatgcgacagattaaacctcttgatgtgattctgggcggtaacttcccagggtttacagcaatggatctgtatcagcaagcacaagcgaaagtgaaagcgttcattgatgcatcctatgcgcagatctccgcattgtatgatcaggggcaagaactattcaacaccctgaaaacacagacacaggaaagggattcgattaaacgcaagttcgatcagtacctaaactggatgtgggaacctgtaacggaagcaacaaccgctgcttatcaggctgcacttgatgccgctaacgctgctgtgaatgcgactaaggccgcatatgagggaatcaaagcacagattgctactctgcaagatgggatgaaagacacctacagcatggcaatggctgaactcaaaaaactgcctgtaatggctcagattaaccagttcttaggttactgtggggttgcattcgatgacctgttaaaaacgtatgagaacgcgctgacgggcgcacaatcgctatataaaaactttgttgacagttcccgctcgtttaaggacacatgcaaggtgatttataaccagatttgtacgcttgctctaagtaaggtaactcaatacgtaaacaaattattgtcattaatcggactcgcgatcacattcggttcaattagtgtttgcgtccctatggttcaatactaaatacccgataacgaggggtaataatggctactacaaagaaacaaattaatcagatccccgatatctttgtcggggctacttttgacgaaatcaaatctgacttaatcaactggctccgaggtcaggacgaattcaaggattatgatttctccggctcgcgcatgaacgtacttgtggatctgttatcatactgtacactgtacattcagcaaatgagtaacaccgcactgttcgaatcgtttattcgtaccgctgcattgcgtagttctgttgttcaacaggctcaggatttgggctatatgccggactcccgcaccgctgcaaatacttcgatcctgatcactgcgaaaaacccactgaacccaacatcgatccgtattccacgcggtacgaaattcatcggtacagtgaaagaaacaaacagtttcccgttcgtcgtatccgatgacgtggtgatcgttcgtgacaaaaacaataactatgtttcgatgttgaacatcgttcaggggcgtttagtccgtaccgaagtcatctttgatggttcgactatcctgatccgtgatccaaacatcgaccgtagccaggttcgtgttaccgtcaacggcgcacaatgggatgactggacaaacgaaagtatcgtaaacgcaacgggtgcatcaactgttttctatatgcgtgaaactgttgatggacataccgaagtttactttggtgaaggtgaaaccagccaacaggtcgcgggtggtgctctgactgctgattacatcgggggcttgaaacctgcaaacggttcaaccgttgttattgaatatatttcaaccaacggcgaagaagcaaacggtgctgaaaactttgtttacgtggatacgttgacaaacattagcattacgagtattgttgagaacccgactaattcagcggactatgtaggcgctgatggtggtggtgaaccggaagatatcgaacgtattcgcgaactcgcgcctatcatgcgtgagacacagcgccgttgtgttactgcatcggattatgaatcgttcttgtctcaccgtttcggttctgttattcaggcggttcagtgctttactgataaagaaaaacctggctatgcgttcatcgcggttaaaccgaaatcagggttgcgtttgacctctgttcaaaaagaggatatgcaaaactatctggcgaagtataaccttgcgacgattacgccgtcgatccttgacccgaactatctgtacatcgtacaaagtatcaaagtaacgtatgatatcagtaagttggttgaatcagaggaatggttgcgtggtcaagtaatcaatgaggttgacagatattatactgataacgttgaaattttcaacaaatcattcagtaagtccaaaatgttaacctatgttgataacgcggacgtgtcgatcattggttcttctgcgactattcagctattgcgtgaacttgataactattacagcgctccgatgtctggtattcacttcttaaaccaggtgaaatcacgttctgttgtttcgaacgggttcaaatacacaaacgctgctggtgattcgtatgatgtgcgttatgcatcaaccgatatgaacaccacaaccggacgtgcaaaaattgttatcgggccattcaaaaacggtgatatcagtatcgcagcctatacaggaaccgattttgataaatatcctggagtgaccgatcgtaataaatattacgaagtcggctatgtggaacactacactgatttcattagtttcgatctgggtgtcctgaacgttccatccgagcgattcagcgctgcttatatcgaactgactggtacaccattggaagagaacattttcacccgtgatggttctctgattgtgtttgaaaacgatctccgtcctcaatatacaacattgacaatgaatccaatcagtcaataattttaacccctgtcatccggcaggggttttttgtttgctaaatatgggatataagtaacgcaaatttggagaaacataatgattaaagcgccgtcaattaccagtttgcgcgttgataaactggctgctaacttcgtttatttgaagtgggatagcgtcggcatggatttttactatgtcgtggaaatggcagaaactcgcggggcaggtggtgttactattccagatgaagatttaacctggttccagttgggttacgcttttttgaatgaatggttttcttccgatgtccagccaaacaatttttataaattccgcgtcatggttacgcacaagggctttgaaccgtctgattgggtttatacagatgaattatggacgttcagccttaacgcctacgcatattcaacaatgcgtgaatttacgccaagtgatgcattcataaacgaaaaattcgcaaagaacaatcagaactacgttaacttcaatacagatgtggtaatggcagcgttgatgaaagaagactttgtgttttctccactttacactgacgtatcccagatcagcgataaaattcttacacaagaaaactatcacgaaatccaggatcatattgaacacgtttgtaatgacattaacagaactttcctggtagcgtcaaacggtttgctgtacctgtttgaacgttttcagaacatggcaaaggtgtcaaacgacaaagggcagacatggcattactacaaagcatttaacgaccgcgtaggaaaccctgtatcgcgctctattgcgtaccaaagccgaaacacaacctatgtactgggttacgatcgtatcttctacgggcgcacctcaacggatattcgctggtctgcggacgatgtgcgattctctgctgatgacgttacgtttgccaaactggggaaccagactggccttgatttcgacgtagactcatacaacacattcgctaaactgcctggtaacgtgtcgaaatatgcagaagcaatggcatgttccgatgactggctttatgtggttgcgaaaaacgttgtgcgtcgtatcgcactgaaacagacaccgatcgacaccgatccgagttctccgacgttcggagaaaagattttcgatacagcaagctatacagttgtccctggaaatgataagatcgttgtcaagaaaatggatgtgatgaacgggattctttatgcactcgttacgggtgaagtgaaaaccgctctgcaagatcctacaaaacccgctaacgtggttccgtccgctgctgctggtgtgtatcaatggcaagaagacacgaaaacctttgtgcgcctgtacgggaacaccgaggaagaacgtttttatatccagcatgaatacaccaatatgtcaacgaacggcacggagatttttatttccgtagcgaactacaaatatccaggcacacttcccgatcctgaattgttgatcgagaaccctgcactggttggtgctgtaaaatatgatttgcgtcctggctatactgccagccttgcgattaactttgcgacgattcgcgctcatatcgacgacccgactgtttggaaatttggtgcgcaggaatattacaacgaggcgaattatagctggttcttccgcgactctgtgcgcacatggatcactaatgataaccgtcctctggtggtgtatccgaaaatcacctacagccttgtaaccgatagtgctggtccttcgtcatcgcttcgtgtgaacaaagaggtatgggatcgcggacatgttacgatttacattaacaacattaagtttaccggattcacaaagtatacgaacggcgtgttgctgtataagagttcaggcgaaatcatcgggttctttgaactgagttaccgcgctcgcgataacttaacgattttctggaaaccagacaatacgttattgattgccgatcttattcagcaggaacgcgaaaaaccgtatcaaccggatctgtcacctggtttgattgacccagatttaagccatatgattacgcgctttgcgcctcaaagctatctggaacagcagtatttcgagaagttcggggaatactatttgcagttcgtttcgctgggtgaaaacacctactataacaagctgctgaacctgatcaggaacaaatatccgcgtgagaagaacagcgtagaatatctgtggtcggaagtaaaccgccgtaatatctacctggataaaacgaagcgtgatcaggtggttcgtttctttgaatctcgttgtagtgatttctattcaacgaaaggcatcgaagcaagctataaattcctgttcaaactgttgtataacgaagatgtaagtgtagaaatcgaaagttcgaacactctggaatatgatattctggttcattcaacaaatatcaaccaggacattgtaggccggacgatttacacaccaacagcgagagcaaacgtgacgtatatcgaacgccagtatgatgacggtcaattacgttggtcggtaacgctgcacaacgtgatcggtaacttccttgaagggcaggttgtcaagtctgaaaagactaacttcacaggtactattctgcgtggtgtgcgtggtaagcaaatggcgaacaactcgatcgactacttcaaccgtgggcgttcttactacgtgatgaaaattcgttcgaatctgccagcgtcccgttataaggatgacgttttacgattcgtgcatccggtaggctttggctttatcgggatcaccatgctaacggtgttcatcaactccggtttgtctatgacgcatagtgaaacgatcattgacattcttcgaaattatcgcttcgatagcggttatccgaagtattggcctgatcgcgtagcacgtctggacggtaacggaaaccagacatttgaccttgtaactggtgaagcattgtacgacccgcacccgaaagcgggacaaccgtttgatgttccgccacaatatgacattgatgaaaaaccgctgaatggtgtactgccgtccgcgcgtcgatttgatcaaagtcctctgttcgatagttcagcggttaaatactctcagttccgtaacttagtggaaaaacgattgaaagacgacgcgggtaatcctcgcgatccgaatccaccgactcagagaaaggtagcataatggctcaacaaaacatctaccgtgcggtcgtaactggtaagttccgcacggaaaacatgatgaactttcgcgaaatgatcggggacacccccgatcataactcgatttatatgtcaatcgggcgtaccgaacaatgggcggataacgaatccgaccctgaattcgctcccccttatccgaacgatgatacagatggtatcgttgatatgtggacgcatatgatcgggatgacgaaagtaccaggcgaaatgattgatgcaatcgttccgcgtaaagactggggcgatactcgatatccaaacccaaaaatcttttacattaatgacatcgtggttgtaaactccgcgccttataaccgtactgactacggtaaaggatggatggtataccgcgttgtagacgttcctgatattggatcttgttcaatctccagtatcacgggtaaagttgaatgtgtgcgcattggtggcatttggacaccgacccacgaatcgatcgaacctccgcgcggggaagcgaacggtatcgacatgggcgacggctatatctgggaatatctgtatacaattccaccagatgttgttatcaaccgctgtacaaatgaacatatcgttgttccgttccctgatgaacttgaagaagatccggttcgttggggttatgataacgtgatcaaatggtatcctgatatgtacgatttggtgtaccgaatgaaggttcactcaatgcgattccgcgcgtatatggattccctgttcttcccgcaagcctctttacctggcaaccgtgggttccgtcaaatcagcgttattgtaaatccgctgttgaaaaaggcgcaaccatccgacccagaagtaaaagcaacggggcagtattacacgaaaggacagcttgaacttgactcaggacaaatgatctacatggaaaaccgtcaaccgattattcgttctcctgatcagaccgaagaagtcagtattattttcgaattctaaggaaaccataatggcatatcaaactggtaaaaaattaattgacgtggggcaaatcggcaacccgtcaactggtgacccgctgtatgacggcggtgttaaacttaacgaaatcatcaccaacgtatacaacgcgtttggtgatgtgcgtttactgactgcgaatgatggtgtgggtacaatgttactccacgcgaccggatatttccagaaattaccgcgaacttattattcaggcaacccgatcgaactgggttcattgcatgatatggatacttcaacagggccaattactgttgttcttccatcgggtaaacccggcgaagggttctatttcataaatagtaacggtagtatttctgttgatcgtcctgttgtattccgtccgcaagttggtgatggtatcaaaggggttcaggatcaactttacgtgacctctccatatactcagattaaaatctggtgtgtgaagaaagaaggttccgttactacatgggattattctgttgaatcaatgtttggttcaaaaacaatgcctgtagatactactaaactcattctgaaagcatcaccgaccgcaattcctttatttggttatagtgaattcagtggggcgaaaattctcgtgtacgcggagaatatgacaggcacagtcaataaaatggctgaaattcttttgtctgttgaccgtgtcgctaagggcgtgtattcaactgaatacgcagttctcaaaaatagcgaagatgaaatgtacacgcttacgttcactgttggtgcgagtgatattgtttacgcaaacgtacaatccaaaaccgaggatcgcattaaattctcgattaaagcggttgacaccattaaatcagggatcgcagcatgaaacaagaaattcttatcggtaacgtggttgatgacggcgcaggtgattatctgcgtcgtggtggtcaaaagactaacgccaactttaccgagttatataataaactgggtgacgggagtatcccgcacccagcgggtgcgtggaaaacgcacacagcgcctacgctgacccctattttcggtgaatcatgggcgctgaataccagcaacaaccgtattacggtaaacctccctaaaggcagtgtaagcgattataacaaggttattcgcttacgtgacgtatggggtaagtgggcggtaaacaacgtccgtatcgtccctgcaagcggtgataccatcaaaggctcaccgacttacaaagaactgtacaaagacctgatggacgttgaacttgtttattgttctcctggacgttgggaatatgttgaaaacaaacaggttgacaaaatcacaacttcggatctggcaaccgttgcgaaagaaacgtatatcgcgactcagggacaaactgacttcctgaacgtgttcggccctggtaactcgtacaacgtccgcgcactggaagtttactatcgcggtaacttgctgtacatcgacgacaagaacgggtttaattcatcaaacagcgattacggttcacctggtgcgagcgccggacaactggtagatctggatggtgtaaatatccgtcttaaaaacccgtgtaacgctggtgacacgcttcaattcgttacctatctggatggtattgccgcatggcgagcgacgtatgaagcgcataccatgcgcgtatataacacgggagacacagaacaggttagtatccctggtgaaatctgggttggtgatctaccaaacaaacgcacgttcactaatgctgaatttggtatcagtccgcgaattttgattaacccgaactcgttcgaactgctgctgaacggtcgccagcttgttaaagcaggcgatgcggatctcccgacatttgtttgtgagggcgcagaaggttatgatgaagatagctgtattgcgaactccggcgcgtgggttccttctggacaggattacagtctgatttttgttgactccgtggttactggcattaaatttgctcaacctctggaatcccgtgatgtggtaactattcgctggttcaacaatgatatcggtactgtaatggaatgggacggtgtaggcggtattaaagaacacaccgataagatttacctgaacaacgaagaagaagtgacgctggttaatcagatcgaatataccgattataacaacccaacgcagaaaacctcgcgtaaagtagcggatacatttagcggtcgtcttctggatctgcaagcgttctttgatgttattcacccaatcgggacaatctacgaaaacgcgcataatgatgctaacccaggcgattatatgggctttggtatctggacacgttacgcggaaggtatgttccttgcaggttggacaaccgatgcatcggatagcgattttggtctgaacaataacgatctggatggttccggtcaaccaactcacacttctggtggtactggtggcgaacgtggttatgaaattaaaccgatcaactttccacaaattcagtcaaccgataaggtgttgattaaagatgacaacgggatcattattattggtggctgtcaggttgacccagatgcaacagggccaggttacactaaataccgcgaggatgtattaaaagtaaatcgggggaacactactccagataaactaaaaacgctcccgccttatattactgttcaccgctggataagggtagcataaatgactcagtttatttccaaaacaagggagggggcgaaagtcccttcccgtgaagcagactttttgcaatatgaaatgggtacgaaagaaccgctgattggtggtaaacgtactattggtggtgcaaacgtcgatcagcttcgaaaaggggtagattaccctaacgtacaatcagcaattgatgacctgtattctttgtctcaacagatcccgatcaatggggtaatcatgatgacggaagatagccccccttctgcggtgcaacaggtagaatcaattacgtttgatgggacggtttcaaacccagatccagatcaaacacaggcgactattcacgtttatggtttcccgttcgttttcgacaatacaacgaacgcctctaccgtatgtgagacagtctataacaaattcgttgaattcgtcaacgatgaaaaatatttcgatttggttactcgtaaaggtctcaacggggaaattctggaagttcgttttattgattcagttccgcatccggttactaataaaactgaatacggaatttcgatggtaggaacaatcgacgtacaggctaaatctggttacggtacatggacaaagttaggtgaaattgaccttgctgttactccagcagttccgatttattatttcaagcgtattgcatgaggataacaaatgaacaatacaattaaccacgtaagcgataaatccgtttacgtgacatttgatcctgctggtacgcaatggcctagcacgtttaagaacgtacaacaggcattagccgctattgggccgtgggcgcgtactgatgttggtttgcctaatgccgcgcctggtgtgcgcggtattgctgctattgcgacacaggcaatgattgatgcgggtactgatacccagacgatcgtaactcctgctttgctggaataccgtctgcaaaaccctcatgcatcacaaaccgtatggggttacactcgttacgcaactgatgcagaatcagtaacagtaacaaacgatctggtttctcttactccgcgctcgttgaactatgtgtttaacacccgccatgcaaaagaaaacgtttggggttctgtgaaactgtcaacaactgctcaggcaacatccggtactgatgacactaccgcaatgactccgcttaaagtgaagcaagcgatctctgctctggttccggtacaggcaaacgcaacagaaagttcgtttggtcttgttcagttagcaactgttgcagaagttcgcgcgggtactattcgcgatgggtttgcgatttcaccatacacgtttattcgtctgactgcaagcgaaagtgatttaggtttactccgtatcgctacccaggcagaagtaaacgcgggtactgataacaccaaagcgatcaccccgcaaaaactcgctgctgtgaagggttccggctctactttcggtatggttaaattaacaacagatatcaataccggattagcgaatactgctttgtctgctggtgctaacgtagtaccgagcaacaaaaacagtgcaattactggtggtgcattgtatcagggttcgattagtgctgacaataaataccagacaaagacagatgttgacgcaaatatcccgatcggatgtatgatgcttgcagcgtttaacgccgatgttggtaacttgtttatctgtaacgggcgagcaatgaaccgcaattcaaacccagaactgtttgcccgaattggttatacatacggcggttctggtgatattttcaacttgcctgatatgcgcggtcttgtagctcgcggctttgatggtgggcgtggtgtggatgcaggtcgcggttttggtacatatcaggctgatatgtttgcgtatcacgaacatgatctccagatgatttaccagaacggcggtaatcttcctaagagtcaagcagtttatgaactgaaaggcgcggaaaaaaatgaccaacgtgttatgcacctgaataacgattacagcaaagcattaggtactggcggaaatgaaacgcgaatgaaaaaccttgcggtcaactacgtaattcgagtacgataaaggggttaatccatgatttcaaaacttaacccgttaccaaagatcccgtttgttgatggtgtccctgcggacaccacacaaacccagatcaattggattgttaacggcgaaactctcgatggtgcaaaaaccaaaaccactaacgagggttctttaaacagatgcggtgttctggttcaaaagaacgcggtacaattagaagcaaatacaactacccagacatcaaaaatcaacgaagttatcgatcaggttaacctcattactgaaaacctcgcggcgatctctgatgatagtgtgatcgacaaactggataaagttgtcgctgatgttgacgtgctgaaagtagatatgtctgctgtacaggcaactacagcaagcaacaccctgaaaattcaggatatcgaaaaggaaattggtgtatgggatgcgtcaaccgatcctaaacatcgtaccattcgaaaagatattattttcctgaaagatgaactgggtgcatatcctggctttaacgaagatggtgatgttgatccgtcctctactggctccggcgtgaaatacaaggtaatggctaacgctcaggcggtatctatccatgaagcacgtattactaagctggaagatgactgggtaaactcagatgtaggtaatttaaccgatgaagttaccgatctgcgtaacgaaatggggccgaagcatttagccactttcgaatctgtgtatgttcgtctgaatggtatcggtggcgatatcactggtattaataccgaactgtcaaacatcaacacttatatcgggcgtacaggctcaggtggttctggtagtattgattcccgcatggaaactgcggaaacgaacattactactctgcaaacccagatgaatgatccggttgttggtgttctgcctcgcgtaatccttctggaaagcgctgttggtaactcacaggttccaggtagtatccgttacgatatcagcacaatgaaacgtagcattagcgatctgaatatgatcgttggtgaaacaagtgatgatggtctgcgcggtgaaatggcgcaggttatgaccgatatcggtactgactcccagccaacaagcatcaaaggccgtctgctgaatgtggaaaacacacagcgcgacgatcaccaggcactggttgatgttaccgcaattgtgggtaatacgtcaactggactcgttgcggctaatatcgcgatgggtaaagctgtttatggtgatgcaaccagttctgatccattcctcaaagatggtattcagaaaacggctcgcgataacaaaactgcgatcggcgttaatactacaggatcagaaacagggatttataaactgatttccgatctgactgcgcgtgttgctgctctcgaagctggcggtggtggtaacgttgaacaacgtctggacgatctggaacagaataaagcctctcgccaggatgttgctgatgctctggttccgtatatcacagaagttgaagcggataacaaatacgaagcgaagaaagttccactgtcatttactcaaaatctggtcggtcgtaacgattatatcgagggtgatgatatttctttatctgttaccgttacaggtggtaaactgccttatgtgtaccagtggaagaaaggaaccgcaaatatcgggactgattcaccgagtgtaatgatccagaacatcacaacgagtgattccggcgtatataaagttgtcgtaaccgacgctgaaaataccgtgattacttctgatgaacttgacattgcggtacatacggttcctcagttcgatacaaacttgagcgatatttctgttgttgatggtgatccattgactctggaagtagtgtttagcggtggtaaaactccgtacacttacgtatggcataaagacggatctgtattgagtggtgaaactggttcttctatcgtcaagtctgctgcaaccagcgcagatgcgggtgattactatgtaaccgtaactgacgcgatgaacagtaccaacgattcagcaaccgcgactgtgactgtaactactcgtccggctctggcgtttacaacggatcttccggcaacgaagagttatacaacaggcgataatatggatttagccgttgttgttactggtggcaaaacaccatatacatacaaatggtttaaagatacggttgaagttactggggaaactggcgcaagcctggctacagtagcagaagcgggtgtgtacaaagttgaagttacggattccgcgacttctccggcgaccatcacctccgctgaatgtactgtgacggtagcataattttaacaaggggcgcaagccccttttgaggatcatatgattacgaataatccagaacagttaaaggatgaaattcttcgtcgtctgggcgcaccaatcatcaaaatcgaaatcacacaagatcagatttatgactgcattcaacgcgctttagacctgtatgcagaatatcattataacggcacaaacaaaacgtatctgattttgacactgggtgatgataacccgcgcaacgtgttcgacttgagcaaagaacacatcttcgcgatcacgaaggtgttgcgtacaaacatgggttcattgaccacaatggacggtacagcggtttatccgtggtttaccgatttcctgatggggttgactggtggctctctgggtgggcgctgtgcatcgagtgtgtacggtatgaacgcatacggcgcggatatgggctactttacccagatgatgtcctatcaacgctcaatgcaagacctgctggctccactgcctgattactggttcaacgatgatactggtcagttctgcgcatgggggcaggtgaacaaaggcgacattatcgttattgaagcgatggttcgttccttcgttgatgtccctagctccgtaggaagcgtcgcaggatacgctacagcgggttctaacgcagtggaagaccaatccatagccgacatctacgaaaacccgtataacagcgttgtaggcggtgtacgagcgggacagggttcaactgttacgggcggaacgtctgcatataacaaccgctgggtaaaagactactctaccgcactggtgaaagagatcaacggacaaattctggctaaattccaggggatgcaattgcctggcggtgttgctcctgatggtacgcgactgatccaggaagcggaaaccaaactgcaaagtctgcgcgatgaactgatttctatgtatgacgcagtaccgatcattatggtgtagggggaataatgcaaaactgggatgaaagtttattcgctcagttgtctacgggggaaggggttgatcgcaacttaaaggatcaggtcactaacccgtatgtaaactggtacaaatacaacccgacacaacagctacacgattcactgacagcagaatcaatccagatgaaatcgcctgatatgtattacgtccggcgtgacttcgtgaatattgataagatcctgggcgaagaccgagaatccaaatttacgaagtcatggaaaattgctgcatatattgaatcatatgccaattatgaaggacaacgagatttctttagtaaatttggtctgagttcaaacgatgaaatgacgctggtaattaaccctcgtttgttcgcacatcaaactgatggtggtattcctgttctgggggatctggtttatttccctatggacaatagcctgtttgaaattacgtgggtagaagccgatccgttctatcagttcggtgatcgtcctcaacgcaaaatcaacctggcgaaattcatctacacaggtgaagaactggctcctgaattgcagcgaaatgaaggaatccacatcgaacctgatgcagaactggatctcgaacctatccgaaatcttgacgggctggctgatatcaacattgaacagtacgaagaagacaaagaatttgaaagagaaggtgatgaattcatcgaatcttttgatgttgtcaacggacgcggttcaccgtttgcaagtctgccataaatacgttatatgggtataggcggaagtctatacccaacaacccatacaggaaaataaaatgtttggttattggtataatagttcgctgcgtaattatatcgtcctgatgggggcgctttttaatcacgttcaggttaaaagagtacgcggcgatcaagaaaaatacataaaggttccgatcacctatgcatcgaaagagaagtttctcgcttccatgaacaaacttaactacacgttgagtcaggaaaacgttgctaaaacggaaacgattttaccgcgcatgaacttatcactggtggatctgcaatataacgcaatccgtaaaaccagtatcgcggtcaaccaaaaaatgacacagttagcaaccccacgaaaaacgatcacacagtttaaccctgtgccatatcgtctgattttcgaactgggtgtgtatacgcgatatgaagatgatatgttccagatcgcagaacagattttgccgtattttcaaccgcatttcaactgcaagattaccgaactgcataagaacgaaatcacagttgaccgagacatcaaaatcagtctccagtcggttgcgccggataccacattcgagggcgaagcatcacaacgccgtcatgttgagtggtcattcatgtttgaattacagggttatctgtacccgcctgtaactgatgttaaaggcgaaatcagaaccgtttacacggatttcttctctaacatgaacccgttagataaagataacttcgaatccgtggatagtcaagccgatccggtagatttgcctatgcaggactacacgggcgaagaatatattcagacgtactcgcacgataagccgatcccgtctggtgatgaacctcctaagccgagggaatgagaatggatgaaaaattagatttgcagcaattgctgaatattgattccctccctggcggcgttgagtctggggaggatgtggttgtttacgaaaaacttgaactggttgacgttcaatcacatccagcagaccggaaaccggatctggaagaggattatacgctcgcgcgtaagactgcgcaccatatgaatcagatgatcatggatatggcgcagatcgcattacacaacgcgaagaactccgaatcgcctcgccacgtcgaggtattcacaagcctgatgaatcagttaaacgtttcaaacattggcctgatgaagattcacaaagaaatgcgtgagattacggaagagactacaaaaccaggtgctgaaaagggcagtggtggtagtgaaatgaatatcgagaatgcaaccgtatttgttggttcccctacggaactgatgcagaaatacggcagtgcatatgaacccaaagagggcttcattaatggtgaagctgtagaggtaaaccctgatggaaatggaaccgacgatcgatccgagtaaggaatcagatcaccctatcggattaatgcatcccaaatatctgaaaaagaaaattgatgaattggggatggagtggacacaaagcgaacacgataaaaaatggtatccgacaacgttcagtgactacctgaaaattaacggcattcaaaaggtcgatattcagtctaaggacagttcgaactttgccacgtacaaaaataaaggcaacaagaaaacccgatataacggcaacccaaacctgaaacgtgcgtatatccagactaaatggacgcaacaaatgttgatggagtgggtgaaatgtcgtgatgatatcgtttattttgctgaaacatattgtgcgatcacccacattgactatggtacaatcaaggttcagttgcgtgactatcagcgcgaaatgctgatcgaaatgcacaaaaaccgtatggttgcctgtaacctgtcgcgtcagttgggtaaaacaaccgttgttgcaatcttcctggctcacttcgtgtgtttcaacgaagataaatatgttggtgtgctggctcacaaagcctcgatgtctgcggaagttctggatcgtaccaaacaggcgatcgaactactacccgacttcttgcagcctggtattgttgaatggaacaaaggttctattgaacttgacaacaaatgtaaaattggtgcgtttgcatcttctcccgatgcagtgcgtggtaactccttcgcgatgatctacatcgacgaatgcgcgtttatcccgaactttgttgatgcgtggttagcgattcaaccagtaatctcttctggtcgtaaatcgaaaatccttatcacaacgacacctaacgggcttaaccacttctatgatatctggaacgctgctatagaaggaaaatccggtttcgtgccttacacggcgatctggacatcggttaaagagcgattgtatacagacggcgacaacggtacatttgatgacggttattcgtggtctgcgaagatgatcgctggctccagcaaagaggcatttttgcaggaacactgcgcggaattcatgggaaccagtggaaccctgatcgctggctggaagttgtcaaaactcacatggattgatattgatgaaacggaaacgaacttctatcagtataaacgtccagtagaggggcataaatatgttgcggtacttgatccagcggaaggtcgcggacaggattaccatgcaatgcatatcatcgacattacgacgatgccatttgaacaggttgcggtgtatcactcaaacaaaacgtcgcatcttattttgccggatatcctgttacgttatctgaatatgtataacgaggcatggatttacattgagctaaatagcacagggcattcagttgccaaatctctgttttccgaactggaatatgagaatgttatttgtgacagctacaacgatctgggtatgaaacagactaagcgatcaaaagctatgggatgttcgacgctgaaagacctgatcgagaaagataaattgatcataaataacaaaaagacaatactcgaatttcgtactttctcagaaaaaggcgtttcgtgggctgcggaagaaggatatcacgatgacctcgttatgtcgcttgcttgtttcggttggcttacaactcaaatgaaatttgccgaattctgcgagaaagacgatttaagactagccaatgaagtttttgcacgggaacgcgaacagctatacgaagacgcattatgtccggttatcgttacaagcggtgatgaaacgatttcggttggttctcacggtatttcgtttatataaattagaggaaattctataatggctttacaatctccaggtattgaaaccaaagaaacatcggtacaatctaccgttgttcgaaattcaactggtcgcgctgccattgtcggtaaattttcatgggggccagcttatcagatccgtcagatttctaacgaagtcgaaatggtaaactattttggttccccagacaacttgaccgctgactatttcatgagtgctgttaacttcttgcagtacggtaatgatctccgtgtggttcgcgttgtcgataaagatgccgctaaaaacgcaagcgcaattttcaaccagatcaaaacaactatcgcatcacagggttctaactacactgtaaacgatgtaattaaagtaaaatacaacagcgttgttgtagaagaaaacggtaaagtgtccgaagttgacagtaacggcaagatcctcgcggtaatcatcccaagcgaaaaaatcgttgcccgtgctaaacagattggcacttacccagatatttctactggctggactaccgaaattgtttctcagtcttccggtgtttctgcgtctattacgattgacggcatcgaaagcgattcagggatcactctgttgaacctggatattgcaaaagaaacaattcagggaaccgcattccagactcttacccagaaatatcagatcccgtctgtcgtggctctgtatcctggtgaactgggttcaactgttcaggtggagattatctccaaagctgcttacgattctggcgctatgatttcaggctacccttctggggtttccgttaagaatagcggtcgttctgtaatgacctacgggccacagaccgacaaccagtacgcttttgttgtgcgtcgtggtggcattgtacaggaatccttcatcgtgtcaactgagaagaccgataaagatatctacggcgtaaacatcttcatggatgactttttcgctaacggtggctctcagtacgtttacggtacttccctgaactggcctaaaggcttctccggtatccttgagttcggcggtggtttgtcctcaaacgacactgtaggcgctgatgaactgatgactggttgggatatgttcgctgatcgtgaagcgctgcatgtacctctgctgattgctggtgcgtgtgctggtgaaactgtagagatcatgtctaccgtccagaaacacgttatctctatcggtgatgaacgtcaggattgtactgtgtttgtgtcgcctccgcgctctctgatggtgaatattccactggcaacagcggttgataacatcattgaatggcgtactggatataaactcagtggtggtactccggttgacaataacctgaacgtaagttcaagttatggcttcctggatggtaactataaatatcagtatgataaatacaatgacgtgaaccgttgggttccgctggcaggtgatatcgctggcctgtgtgtttacactgatagcgttgctcaaccgtggatgtctccagcaggttacaaccgtggtcagatccgcaactgtatcaaactggctatcgaaccgcgcacagcacatcgtgacgcaatgtatcaggttcagattaacccggtaactggtttcgcgggtggttccggcttcgttctgttcggtgataaaacactgactaacgtaccgagtccatttgaccgtatcaacgttcgtcgcttgttcaacatgatcaagaaagacatcggtgataacgcgaaatacaaactgtttgaaaacaacgacgatttcacccgttcttcgttccgtatggatacaggtcagtacatgactaatattcgtgcgctgggtggttgctacgattaccgtgtaatctgcgacaccacgaacaacacgccggacgtaatcgaccgtaacgagtttgtagcaacgatctacgtgaaaccgcctcgttctatcaactacatcactctgaacttcgtagcaacgtctacgggcgcagatttcgatgaactggtagggccacaagccgtataacgtcaagggggctgaaaagcccccataaataatccgaggttaaaaatgcttactgacattttacgcgcctttgaatccggtgatttcgcacgtccgaacctgttcgaagtagagatcccgtatctgggcaaaaactttaaattcaagtgtaaagcggcaaccatgccagcggctacagttgaaaaagttccggtaggataccaaaaccgcaaaatcaacgttgctggtgaccgtacctatgatgactggacaatcacgatctataacgatgacgcgcataatacgcgtgacgctctggtagcatggtcaaacatgatgcacggaatgggcgatcagattagtggtgatattccagcgaactacaaaaaaaccgctacggtgaaacagaaaaaccgtaacgatgaaattaccgccgaacataccattcacggtcttttccctactaacgtaggcgaagttaccctggactgggacagcaacaacgaagtgtcaacctttgaggttactttcgcgctggactggtgggaataaaggctataaatacaggggtagcaatacccctatcattatttttcggagttactatgaactttttgggctttggcaatgtacttagctttttcaagaatttcgcccgtgaggacgaattagatcttgaacagcaattaaaaaatgatacaggttcggtcgcgcctcctaaaaataatgatggtgcttatgaaatcgaaactgatctgactaatcagaaatacgcaagcgtattccagcagttttattctggacaagatccggcgattcagaacaaagaacaattaatcaatacatatcgcggtatcatgtcttacccagaagtagaaaacgctgtttctgaaattattgacgatgctatcgtgaatgaacagggcaaagatatcattactttggatcttgccaaaacagattttagtaaggcgatccaggacaaaatcgtagaagaatttgataacgttctaaatatctatgattttgataacatgggtgcgcgtctgttccgtgattggtatgtggattcccgtatctacttccataaaatcatgcataaagacgaaagcaaaggtatccgcgaactgcgtcaactcgatccgcgttcgatggaactgatccgcgaatctatcactgaaaccctcgatggtggcgtgaaagtattccgtggttatcgcgaatttttcgtgtatagcgctcctaaaaatggctatacatacaacggacagatctaccagcataaccagaaggttaaaatcccgcgctccgctatcgtgtatgcgcattctggtctggaagattgcagtaacaacattatcggatatctgcaccgcgcagtcaagccagcaaaccaattgcgtttactggaagatgcgatggtcatctaccgtatcacccgcgcacctgaacgccgtgtgttctacatcgatgtaggtcagatgggtggcaacaaagcgacacagtacgtaaataacatcgcacaggggcttaaaaaccgcgttgtgtacgatgctaaaacgggtactgttaagaaccagcaaaacaacctgtcaatgacagaagattactggttaatgcgtcgtgacggtaaagctatcaccgaagtagacacgcttccaggcggtgcgaacttctctgatatggatgatatcaaatggtttaaccgtaagctctatgaagcactgcgtgtgccattaagccgtatgcctcgcgatgatgggggtatgcaaattggtgggggtggtgaaatcacccgtgatgaactgaaattcagtaagtttatccgcacactgcaaattcagttcagccctgtgctttccgatccgttaaaaactaacctgatcgcgaaaaaaatcatcacagaggaagaatgggaagaaaacgttagtaaaatttccttcattttccagcaggattcatattacgcggaagtgaaagatattgagattatggaacgtcgcctaacgttgatgtcacaggttgaaggtgtagttgggaaatatgtctcccataaatacatcatgaaagagattcttcgaatgtctgatgaagacattgacgaacaagcgaagctgatcgaagaagaatccaaagaagaacggttcaaaaatcccgaagaggaagaggaaaacttttgatgaaagaatttatcgaagcaatcaaaagcggtgatctggtggaagcgaagaagcaattctattccatcatggaagaccgtaccgaagcccttcgccaagaaatgcgcgttgaactcgcggaagctgtacgcatcgaaggtgaaaccgacgatgacgacagcgatgacgatgacgacgacaaaggcggcgatgataaaggcgacgacaaagacaaaaagccgtctgataaaaaagacgacgataaagacgaataagaggtgtaaataatgcaactcgaactcgaagaaatcagcgtcgaagatctcgaaccccatttaaccgaagcgaaagcccgtgttgatgttctggggatcgatgacggcactgtgaagatcatcgaaaatttggcggtcaatgaacctcatttagccctggctatgatgtccattgtcgagggtttgagtttagatgaagtcattgttaaacacgtagattcgcgcggtaatgtggaacgtaaaaaagaccgtaaaacccgtgaacgtaatgcgtatcaaacaactggtttaactaaatctcaacgtcgccaaattgcgcgtcgtgcgctaaaaacaaaacgtgcaaacccttctattacaacccgcgcacagcgtaagcgtaaaaaagcgctccgtaaacgcgccgcattagggctataaatatgaatgaatcccaactcaatgaaaacggcgatatgctgctaatcgaggaatggggtttaccttgtgcggatatttccgattcaattttagaatcggtcggtgagtcaaaaaaagacggtaaacttcggattgaaggtattttcctccaggccgaaaaagttaacagcaataagcgactgtatccgaaaaaagtattagaagaagcagtaaacgattatatcagaactcaggttaatacccgtcaagctctgggtgaaatgaatcacccgccgcgaccgaatgtcgatccgcgtaatgcttgcatcctaattgaaaaattatggtggaaaggtaatgacgtttggggtcgcgctgttgttgtcgaaggtgataacggtgatggggataaactcgcggcgttaattcgcgcaggttgggttccaggtgtttcttctcgcggactgggtaaactttccgattctggaaaaggttacggtatcgtacaagaagggtttaaattggcggtaggcgttgatgttgtttgggggccaagtgctccagatgcttacgttaagccgattaccgaatctcagtcaagcaaaacgcttgttgagaataatagtgctgatgatgacgctttcagaaaactctctgaacgtttgaaaagtctatataaataatatcatatcaaacaggaaacttagaaatgcttaaagaacaactgttggcagaagcccagaacctggataccccagttgagttagacagcattttcgaatcagttgaactttctgatgatgcgaaagcaaacttcaccactgtattcgaacaagctgtaaaagcaggtgctgcgaaactcgctgaaacccacatcgcccagatcgcggaacgctccgatgaactggttgaagcccaggttgccgaaaaagctggcgaaatcgaaaataaactgtacgaagatgcgaataaatacttcgaccacatcgcgcaggaatggctctctgaaaacaaagaagctgtgtcccgtgatatcaaggccgatctgttcgaatctctggtaatgggaatgaaagaactgttcgttgaacacaacgtagttatcccagaagcgcaggttgatgttgttgcagaactcgaagatgaactgaccgagaatcagcaggaagttaaacgcctgttcgaagctaatcaggctcaggctaaagagatcgccaacatgaaacgcgataccatcgtttcagaaaaaacaaaagatctgactgaatcgcaaattgaaaaggttcagaacctgatcgaaggtttggaatattccgacaagttcgaatccaaactgaccgcaatcgttgaaatggtagcgactaaagcggaaaaacaggttgaagagagtaccactactcagacaaccactaaagatgactttgttccggtgaatgaaaatacacctccagcagagaaatcgaagatcaataaatatgtacaagcggctaaagccctttcctaatcttataaggtaagaaacaatgtctaagaaaaacgaattgatggaaaaatggaacgatcttctggaatctcaggaaggtttaccggatatcgctaccaaatccaaaaaacaactggttgcagcaattctggaaactcaggaaaaggatgctgatactgatccagtatatcgcgacgaaaaaatcattgaatccttcggcggtttcctggcggaagcagagatcgcgggtgaccacggttacgacgcaaccaacattgcctctggtaaatccagcggtgcaatcaccaacatcggccctgctgtaatcggtatggttcgccgtgcgattcctaacctgatcgcattcgacatttgcggtgttcagcctatgactggccctactggtcaggtgttcgcactccgtgctgtatacggtaaagatcctctggctggcggtactcctgcaaacgttcgtgaagcattccatccgatgttcgctccagacaccatgtattctggtgaaggtgcaaacaccgcgtttgctgctatcgcaactggtgttgctatcgcttccggcgctatcgttaagcacgtattccaggaaactggtgtcgcgtacttccagaacgtaacctccggcaacgtaaccgtaactggtgctgatgctgctgctctggatgctgctgtaatcgcagaaaacgagaaaggcactctggctgaaatttccgaaggtatggctaccagcgtagcagaactccaggaaaacttcaacggttccagcgctaacccgtggaacgaaatggctttccgtatcgacaaacaggttatcgaagctcgtagccgtcaactgaaagcacagtattccgttgaactggcacaggatcttcgtgctgtacacggtatggacgctgacgccgaactgtctgcaatcctggcaactgaaatcatgctggaaatcaaccgcgaaatcgttgacctgatcaactacaccgcgcagattggtaaaactggtttcacccagaccgtaggctctaaagctggtgcgtttgacttccaagatccagtagatattcgcggcgctcgttgggctggtgaaagctataaagctctgctgattcagatcgacaaagaagcgaacgaaatcgcgcgtcaaactggtcgtggtgctggtaacttcatcatcgcttcccgtaacgtggtttccgctctggctcgtatcgacagcggcatcactccggcaggtcagggtctccagaaaactctgaacgtagacaccactaaagcggtattcgctggtgtactgggtggcacttacaaagtgtacatcgaccagtacgctcgccaggattacttcaccgtgggctacaagggtgataacgaaatggatgctggtatctactacgctccatacgttgcgctgactccgctgcgtggttctgatcctaagaacttccagccagtaatgggcttcaaaactcgttacggtatcggcatcaacccgtttgcgaactctcgctctcaggctccggcagatcgtatcacctctggtatgatcagcaaagaaatgtgcggtaaaaacgcatacttccgtaaggtctgggttaaaggtctgtaatcgactttacactaaaaggcaacctacgggttgccttttttgttggtgtaaatagatacaggtaaaaagccctctaattcaggaaccaaagaaatgagtgataaacactacacaattcacaagttgatgcgtcagtcttcgcttccgtctggtaaacgagaaaaagttatcaacgaagcaacaggcacgaccgacatcaacgtacagaacacgcgcccagaactggtttctttgactcgcgcggttaacaacctgatctatcatgaactggttgctgtacaagaaacagaactccctgttgcaacactgttcggtgttcgctatcgcaaccctaacggtgatatgactttctccagtgctgcaacctattcaggccgaatctctggacgtacagacatcgacgaaatcgatctgactaaagcctacgttaaaggtgatttgttcaagcatgatggtactgacgttgtttatgaggttatcgaaccgattaccctgaacactctggataccgacaaagacaccgcgatcatgaaagctgtgttccaaagcaaaattcgactggttagcgaagccgctgatacttctaagtatgaaaccagcgaagatatcgcgtcaacctccttccagatggatcgctggaatattccggtacgctcgcgtaagtttaaaaccgaaatgacggttgaactgatgcaggatttggaagcgaaccagttcgaagctgatggggtgatcgaagacatcctgggaaccgtggcaagtgaagaagtcaacaaagacattattcaaacactgatcaccgtttccaaacgttacaacgttgatggactcgttacggatggtatttttgacggtactaccgcatacaccgcgaaggatgctccagcattgggtcgtatcctgtaccaattagcgtgtgaaatggggcaggaaatgaatagaacgacttcatttgatgctacctacgtcctcgcaacagcgcgtgttgtaggcattctggctgcgtctggttggatgcacgaaaccgacgaacaacacccactggcaacaggtaagctgaacaacggttattatgtctatacagacaccaacagcccgttcgattatatgctgactggttgcaaatatgatctgggtgatatggatcacgtaggctctctgttcttcgctccgtataccgaagctgatgaagcaggttcaatcaaagtatccgtagatccggcatccctgcaaccgaaagttgctattctgatgcgttacggtctttccgtgaacccatacacagcagaaagcgaatccgatcacctgatcaaaggtgatgattggtctgctcttgcaggtaaatctaagctgagtcagatcgtaggtattaagttacctaaactgggttaacaagttttgttttgagaagaccattatagtaataaagatctataaggtcaaacgagcgaagcgagttttcacgaacgaagtgagtgatgggtaagtacgatgtactgtttataatatttatattttatatatagagaaaacagtacatttccgtatactttttaaccaacattcactcactacgttcgttcatgtactcgcttcgctcgtagatttgacttcttgatctaactggttataatgttactttgttttgaggtgatacatggctgaactaaaacttgaagatctacaggctgaacttgaagaggatatgcgtattgatccgttgaagttacaaagcgaatcagcagacattccgaagatttggtcaaaatggcttcgataccattcgaatgctaagaaaaaacttattcaactccaggcgaagaaagaagcgattgtaaaagatcggttactgttctacactggtagacacgaaagcgaaatgaccgatgtcatttacactggttcgggtgaaatcaaaattgctatctccggtgatcctaagaccgttgaagttaacaagctgatccaatacttcgaactgattgcagagtttaccggaaaagcgctggatatcgttaagaacaaaggctactccatcaaaaacatgttggagatccgtaaacttgagagtggtgcataaaatggcagaagaatttgattgcaaatgcgttgtgtgcaaacaaccgatgaactcccgtaatacggcgtttgtcaatgaagctggcccgatctgcggtgtcgtatgtttgcaatatctcaacgaaaggaatgatcgcggtatcaatgaagccgacgatctgaacgaagttcaaatgttgctgtaggtgtgaatatgaaagactattcaaaaatcgactttaacgaagtatttcgtttgctgggattgatggaagaatgtgtgaccagggttcatgcacttcgaatttcgtttgaaagcggttgtatcgaagacgaacgcccagatttatagcagtaaatagatgtgtaccccttgtggggcttgggcttaccgtgtggcgtacccatttgcgccgtccgatagaatttactttcggtggggtgattggtaagataccttcgagtaaaggccagttaattgtaattcagaatagtacagcactgaaataaaataaatgtacgtgtcggaacaaacggtttccgaaattaaaaagccccttcctttcggttggggctttctttttaaaacttctcttcttctccggtttcaagttcggctttcagttcttctcgccgtcccttgatcgcgtcacgcattgaaatgtcatcggatgctgcaacctcgacttctttcacgcgggtgttgtaatacttttcaagttctttcaaaccttctagtgtccggcacgaagcaaccttattcatgaaatcatcaatcgctgcttcgtttacgaatgtagtaaaacttttcattttggcctcttaaatttctacctgtttgatcgcgtagtcgaatcgttcttcattgtagatccgcacacgttccatagcatgtttcataccgtagtttgtcgcactgtatttatttttggctgtcttagactttgacagcgtagccaggttatcaacgatatcccatacagtagcgagcgctttcgatccgtgcttacgaagtacacgaccgatagactgtttcaccacaacagcagatttgcaagggtgcgcaaaaatgatgtggtgtaggttcttgattgagatacccgtactcagtaccccgatcgaaccgatgacgattaaacctttcgtcgattccgcgattttcttcatttcgttacgatcgtcaatgtctgtatcaccattgaccaacaccacgttatcgtaaaccttgctcaactgctcgtacagccattttccgtgctctttgtaccggaacatcacaaaggcgttttcgttcttctcacgggctaatttgagcgctaattttagaatccacgcgttgcgccgtgtgtggctggttacgtacttgatttccgtctggtagtccgcacccttcaattttttgacctcttcttctttgtatcgaaggaagatcgtgttaattttcaggttggtgacttgtccatcatccatcaaacgacgcgtatcaactggtttaaagactttgccgaacgcaccgatgtattgcatcatgttcgttttcccttctttcagggaaccggataaacccagtttgaagatacattgatccatcgtgtcgataatctttttgatgctcatgcctgttgagaggtggcattcatcaaccatcaaacacatgaactgttggaaccattcggcaggcattttaaccgctgattgccaggtagaaacgtaaatcagtgcattactgtttttcgctgtaccggaacggatacccagcattgccgatttcgggaacaaacgatagtttgcgatgtcctcgatcatttggtcaacaagtgcggtagtcggaacgatgatcaacactttcccgctgtaatgttccagacaccaacgagagataagcccctgaatcagagatttacctgctgatgttggcaggttcagaacaccgcgacggtttttgataccgtggaacactgattcgcgttgataccagtacgggtcgatctgtttgtcgccgtcataaaccggatgttcgctaacccacttatcaaaatcttcttgcgtgatatcctctgtttcgtggatctttggatcaacccagattgaatacccgcgtgattctgcgaatttggataccagataggctaacccatacgggagtttcccgttgtagtccatcaagtaaatgtaaccgttccatccaccatatttgtatttggcctgatactgatagcctgggggctggaagctgaaatagtcacgcagttcatagacaatgtttggttctgcctgaatctgtacgtggcttgtgtttaaaaatttgacttcaatatccactatgattaccctatgtacaaagtatatacgtatttatgtcataaatattggataaacacttggagataccaatgaacattgattacgaaaaagttgatgggttccgtaccctcgacgcaaaagaacagaaaggcgcgttagctgattacgcaatgactgtgtttgctgttaagctgaacaaacaaaaatccttcgataacatgctggcggatctggttgctgctttaccggaagatgaagaaaaaccggaactgctgatcgattcccctgaaccggaaatcgttgcatataaaggtgaggtgactatgggtgaacctgtcatcgaagccccgaacgttcccgatgtggttattgatgcttctgcggattttatggagtacgttaaagaggtcgcgccggaagtagccgatcaaatccaattagtacctgatgtcgtagaagctcctgtaagcgcttctgacgagtccaaaggcgaactggtatggttggaagggtttagcccgacaatcttcatgatggggcgctctgcgagttctaacgggtattatacctgtccgtggtggatctatgactggattaaacaaaccccagactggtacaaagatcctgatagctgtccacatgcaagcgcaatcgacacaatcaaatcacttgcgttctatatcgtgcgcgatggtgaagttcgtgttcgcgaaaccagaaatagccgattcgaaacatttaagttttagcactttttgctaaaaaacttgttgacgcataccctcgtttaaagtatatttgtactcgaaggcgggggaatggctctcgcagtgaagaaggaaagcaaaatgaaaaacgaaatgatgaaaaacgcttattacccagttctgtttgtttgggctgatggtaaagtgaagaaagtagtcaattcaaatgctccttactatactgttgaagaagcactgcgccacgcttacgaagctgattatcctgtccctgctgaacctggttatgctcgttggaacggttcaaaatgggttgctgatacctgggacaactacgaagaagcaaaaatggaatgcgatcctgattatgtttctcgccaaatggaagcgcacatgattgcagaccgtcgcctggataacgaagctcgcggtttctattaaaattcaaagggggcgtagcccccttttttgtaggtaaaatatgactgaattaaatcacgaatgcctgaaagacttatcagaaggtaaagagatcggaaacgtcatcttccttgatatcgacggcgttctaaataatatgcggtgcatgaaatttggtgagcatatggacattgaatgtgctcgacacctgcgccggatcgtaaatcatgcgaactgtgatattgtcatttcctctacatggaggatcggcaacacaacccatactctacgggaaatcttctacccgtggggattgtatcgtatcattgggaaaacctgtacgaatctaacagaccgacaagcaggacgcggtgatgaaatcaaagcatggatcgacaccttcggatgtaagaattaccttatccttgatgacgataccgatatgctgccggaacagagtgaacatttcatcaataccgatgggttcgtagggctgacagaagaacaatccacttacgcgatccgtaatgtgttctgtgtaacaaacccgttctgtcctgaatgcaacggctatgggcgcgtgaaccaatatgataaatgtccgtcttgtgacggcaaaattttacttctctaaatagagaaaaactaagaggttttgaaaatggctacagaaaaatggactacggtacacccgatcccgtggcgtaacaccagctttacctatctgccgtggtggatctttgatatcatcgtggctgcgaatgctgcaagcgaagactggcgtgattatgccgaagaaaaatatgcgaaagaattcgacacactgaaacaggcgtatattgattacaccgatgttgatttcatcgaatctcgtaacggttatctgtataagctgagtgattttactcctgctgatcctgtcgtaacaattacaccaaaaaccgctcctgctgatttcaaagtaggtgatgcggatctggctgcaactgatctgtttaccatcgatccttctggtacagaaatgactctgagtgttgactcttccggtcatggttctatcgttggtggtaaacttcatgcggttagtgaaggtgatgttgtcgtaacagcaacctctggatctgttactgcaactctgacggtaaacgttaaacctgcaccataataacaactaagaaggtaaaaatgctactatttgaattcaatgatgtattcgcaaaattcagcgacgcaatcgaagccaaatttggcaaacgcccacaaaacatgacagatgcagaatatgaagctgctgtatcgtccctggttcgtacagatttctatgaaaaactggcgatcgaggtgttgggttgggatatgatgaaatggggcatgacctatcgcgatcgcgaagtcggttttattctcgtcaacgaagcaaaaagcccgtcctgggtgaatagtcaaaaaatcgcgtacatggataaagtatgcgcacagatgggtattgtacgtttagacttctggacttgtcgggatctgaacgaactgaaagcccacgcttaccgttgccctctgatctcccgcaatgataagcatcgtcaagcatgggatagcgcagggaaatatcgtagtgttttcctgaacgacgatatgaacatcactattcaggatgtgaaccgctcctttgcggattacacaccataaacaaaaaagggaaccgcaatggttccctttcttttatgcaatttttctgatttctttcaatgcttcttctttgctaccaacgaagagaatcgctttacctccggcttttctgaatggcaacacagcttttgccctgtcatcaatcagtatacctttgtccgcatatgctgctttctctccgctgcttttggtgtagtggaattcaggcagataaccgaacaccttcatcaacgcttttcttttttgttctgctaccgcatcggaattgtatttccctacgctggttaagatcgcaacctgacctaaagttctcaaatgacagaacaggtcgatgccctcttgtaatggttccagattttcgtagaagtcagtttgtgatatagcctgtttcgcttttttcaattcttcttccggcattctcgccgggtctccgtaaaagaaccttcccagttgaacagtacaccatccatatcgaacaaaaactttttcatatcaattcctcggtttgtgtgtgcatcatattcatatatgttcctattgtcaaccccatgtatcagttttcggtgcgtatgctgcaactttagccactaactctttatcaagctggtcaatggatttttgcggcttgccttttgccttaactttgatgtagttagacttaacaacaaacataccgcctttgtcagatttcttgatttcgctgtcgatgcctactttgttgaagctgatccagatatcgccgtccatgtactgtttcagagagtcgcccatattcaggatcttcgccatagtgagcgctgccccttcgtgggtatccatgaggatttctttaggcactacacgatcgcgtttaaggttctgctgcatagcaatatgaacatcgttcataacccaaacgatatggatgttttctttctgataacccagcgcttcaacatcacgggcgatacttgccagcttgctcatgcttttcagggttacgtcaaagatcaggtttggtttacggtcttccggtgctgctgtgataccagcgtacacacgcgcctggtttttgttggatacgttgaacacgtctgcgatcacatgatgcagtgttgctacgttgtccgggtttttcaggttcattgttttgacatcgtgaccagttttcgctttgatctctgctgccagtttggtactacccatgaccaattttttgagtgcgtcaacgtccagggtgatcccttcgatgcctaacagcttttcgagggtgaaccctttaccagaacccgcaccgccagccaggatgactacctgaccaaatttaggataagccttaccgccgaaggtgatcagcgcttcatcaaggctcgtaaagtctttgaatgatttcatcttagaactccaggtgtttatttaaaagtatttattgacacggtttatgagtgcgtttatagtgcaattgttcgacggataagccggaagaactttaaccataaggtaacaattatgaaaaatgaactgcatgaattcatcaacgccgctgctcttggcgaccagtcaaaatataaatcccgtcgcgataccctaattgacgatttctgtaatctcttggggttcaagcgctggcataccccgtctatgcgtccagattgtgatccaaaatgggattacttcaaatggagtgctcgcgatcgtggttacgtcgataacgtccgcgtaatgtctttcaaccacttatacgcaaattcaacaattgctgttgctaaacgcaacgattcgacttatccgaacgggtggagtgttgctaaagtcatagaaacacttcttcaactgcgtcgcgaatataaatcagcataccgtgtcaatcccaatcctatctataatgaatggcaaatcgtcgcgaaatacctgctgaacatcacctattctattttctgtcgcttcgggacaaaagagattggatttggctctcatgatataattgcagaagcacgtcaccgcatgatccatgcaatcctgaaaattcaaaactctggtgggcttgttctttctgcgttctgtgatgaaattgtttactacggagaacaggtcgaagttgatgatgttcaccacgaaaaattcaaaagatttgtattcgggcaatataacagctattcatatggaaacgatattcgtgtgatgatgcacccgcgcattatgttggatatggaagggtgggaaccaggtcacggaattggtgatgccgaaagccaacgtgaacgccgtgttcgttcagttgctaaaactcgcgaattgatgacaggtagccttactgattacctgttcagaacaaaagaagacgttgaaaaagaatttgttgacttgtcgggcgaatagcgataagctgtaatctctgaaaacaaggagataaccatgaataccattcactgccgcaaagagttcgttgagttctatcacggatcatgtactgctgccggaatcgaaagcatgttgttgcctccttgtgattctgatactctgtctgaaaaaggcagaaagaaaaatctggatcgtgttttcttcactgctgatatcgggctggctcgtatctatgctggaagggctgcacgttcaataggtggtgatccggtactgtatcgggttgtgtgtccggtagatgtggtatgcatgaacgatgacaaaggcgcaagcgtttatcatgctgcatgggctttctgtgaggaattatgaaagataaggtgttagcgtatctcgttttcttgctgggatatcgcgttgaagtgatgggtggttattcttctttgtatggggatttaaccgcgatctggatggttgcgttgggggttatgtttacctttatggcgatctgtattgcgaatgaggctgatcaaaatgcttgaattttatcctgctggttgcaagtcaaatccgcctgatgcatcgttccaatcgtggatttattttcacagggaactaaacgacatcatcgaaagtcagtggaaagaccatcctgaacgaagtgcccccgatttagtcgatagcgtaacagatgtacgcaccctggaaaaagggctgtatgattgtctggttcagggaatggtgtgtaaattgattttgtggtatgctccgatcggttcagatctaactcgcaaaatcgcccgtggctatatcatgacgaaacgtgagtttgaccagatctggaacgaacccgactgtttcgaacgcgaaaaatatgaaaatgaggttagttgcatatgaaactatttcatgttgtgtatggtgggatgaaaaacatcgacatcgccgcgttatctgctggtatgctggacgaactcgaagcacagatcgggaaacgattcaaagccagtatcaccgaaacgcaaactttgtttgtcgatcaccctgcggatatggaaaaccttgtcaacactctggatgatctgatgatcccgtgtgctgatggttggaacgaagcatccggtgttcatgtagttgtaacttttgttcttaaaaatgttgacagcagaaatgccgaagtgttagagtttattcgtaaaattgattctactaaaggaaagtaactatgaaaatcgttcagcgtaatatcagcgaagttagccagcaggaaaaagtacagattcatttcaaattcaatgatctgaaactgggctatgcacagatcgcccgtgagcacatgctcgataacggcgacatttacgtgattgttcaggaaattgagcgaattcgtgctttccgcgcagaaaatccaaaagtgaaacatgttctgcgtcgtgtgtatatcaacaaacatcgtgaagaacagcgtaaacctaagaccaaagctaaacgcgatccgcgtccagataacaaacgtaaagcaatcaacggcgctatggcgctggcgttccaggaagcgggtttggtgtaaggggtttatatgtcttcaatgatgaatcgctggtcgggcgtgataacttcgactatcaaaaaggatttggtgaaggttgaagcaaaaccaaagccagtagaaccggaaaaagttcaaactatggtatcactcgatcctgctgagttagaacaccgccgccgtgcaaagcaaattgaattcgatctgcgtgtcgctcgttcatacaacagtaaaaacgatgatgcgcgtaaccgcaaccttcaatttgctctgacgttaagcgactgggcgaagctaatgagtgaacccgtatgttcttactccggcagaccgtttagcaacaaaggcggttgctctgactcccgaacaatggaacgaatcaacgcttctctgggatacacggttgaaaacacgatcgcagtaaccagcgccgcgaatagcgagaaatcaaatctcgatgcgtttatgaagggttctgtgatccttccagaagtaaaactgaaactgttacgcaaagctgcgtatcaaattgaaaaacaactgaaaatcaagggttaattatgtttgtgaaatattcttctctgactaaccattatgaaggtaaattcatcaatggtgtgatcatgaatggtttgactggtggcgtgtgggtagcgcgtgaaaagatccacggggctaactttagcctgatcacttcggacggtatcaaagtcattccggcaaaacgtagcggtgaaattctccctgctgaacagttctacggttgcgaacccgtagttgcgaaatactccgaacctgttcgtaagatgtgggaaatgatctctactgcgcgtcagttaagcggtgagtatagcgatgaactggtgatccaggtatacggcgaattcgcggggcgtggtgtacagaaagatgttgactacggagaaaaagatttctacgtatttgatatccgcgtcaatggtcagttcctccctgataacgttgttgcaaattacgctgttgctgttggcctgaaaatggctccactgctggcatacggtacgtttgacgagatccgcgcattgcctatcacctttgattcggtggttaacctggcgaactccggtgcgatccctgcaaagaacggcgttgaacctgagttcaaaaacttcatgacgctgaaagatggtgaaggtgagaacatcgcagaaggtttcgtgatgaagcctgttcaacccgctttcatgccaaacggtgaacgcgttgcaatcaaatgcaaaacgacgaagttcacagagaagaagaacaagcaagcgaaccgcttcaatgctccttctgaactgtcagaaacagacaaagtgaagctgaacgaattcacctgcttcctgactgaaaaccgtgtgaaaaatgttctgtcaaaaattgacagcgcgaatctcaccgcgaaagatttcggtcgcgtgatggggcttacggtacaggacgcgctggaagaaatcgaacgtaactacgggcctttcctggaacagttcgaaaatccaacgctggcgaagaaaaccttcactaacgaagcgtcaaatctggttcgtgagaactggggcgcaatcctgaacaatgaattttaaaactgttctcgaaaacgcaaaaacggctaccctgatcggtagccgtgaaccccctgaacgtatcgcgagtatagccataaagattggacgtgctttaagtgatcgggggatcttcgcttactctggtggtgctcctggaatggatagccatttcatgtttgactactcaccagaaagacggcgtataatcctccctgagaacggttttaacgggttgtattcgaatggtaaggatatcatcgactatacagaatacgacacgtacaaagccgctgacgaagcgagaaaggtagctggacacttcgacaaccaaagcgaatggacacaacgccgatacgctcgcaattcaatgcaggtattaaccgaaaacctggacaaacctacagattttgttctattctgggcggtagagaaagatttttgtgttaagggtggtactgcgatcgctgcaaggcttgccagattgtataaagttccaacgttcaacctttggaatcaaaacgttctggatgaagtctgcgatactttagggattaacactaaacctcctactctggattttctctggtgataactcccgaacaatcacgtaattacgaacgcctctctgttgaagaggcattaaaaaaggcgaaacataatggtagaaatcaatggaatcggtgtgaacgcacaggcgggaagcgggacatcgtgggtcaaacgcgaaacacaagatgatccccgctgtggacgtagcccgacactggcggaacgtgcgcgtaaactggttgatgaaatcaacgcgaaaatggtcgaagcatcccgtaaagacatttccgagtatgtcctgaaatatccgactaaacaagcatatacctttgatatgaaacgttttatcggtaaggttatggatcaggaatgtaccgaaaaagcatatgcggatctgggtgaatggctggcggaagaagggtttactttcgatacccagcgcaaccgacaagctgcgttactcaataccttcgcgggttcgcgtcgtattaccaactttagcgatcctaagcgtgacggatatagcgatctgacttattacatcacctggtgaaaataattcgaaaaacttgttgacgggagttatgagtgtggtaatatagctcccgtagacaagacactaacctaaaaggaaaacatcatggaaatcaaattagtacctacttgcgctggctactgcttggcactgaatggtgtagcacacaacggtaaaggcttacgggctaacgttgaagcaatgctgaacgaactgggtgcggtttatgaatatgatgacgttgcaaccagcgttaaaatcataagccttgaaaaagatggtgttaactgtgcgggttggtgggattgctacatcgactatagcgacaaccgggtcttcttactgaccagcaattaaggatcgaacatgtttggaatgaatgagtgttcagaagcggaagcgctcgaagattgggctgactttgatgaccttgatctcgataatgaagatggagaattcttctgtgttgggcgcggggttgaaagaacaaagcgtgaacttcgaagccgtttagcaatggggcgtactgttggatctggaaagaaacaacaagttaaatattccgatggttcgattcgaactgaaacggttgtcaaagaagtaaacgggcgtgtcattacgtccgagcggcagaaggacatcaaacaattgtacgatgttgcaaaagccgctaaagtaggaaccatgatcacctgtcctacgtgcaaagagttgcacaagaagacgacatatcataaggtgttctgctctaatggtaaaaaatccaggaaagactgtaagagtaaatactggaacacgatccatccagaacgtttggatcgtatcttttaaatcaaaacgtggagtacgtttaaatgaaaacttttaatgaactgaatagcctgatcacctcaactgattcctacaaagtgtcccactggttgcagtatccacaaggcactgatgcagcgatgttctatattgaatctcgcggtggtaagtttgatgaagtagtaaccgctggcgttaacttcgttgcgcgggttcttgctgaaccaattaccatgaaacaagttgagttggcacgggtactttaccgtaagcactttgggaaagagattttcaactacgaagggtggaagaagatcgcagaactgggttatgtccctgttactttccgtgcgatcccagaaggtacggttgttccggttaaaaatgccgttgcgactgtgtacgccgaacatgaattctcatggttggctgggtggctggagacaatgacgattcgcggtatctggtatccgtcatctgtagcaacgctatcgcgtgagtgtaaaaaggttctggctcattaccttgatatgacttctgacctgactggtgaagcatataacatcacactgggtacacgtctgcatgatttcggggcgcgtggcgcgacctctgctgaatctgcgggtattggtgggctggcacacctctataacttcatcgggactgataccgttgaaggtatgattatggcaatcagtctgtttgctgactatcaaactctgtttgatgaagttgaaaacgtcgaagcaatcggtgtttcaattccggctcgcgaacattcgactacgatttcctacggtaaagagaacgaagacgaagcatacaaaaacagcatcgaaatgttcggtacagggttctacgcttgtgtgtacgattcctgggactacaaaggcgctgtagatcgcatcgctgaatataaagagcaaatcattgctgcgggtggtactctggttgttcgtcctgattccggtgatatgattgataacatcatgtacaccctgcgtaaactgggcgaaatcttcggttacaccgtaaacagcaaaggttacaaagttctgcataattcagttcgaatcatccagggcgacgagatccacggacctgaaacaatcaaccgtgtgttaagttggatggaagcgaacaagtgggcgagtgagaacatcgcgttcggtatgggtggcggtttgctgcaagaagttacccgcgacactcaaaagtatgctgaaaaactgtgcgctatccgcgtgaatggtgtgtggaaaggcgtttacaaatgcccgaaaggttccgaatggaaacagagtaagaaaggtttgctgatgaccatcactaacggtgtggaattcaaaacaatcgacactctggaaactgagattcctgacgggtggcgtgatgcgatgattacgtattacgacaacggtgtattaaacacctccgatacagtaggggttatccgtgagcgagcaaggatttaatatccgcgccaacgataacggatcggtagtcttctacaacaatcagccccttgtcgctcgcaaggggcttttttgtaagttggtgggctacgggttcaagttggaacaggtggacaacgcgacactaaaagaggttgttcgaattgcttatctactgaaagataaaaaagatgaacaccgtgctattgcaatgcttgagaaactaggcgaaaattattgcttcgtggtgaatcgtgggtataagtacgaaacgatcgccttatttgagaaaggacttggtgaattatgattaccacaattaaagaaggggttgacctccatttaggcgactccgtaaagctgattaaacagcttgaatctggttctgttgacttgaccataacttcgcctccgtatgacaacttgcgccattataacggctctggtgatgtctggggtgaacacgtatggaaagagttgatatcggaactgtaccgcgttaccgcgcctggtggtgtggttgtgtgggttgtgggtgacgcgactatcaacggtagtgaaacgggtacatctttccgtcaagccttgtacgcgatcgaacaaggttttcggttgcatgatacgatgatctatcacaaaaccgctctaccgaagaaccataaccgatacgaacaggactttgaatacatgttcgtgtggacaaaaggcgcaccaaaaacattcaacccaatccgcattccgtgtaagttccctgaaaaggaaaccgcacgacaaaacagctacttttccgaaaccaacgaaaagaaccgttcagcccgttccggtaagaaacgtaaacctgttggcaaggataaaattaagggtaatatctggtattacgctgtagggcgcaatcactcaacgaaggacgagattgcattcaaacacccagcaatatttcctgaacaactggcagaagatcacattaaaacgtggacggttgaaggggacttggttcttgatattttctctggttctggtacagttatgaaaatgtcgatactaaccaacagacggttcaaaggcttcgaactgatggagaattattatcacgattctattcttcgtgttcagccatacgttaacaatctggaatcttttctatgagttatttgggtgttatcccgtatacaggtaacaaacaatcgctattgcctgaactcttcaagctgttccccgaaagaagttcatacatgcgtttcattgattgtttttgcggtggccttagtgtgtcgttaaacgtccctaaacccgttctaagcaacgattacgataagacgctgattgatatgtatgagcgtcttaaaacgcttcctgacctgtctccggtgcgagaattgattgcatcaaaggggctggggaaagacaagaaagaagagtatttgaaattccgtgatgaatacaaccagaacaaagatccgttatggctctatgtcctgatcctgcattcattcagcaacgttaaccggacaaacgacaaaggcgacttcaacgctaatttcggatgccggacgctcaacgatgcaacagtaaaacgctttgaacatttcaaaaagaatgtgaaaggcattgagttttccagtggttcattccgtgacattgatatctgtgaaaatgatttcgtgtactgtgatcctccgtacctgatcaccgatgcagtgtataacaagttctggaacgaagatcgcgaacgtgagttatatgctttcctggatgaactgcacagcgaaggaatcatgttcggactgtccaacgtgactcaccatgccggaaaacaaaatgatatcctgattgaatggatgcagaaataccgcgttcataatctggataaaaagtatctgttaggccagcataccgactcttacgagcaaaacaaaacgcaagaagtctacgtgtgcaactaccagaaacgcgacgtaaatacattccctttaacactgaacgatttaatgtaggttaacatgtttaaaatttatggctatatcccttctgtgtataactgcgctccatgcctgaactcaaagcgcttgctggacgcgaaaaaacatccgtatgagttcgtgtctgttgcggattccgtggaagacggtaaacctgtactgaacgaagcggtgatcgatgaactcgaagcgcttgttggtacgcgccggatgaccatgcctcagattttccatgacgggaaacatgtaggcggattcgaccaacttcgtgagtacgtccgcaccctgtaataaataatgacaccttactgaatgttgttattatgctgacgaaacgaattaccaaaaaagactacccaactatcaagcaagctctctttgaaaaacaggggggctgttgtgctatctgtaaacgtcccctggagggcgagatcgagaaacatcaccttgaccatgaccatgctttagacggcgaaaacgccggacgtgtgcgcggcctactttgtaacctatgcaacggtacagaaggtattgtgaagcacaaattcaacagatccggtctggtgtcccgtgatgtcgattacatccagtggttagagaacttgcttgcatatctgaaacaagactattccgaaaaccgtattcatgacaaattcataccagataaggtaaaatggttttcaagacttaccaaacctgatatgattgccgaaatggtttctatgggcttcgagtacgccgacaaagacgaacgcaaagccttaaccgcgaaatatagaaagcaattaatgaaggcaacgaaatgaaagtagaaaaacgcgacggtaaaaacgtcgatttcgataaagaaaaaatccgtattgctgtagaaaaagctggcggtactatgacggatgctgatgccgcaatcatgctggttcagtacaatcagatccgcgatggtagcgcaatgaagatcgcccgtatccaggaactcgttgaagaatccctgatgaaaacgaacccagcggtcgcccgtgcatacatcgaatatcgccacgatcgcgatattgcccgtgaacagaaaagtaagctgttcaaagatatctccggcatggtgaatctgtccaacaaagagatcaccaacgagaacgcaaacaaagacgcacgggtattcccgacacagcgtgatttgctggcgggtattgtagcgaagcatttcgcccgtaatcatatccttccgaaacatatcgtagaagcgcatgactccggcgacatccattatcacgatctggactatagcccgttcaccccttacactaactgctgtctggttgacctgaaaggtatgctggagaacggtttcaagatgggtaacgctgatattgaaccgcctaaatcgatcggtgttgctaccgctctcatggcgcagatcaccgcacagattgcctctcaccagtacggagggacaacctttgcgaacgtggataaagtgctggctccatacgtcgaaatgacattcttcaaacatctgcgcgatgctgaacattacggcatcgaacactataatgaatatgtgtatgcgattgaaaagactgaaaaagatgtgtatgatgcgttccagtcctatgagtatgaagtaaacaccctacatactgccaacggacaaaccccgtttgttaccatcactttcggtactggtacgagcgattatgaacgcatgatccagaaagcgattctgaaaaaccgtattcgcggcctgggtaaagagggtattactccggtattcccgaaactggttatgttcatggaaaaaggaattaaccttgatccagaggatcaaaactatgacatcaaacaacttgccctggaatgtgcttctaaacgcatgtacccagatatcattagttcagctaacaaccgtgttattactggttctagtgttcctgtatctcctatgggttgtcgcagtttccttagcgtgtggcatgatgataacggtaatgaagttcttgatggacgtaataacctgggtgtggtgacaatcaacctcccacgcatcgctattgaagcggaagcacaggaagaagaagacgcgcacgacgcattctggcgcatccttgatgaacgtctggaactgtgttttgaagccctgatgactcgtatcgaaagcctacgcggtgttaaagccagtgttgcgccgatcctgtacacagaaggtgcttttggtgttcgactcaaaccggatgatgaaattctggaactgttcaaaaacgggcgtagctctatcagtctgggttatatcggactgcatgaaacgctgttgatgtttggctcaggccagcatccattcgatcgtatcggctcccagaatatcggcagattgatcattgagtacctccgcgctgcaaccgaagcatggaagaagaaaacaggatatggtttcagcctgtattcaaccccagcggaatctctctgccatcgcttctgtaagctggactttgagaagttcggaagcgtcaaaggtgtcacggataaaggctggtacacaaacagtttccatctggacgttgaccgcaaggtaacaccgttcgagaaaatcgactatgaagccgattatcattacatcgctactgctggtcatatcagttatgttgaattccctgatatgaaaaacaacctgcaagcccttgaaaaagtctgggattatgcgatggaaaaactggactacttcggaactaaccttccggtcgataagtgctttgtatgtggctctgatgacgagttcacgcctacagaagaaggtttccactgtaagcactgcggtaatcacgatccggctaaaatgagcgtcacgcgccgtacatgtggttatttgggtgctcctgctgtccgtggtttcaacgacggtaagaacaaagaaatgatgcaccgaactaagcatcaaaattaatcaaaaagccccttgcgaaagtgaggggcttttgttatattgcacataccgaaactatgaggtattgaaaatgatgtactggacaaaagattattttgaatttcgtgacgaagaaagttttgggacggtgtaccgcaatttagctttgcgtggtagtcctctgtcgcctaatcaactatcatctgtcgtgtttcctatcaaggtaacgcactgcaaccggaaaggtgttagtgggatcgttgatgccaatggcacaacatggtattccgaagattcttatctgtttgataatgaggatcgcggtttctttaaaaagtttgtcgcgcttaaacctgctgttgaaaaagccgacgcgcaacaactgctggattgttctcacctgctgggacggatttacgtagatggtaagctggtgacgaaacctggcgatctggaaaaattcttgcgtaaggcgcgggaaactaccctgaaagacaccgaaaagcgttacgatactgcaaccgccaatctacatcgtttgtctgatgaactgaaagttctacggggtgaatgatgtttccattaaaggcgcgggtacgcaacaaaaccggaacacaagaatggatggagtgtttacgcgaaactaaacactactacatttcacaggctgtaggctatgacggaaagaacatccgttataacaaagtaggtggtaagcgtgtggggatggaacaatatctccaattagaaaccgtccggcctgtgaatgttcctttcgatctgaaactaccaaacggaaagccaacgatatgatcgggaaaatccttgatactctgtttccctcccgtgtacgcgcacgggtagaaagagaaaacagactggaagagatccgcttcaataagttccttgaggacaagaagaagtgcgaagacgagaaacacccaaacgcaaaaatggctgagggtgtatcgaaatgttctgtcgggcggttctgggttgaaaaggattatcttgatctgataggtgctattgcccccggcgttacgctggaggacttctcccgcgctactgggcgttcgtatactggttgcatcaaccgcttgcgtatgctctctatagtggtgcgtagtgcgcatttcggctatcgtgacgttatccgtccggtgatcccagtaagcagattaaaattttacatggcgggtggaaaaaggcttgacttgaccaacgaactgtgtaaaatgggctatatcagagaggggaaagttgttaaagcccctgaatggttcaccaatcaatttgaaatcaaataaggcaaaattatgttcaagaaacttgtatctttcgtgactggtaaagttgaaactgcaatcgaacaaaacacttccccagaagaagcctggcgcagtgctgcacgtatcctgatcaaagagatcgaccgtctgcaacatactcgtgtttctgctgttcaggaaatcgtgaagttgaaaaagaaagtcaaagaacacaaagaccttcacactggcaaagagtcggagatcaaaaaacttctggcggcagggcaggaagtgtcaaacagtcattacgtgctggcgctgcaacatcgtaacatctggcagggcttacagacgaagatcgaagaactggaagggatgaacaaagagattgatctctctgtcgtcgaactggatcgcaaactggctgatgtcaaaatcaacctggagatcatcgaactgaacaagcaaaccgaaagtctgggtctgactgtaccggaagacgtgatcgccgctgtaggccacacctccgtaagcgtcgataccatcgtgacgaagattgatgtgttgctgggtggcaaaaatgccgcttctgtaacctccgctgacgttagcgcttacatcgactccctgaacgcgaaataagaggaaggggcgcaagccccttttttgctatgagttatactattcaaaaatatggtaacgaccattggataatcaaccatgctcgtaattttcgggtaaaacttccgtctgattggtggtgtcttcctagtgatgaatgcgaccgattgatacggatgttgcatgatggggcgattagccagcaagtttttcaaggaatggtagaccatgcagcatcgcggtcacaagaaaagtattgtgctgaactcacgtttgatggtatggttaattttcatcttaaagaatcatatgaaagaagtgcaacggaagttcttagcgagatttacgaaaaagagaggaaaggtgaaatgatgttcgaagatggtgcatttaaaccagcacgtaaaacgtatccagactggcgcaaacagtacgcagaacagttatggcacattgacattcccgaagcgctcatgaaagcgattagccctgcggttgactactattcaggctggaaagatgaatatgagttagaggtcggttcgtttaaggcgcacgtcatcaaagcgaccagaattcttgatttcgttgaagctgttgcgtcatgtgatatcgttgaagatattcgtattccttcaatcaacgtttctcggtatagttctcctggtaacatccgcggggatcgttatgcgaacctggcaagcactacggataagctgaacttccataaaatcaatgaaaaaggatttgatggttgtgttctgatctcaatggtggttgtcacgacacaaggcgagtacaaactgatcattgattgtgacaaagcggctcgtgcaattcccacaatcaaacaatgctttggtgaagatttcaaagtattgatgaaagcccgtgcgatggaaaagttcatccattcgtgcaaaaagaacgtgctggagaagtatgatccggcgctcacatacaccaaaattgataaagatctggtaggtgatttatgctgattaacaaagcgcagtgcaaagcgattaattttctgctacacgaactgattgaaaacggtatcagatttgaattcgttgatccgattaacggtgatgatcgtcatctgctccgctgggtgtctggtagcaatcctctggattcagtctcccaggttgtagagtctgcacttaaacatatgccttgtcgtgttctgttgggtagcgttaacgcctccacatggaatggatctgatgcttattatgtcggattcaaaaaagagttgacggacgacgaatgatgttataatatgcccctgtagacaacaaactataggggctaaatcatgaaaatcaaaaatactgctactgaaaatctttgtaacgaaatcgcggtgacttactggaaagaaggtcacgtaaaagcaatgaaggattttcaacagtggtgtgatacccagaagttagccaactgggaatacgccgtaatcgtggaacggatcaaagaactgatccttgagaagaaaggcactataaaatgattcaactgaaattagacacacaggcgctgaacaacctgttcccagaagggacacaagcgcgtatggatctgcaagccgctgtcatcaagaacgttgttgacagcgttatcggtaagcgcgtaaccgaagaaatcgaaaacatggtgatcaagcacgtcaatttgatgatgccagccaatcacgaaatcgaaaagattgtgcataaagagtttgctgattacattcagaaacgttacgcatacagcaatgttttcgatatcaattcaggcggtatccgccagatcaaagaactgatcacgacaaacgttaaaaaacagtgcgccgacctgctggattcaatcaagctggaagcaatcaacgatgcaaccggaaacctcaaagcggacgaagaagcgtttattgctcgcgtaaccaaaaacctcgaagtaacggttcgtcaggaaatcgttaagcgcgtgaataatgaattcccgcaaattatcgacgaagcgatcaaagcccgtctgttcccagaggcgaaaggctgatgaactttgaccgcatctataacatggatgtggttaacggtaaaggaatccgtgtagtgttgttcgtgactggctgcaatcataaatgcgaaggttgctacaacaaatcaacatggaatccccgcaacggtacaccatacaccgaagagactgaaaacgagttgattaaactcctttcaaatccccatgtggacgggttgacgcttacaggcggcgatccgttttaccgcaccaatcatccgacgctcttaaaactgctccagcgcgtccgtgcgacgttccctgataaagatgtgtgggtttggacgggttacaccctcgaagccttacagggcgatacagaacgctctaagctgttaccattcattgatgttctgatcgatggacggtacgaaaaggatctaccgactaagaaaccgtttcgcggttcggataatcagcgaatgattgagttcaaaaagaattccatcgaaattaaaaatatcgcttgacctggttggtagttctgttaagatatccacatcgaaacaaacttgaggacgagaaaatgaaaaacgcaatcatcaaagaaatctgtgaactggttgatgtgtatggttggagtttgggcgctgcaaaagcagaagccaaatctcgtctggaagttgtaatcaaagcccgtagcaaagatgaatttgttactaaattgcaagccctctatgagagataatatcatgatcctgaatttcaaaacccgtaaagaagcccgtgactattgctggaagtggtcgatcccgctgaaaaacatcaccaaaggaagcggttcacatccgtggacggtgagaacaaaagaaacccgcttcgaaactggcaaagattacaagctggttgatgccgaaggtttcactgacaacggcaaaaacattgctaacagtgttcagtcaaaacagatccaccaattgctgaacggtgttgtacatatcgcaagccgtaacggtgatcgctataccttcgatgctccggcaggtgttgctatgaacacccttcgtgcatgggaagcgaaatacttcacagaagttgctccggctaaagccccagcgccaaaacgcgctaaaaagccaaaaccagtaggcaaaccgtccgttgctcctgcaccagctaaaccagatctggattcagaactcgacggtggcgttaacctcgctccgacaatcgaaccagttgcgaaacctgttgcaccacagccagcaacggttgaagcgatgcctggtaactttgttgcaaaccgtccgtatgttctggtagatgtagatggtttcctgcgctctcataccgcgaataaacgcattgtgcaacacatcaaaaataacaacggagttctggtgtttgaatccgttgatggtgacggcgacgcggtgatttataaagatcgtagcctcccgtttgtaatgcatcgtgagcgtaagttcttccgtgaactcggtactggcacagttcaggcagataccccagcggttcagactgttgacattgccaaacagcaacgcgataaagagatcatcgaagctgcacaggcagtagaagatgcactggcagaacaccagaaagcgatcgaagttgtcacacagaaagctcgcgcagttcgcgaagccgctgcaaaacttgcactgctggcacgtaagtaatataattcgggggtgcttacgggcatcccctttttatttgaggtaatcatggaattattcgctggaaaaacttacggtttaaccgtatccccagaagtctttgcagaaaagacctggaaaacaggtatcgcaaacatcgttcgtgaaaaaggttatgttacaattgatcgcacctcgatcggtgagttcgaagaccgcgcatttatcatggacggtggctacgaatatgaactccctgcatcactatggaaatggttcaaggaagtaacgccggaagatggtgaattcaccccagaagaaccagaagaagttaatctgggtaaaggtgtagaggctgaaaacgttatgcgtatcgctacaccggaagaggtttccgctggtgtcactggttcggatctgtgcctgatggatatccctaaattcacgtatcgccctgtacaggaaaatcctttgcgtgatctccgcatcgatccatcatttggggctaacctggaaacgttgagcatcgcaccgatgccagtacgtaaatctgatgcaatgcttcgtttcgccttgcaacatgttttcagtggtggtagcatctatcaaatcaacatggaatctgaactgaaaatgcaggaagaccagattgcaaacctgttcgatctgcacactcagttaaccgctgttgaaaatatcgaaaaactgttaggcaaagagaaaaagcgtattttgcaggatctcaaaccatacgggaagaagaatgaaagtcgaaatatacggaatccccgaaagtcttcataactgttacgggtgtatacaagcacaaaagctgttgacagaaaaagggatagaatatacattttatcccgttctgaaagaagcgaaaaacgatctgggctttgaatacgatcgcccacgtatcgaagagttagcaaaacgggtaaggcaacgtagtttagcgtttcaatacccgcgtatttttgtcgataacaaacttatcggcggttatctgcaattgaaacaacttattggtgattaaatgagccgtgaaattttactccctgctgcaaatgctgttcatgctgaaacaatggaatacatggagaaattcgttgaacgcgataacaccgcgatcatcactcctactcacctggacgcgctcgaagatcgtcttcataagcagattaaagatcaatttcctgaaaaggttagccgcaacttcattcgtcaggaaatcgttgcaatgatgctgaaacattatggcgttgaaatcttcggtgtcgaaccactgaaaccgaagaaaccgcgtcaaatgcctaaacagatcaccgacgaagcaatcaagaaataccagaagaaatacgctaagaataaatgatctttaatacgattgaatgtgttccgtcaagtggtaaaacaaaggcgattctgaaccatatcaatcaaacgggcgaaaaagcaatcatcgcatcgatttccatgatgttatcaaaacagtcttatgactactacatcaaccaggtaaaaggaaaacgagcggtgattgtggacacggatcaccgaaccaaaagaaccaacaatgacgcgctgcgtgaggttgtcaaagattatgatgtgatctttatcactcatgcagcactcaaaaacattgatgactttgatttgtataaggatttttccctgtacattgacgaagttcctgatttggttgcgttcgaaagtctgcgatttaatagcaatatcaagcacatacgcgagatttgcttgccgtttagttgcaatgccgatgatatcgttgatttaaaacttgacgaagaaaaacgagaactggttacacgattagcctatgatgggcttcgtaaacgtgatgatatcgcaatgaagatgttcccgctttaccgtgctctgttaggggctattccggtgaagatgcaatgtagcgattcgggatatgtctgttacttcgtagaggatcatgacgtaagccagtggaagttcaaaaatgtaaccattgcttcatccaacatcaaagacacgattacagggaagatcctgcaaacgtttcatgatgtggagttcaaagattcaccgcttcaaaagctggttgactttaagcaatacaaaaacactgggcgcatacatatacatgtgctcgcagagggggattattcgcgttatacgggcgatctctctcaatctgggacgacagtatacactcagattaaaaaacgcgtggaggcgcttttagggggcgaacagttcatctattgcaccaacacatacagatcgaagtttagcgaggggcaggaaattccgtataactcgcatggattgaacttctattcaagctatactaacgtggttgcattattcagttacaacccgttaccctggcttcgtcaaatgttgcgagcggttgcggtgtcctctggactcgaagaggaagaattagttgatgcttatgttgtcagtaaatattacgaaccagcctttcagttatgcgctcgttctgatatccgacacaacaacagcaaacgaaagattaatttatttgtgcctgatatgcggttagcgaaatacatgaaggaaaaatattttcctgatgccattatcgaaaccacagaagcagttcaaacgaaaaggcaacgcaaatcatttcaaacccttttccaaatgacggacaaagagaaaaacgcttttacgccatacaagaaaagaaacaaattagattatgcgaatcctcttcatcacgcgattgttaaagattggctgaacaattaccgtgagaaaaaggcgacttgatggtcgccttttttgtttataaatatcagtattgaataagataaaggaaaacgataatggtagctaaatcattccgcgccacaagtggccttgatgctgctggcgaaaaagttatcaacgttggtaaagcatcacgctctgtgttgagcgacggcgtgaacgttgacttttttaacgaatttaacacgatccaacaatacgattctacccgtggttatgctgcgtttatggctatcatgtacgcgcgtcgtatttggtacgctcgcgcagatattccatcgccagcgggtgctttcgatgaaacaaaatggatctcaacccgtaacgatccaaaatgggtatataacaacgtaacgagcactgacggtctccctcttgaatccggtacgtacttaatggctgatggtcgtttctctgaactgacctatattctgccagatgcccctgttgagggtgatattatcaccattaaagacggtggcggtcttgcaggggttaacaacctgttagtacgttcaaacacccgtcagatccgtttacgtgatattcagtcaagctcttatcgactgactcacccatatataaccgttgcgtttatttttaacggcaacttatggcgtgttgctgaaatgcgtgataaccgtgattcgcagtttgttaatgcgactggtttaaccgctttccaaatgcaagcgggtatggtaacattccgtaacagtggaacgggtaaaattacgttgcagttgcctcgttacgcaaatgatggtgactcaatcacaacttacgatctggatcgccttgcttcggtgaacgttgcgactctgcaagtttatcctggtagcggacacacgatcagctatgacggtatcaataacgtaacctctgtgacttcacagcgttccggttatggtatcttcatgttcgatcaggctaataaccgttgggttgtttatgacggtgatcagcgcgttcgtctgcgtcgtatcagtgatgacctgaacatgttgccgaacgattacgtgttcatcactccgattgctggcaacccaccaactgtacgtaatgtaacgctgactcttccgcaagatgttgcagaaggtgatcgcgtatatatcagtatgtacatgatggggaaaacgcagaactgtacgatcaaagttaaagatggttccggtgaaaagatccgcaccaacaaaaacatgatgcagttcccacagcgtaaggattatccgcctgatgactggttcagtgttgacactctgactttcaacgccgatactgactatcttccatatatggaactgtcatatctgaaagcaacgaaagaatgggtagttgcacagtatcgcccgatcattgaacgtgtcgatccaacaaatcgttctcgtctgggtgtgattgcgctggctacacaggcagaagtaaacaagaatcatgaagatacgccgtctgatgaactggcagtaaccccgcgtacactggcgaataaaaccgctactgaaacgcgtcgtggtatcgctcgcctggcaacaactgcggaagttaaccagaacacgacagcaaccttccttgatgacgtgatcgtgacgcctaaaaagctgaacgaacgatcagcaacagaagatcgtcgtggggtgctggaaatcgcaactcaggcagaaacaaacgctggtactgatgacactaccgcaatcacgcctaaaaagctcgacacacgccgcgcgaccgaaaccctagcaggtatcgggaaactcgttacaacgggcgctacgacagcggagggggctttacgtggggatgctggtacgaacgtctacaacttcaataacggtgttgatctgatcaccccgaaatcattgaacgagaagacggcgaccgaaaagtcaaaaggtctggttgttctggcgactgaaaacgaagtggtaactggtgctgctgcgggatctgcttcaatgccgatcgtagtaactcctgaaatgctgcatcgtaaaacgtctactgaaacgcgtatcggattgattgagatcgcaacccagacagaaacaaacacgggaactgatgatctccgtgctgtaacgcctaagaagctgaacgatcgtaaagcgactgaatcacttgatggtattattgccctcgctaccactgcggaagttgcagcaggtacggtaacgaataaggcggttgttccggttaagctgaaagagttcttcgacgttacaagtcatgttgcggttgctaccgatgacggtttaactcagtccggcactatctggacaacgattaacctggggattgcgtctgctactgaaacacagcgcggtactttacgtgttgcgactcagggtgaaactgatgcgggtcttctggataccgtgttcattacgcctaagaaactgcaagcgaagaaagcgacggataccgccgaaggtattattcgttgtgcgactaacgcggaagcgggtgcgggtactgctactaacctagcaattactccggctaccatgcagttcttgaacggtactgatccggcgtggggtgcgacgacaactcgacgcggtgcggtgtttatcactacccaatcaaacactttcatcggtgataatctggttggttctactcaggccgttgacgattatctcgaagatttctatgctgtatcgcctcgcggtctgaactttgctctgcaaaacttcttaccgaaaatggcaacggcacagaatagtttgagtctgggcggtgtggttgctgcaagctggatgcgtcgtgatgcaaaccagacggtaactggaaataacacgtttaacggtacaagcaacttcgttggtaacgtaaccactaacggaacactgacggctaacgctgcggtaacggttaacaacaccgtaaccacgaacaataacattaatcagtctgcgaaagcaaacactgtttatgcaaatactgttctgagtggtgaggctgcgggaaccaaaaacttgcttcgtaccttccgtggtggtgtggcggatacgatctggcatgaaactgttcaggcaagcacgtatcgcctggcgacgggtacaacggatctggttgacgttctgacagtaggtgatgtcggtaacggcacaatggcgtattccggtacgaacattcgtctgaatggtaaagccctggctaacatcaacacggcgggtgatttgtttgttgcaagtacagcaacgcctacggtacaattacgaaccgctgcaactaatggttggaacggtgtaacaatcagtaatgacggcggcacaaccactgcaaccgtgatcaacacccgaaactttacccagcatcttgacagtacctatgtcaacgtagcgggtgatactatgactggtgcgctgtcagttagcgtaaacggtacgggtggacgctttaccagtgtgagcggtacggcacatgttcaggcaggtgatttctctgggaacgtccagaaaatgcgcttaactggcattgacgataaggtattgactgagttcaacatcaatatcaccgattacaacaaagcgatgatcaacggaaacctgatctatcatgcgggtcgtaaaccgactccggcagaaatcggggcggtagcggtagcgggttcaaccgtcgatactctggttgtacgtaactatatcaaaatcggtaacgtgaaaatcttcgcaaacccagcaactaagacttgtgaatttgtgtgggaggaataatttaaatggcgaataacgaatttatggcgttattcggccctgatagtttcacggcgaatgtgttttcagaagcaaacgccgtgaaatatcgccttgttgtccgtggaacgaataacgattctgcggtcaactcggttgaggtatctattaacggggctgatattattaacagacggacacaagttgctcgcggaattaacctggcagtcattgatggaacaactttagcattattggattacaaatcatttgatatgtatggtgatcctgctacgaacgggaatgcgattaaagactacctgaattcacttccagcgaacagaattgtgtgtttttatactttcgatgcgatcagaagtgatgataactttttagcgacaatgaggaaaattggttctgttgcgtggcccgaaactcggttctttaatatcccgatcaccacaaccaactattctcaccgttcatcctattcagctatctattcatcaacgatgaaaaagatttgcatggaaaactttgtcggtggttctggtacggggttgaaagacaatacaacgagttttgttgaagttgtgtttgatgaatttagtgatatcggggtaactggtattcctgaaagaatgctggatgatcctcaaacgtatagcggtaatggttatccattcaaagcatacggggtttggaacgttgggagtgatgtttctcgtaatgatattttcaaaatcactgcggacatctatatcgatcaggctgcacgtaatgcgggggcagaatgttatctgtatgcctttactcatattgcgtctggacagtggatatcatcaacagttcttagaacaactggacttgctgcggatacatggcattcggtatcgggatattacactattccagataatgctgatataactcgtttgggtgtttctgcttatcattatccgtcaacagttaccacaggtcaggcccgatgccgaaatatccaattctgtaaagtccctcgcgaagaggtgaacagaaacggggcggctatcggtgtcaacggtattaggatgcaaacactttccgaagtcactgatgctggaaccgtaaacccgattgaacaattgctttctctgcctgtttcgcctgttggggttatcagtgacaagaaaattagttcgcataactttgctgaacttgattatattgtttctgatccgactgaatatacttctaccaatacagcggagtaccagttcaaagaatggactgctacccagcaagcggcggtaacgaaagcatcactaagcagttatggaataaaacctggtgatacgatccgtatgcaatgccaaatgaaacgtgatgcaacagcaatcgcaaatagtaagggcgcgtacatcgtaatgcagttctgggatgcaaacaatacgtatatctctggaattaacatgcgtgatgttggcacgatcccgaacgtatattcattctacaaaaacgaaggggttattcctgctggtgctgttatgtttgatttcggtttatatcgttatccaaacaacacaagcacaggttcgatgtccgctaaagacgttaatctgtcaattgtgcgttaaaggggcgaaagcccctttttcataaatacagtcattacaggagaaatttttatggctgatttgaaattaggtacaacgctgggtggtgcgggtatctggagtgcttctaaccttcctctattgccctctggtggacaattaacgtataaaggctggagagtatacaccgaaaacgatcgtccaacagcggaggatataaacgcactatcgacgattaacggcggtactgttgcgaagaatactacgtttagtcaaaacgtgacagtaggcgttctgttgaccgcaaacactattcaatctaaccagtcggtcgggatcactcgaagtgctgctgctccggtggttgttttccgtcgccctgatattacttcggttcctggtgcggaatctgggttgatggacattaacgcatacaacggtatttctggcggacagttagcgggtgcaattaacgtgaacgctcgcacagacggaggtaataaaatatacatccgtgcctttaaaaatggtactcaaaatacgctgttgagtctggattcacaaacccaacaggtaacagttgagcaaggatctttccgtgtaatcgggacttctaacctcggcttaacgaatgctacatcaatggcagttagtggcgcgattactgcgaatacagtaactccgtcaaactgggctaaccatgatgaacgttatatcacgggtattcctcgcggtatgtctggaaacagtttcggggctgctgcggttactgaaaagaacgatgttctgtcggtcggtggtaacgtaacggacggtccatatggaaacacaacatattacggtcaggttgccacatatcgccgtactctgaatagtggtgtttctctggttcagacttactatgatataacatcaacatggattcgtgctgcgacgggttctcctggtgcatggtcttatagtgcgggtgatgctaatggatggagaagaatttatgatacttcgcttcctccgactccggcggaagtaggggcagtcaataaatccggtgatgcgatgactggtgttctaacactggcaaacatatctcaaccacttaaaacacccggcggtggtattctgggtaatgacgggaacgtgtatatcaacaaaagcgggtttgcaggatggatcgatgcactgttcttgaaaaatacaggaggcacggtaacaggaaccatcaaccaaacaggcggttattttgatgcatcgggggaaggtagaggttcttgggcttcacaaaacaccgcaaaagctccaattttccaaaccattaacacaacagcaacttccgaatactggcctattgttaaacagtattacacacaagctggtggtgcttggtctatgggtacgttggtaaacactaaccgatttaccgttcattaccgcacgagttcggtagatcggcagtggtattttgacaattcaggtgaatttgtatcatatggtgatattattaccacctcggcaaacggatttcgaattgcatatggtaacaccggatcatttattcgcagtgacggaaacaacacgtatttcctactgacaaatagcggtgatgtttatggtggatataacaatttgcgtccgatctattacagcaacaccacgggtgctgttacaatgggacatacgttatccgttaatggtcgtattagtcaatctagtagttatatcgacaatggacaattattgttaaatggtagtggtagcggacgtatagattttattcgcagtggtgcaaaccctcgcgatatgtatatgttccatgctggtgatgcttctcgtggaaaccgtattgaaatctctgatagtgcatcatatctggtttattttgaacgcaacccttcatccggcattcagttggtaatgaacggtaacggtagctttaacgatgtgtatattcgttctgatgaaagactgaaaagcaatttcagtaagattgaaaatgcattggataaagttgatttgcttgatggtatggtgtacgacaaagcaaatcatatcgggggtgaagaaactacccgtgaggctggattagtcgcacaacaactgcaagaagtattaccggaagccgttaagaaaggtgttgatggtgaacagaacgagatattaactgtttcttcttctgctgttattgcgttgctggttaacgcagtaaaagaactccgtgaggaagtcagggaacttaaatcccgctaattaaaagcccttcggggctttttctttttataaatatcataaaagcatttgaggatctaataatggcagatttaaaagcgggtactaccgttggcggtaatactatctggagtcaggctaatttgcctttactcccttctggaaatactttaacatacaaaggctttaaggtatacacagaaaacgacaaaccaacaaaagccgaaatcggattaggcaacgtaacgaacgacgcacaggtgaagaaagctggcgataccatgcaaggaagtttagagttacaaggttcggcaactgaattgaaattaccgttcaggatcgcaatggttcgagcaacagaaccttatctcgttgctactcgtaccgacaacaacccagtaactaacggtttccctagcgcagaaacacgcacttttgttatacattcaaaaacaacttcaccaacgtcagatcctaacgctggggcaaaccttgttgatctgatttgtacccaacgccctgcgggtggtggtgcttattatatccgtgcttttggcgcaccaaacacaacaactggtgctgctgggaccattcgcgctgaattgcaaatgctgggtgataatggtcttgttagtttaacagggacgcaattcaacatcgggatgcaaactgttgtaagcggtacgatctttggtacgcaaatgtctatcaaaggcgatggaaacagaaacttatatttccaggatgctggaggtaatgaattgggtttggtctacgttgatacagggaagaacgtttatgttcgtactggtggtggtgcgtatgcaactcgttttgcttctgatggaactttagttctcgctaaccatctaaccgttcctggacaggctacgtttaatggtctgggtgtattcaataaccgtgcttccgttgaaactgattatgctactcaaggaataaacacagcaatacttcgagtaactacaaacggggatggaaacggggttggtgatggtgttacccacttaggctataaagatggtaacggaagatataaccattatttccgtggtactggcgcaacgtatattaacaccaaatcaggtcttaacgtaaacgtaccatcgtattataacgaagttccacagggcacaccagcgcaatatttcttacctactgttggacagggcgggaaaaactatttgcgccagttccgaggcggtaatgcggatacgatctggcatgaaactgttcagggtggcgtatatcgactggcaacaggttcaactgacggacaggaagaattagcaatttctactgcgggttatgctcgattccgtcaagagatacagagtaatacttatggtactggcggacaattccgcgccgtaggaggaaactatggtttcatcattcgaaatgatggtggaagtacatatttcttacttactgcatccggcgatcagtatggaacatggagtggtctacgtccgtttactatcagtaactcgaatggcgttgtttctatagcaaacggtgcaaacatcaacggttctgttaactttggtaacgcggtaaacttcaacggcacggtcgaaacaaacggtctgggttgtggtactgcaaacggattgggtacgactggtatttctctgggtgataacgatacaggtttcaaacaggaaggtgacggtattctcaacgcctatgcaaatagccagcgtattatgcgatggactactggcgcaactgctaactataaacagtttacaggttcagggtgttaacggaccagcattacttctgaataacacagcgactaaccaatcatgttatttgctgattactttggcaggtaacaacggcgcatacttcgggtttggtggtgctgatgataacgtatcggtacacaactaccgactgaatacgaccttacagttgcgtgcttcggatctgtatatgaaccgtggtctgtatgttgaaggtaacgtaaacgccaacgatgtgtatattcgttccgatattcgactgaaatcgaatttagttgaactgaaagattcattaagcaagattgaacagcttaaaggttatatctacgataagcaatcaaaagatgctgatgatatcgtataccatcgcgaatccggtctgatcgctcaggatgttgagaaggtattgccggaagcagtgcgcgaagacatcgacactggtatgttaaccatttcaccttcgggaattaacgcgcttctggttaacgcaatcaacgaactgcgtgaacgtctggaagcaatcgaaaacaaattaggggcttaattgcccctctttcatgaggtattttatggctattgtaggagttcctggctggatcggttcgtctgcggtcactgaaacagggcaacggtggatgtctgctgcgggtaacgcggttcgaatcggaacaccgttttatatgtctcgaatggcgggacaatcggtatataacatcacctttacggtgtatgagcgttactataacaacgcccgttatcgtggtcagtggggggttggctggtattcgccacattcaaaaccttccggtcatggagcggttagtggtagttttaatggtaatgcgttcggtacttgtgtttctgcacaattcagcaatgagattagtgtaattactattcaaaatggccctgctgttaacctaagacttacgatggatgacggcggtgtgtttgactttgacaataacggtcgtatacaggatggatatcgccaatatcagattgcttctgcccaacataacgcgtggtatgactatttgaacgcccgtgtaggccaaacacgatccggtctggtcactcaacgttaagtaaattcctaaatatgttcgggggtcggcatccccgaacttgaggattaaacatggcgctattacaagataaattggcggtgcttgaacgaataatatcgttcatcatggcggtcaaaacatggaaacagttattcattaaattggttcttatcgtcactattttcattatgttcgtaacatggtataagtgggatgacttattttcagtctggaaaacatcttcaagcgttatagacgtaccgacgatggagattgaaaaggcaaaaaagtttgaatccgcatccattgaacagttaaacatagtgcatttaactacgggtgcggatttttcggcaatctttgggttcagacctaagaatgtcaattattttgttgatataattgcgtatgaagggaagttaccgcaacagattaacccgaaaaatctgggtggctatcctatagacaagacatcggaagaatacaacagacatataaacgggctgtactatatctcagatattgcaagcccgtatcttccgactaaagaccttgttccggtagcatatacctttagttgtccttacttcaatctcgaaaactactattcaggatcaattctgatggaatggtatatacagaagcccgaagtcaccgatacgaagttaatgatcgtgtgcaatcaggccgcaagaattttaggcaggattcgatgataatttcagtttcatattattcaaagcccgattgatgaaatcttttactttcgtcatcgggcttttatcgtatatgtcccatacccgcataagttcatatggtgtaggtacatattcatcgttccagtatccaatgttccctatcgtaatgcgccggaaaccagcctctacgctgtgatatacaaagaacccagccttacccacaggggcgactttaaaaccgcgtgtagcggctttcatggcttcgtcgtgtgtcatgatagaatcacttcgcctctgtattgattgtggtagatgtatggacgaacacccagcgggtgattatctatgactaagatcaggtcaagttcgtcgtggttatcatcttctgcaactatatcccagtcggtcgctttctgttcttcaacactggcaatgaatacctggttaatctcaaccttacggtgagaacggcgaatgatcgtatccccttcgcggaacacgatcatatctgggttaatcgggcggtacgcggttttacccgcgcacacttcgtttaacatttcttcgtatgtcattctaatacctttactcgctgaacgattgtctgtttaacttctttgtattcgttgtgaagtttaggtgtcgctttgaagcgaatcacatcaccctcttcaacaattttgtttccgtagtagataaccacgttaccatctacgttgattttggtcatgaaacgttccacttcggtgtaataagaaacttgggtatatccgagagaaatcactttctcaacaaccccgctcatttccatacgcttaccgatttccccgatgtgctgcgctgctgcgatcttcgcctggcgctctgcttcccattctgcgcggatttcttcacgtttagcgatgtaatccttctccagcgctacgcccatgcagtaagagcaaatagcctgaaatactgggctatcattgccgttttctttgcactgatcagcccaccacagaatagtatacatcggcatatcagcaatcacttcgcctttacgcttaccgattggcatgatgccctgttccagcagttccaggttttcggtatcctgtacagacagtttgccgcgacgttcaaacagatcgaaatctgcgaagccctggaacaccatctggaaagtatcggtctggttcagacgatccaccatgcgatcgaagtattcacgcgctttcgcttccgctttatctgggtcagtagacaggttgcagatatagttatcagaagtgaatccacctccacgacgctctacacgcagagtgtacatagcgtttttagcgccagaagaaatgaagtatgtcgcggtaactttagtcaggttagtcatggtgaatctccttagtggtttcgtttcgataaggccaatataacaaaagccctcaaccgaagtcaagggcttttttatcatgcgttcgaatctttcataactttatgaagatggatatcaaaaattttccagtatgcttttccgcgaggataaatttttgctttatcaatgtcttcgttgcttccccatgtattgtttgggttacgacaacgattttttgcataatccatgtgccagaataagcgctgtaccgatgaatctgtgcctaatggatcttctttgctgaacagaatttgtgaactcataagaagaaacctgttcgaactactaaatcgatctgtttttccggtatcagtggcgctttatcgtcaacgttgcactgataatacatcccgacatactcatgaggaacgttggattcgctcgcccatttcaggttgtcatctgtacgcggccctaacatgaggttaacgatattgacaacgtgatcctgttctggggtattgttgcatccgttcacataatgtccgtgagcggttttgaggatttcaatgatatcttcgtcggcttcaacgagatacagccccgtgttttctgggatttcctcaagaataatcaaagcggttttcatcacacttacctttatgtttctgcttacgttttgcttctttaagtgctcgcttgcgatcgcggtgagtagaagcgcggttgaaatcatgtttcgctaccaggttgttcatcgaggatataatggcacatgatgttgaatactgacttcgccatacagttttacgatagttaagctatcagatcctttaacaattctgtatttttctggaacaacgcggtcgatttcttttttgacaaagttaagcaatccgaagtcatctatatcttttggtgctttggaaatagaagacaacgatactcgttgacgtgaatcatagtacgaagaaattacaaacatatattattttccttattggggcttttcagccccattttagataattaatccagcagtttgcggattttatccgcgatacgtccggctcgtgttgcgcttgcggtatgatcgctttctttggtagccagttcagccagcttacgctgatgttcttcttccgctgctttgcggtctgctgctacctgttcgacctgcttctgatcatgcgcaatacgcgcttccagttcggtcagggttttgtcaaaagttgctacgatttcgtctacagaacggattttggaaaacagtttcatattcattatctcaattagtatggttggaattcaaagtcaaacagatcatttagtgcgcggttgtattcagtatagttctcaccatccccgaaccgcatctgaatcgcgctttccgctattgtaccagtaagattcgagaaaccaaagaggtttttaatcttatcgtgtgcaacgaagtacagagaagcactatccagcaaggacaccatcgctgatggttcatgttcgcggcgtttgatgcgtaacagagtacggtttgcgccagtcttacggcgttgatttggggctacgtagaatcgaaatactaccttacccgttttatcatcaactaccaggtagaagccgtgttctttcaggtcaaccccttcgaacttggtgaagtcaccgcgcttcatgtcacctatcttaacagcatatttgtggatgtcaagccttgtcagaattcttttcatttttcttcaccagtttatttcctaatttggtgtttacaccagttttcatattcattgtcagtaccagcaagaagatagggcatgacaaaatcaagatcgttgcgccgaacactaagcgaactaagcgaatcaacaacgtcccgatccatttcatcggtatctctacccacttctgaaccgttgcgagtaccagcataacataacccagattaaatgcaagggctgttgcgataataccgtaaggttttttgaagtatgtctgttctccgtcttctgtacgtccagcggtaacgttgcctccgttccagagttctttggcggttttaatggctgtttctgccccgctcaagttctgccagtagtcaggaatgctctgtaggaatttcataatcgaatcctccgcgcctgaatcgctccaggcgctgttttggggttagtagtgactgaatcccacagttacatcacgcatcacctgataacggcatacacgcatcttagcgttgtcgtaatctgtcgggattgctacaacatcgcgaggattaaccttgacctgaataactttcccgcgtcctccgccatagtgaggcaggtacgattttgcggcaacatgcaaaccgcatgaacaggttcggtttttattctcgtctacctggttacgtggcatttcaaccacaacaccaggggaattatcgaacttaccggaagccagatcgcggaagtcttcacgaacacgtttccacgcgtagaaatctccatcatctgccagttcgatatcgttatgcaccatgaacccgtaaagctgatacacagcatcgcgtgaagggttttccatcaacttctcgaagaagttcaccaggtgctcgtaagggcgatcgttgtacatttcgcgaacgatacgttgtgtgataccgctgtcaaacacgatatctttgtacaggactttatgcccgatgattttaatgttgcctttgctgtaaatcttcaacgcttgcgttgtgtccaacagggtagcaactccctcgatgtcgcccttaaccattaaagcatgtgctttttcgaagttagggtgtgacgaatccgctgtgatgatcttgccgtccagtaccagagtaatgaacgattcagaaccaatcattttagatttgacatctgtttgcggaagtggtttcgacgcttccgtattatacttagaatgctgttcggtaataacgcgcccgatggttcggacgcttacaccaaattgtttagccagtgcggttttgttcgcgctggtcagaaagccctcataaactgctttcttttgtacatcatcaaggatcttaacgtttctcattatttccaccgtataaggttaatcaggttcgtcttgatcttatcgtccgtaatcatggtacggcctaaagagtaagacgaattgcgcaacacatacaccaatgcagggttgcgttcttcaaacaaatcaaaggcggtatcaacacgttctttcatatctttcagcattttgtaatgcttcaccgacatttcacgaagtaacggattgcgcaccacatttttcgatttgtttttgttctcgatagtatcgtaggtaaacttaccatcaagataatcaagcaacaaatacaattctggattatagcggtttttcaccatgcgatcaagagtcacctccagataatcgcgaagggttcgaacctcgctaccatgtttagacgaaatccaggctggataccagttaggcttcatctttttcaccgcgtcggcaaaacgctgtaccagatagtcatcaagacatttcatgttgctatcaggaatgcggctccacagggagtttcgcagaaccatcacgcctttcagtccggtaactttcaacagggtcatcatactgctggcgatgctacccagtgtatagttcggtgcttctccgtccagtcggctatattcatcaatcccgtagaggcgcatagcgtacatttcatccagtttcacgaactgtgcttttgtcaggaacagatcgtttttctgtaagttaccctgatcatcaaggaagtaatgatatgccgtaggcgttttcggacgtggttcagaatcaccagaagatgattcacgcgttgctttccagcgcttgcgatcttcggtgtacgtttcgaattctttggtcaattcactggttttcagtgtaacgatctcagattcatcgaaatagccagtttcaatcaactgacgcacagagtcacttttacgatcggcagttacgaaactgatacgatccgaaccgttcatcatgcagtaaccgatcagatacgggcggagtgaacgcgcttcgttatcattttcaacgatgaacagtttcttctgtcgccacggttggatcatgcgcataacgtcctggcgtttggtggtttccgctttatacttctcataacggcgaccagaacccacacgttcgaatacgcaatctttcccgtcatatgggttagcccagaagccccacacatattttccggttgctgtatcagggcttttgatacgcgtcagaatttcagccagcgattctttacccacacggaaacggttatcacgggttacgaatgtctgtaacaagctaggcagattattgaaccatacgagtttatcgcgggttgtcttctgctttttatactgttccatcaactcttcatcaaagcgtttgttgattttatccagtcgatccgtaatcactttcttcgtgactttatcaaggctcaactcttcacgcgacggcatgaagtccagcgatcccagagggaaatccagaatatatgcgtaattgctgttacggtagcagtagaacagcgagttttcgaacatatccagatcgattggataacaaatgttacccatacgcgcgtatacgcctgaatagttgatggacttataacggatgatcccgcgatcgtctgcttctttcggttgccagtttacatcaacctgaacaccgataaagcgcggacggatacccgtaaacggttcataaacacgcgccgcttcacgttcccattctgcgatatcttcgactttaaccggaacggtgatttgaacgccgttaggttcgtctgtttcggtttcgtagatttggtcaacgaaaggttcaccattatccatataagccgtgtacgcacgtttaacgccgtcctggatggattcgatagtgaatgtttcggtgtagcagaacggggatttactacccagtcccagcgccccgatcagttcgtcggtgtcggttttggtggattcgaaataggttgcaaacacctctttaaccatccagtcacttaaccctgtgccgtaatcacggacgatgaaacgcggatcgagaacagttggtaactgaacatcgaacgggttcatgttacccgctaccatatgaccatcaatggcgttactggagatttcgcgaatgattgcgcggatcttgtatttgtagatggttgatgacatgattttgtatgttttcgcactggtagccattttaaacttcgtgcgttcgcctttatcgaagcccgtagtgtgaatggtttgtggtgctaactgacgcaatttcattgtttatatctcacttggtgttgaagatgatgttatcacatgaatatttcataggcttttgatcaagcccatactcaacaggtgtacacatccggtcaaggtattcgtaaacctgttgcttctgacgttcgcggtctttcatatccatgataccgaccacgatagcagttacaaaacatattgcaatagtacacagcacagctattgtaatatattttcccgtttttggtgcatcatatggtttcattgaatcgcctctgcatattgttctggtgtcaatttacgcgctactaagcgccctttggttgctcgtttgtttcttgaaatgtagatgtttgcaatgttgcgtttaccttcctggatctcattgtacatcttttcggtcatattgcactgataaacttcaccgttcggagttttcaggaaaaacgcgtatatgtctttttcgctttcctgaattactgatttctcacggatacggcttttgcatggtgtaggctgtgcgcccaactcgatagctttacgctgccatacgatcccgtgtccagccccttcggtcagagcatgtgcaatttcgtgcatgagagtatctaaaacgttctcgtagatatcttccttaacgtgagaacggctcaattcaattgacttgcgactgtaattgcattgtcccagagtacgcttgaaacgtccgttgattttgaaagaccaatgagataagccatgcttcgccatgatgcttttggcccagatggttatttccatatcgctacgagttttgaacattttatatcctccccaatcagtgaggacactataacaaaaaagcctcccgcaatgcaagaggctttttgtaaattatttcaatttcttcgaaagttctttcaaatcattgagatattcagttttcggggtcgtttcttcccagtatttcagttgcttacgcagttcgttcgcttcgtcttccagcttttgacgttcatccgtggttagatgatagatgttcatcgcaaccaggatttcggcgtggttctcgcaacccgtccacgtagagacaagtttaaccgcttcgctgcgactaagccccttcaatgcgtcaggctgtgcgatcatctggtcgatgaagtcaaccttcgccagcgctttatctaacgcttccttagtctcctggatgcgtttatcaatacgctgttggtaaacaccaatacggatatcaacgaagtctttcagcaacgtttcaggacgctcgtatgaatgcagtttcccgttaaagataacgttgatgtttgggtttgagttctcaatcaatccgaaatctttcaggatcttctcaggggtaagcccgtttgcatactcgcgtttgagggtgatctcgtagcggaaatcttctttcgatagatccttatagcttacgatataccctttctcttccagcttatccagaatagaaatatatttcacgcgatcatacttgaccggaatctctgtgatcaccagtttagttttaccctggagttcatacttgccatacatcgtaccgttttcaatgtcacctttgaaatgcgggtatttcagatccagtgtgaaatctttcccgttcaggtaactaacacatccattcagaaccgaaatcggatcgtgtggtggaatgttggtagcgtatgctttcgcgatcccgctgaacccgttaaccagtaccatcggaatgattggcaggtaataggctggcggtacgtgttcaggatcttcatgcgggattgtcaaatcttcatccatgtagatagccttgaacagcggagacagcttacatttaatgtaacgcggtgcgcctggctttttaaccagacgggaaccaaagaacccatcgcggtcaaaaagcgggatgttattgcaccagtgcgccgccataagagacaatgcctcttcaacggatgtttccccgtggtgataaccatacattgcaacaccgccagcgatagaggctactttctggaagcctgtaccgcctttcgctgcggaatgcacgaagaaacggtgaacgggtttgaacccgtctaccaggtgcgggatcgcacgagaataaattgtgtaaagggcaaacgtaagcccttctacctgtacaacgtctttaatacttctttccatcatttcaccgaaaatttatgttttccgttcacccagtctttacgcggatcggattcatcaccgaaacacagttccagaacgtctttgtattcgtcgcccagtacgattgtatcgtattttaactggtcgcccaacacccgatcgtaatcttctttgcgtaaagaacccagccctttgatatatcgcacctctttcgctttatcgcggaacggtgcgaaatcttcaagggagtagaaccatttttcatctttaccgactttcgcaatgataatcggtgtgcggatataacggatctttttcttctcgaacaactcaggccagcgactaaagaacgcaatcagtagggtgagaatatcgcccccgtcaacgtccgcatcgaccatgatcccgatgttgtcgtaagtcatttcggaagagtcgcctggatggagattcaggatcgccatgagttcagacaattctttgtttttgagcacttctaagttactcattccccaggtgttcaacggtttgccacgtagcggaaatgcgccttgtgtctcttcgtttctgcactcgataaactgccctacagcggaatcgccctcggtcagaaacaaagtggtttctaccccgtcagtgtcgatccctgatgccggaacatgttttgcaaccttcgcctttttcgctttcttcttcgctttggtaatggctgcggcttctgctgcctgtttgcgaatcagagcggactcaatgatcggagtgattatttcagaagtatccataatctgtttcgcgatctttttgtagttcagtccggcgtggttgttgaactccccagcggtgttagtcagtttttctttcgtctgactatcaaaagctggtgcattgaagttatgcaaaaacacaaccaaagtcaagcattcttttacacgggctttcgggatctcgatagcgtgtgttttcttgatcatcggttcgagttcggaatagataccgtcgatcatggtgtcaacatgaacaccgccgtttttcgtatccaatccgttaacgaaggatttctgtttgaaaccgtcttctgtgctcgccaggatgaaactgattttgttgtttgtctgggtaatcgttttatcaccgtacatcgcgccatacatcgcgaatttgttcgggaggatatcaccgttatatgtgaatttaacggcagggaaagccactgcaagcgccataaggcgatctttgatgacttcctttgtctcttcgtcgataccgtccacaccgaaaatagagaagtcaggggtaaacttaacggttgtcccttgctccttcgtcgggctggtgcggtaatccatgttctgcgctccgtccgtacagttgatcgtgactttgcgtttaccgttggatgtctcaccgataaagattgcgctgtaacagtttgtcaggaaagaaccaacaccgttcatccccattgttacacggttttcgtcatcgaagttagaaccggatttagccattgtccaggctgcaacaggtttaggaacaatcttcccttctggcgttctcacgtcatcttgtggaataccgcgcccgttgtccgaaatagtaaccagattgtgatcaatcttgacttcgattttgttcgcaaatttgaaatcagttcggatcgcttcgtcgatggagttatccaggatttcgttgatgattttcaccaacccttcaacgtattccactttgcggaatttacccatgataaaacgttcatgggcttctttgttcactgaacccacgtacatgttcggacgtttgcgaatgtgatcgcgatcgctcaagcagaatgattcatccaccttagcgccctttgtcggggcttctggtgctttctgcggctcgttatcgtccattaagaaatctaaactcatattcacctctttattagttctcaggcattatatagggttctatgaaaaagaaaacccctttcggggtttacttgttgtacgggaaaccgtctttcaccatctgcggcttatcaaccgttcgtttcgcctcgcccccgcaatcacaatctttcggttcgtcacggctcgcgatgctggacatcttcgggaattctttttcgcacttggtgcatttataggtatatgttggcattaataaatctctgacaatggaataaaacggatcggggttgcggctttgctgaaaacacattgtttgttccctgcaaacatgagatcagtttcgtacaccatacagatatatccctgattctccaaaatttgccgctcccagctatcgaaccatttagacaacttctgcaatgaagagaagccgaaaatatagctacgataatttttaccatgttttttgaggttacgcattaaacgaaggtcttcgcatggtgcggggtgacgagtctcggagataccgaagtttaaaccgaactcgattccatgaatatcaagatactcatagagatcgtcttcatcaccaacacaacccgtgtacgggcctaattgcttacaccatccatcatatttggataatatagacgctttcaattcaacgcgataaaccaacatgatccgatcctcgtaattgattaactacaagtagagtaccacttatctaatttcttatcaagcagtttattgatcacttgcgcgatttctgttgtcccgtgggtagtacccagtttcaggtaaatcacatccaacgcacacacgatcgcatcaacgctttcttcgacgatatcaccgccgcgttgaggctgaacgagacattcggagatctccccaacctctgcggacaggtggtgaaccacgtcgctaacggttcgttttttgacgctatgagcggtcttgaaaaacttatccagaactacagcggaattttcgcgcggtacttcctcacctttattgacgtggttgatttcagtttccggttctggtgcaacccataccggattgaaaagccctttcatatcgttgaacttgataggaacgggaataccttcaagataaagaatccctgtttcttcatacaccatactgatccggcgtggtgaattgaagtccatcgggttcttacgcaacgcatcatacatacgacgaatcggatcggcttctgatgccatttgacacacagccattaaaatagatttcggggcgtacatatcaccaattttatacttgctcatttacaatacctttatgataaccaacaataaaacagttcacttctggacgttcgccagggaaatgcacacattgcatgacgcgttcagccatgagttcttcgcccaaataaacagaggtggtttcttcgttgtagtgacaacagtaagaagttttaacactcataccaggcaatccggcgatatgcataaactttgagttcgtgcatggtttaccctcaatgctctttccgtttacatcaaacgttgcaaacatttcggttttgctgttctttgggcgtctgctcatttattcacaacctcattatatgttttcaggttccattcatgcacttctggcactttggagtaatgatccaggaatactaactggacttgcataacactagcacgatccatattgaaaaggaagcgttgcggggaagtaatacacaggaaatcttcggtacttcctctgcttgcgctaaactcttttgtttctccgccgtcaaatttagcatatacaggcgtagaaaaatacggggcgaatagttcgcgtttggaatcgtccgtaatcgcactgaaacacacgtctacgagctttccggttccttcccgtctgatggtgagcattgtccctttcgtgcgccctaagacgtttacagagcgcgtagtgacatcaccaaaagcgtttgtgtaactcacagtctccacaaagcccatatcacgacgctgttgtagcattgcttcgtgttgtgcttctgcatcctgttctactactcgttgtgcggcttcatacgccgctttgttcggatctcttgattgccatgcgaagaataaaacccctgcggctatcagtccgaagattgaccaactggcggttgctgatagtttcattttaatttccaaaggggacgaagccccgattttagcgaagatagcgaacgtatccactccggtcgatcgcgttctctgggttgttgaagatgttaccacgaatacccttagcaggtgctttccagccagcggctttcaagatatttccgtcattgtcgatgaagccagcaactgaacgctgattgaacatttcacccgtttctttgttgcgggtatcctgcacgatacggtgatacttacggcctttttccagaacgaacacagtttcagtgtaatcgctgaaccacatgccagtgttacgacctttgtgcatcgcgtccagtaaaggctgtgctgcggctttcagttcgtcaaaagtatacatggtaaaatctcctaagtgtgtttcgtttcgatgtgtgtaatatactattatgcgttcaggattgcaagcattattttggttgttcgcaaatattgctcaatgcatcgcgtttaatgaacttcaatacacctgctttagcttctttctcgtcttttgcctgatacaagaagcagtcttcaccatttttagttttgacggtaatcacgaaagttttgtagttcatgcgtagttctccaggttagccagattttcttctgctttagcaagggatttttctgcggcttttttcactgctgcatactctttcttttcccatgctgcgatatcgctgttcatcttctcgtcgcaataggcgatgatgcctttgttgtcgttgatctgctgaatcaggaatttgccgtgacctttgattaaagaaccgttctgcatcatgataactctccttccgttttgtttcgatgggataactatatcaaagctatcccgtgaagtctttagcaaaaagtgctatttgttaaacccgtttcccttgataccatttcgggaaaataaccctctcgataaaagttctccccaggttgaaactatcaccaaacaggaggacaccaaacaaaggatcgcgcttgatatcgtttttcccgacagtcttcattttcccttcgtggatcacggtgtcaccaaccgtgatatccttgatgcttacttttacatgatgcatacaatcacctctgcgagtttagcaggttttgcttctggtctaactttcaacgcatcattcagattcttttcaaccatcgctactgcgtctttttcattgaacccgttcttaaccaggactttaactactttggcttctaagtttttcatgatgcgttccttttgtctgtttcgtttcgatgtgtgtaatatacaaaaaagcctcctgcattgcaagaggctagtttaacaaaaagtgctattttaatgatttaagtgttctacggattcccccgttttgggtgatatcgtaaagctcttttgctttggaaagagataccgtgatgtcataatcggttcccttctgtgagaatgagaatctaacctggtttagctccgtgtatacgtgggtacacactgcttccattcgaaaatgttttataaacgctttcttcgtgtagtagtcgctaaaccattctcttgctatggattggtcgattgctttgaagatgacaaacagcacaaccaacacaaaaattactataagtggaattgctgtgctcattatttgcccctgttcacagattgacggtgtaacgcacggttaacgcgtggcgcttgataaggtttcattttgtacggtgttggatcagagtattcgatccggttaggtaatgaatacagttcaacgcttggttgaatccagcggattgagtcgattaacccttgagttaacgcacgaccgaaacctacaccaactaaacataaacgcataatatccccttactgtgccagaatgtgaagccattcgcccaaccacacgatcgcctgataagacaaccacaccgcaccggacacacaagcaatcacaccaatgatcgcgaatccgattaaaatgttcaaaccttctttcaaatcaccaaacatgttttatcctcttttgtttcagtccctacaaaataacaaagcccttgcacgaatgcaagggctttttatcataattcgactaactgaggcaatttcagaaccatccccggaaggatatagcttgcattgctaacggttttgcggttcaacttagcgatagactgccagcgctcaccacaaccgtataatttttcagcgattgaatacatgctatcgccaggctgaacaacatattcatcgtattcgactttaacgaacgcggggttcatgagaatgtcaaacatctgcgctttcgcttcgttcagtgtttttgcatgtacagttttacctacaaatgataatttaatcatcttttcctcggcagactcaatggatcggtttcttcttcacttgggggttcttccagccccagcgcatatctcaatgaatagactatcatcaaaacatctttcgcgcaatcgtgaattgaattatgcatcacaaaaccatcaagcaaccctttccgaagaggacaggtcgaagcatcacgcgttaacaggcggttttcgatacatgtacgcacatcgcgactattccagaacacggtcggcatatcttcgaagatgtcgatcttaccaaccatcttacgcacgatatcaaccaggataccgcgatcgaattcaggaccacgaacataatcgagtgattgccaacggctcacaccgtccgctttcaggtcttcaaagaattgtctgtgtcctgcatacagttccagatcttccggcgacggtttcaggatttgacgggcttcttcgctttgttgtttccaccaggcaattgttccctgatcagcaatacgatcaggctggttgcgcaaatcaaatttgtacttgcgcccccgtgcaaccagttccgcgaacgttggcgggttgtggggatcgtcaacaaatggaacgtatgagagttcgatcaccttcccattcggggaaggaccaaccgtttcataatcccatacgtaatctacgggtaaatgactcatgaagttctccgcttatactcttccatgaagtacgccagcgtaagcgcaacttctgggttgatatcaaaagtttcaaactctttgctttgcaaagtcatcataccgaactgacgcagaccggaatgataaattgccttttccagacggttcgcgttttcaacagcttctgtgaattcgtccaacacatcgcgatcgatgaaatgcggaagttcttgaacaggggttttgaaaattagatctgcaatcgcttccgcgtggaggcgtgggatctggatagatatatcttttttcatgatattaatgtccatatgtctttatcttcacgaatgtttcgtgccattcgaaggatcagcacgataacgccatattcatcataagtcagttcgacttcttttgcaataggactccatgaataacttggtccgttcggagaatacagaatatcgttagatttttcaatgaagcgcaaacggtgaataacttcttgcggatctgctgcgctatacatcccgaacacattgaccgcatgtggatctttttctcgaattttatcgagtgcttcaagaattcggggaatgtcttttacaaggatagtcaatttcataataacctcaaaaggggcaaagccccttatacataatcaacggtgtaacgtgcgcgggttacgcccacatagattaactgcttacacagatcgtaatctgcgaacgcatacgcatcgcgcgtgtacatgtacgcatggtcatacgtgctcccctgcgatttgtggtacgtgcaaaccggaagaggcttaacatcctggaacttgtttttaatcgcccagaacgaatgccacggggctttatagcctgtttgctgcttgatgcgcttataagtgctcgcaacgtaggccagatagttacccagacggtctttcatcaccggatcaacaacaacctgaatctgtgcttcggtttcctcttcgagcgataccgttttcagaagatagaattcaagttcgatcttctcgtcgcacttctccgccttgataacttcccgacgcgggatgatttctaagactcggattttttcgttgttgttataaacaatctcggtgaagatttgcccgttcaaccgcatttcctgaactaacggttcctgcatcacgatcacttcatcgagaatgaaaggttctgttgttttgtacaggtgtttacggatcgttgcgttcagcttgtccacgttgtcgttagtgtaagcgaacatgcggttctcgatcaagtcatccggcgttttgacacggcggaaatactgacggaggaagtcaacagcgttagcatgttggaacacacccagatcaccgacagacatcggtttcagcatcttaccatcacgtacagcccttgaaacctgaataatcgggttcccttctgcctgacgcatgattttatccatacggataacatcaaagatttcttcatcaaagaacggggagagttcaacacgtccatcggcgtttaccggacggatctgatctttatcacccagtcccagaataacagcgttgcttggaatactgcgccggatgattcggaacagatccatatcaaccatcgagacttcttcaacaacgaacacgcgacaggtagacagatcaggcgctttcttgcctttctgctgttcgaacacacgaagttcttcgttagtcacagggctaatcttcaatgcagaatgaatcgttgttgcgtccattccggtagccgctgctaacacgtttttagcctggtgtgttggggcagttaaccaaataccgctaatccccaaccctttcagagtgttaaagacaaacttaaccagtgttgttttaccaacaccagggccacccgtaatagttgtatgaatggcgttctggatgttgtggatcacgcgatcatgcgcggacttctgatcgtcgctcagatcatcaaatgttaactcgctcataatttgagtaataccccttgaattttcgaattctcaataaaccaacgcatctcttttttctgttcttcggttgctggtagttgctcggttttgcggaagaaactgaaacgcggttcgtccggcgtgtagttcagtttggtttcgtagcacttgcggataaaatctaatttatcttttgcaagttgcggtgatgcaaacagttccggcgttttcccgttttcaacgtatggaatagtaaagccgtctttgtctttcgtaacaatgatatagtatttgtcaatcattttcgcccctcatagatgacgtagaaaaaacctataacccatagcaatgataatactatcaaagcggcttttctgtcaacaccgttaacgtggaaaacgcaccatccaaagagatacgttatcaccgcgcaaacgatataagacaaagcaaatacggcatgtagcgcggtgagttccattagtagttgttagcccaacgacgcaggttttccgcctgtttcagagcatacagcttgtagatggtttccgcatccagtcccagcgcgaggaacttacacatgaagaagtgccactggtcaatcagttcaaacaggatttccagcttgtcttcttctttcatttctgcgaatacctggctacgcagttcctggtgatttgctttccacggtttccagacaccggaagccgcttttgcaccgcgagacataccgcccagagcggtgtaaagttcgcgggtttcgtctgcgatcgcatcatcttgcagtttcagccagtccaggatctcaccgcacgttttcagttcgttcggacgtggaacccaattcagggtatcagacaggctttgttgtgcatggttttgcaagtccagcatcttttgcagcgggtcaattccgttctgtaatgcattgcggtagaaaccttctaccatttccagatcatcggctttaaccaggtgcgcacagctattaaacacaggagttttatcagtcatatcaatctcattttttcggtgatttgttccacgacttaaaccgaagtttcgccgtgagtccagaaacagtattatctttcaaatactgcatgatttcaagtttagttgcgccgtccgtttttatcatttcgttgatatcttttgacggccacgggcatttgtcccacaacacaaccttttcgccagcctcaatcaattttaaaaggcggtgagtagtatcagggtgtctcgcttcattgtcaagaacccagacacgcatatttttatacggaacatcggacagcgccatttgtccgcccgtaatcgcaccagcattatctacaaacaggctatccagcggcccttcaagcaggtagacaggtttcaacggatcgatggtatcttgaccatacactttcgttgagtgttcacatgctttgattgtcatgtattttgcgttggcattgtcacgcaaggcgcgtccctggaatgactcgattttacccttttcatcaaagatagggatcaccaaacgcggttcatccttcggtaaagggtatgcgtccgcattcacagagttaaccaggtgttgccattgacgcgtaaaccagaggcgatcatatttgtctttaggtatgtgacgacctgcaacatacttaacgatagggtgattttctggcaacgtgtccagacgttcgcagaactgcaattcaggaatatatttcttttcttccttcggcggttcttcgtgcgtctgttttaaatctttacgatccttgaaagattccatcaaatacgccgtgtaatcatccgggtaatagtctttcagaaacacagaaaacggcttgctgtagttgcagttaaaacaaccacacatcatgtgtgtgcctcgttttgacgggaatatccagaaacgttttttgtgcttatccttcatggagtcgccacaaatcggacaacgggaatggatactgaattccccaccccgtcgaacgatttcgctttgtggtaatgatcccatgatacgagttgcgaactctatatcaagatacatgtttacctctatcggctaacttctttctctgtgccgtctaaagtgattttccattcatagaatatcttataaaacggataaggtctaggaatatcgacacccgatgatgtttttctttcgttcgtgtacacgatcgctgtgtcgctcatgtacttgatacggataggaaaccaggtgtaattgttcgcagtaacccagatccgataattcagaggcggtaatggtttcattcttcactcttcatgattttacgtttgcgtttatgcggacgcgtagaacccagaaccttcggccctttgttcgtgatcgcgcctgtagtcacacccgaagcaatattatccacgcttccgcctgaatcacctgcaaccatttcttcgttgagtctttcgcgaagttctgggaggttcatcatgatctcttcgtgctcttgctcggtcaggttccagcggttccgtaacgagtcatacgcgctcgtaaggttcatgaacccagacatataaggaaccgcgtttaaacggcgcttgatgtgtctcacagagcgatggaatggggaatatgcttccagttcttccttcgtcttcgggttcttgattacttccccttgaccgtcgatgatacccagcttgtaagccgtccattcagtccagggctttttcagtaggcgaatcattcgcacactgtaggttaaatccatgtttttgattaattgatcgctcatagtctttactctattgtgaaagtgaaaaggttttgcgcgggtttggtttctggttcagggaattccatacagacaacttcacacatcggtttcacgcctttccattcttccagataatatccggtatcaatgccgcaacctggttgcatttcaaggccagtttcatcaagaaactttttgcatttcgatgttgtcgttgattcgtcctgttggaaatatcgttctccagagtaacgaaaattcgcggacatctgcgggagaatgaacgtacccgcacgggcaatctgtgaagcacgttcaatcactttatattcaaattccgcgcccgtatacttacccttaaaatcggatgtctttatcttgccgaaaggtggattgctgatcgccatatcaaacagagtatcaaactccgtcgttaacgcgtctgcgttaatccaggtcgcttccggtacgatacgcttacccaacttatagtatgtatggtttaactcaacacagacgatttcacgcggtttggcgtacatcatcatatgaagcatcgcgaaggatagcccaccgatacccgcgcacaggtcaacaacgcttccactggtacaagcatcaatggtgaaatcgcgagcaagtccgatcggggtaaagaatgcacccagttcagagttattcgtaaatgcaccttcatggaagttttcgataatgaataatttttcgtcgtaggttagcgccttgtcagactccaccagatccattatcttgttgtgttgtttggtttccgctttcgttaacttcgccattgaccttttccggtaataagaacagaggggtagattctaccacatcaaagccccagtcatcaacaatattgctttcccagtcgcgggtttcccacgggctacaaatccacttatacaccccagcaggatcttcaacctgttcaggcatacccagcatttccgcattgataccttcgtccaggtagccaggatgaatattaggccagcgcatgatatcgacatagcctttatcgtcaaccgatacgatccattctgaacgatacgggctttcgaactcctgttcttcgtctggaagaatcatatctaataaatcactcatttcactaaaccttctttaacgccctctttcatggctttcagaacaccgataaaagcgtctttgccaccgatagcgccgatgataagcatcaggacaccaacacaacccgctaaaccgattctgaacaggttccaggcaaacgggatagccagaagcactaaccacgggaacggaaagcccataagtgcgtttagaaccagtaagataaaagcgattgcgagtttcatgatgtcctcctttgtttgtttagaataaggtatcacctttcgagaaggattgcaatacctacagatacaaaaaagcccctttcggggcttaatttttatgctttgttgattaaataccgaagaacgtttttggcctgaacttcgttacagcagagtttgaattctgggtcgattgggaggaagccccagaggaaatcaacactaccttcaacatctactttcccacttttcagcatttcaaccagtaaacctctgtttactacgctgttcactactgcatcgaaataacccgcgctgaaatccagttctgggttcatcacttcgtcgtatgggttgttcagtacgttcatttggtatctcctaatcagtttttgttgtctacgggagtcatattatcacaatcataactcccgtcaacccctaatcaggattattttgcgttttttgcaatccagagagtcagtttagggaatacgtttgccattgccaccacaaacagcacccagaaagccagcttaatcacaccgatcacgattagaggtgcaaacacaagccaccatgaagcatttgccataaccccgattgctgccagtttcagagacaggaggatcaggaatacaataacgagaatctttttcatttcactatacctttgattggggccgaagccccgttaaaattgaatgtctgtactatttgcaatttcggctaacttattgcttcggttagtctcagcttgttttaccatagcaccttgtgcttcttcaacagttttcggcatctgacgacctttataatcagatttgaacccgatatcgctgttgtcggtatccatccagcgttgattacccttacgcacttcgagtttgaagtggttaaagtggttcttatcgccgtaacgggatttgatctgcttgaacaactgcaagccctgatcagctaactcgtcggtctcaatcacagctaacataaagtcagcagtagccggaagaccagcagattcggcaacgtcgcccatgctgatatcagaagcatcccacgcggcgcgggtagtctgcgcaccagtccacattacggtatttgtttcaacagccaaaccgcgaagttcttcggcaatcgctttaaccaggatgtatgtgttttccgccccgcgtacacgggtagaagcacagatccccaggtagtcaacaataatcacatcaggtacgaaacccttcttcaatttaagctctttaatcagcgctttgaagtggttagcgttcgcccctgctgttgggtattgcttaacgattaaacgcccgaccttcgactgtttgaggcgttccatacggttcttatagtccgcataggtgatgttcccgttgtcgatatcgtccagtggcacatcaagcaggttagcgtcaatacgtttagaacaaacgtgttcagccatttccatactgatatacaggacgtttttacctgattgcaggtaatcagcagcgagagaacaaagccccagagatttaccaacgttaacaccagccattaagatgttcaatgttccacgttctgcgccgcctttggtaatggcgttcaggatcgggatattgaaagcaatcttcatcgctttggactggtaaagcatccagcgtttttcatagtcttcgaagtaatcatgaccgaccgaactatcgaagctaatcgctaacgcttccgtcatgatgtcagggattgccccaacgtcagggattttgttgttgcgttcgccagcaggtttttcagcattcgcctggatctcaattgcacgggacagagcgcgatacattgccttgtcacgacaataggtttccgtttctttcatcaaccattccagatcttccggcgcatttttcatgctgcggatcatctttttggtatcttcgtagactacatcactcaggctctttttgtccagagctacttctaaagcagtttgtgaaggaatgctgttgaattcctgtacgtgcttatccatcaaatcaaagagaatctgcgcgttcccttcgaaatattcacggcgtaaatggggccacgcctgaacaaaatacgtaccattaaaaaccagatttgaaaatattgtttcgacgatcattattacctcttaaaccagattagcgaacatctgaaagaaattatacagctttactttcaacgccgcccataaggtcttttcaggctttgggagattgggcttgatctgcgcgtagattgcatcgtgaaccagcggaatcagtttttctttgtcttcgtccggcgtactaaattcgactttcaggccgttatcccaatacaccttatggatgtacactaagtgtgcaacatcgttttcatcgttgatcaacagttcttgaataacgtcctgcattgcttcatcaagaatgttttttgttttttgttcaatgtccatgattcacctattaaaagggggcaaagcccccagttgtttattactcttctgacatatccacatcatcagggatatcgtcatcgagatcaaatttatttgacggttctactacatcgtcggaataaagatcttcgagtgctgccccgtcagtgatctctttgtcaggaatacggtacttatcctgaatggcatcaaggaatggctggtgagtgaacagaggtttccagaactcgatcgagttggtttccgattcacgccatttcttttcttccagttcaagttcgcccgtttccgtgttcaggaacgcacgaccgcgccagcctttcgttggagtctgaacgaagttcatttccatagccagatccagaagaccagagaacatactgataccgccctcataggtaacatgaagcgggaatttggatttctctttcacgaagcgagatttctcgatattcatgatgaagtcataaccgacaacttccgtaccttctttcacctgctgtttgcccaggatgatcgcggtatctgcggaatacatcagaccagtaccaccggaaatgactttcttactgtacatttcttgtgtgtcgtatgtgtgacagatacacaccattggaatatccagatccgccaggtaaggcgtaaccatacggaacatacctttaagtgctttagcgcgggtcatgtcctgtttgtcgttgtcagacagggcatcagccagttcttttttactcgcggtgttgcctacagagtccacgaaaatgatcactttgtcgccacgttccagcgcgttaagctggctcacaacgtcatttcgaagttgctcaactgtcgtgatacgagtatacaccacacgatcggggtcaacgcccattgatttcaggtaagacttagttacgcctttctctgaatcgtagaacagacacacagcatcctcattcgctttgaggtacgccgcaaccgtcaccagccccagattcgatttaaagtgttttgacggaccagcaaacagagttaagccggaagtcagaccaccatcgaaagcgccggacagcgccaggttcaggatcggtacacgggttcgagttttggtgatgttattgaaaacatcgctttcagacagaattgacgcagattgactattcgagtttttgatcagttttttcaggagtgctttattagacatttatttttccggtttatatacacgcataatatcttcctcacaaatttatataaatggggcatttctgccccgtcaggtcttaccagtcatcaccaaacagagtgttcagggatgcgcgtttttcgtaatcaattttacatgcttccgtgatgttttgcaacggactaatcacatgtttttcaaacaatccgccgtagtctacccacttcaaaatatcttcttcgatctcagttggtaaacgtgtaccggattgccatgcgatgcaatcagcttgccacgggtttttatctcgcaacggcagaaccatcaccttttcaccttccatgatcggggtgattccttgaatacccttcgtatggcggttaaagaacagaacgcctttgatgtggtttggtgtccctttgattgggaagccagcaccatcattatattttgagatattattagcagatgatacaccagctatttcgcggtagtcaagcgccttatactcttcttcaaatactttgaagtgttcgtgtaaggattcttcaccttcttgcaggatgcgacggatcgcttctttcaagaactttttaaccgctgtcggtgtactacttcgctgggtttccattcccatgatctttaatttaggtttctcgtagcgggttccttcggagtcccatacgttagccgcatatcgtttcttagccgtccagaaactacccagacctttcgatcccagaggtggtccagaaatgatttcgcgatccataaacatcaggtgttcgacgttgttcatgtactcgcacagttcgcggtagcccttatcaatgataggttccatgcgttctttactgaacttatccaggaagtcaacccaatggttgttatccctgaacttattttcaccgccgactttcgcgatcacgttgtccatacaaacataaatggagtcggtgtcacagtaacgcacgtatgcgtaatccgtggtgttgcacagttcgttaaggtattcgttaaccttacgctcaatccactgaatagccaactgcccgaacatggtgatcgcactggcgtttcgaatatcgaagtaacggaaatgttcgttacccaacgcaccataaagggagttgatactgattttacggttaagctgtgcggtgttcgcctgtgcgattttcttctcacacactttcttcacggctttaagcatttgcttagacagcgttttcagtacagcttttgattcatcaccgaaatcttcgtagaactcgaaatcagggttgatcatttggttgtgcgcgtctgtcaggtgttcgagttcgtgcttaatcagttcgagatttcgctcacccgccatcattcgttttttccacgtcttacgctgatcaaatactttcttgatctcgaccggaatcacgcctttaacatcgcgtcggaacatccacccgttaggagagcagctaaattcgtcgctaggacgcggcgcagtcttattgatgtattcatgcatcggacgcactgcaaagctgttagcgattgtctcagggcttatattcacctgtcggatgatagatggatacagactggtcaagtcgaacgatacaatgtaacggtatggagcgacaacaggatctttaacgtatgcaccatcatacggcgttttagtatggcgtttgttttctgggattactttcttctcttcacgcagagagttgtaaatgattgcgtcccacgttttaagcggtgacataaccccagggaaattgattttcgcgtagtatgctacagacagaaccagttcgataaagttgcgtttaccgtcgatatccaacacgcggataacgtcaacgatgttatacgtgatgtatttctggtgatccgcttgacgcagttcagacagcgaaccttcgtaatcaactttgcttttacctgtttcgaactcagcgatcgcgcccagagcgtaagttggttgcggggtgaaactgaatttcttatagagatccattccatccatttgagcaacgccgtaaatctcatagcccagttgttcgttcccgtaatggtcggttgttgtcttcgcagtcactttcccgaacgggctgaaatgacgaacaacgttttgcccgaagatattcaggtaacgggtgatgatatacgcgatatcgaacttgtttgagttccatcccgtaacaataacaggtgtccgctctttccagtctttgatataagccgacatcagcgacttttcggtctggaatgaacggtaaacaattttcttcaagtcttcttcgctgatctcgttttcggtatcaacttttgacgctacccattcatctaaaccaccctcgacaagatcgtacacaaagaatttatcttcaacgctgtcatagtgggtgattgcgtcgatagcgtattttgcttcgcgtggatcagggaattcaggcgcggtaacttcgatatcaagtgaagcaatgcggatcttgtcgcgatcgtattcgatttcctttctgtaggaatcggagatatacgccagcctgaaatcatccatgcctagcgcttccatgcctacatctttcattcgctgcatccagttttttgcttccttgatgctttcgaagttctttttgatgcaggtcttgccgtaaatgtcgcgatatggcgagtctacacccgccatagcgtgttgaaacattgtaggcgcatattttgttttgcgaacctgttcgcgtccctcagagtcaatgaagcgctcgtagatgtgatcgcccatttgctcaacggatagataaaattcattcattacggttttctttctccgtgtttaatcgtgacaggaatgataccccagccagcttgatcagatcaagcgagcgttgcgctaatttgtgatagcgttgggtgtcaggccgatttagttgttcaaccagcacggtatattcttccatgatgcgggtatagaacttagggaagtgatcccgcgcgtatgcgtaggtgcgcagatcagagagattgcaagtaagagacagtttgatgtcttcgctatgcagacggttgatcaagtgatcaccggattcaatagctttgatgatttcttcaatacgaattttcataatttagtcctcacaagtggtgtacaaccaatataacaaagcccctgcatttctgcaagggcttttgattaatgtccgatccggtacttgtatttcaaagtccattcagctttttgtgcgtgagtcaatacgcggaagttgttctcttcggagaatttcagatccggcgtaaggatggaaaccataccccactcttccagaagtcgcgcaatgttattgcggcgcagttcgtcatcttcggtcatgtcaacctggcgaccgtccagcttcaacagttctttgaagtgtacgataaaataacgcccttgtttctgtaggatgtggcaagactgccacagcattttctttttgttatttgcgatcccgatacgggtcagcgtttcgcgaattttcaggaaactgtcatcgctggacagtttaatttcgagcatgttcatacatcaccatttctttattagttgttcaacctttttctggtcggttttatttttcacaacatcagccaacacagataaagcaactttcatatttttccgcttccactcgtccagtttttcaagctgtttgagttcttcgtaatattccattgctatacgtgtatttacaccgtatcgtttttggagaacatgaaggataactttcatttcgttatcttcggtgagtttagcccacgccccgaaccgcttacctttgcgcaccgtatgcaggtaataatcaaagtgcgcctggtctggtaaaccggaaccgatcatattcatcgtgtatgcaggtatcagcgtttcgatatgctggctcatcgcattgtcgatgaaaaacttatcgtatgaatcaagggcagagatccgtaatggtgtcttcccgttgttcagttcttcgagcaccataaacaaggtgttttccttgtctttggtgtactctttcacaagttcttcgatcttgtcccagtctttagaacgccaggccgcttcatgttcgttcagttcttcttcatcgagaaaagcagccagtgacattttaagcctcccacgcgagggtaagcattaagcccatgaacaggtattgcaggtgaatctctttgttcactgccagcccgtactgtgcgttgttttcgcctactgcctgaatgagtgcaaccttagattcgttggtgacgatcgggtataccgcatccagaagtttagccaggaaagtttcatactcaggcgcgtacttgattgcttcggctcgcagtgctttgaagttcttcgctttaagcccctcaatcactggtgtgatgtccgaaccaacaatctcagacagaataccagcatcaattttgccacgcttagaatagaacccaagagctttaacgatggatcgcgcgtctgggtagtgcttcttaacgaatccggcgatcacctgctggtcatattcgattttctcgatttcgaggataccgaaacaacgtttgatcatttgcttcatcagttcaacgcgttcttccttcgacggggaaccgaacttgactaccggacaacgggagatcagcgcagggtgaatcccgttgatgttgttcgcggtgatgataacagtaacgttcttgctgtacgcttcgataaagctacgcatgtgcttctgtgcttctgccatgccagggcgatcgaattcgtcaatcagaatgattttaccgcctttcttctgcgtcatagaggacgcgtaacgatccagttcgttacggatgaagttcacaccacaatcggaaccgttgacaaacatcacttccgcatcaacttcgttagccagaaccagcgccagcgttgttttacccgtacctggggaatcagaaaccagagtcatgttgtcgatgcgtccagacttgatgaagccgcgcatcgtcgctttatcagcagcagggagaatgcattcatcgatcgtcgtcgggcgatagcgctgatcccatgcgaattcttcgggagactgggagattttgccgtatttggtttcgattaactgtacgttttcactaagttccataatattaccttcaattgattatcaaaaaggggcttaacgccccttgtgtactactttgtttatcttacttgaactggctggttgcttcaagtaccactacatacgcaacgccgttttcggacgagaatttcgcagcgccgcgagaagagatttcaactttgtaatcgctgttgatgaactgcatgttgtcaatcttcatatcgaagttgaacatgttatcaccttcgtaatcgcccacttctacagagaaggttgactggctttctttacttttcgcggtgattaccagcttaccgttgattggctcaacagacaggtcggtcagtttcatcatgcgtgacgctttgatcagtttttcgaaatcgttcgcgctaatctggaaaatcagatccgcaactggcatttccagacgcttcttaggctgtacgattgtggttggatcgcttgaacgctcaacgattttcattttctcaccacgaatgacgatttcgccagtggacagatcgtgagttacttcggcatcagtgcctacaacgttcagcatgttcaggaatgagttcagatcgtagatacctacatcttcgtcaattacgtcagaaatcgttgcttctgcgtaaactacgctgttaatggatttcgtcataatgaacgaaccctttttcagcattacagatgggttgatctgggagaagtttttcaggatgtcgatcgtttgtttagagaatttcatattcaacctatagttttcaattaggcaaaagtgccgttaatcagggattctacaacgcgatccgccgcattgtcaaggaattctttgcttttggattctgtgattttcgtacccgcttcgcgagcgtcgtgaatcagtccggtatgtactgcgcttactgcttcgtcgatccgtttgtaatgctcaaagcgttcagcttgaggcatcgcacggaaaatctctttgatgttttccggcactttacctacccaggatttgcgaacgttgttcagatgcgctacatatacgttttgttctaaattcatatctacctcaaactttcaaaattgggggctttcgcccccgtaagcattacagatccagcagtttatccaggtcgtcatcaccggaaccaccttccaggtcaaacggaggtgtattatcatcttccggtacgcttccgcctacgttcagttgacttacgccaccagattctttagcaccgttggaatggttgccattatcgaagtttttcagttcgttgtcaaatgagttcagttctgaatccagatccacaccagcgcttgcgccagcacccattgcagcaccaccgaatactttggtgaacttcgcggtcagttccgcagttggtttgaactggtctggagcagtgattggacgcagatcgctcataccttcgaagatttctttctgacgcgcttcgtcttcgatgcctttgattgggccaggaacaccaaatttgctgtcgtcgtagttaggccagtcgcctactttcttcgcggtcagggtgaagttagcgccaccaaacggacaggttacagcaacacctggttcatccagatctgggttccccgcgatagccgcagtgattttatccatgatctttttaccgaagcggaacttaaacaccttaccttcgttttctgggtgcattggatctttaaccaccagaatgttcgcccagaacgattgtttacgtccgatcatacccagtgttttttcggcttcgctgcctttcactttcgctttttcgaacagatcgttttcagagatatactgacacacagggcaagcatcgtaatcgccgtgggtagacgggcagttttcgatgaaccactggttattctttttgaatgaatggttgacgatacgcacgaacgccagttcatcatcagatcggttaggcaggaagcggatcaccgcagaaccgtttttctgtgcatcgacaccgagtttccactctttttcatctttctggaagccggatgaacctttcagagcggcgacttgttcttgcagtttggttggatcttgacgtttaaagaatgacatatgttatttctcgtttaagttaattaaggtttgtttcattaagtttcggtattttacgatttcttcgttactgatttcaactaattttctgtatgcgtttagttttttgctaaattcattccagacgaaatccgttgcgatttcatcgtgtttatttatgatgtctaaaaacgagtcgaggatcaagaatgattcataagaaatcaccccagaaagtacgagcttgctgatatacgaggttgatgatttgacgctatactgaaacaccgttgagaggggaatacctttcatgcgggaaaattcatacaggttttttacatcgtccacgaaaatattatcaattcgcctcaacttgcctatgtattgacgataaaacacgatcgtatcttcgtctacatccccgacccagaagtcggggttagctaccatgttggagagaagtataagatatatttctttgaatgtaaacctttcggctaactttttgaaaaaatacttatctcttctcttttcgaacgctttttcagtgatctttatttcccatttgtacttgatcgcgtcatacttcccagcaaagtgatttttcatcaccagatacagtttgtataccgcgatcggtttcaaacgggaattagcgtctgaactgtcaaacggggttttaaatttcacatgaaatcatccagtgtttgcgtcgtcgcgtggtctttagccacagaaggacgcagcagattgtttttaatggcttcgtcgctaatcttgtcgatgatcgctttcggtactgttttggacagcatagcataatcaatgctgttttcgtccatccattgtaacgtagcttccatgtaggttgccccctcagaggcaaccagattttcgatatacaagccgacttcggttttgtttccgatttcgctcatattacgccttatcgatcacatcgtacagttcgataagttcgttgttctgttcttcgaacgcggtacgtgcctgttcgtgatacagtttgaacagcttgccgaaggttttaccgtcgataccataatccgttttcgctttggatttgatgtctttgaaagaaccctggaagtgttcgatctgggttttcacgttcgacgcttctttgatcagttctttaaccgctttagcgatgtctgggttttcttgcagtaattctacactcattttgttacctcaaaagtcacttagtttttcatacatacgggtaagtttgcattccatgaagtatttctccatttttgctttgttcccgatttttggagcattgtacgcttcttcgattgccgttgcaacatctttcggaataaaatcaaagtcgcgaagttcttcgttttctctgtaacggatcgcccactcttcgggcatacccacggtcggatcgtcagcttccagccaggcttcgagttcagcagccctgatttgtggggcgcgttctccttcaaccttcgtaacaatatagtcatttcgcattttaatgcaagcgatactatcttttttatcgcccttgatgatcttcatgcgcaaatcgttacgaggtgaaccatatttcggtgtaacccatttcttttgggttggcgaccactgacgcacaccctgatatttttgaagggctgcaaagtcaccatcagcagaaacgatcaggacacgtttaccttcggataccgctttacgcgtcaccacaccgatcacgtcatcggcttctgcgaagtcaacacggatacctttgtacggtaaattagcacggatttcatcgtatgtcgggtgaaggaaaccattcaggcgatcccagtcccaatccgatgcttcttgttccatttttcgtttctttttgtagtaccaggctttacttctgcgccaatacttgttatcatcaaaggctagaacaatttcagggtactcgcctttgaatttaaccacattgtgacgaatggtgtcaagcactatgtgacgaacaatttgttggttgatgtcattctggtctttcggcttgaagttgttcatcaacgttgctaccgaaaggtttgaaatatctatacacatcacatcaacaggatcatcgtcattgctcattaagctgttcaggttgaacatacttgcaaatgaagacatttcaatacctcgttgttgttgaatgaaactgattatagtgatcactttttcaaagtcaatagatcatttcaaaaatctgagcgaagcgaaggacacgaacgtagtgagtgtctatgtactgaatgtacgttttaatatttttatattttatatatagagaaaacagtacatttccgtatactttttaaccagtttaactatccgtttcgcttcgctcacggaagcgcttcgcgctgattttattaaataatatagattggaagtaggtttgaaacacctgattcaatcggctataatgaatgtattcaatttggagaatataatgactacaaagatttatgcagataatgataagctgtatccagttatgtgtaagtggaaacagcaaatccgtgaaactggtgatcgtaagatgccggatgaactcggtattgcgattatgaacattgctcacggtttggcacgtcgatacaacttcaaccgttattccgaagactggaaaatggatatgatcgatgatggaatttcggcaacgatttccggccttcataactttgacgaaaccaaatatacaaacgtctacggttacatcaacaaggcttgctggcaagcgtttgtaactcgtattctctacgagaagaaagagaacgcgaagaaatacaaatacttcctggaacatgtctatgacagcgatgatactgatatgaccacgatagccgatgaaactttcattcaggatatccatgacaaacttaatcagtatgaagagtccgcgaaaaaacccaaagataaaatcgaggttgtggacgaatcgccaacattggaaatgtttctatgaaaattaaaattgacctgaacaaaattttagcagatgctaacgacgaaattgatctgcttccttaccttgtgaaattagagttgcagagcttagggattccgattatcatcgaccctacagatgtacgagatccagacttccagataacagaaggtcgtctggactatgtaataaacgccgaaacaatgatcatggagatcacttactatgaacgtgcagcatgaagtaatcgacgaagtacaccaaaaatcagcgctggatcttcgtgaagaagaactggactccatcaagggtacacgcattgaacaggaagccctacgcaaagcgcaaaagttcatgcggaagaacaaagcggaatggaagcgactgcataaacacgcagagaacgcactcttcgaaggtaacaaagagcagtacgtatacgcgatcaaaaagatgcgtgatatgctcaagcaaccatacaacgatgaactgattgaaacgatgtggatcacttcgaaccagcagttgaaagacctgttcatcatggcttctgaaaaatacggcaaataaaccccttcgggggttttgaggtttatatgaactatgttttaattggggatacccatgccggacttcgccaggataacccctggaacgaagaaaacctgtatgcggtattcaaacagatcgtagagtattgcaaagaacacgggatcacgcgcggcttccatgctggcgacttcttcgacgttcgaaaagcaaccacacaaacgacaatgaattttgttcgtgaaaagctggttcctcttctgattgaggcggggatcactctggatgttcttgtcggcaaccacgattgccaatttaaggacaaaatacgccccaacgcgccacgcgagatactaagtcaatacgaatgctttaatgtcatcgacgaaccgaccacggttgatttaggtggcggaaattcgattgacctgatcccgtggatttgtcaggaaaacagccagcgtatttttgactacatcaaacaatcgaaagctaacttttgtttgggacacttcgaactgtctggttactatttctacaagaacagcaaagccgatcatgggctggaacctgatttcttgaagaagtacgatcgtgtttactctggacactatcaccacgctaacgagggtgataacgtgttttatatcggtacgcctctgactatgagcgcaaacgacgaagacgaaacacgcggattctatgtgttcacgggcaagcctgaattgactttcatcgctaaccctgtgtgtcaccatcgccggatcatgtatccagcacagaaagatgttgatctcgaacagttccgcaactgtgcggtgcgtcttattgttagcgaaattgatcaggggcttgcaaagttccaaaccaaaattgaagaaattgcctatgaaatcaacatcatagacaaagttcaaacagattcggatgtcgataccgactttgaaatcaaaaccgttcgtggccttatcactgagtatatcgccaacatgcagatcaccgacgatgaaaaagaggaagtgaataagctgatcagcgaactatacgcggaggtgtcaagtgcatagccgttatgatgaatatttcggggcgaatccccgatattctcacctgttgcgtatgttgggaatgaaacacatcatttccacatccgacgaagcaggggaaaccagcgcagtttgtttgaccatcatgaagggtgcatggcattcatcacgaacatggtcaatattcatgcttgatacactggacgacgatactctatcatatagtattgattcatcagttgttcaaatgatcactgaattatgtgaacggattttaaatgaaactaaacttcaaaaaaattaagtatcaaaatattctgtcggtcgggaacaccccgatcgaactggaatttgatacagcaaagaaaaccctgatcacggggaaaaacggtggcggtaaatcgacactgatcgaggctttaacctatgccctgttcggtaagtcattccgcgatctaaaagtcgggcagttggtgaacagcgtcaacaaaaagaaatgcctggttgaactggaaattgaatacgggaaagactcgtacaaagttgtgcgcggacaaaagccgaaggtgttcgagatctggaagaacggcgagaagttgccggaagactccgcagcaggtgattatcaggcacagcttgaatctatgctgaacatcaaccttgtgggcttcaaacaggttatcgttcttggtacagcgggctacactccattcatggaactgaaaacccccgaacgccggaaactggttgaagatttgctgtctctgtccgtcatcagtgaaatggacaagttaaacaagtcatacattcgcggtgttaatcagcagttggatacactctcaatgcagggtaatcacatccagcagcagatcgcaacacaccagcgcttcattgacgaacagcgagcgaaagcaaaccagaacaacgcccgatacaaagagatctacgatagccacgtagaaaccgcaaagaacatcaaagcacagcttatgcagttgcaagcggagattgcggaatcggtgatcactggagaagaccggacggaagatatcaacaaactccgtgacggttattcgcggctctcaatgactgtagaacagtttaaaaagctggaggtgatgtatcagaaaggcggtgagtgtccggcctgtaagcaagcgattaaacccactcctgagcgtatggcggagatcgcagagaacatcaaagcgggtacacaacgtttaaccctgatcaaaaccaaacaggacgagttacaagggatcatgaatgacttgctgcaacagcaacgcgcactcaatgccctgaaaaccaaatatgaagccctgaaaggtactctgcaaaacgaagttgccaacgctaaacgcgcacaggcgatcatggaacaggcaagcgcggaagtagtcattgatgaagaacccgtgaagcagttgcaacagcaggaagcagaactgaacgaaaaacgacaaggctacgtcaaggaaaaatatattcgtggtattgttacggatatgttgaaagattccggcgttaaagcgagcatcgttaagcgttatattccgtacttcaacaaacagatagcatattatctggatctgttgggtgctgattatcagttcactttagatgacgagttcaacgaatcgatcaaatcactggggcgcgatgatttcagttatgcgtcattcagtcaaggcgaacgcgctcgcatcaacttgtctattctgttcacatggcgtgacgtgacaagtaaagtatcaggcgtggatctgtctctgctggtacttgatgaagtgtttgatggaccacttgataaagagggttcattcgcgattaaatccctgctggattctgtagatggtaacgttattgtaatcagtcaccaggatcttgatccgcaggacttcgaccgccacatcatcatgtctaaggttggacggttcacaaaaccatcaatcaaagatatggcgatctcatgttagaacgtgaatttgatttaaagacctctcccgaagtggagaggttttatctccataatgaactattggaagaaaaacatgtagttacaatggcagatgttgaggaagcattcaaagataaccccattgaattgacccgcatcaagaataataaatcttcggtgtggttcctcgaaaaaatctattgacagtaaaacataaataccttaaagtcgcccgtgtactgagttgcacgggtttttattttgaggaacggaaaatgattaacgaacaaatgtcacacagcgaagcattgaagattttgggcgctactggcgacgaatctaaagctgaactgtcaaagctctttaaacgtgcttctctgcgcaatcaccccgaccgtggtggtagcactgaactcatgcagaaaatcaaccaggcgtatgacgttgtaaccaaaacaaacagcgctggtaaaactttcagtgatgttcgcgcagaacacgcagcaaacaagaaagcgtgggaagaaaaatttgcagcgtatttcgtgctggcgaaaaactatttcagcactaaattcaacgcgcaagaatttgcggaatatttcacgaaattcaccggacaaccaacaacctatacccagacaatcagcgaagttcgcggtcatactgttcacgcaacctatcgtttcacttctggtgatgcgttctttgacttctctttctcttgtcaaccgcctaacggtcaaggtttagcagcgccggacgcgtccgcactgggtagcgtatcagttaatactctggttctggttggtacgaagaaacacaaaatggcaagccgtgattaccaatggggcaagaacccagacaaaatcacgccggaaagcctgttccctactaagaaactggaatccatctttagcccgactaagaaggatctcaagttcaaacgcgcggactacatgacatcctttgcccgtatcctgggtgcgaaggttagcggtaacgatgttattgttgatgttggacactataaagttcacttctaccgtcacgtattcatgcgtaaaggcgcgtatgtgttccagtatgttgttgacccaactgtgaacaaattcaaacctgctgaacgtctgaaaggtactatgctggaagatgaagacggtgcatgtctggatatgatcatcgacactttcaaagaaatgcagaaagtaaaaccagacgcaagcggcatcgcagcggtaatcgaccggatgaacgcagagtttgcagcggggcatcgttcagcatcttttgttaaacgtaccgcacagcaagcagcagcgccagcgccggaagagaaaccaaaacgcaccgttaatcgcatcaataaagatgactatttcaacgcactgaaacaagcgggggcaacattccgcagtaactacggtgagtttgataacggcgcgggtttgactttccacttcaaacgcgagatcagcaaccgtaaaggtttctggagtttcagcagctttgatttcatgcactccggtcagaaacatgttgaatggttgaaagatatcgacattgacgaggatagcaaaggcgcaagtatcggtttgctggttgataccctgaaacaacttcgtggtgttgctgactggtacacagcccgtaagatcctggaaggtatgcgtgataacttcaaggctggtaaattctcagcacctcatgtgaagaaagaagccgaacagaaacgcactgaaacgcaagctaaggacgagttaggcgcacagcctacgaaaccacaggcagcgaagaaagaagccccagcggttgataaggcgcatcaggcacagatggatcgtgagaagtcacagatgaatgcaaccattcgttctatgctctctgccctggttaaagccggacgcaaagacacgccggaagaaattaaaaaagcagttgatgaagcaatcgctctttggcgcttgaaacactaactgattatgctataatgggaactgttgaaaagcagttccctttttttatgaggtgagtatgattattcaggtatcggttcagggcaacaccctgacagtaacaaattccattatgaccgctatggctgcatgtcgtgatcatgtgatgtcaaaccctccggtaacggaaattctggaaattgatgtatgggaagacggtgtgatcgaagaatcatttggtttcactccgttagaggaagatttacgtaaaatggaacaatggctatggcaaactgtaccccaatgaaactaccaaaacacacaaccctgttaacccgcgaaaaacttcattctgttgaatggagtccgttagatgtgatggtgttcgatctggaatccaaaatcatcaacgctcatgttaacggtttgagtatcttttctgttgaatttgaaaagattcgcgggtacaatgaagcctgtaaagacaaattgcgcgtcatggttgaagctatgggctacatcgtgactattgaagacaacaaaatgtggatcgcgctatgagcaaagtaaaagcagttttcgccgttggtcatgatatgtacgaagtggactatgcgtttggttatgaacagggtttaccgtggggccactgcaaagaggatttgcagaacttcaaagaagaaaccgcaaatagcgtcctgatcatgggtgcgaacacttttacttctctgcctggtaaattgccagggcgagttcattgcgttctgtctgcatccggtcaacgtctggtaacaaagaacgggaataccgctgattatgtcatccacggtggcgggttgtctgctgcaatcgacgtaatgaaagaaacgcatccagatcgtgatgtgtgtctcattggtggtaagtggttgcttctgcaagcaatcaataatacaatggttgatgaagtggttgtgacgcacatttacggacatcatgtatataatgcaccagcttttaaacgtgatgtttcattcacggttcctgaattctgtgaagcggttctgaaatatgaactgactgatttcaaaattcagcagatcgaatcaaacgaacgcgtcagaaaaattatcgtcgatcgacatacgaaaaaggcataaaatgaaacaatatcttgatatcgtcaacaccgttctaacacacggtactgaatcaaccgatcgtactggtgttggtacactgcgcatcttcgggatgcaagcacgttggaacctcgcagaaggtttcccagctactaccagcaaacagctattcttcaaaccgtgtaagcatgaattacaatggttcctcgaaggttctaccaacgtggaaacactgcgtaaaatgacgtggggtgaagatagcgataagcggacgatctgggacgataactacgaaaatcaggctaaagcgctgggttatacgcatggttatctgggaccgatctacgggcatcaatggcgctcatttggtgcggaaggttcttattatggtgttgaccagattaagaaagtcatcgaacaactgaaaaccacaccagacgatcgcgggatcatcgtttctgcctggaacccgatggatctggatgatatggctttgcgtccgtgtcactgtttcttccagttcgtcgtaatcaacggtaaactgtctctacagtggtatcagcgttcagttgatgtcttcttagggttgccgttcaatatcgcctcctacgctctcctgacgcatattatcgcggatatttgcgggtatgaagtgggtgatctggtttggactggcggtgatgtccatatctacaaaaacgcagtagaacaagcgaaagagttgttgaagccggaacgcgcaccgcttccacttccgaccctttatatgccgaaggtaaatagcttacttgatttggatcaagaattctttgactccatccatttgaaagactataatcaccacggctcgctaaaagcagctatggcagtataaacaaagggggcgaaagcccctttcttaacaaggtaagataatgagtgatattaaaacagtagtgaagtcttctggcgtaagtcaaacgttcgaaaaagaaaaactgttcaaagtccttaattgggcgagtattggaagaaatattgatgttaacgcattccttgaaagtgtcgttgacctgcttcgtgatggtatgactaccaaacagatccaggctgtagcgatcaagtatgcagcggatcgaatctccgcaaaagaacctgactggcagtatgtagcggctaacctcgaaatgttcgcccttcgtaaaaccgtttacgggcagtttgacccgattccgttctacgaacacatcactaagctggttgaggctggaaaatacgataaagaaatcctgacaaaatggactccagcggagattgattatctggaatcgaaaatcaatcacgataaagattttgaattctcgtatgctggcgttcagcagttgatcgggaaatatctgttacaggatcgcacgtccggcgacatctacgaaacaccacagtacgcattcatgctgatcgcgatgtgtctgcatcaggacgaaaaacacgctgataaaatcagtcacgtaattgacttctataacgcaatttcggatcgtaaactgtcattacctacgcctattatggcgggtgtgcgtactcctacgcgtcagttctccagttgtgttgtaatcgaatccggtgattctctgggttctctgaacgctgttacgtccgcgatcgtgaagtatatctctcaacgtgcgggtatcggtgtcaacgccggacacattcgcgctatgggttcaaaaatccgtggtggtgaagcagtccatacaggcgttatcccgttctggaaacacattcagacggcggttaaatcctgttcacagggtggtgttcgtggtggtgcagcaaccctgtattatccgatctggcatcttgaagttgaaaacctgctggttctgaaaaataaccgtggcgttgaagaaaaccgtattcgtcaccttgactatggcgtacagcttaacgatttgatgtataagcgtttaatcaataacgattacatcaccctgttcagccctgacgttgcgaatgatcgcctctatgacgcattctatcaagcggatcagagtgagttcgaagaactgtataccagtctggaaaaagacccaacggtacgcaagaaacgtattaaagcggtagatctgttccagttgcttgttcaggaacgcgcacagaccggacgcaaatacattttcaacagtcatcacgtaaaccagcagggtagtttctctgttccggttcgtatgtcgaacctgtgctgtgaaatcgcgatcccaacttcaccgctggacgacgatgataaactggctggcgaaattggactgtgtacgcttatggcgatcgttctcgataatgccgatataagcgaattcccagcccttacacgcatcgcagtacgcgcactggataacttgctggattaccagaactaccctgttgcggcggctctgaaagccaaacagcgtcgttctctgggtgtgggtatcaccaactatgcatcatggctggcaagcaactattgcgactactccgaagcatacgccggaaacgttcatgagttgatggaagcgtttcaatttaacctgctggttgcctctatggaactcgcacaggaacgcggtgcatgtggactgttccacgaaacgaaatatgcacaagggctgttgcctattgactggtactgcaaaagcgttgatgaactggcatcacctgtgtataactgcgattgggaatggttgcgcggtgaaattaaaaaacacggcttgcgtaactcaacactttctgctttaatgccttgtgaaagtagctcgcaggtgagtaactcaaccaacgggattgaacctccgcgcggccctgtgagtgtgaaatcttcgaaagaaggttcattcaatcaggtagtaccaaaccagaataatcagattgacttctatgattatctctggacaatggcaaaacgtggaaacaaaggttatctgtcgcacgtagcggttatgcagaagtttgttgatcaggctatctctgcaaacaccaactatgatccggctaacttcccagatggtaaagtgaaatctgaaatcatccttgaagatctgctgtatgcaaactatttcggcatcaaaacgctgtactaccacaacacccgcgacggtgcaggtgaggaagaagcggaagattgcgaaggttgcaaaatttgattcaatgccccttcgggggctttttataaggtaaatccatgttaactgtaatgaacacaaacccagatcacaaacacttagaacagcctatgttctttggtgaggatacgggcgtagcacgatacgaagaacagaaacaccgtgtattcgaaaccctgactgaaaaacaactgtcattcttctggcgaccggaagaagtggatctgtctatcgaccgtatgcagtacgcgaaaatgccggaacacgaaaaaatcattttcgattcaaacctgcaatatcaaaccctgctggataccattcaggggcgcggcccgaacctggcgttcctccctatcgcttccgatgtctctatggaaacgtggatcgaaacatgggcgttcagtgaaacaatccatagccgcagctatacacatattcagcgcaacctacacatcgatccgtcgaaagagttcgataaaattctgcgcaacgaagcgatcatgaaacgttcggcttccatgacaaaatactacgatgacctgatcgcagaatgtcacgaactgaaaaacattgtgctcaaaatcgaaatgttaacgtcccacggatacccagacgaatcgatcgcagagtacgaaaagaaacgcaaagagcaaatgcgtaaatgcaaaatcgctctgtatctgtgtatgcacgctgtcaacgctctggaagcgatccgcttctatgtgtcgtttaccttcacgttcaactttgcggaacaaggtaagatggaaggtaacgcgaagatcatgcgtctgattgcccgtgatgaagcacttcatcagaaaggcactcaaagcaagatccgactctggcagatgggtaaagatgacccagaaatggcggaaatcgcttaccagtatgaagaagaagcgacaaagattttcctggaagtgtacgaacaggaaaaagaatgggctgaacacctgttctctatcggtgatgtagacggcgtatccctgaaaagtacgatcgcttatatcgaacacctgacagatcagcgtatgcgcgcggttggcttgcagtctccatttaaaccaacgccgaacccgtatccgtggatgaacaaatggttgaagtctgacaacgtacaggtagccccacaagaagtagaagtgagttcttacctggttggcaacctcaacaccgagatcagcgacgaagcctatgcaaaatggcgacaaaaatacgcttgattgtcgcgtcgtaaacaagtataaaggtagctgggatgtcgatattcagagaggtacgaaattcggcaatcccttctacaagggaacacgggctgaaaacataatgaagttcatcccgtatttccaaaacttgattcgaactggcgtgatcacaatcgacgaactgaaagcattggacgggaagcggttaggatgtacatgcaaacctctaccgtgccacggtgattatattgctcactgcgtcaatgtgttgaccggaaaggtgaataagttggatatataatggacgatgtaacatttggtgtaatatttcctttgcgtctgggttcagacaaaaggatagaccggagttttgttaaatgtggagaattccggcattgtgtgtattttattgaaatcgacggtcggatagtgtatgttggaaaatgtcgtgatttgtggaagcggttagacacataccgcaattcgaaatactggagggaagcaaaccccagtaatattttgaaaaccgcacgtctggaaatggcaatcaaaaaacgtaagcgtgtaaatcttatcgtgacaacacacgatgaagacacatatcatgattttgaaataaacatgatccgaaaaatcaatcctgaatggaacaaacagcactatgacaaagctaaccaaaaatcagaaaaccctctttgaccagttgatgaaactgtgtaacgaaagcgaatgcttctacttcattgatcaaaaaactgtgatgcaaaccaacgtgcgcatctttaactatcgcatggcgagctattccgactggttaaaacccggtgcgctggaatgtcgcggtatcatgtttgcgatggatggggatacccccgtaaaactcgtcagtcgccctatggagaagtttttcaactatgccgaggtaaaggcatgggaagcactgaaatcctctcctgtgacgattggtgaaaccgtagtggatgtgatgattaaggaagatggttccctgatctccaccttctgtgattccggctatctgggcgttaagtctaaagcatccgttcaatctgaacaggctatggacgctatgagcgtgatccagactaaccgcgcattgttcgatcgcctgaccgaactggttaacgatggtttcacagtcaacatggaatacgtcgcaccgacaaaccgtattgtaattggctatcaggaaccagcagtggtgatcctgaacatccgtaataacgacacgggcgaatatgtcgattatcaggatatcttcgcagatggtgtattacgtccgttcctggttgagcgcgagaaaatcgaaatcaccgatctggatgcgttcattaccgaagcctacacgaaagaaggtttcgagggttacgtgatcaaaactgataaaggttttgtgaaagcgaaaaccaactggtatgtaaaccttcaccgcacgaaggatagcatcaacaataacaaagatctgttcttaaatattgttgaaaataccgtcgatgacctgaaacaaatgttcctcgatgatatgtacgcactcaagaaaattgacgcattcgaaacgttattccttgatagtctcaatcgtctgactgcaaaagcattccaggcaatcgaagacacgaaaggcaaatcacgcaaagactacgcgatcgccctgagcgctgacttaacccctgacggtcgtattatcttcgggcctatgatgcgttatttcgatgataccgataagcaaaagctggttgataacatcgttgcattaatggcgaagaactacgaacagtttataccggaagaatataaatgacattaccagcctttccaaagttaacttctttggtgtggcctgtcattgtagccctgtctttggcagggcttttgtacatgacaatcacgctgaaaagtgaaaatgaccaattggctaaagatatcaaagagttacaggctgatatcaaaaaagtcaaagagacaaacaacaccaatacggtgatctatgtcgaacaaaaaggtaaggatcagcagttggtcaaggatgccggacgtaaagacctgctgttcaaaaaaccaggactgatcgaaatcaagatcaacaagtccttcgaagagtatatggcggagtacgacaaatgaaaattgcaacgttagcccttgttctgggcgttctgttggttgggtgtgcggagaagcccccagaaaagattttgcctacactccccgcgaaggtgaatccggtgaatgtgaaatggaaagtggttgcagaagtccgagagattgacggtaaaaaataccttgtcatgccttatgacggaaacccatacgttgccctttcatatcccgattcgttaatcttccgtagctggatgaatgacgttaagcgtcagaaagaccagacggataacattctgtgtaccgtgggataccctgagaaatgcaagtcaaaataatcaagtcatttttccgtgacataaccgaaggaaaggtttatgatgcgaagaaggacaaagaaggtctctggatcgaaaatgactggaaccgtgatatgtggctcaatctaacgaatgagcataacaaagaactgattgaatatgagattgtgaaatgaatctgtttattactgtaggcgtaccaggtagcgggaaaactacatgggcgaaagaaaaagcgcgtcaactggggaacactctgactgtttcccgtgacgatatccgcaaaaccctttactgtgctggcggtgatctcactggctatcgcttcaccgaagagaaagaactgtttgtttgccgtgtgcaagaagatacagttcgtaatgccctggcgagtgggaagaacgttatcgttcacaatacccatttacaccaaaaagatcatgatgtgtggcgagagatcgcgaaagagttcaatgctgatttccatatcgaatggattgatgccgatatcgtagaactcctgaaacgcaaccataaacgcggtgtgaatgctctacctgtttcccgtgtctgggcgatgttcgaacagtaccgtaaactccgtggctgggttccggctatgagctatgcagatccgagcaaaccgaaatgcgtcatcttcgacgttgacgggacattaaccaaagttggacaacgtagcccgtatgacttcacgaaggttatcaacgatccgcctaaccctcctgttcaagaactgttcaggatgtataaggccgctggttatgcctgtgttgttgtgtctgggcgtgagggtactgtacagtgcgcacatgataccgctgcaagcctgatcggatacgatgttgacctgagcgatggtatctacatgcgcgaagaaggtgatcatcgtcacgatattcacgtaaaagagcaaatacttgttgaaaagattctcgataagtattatcctgttcttgcagtggacgacagggatacaccagtcgggatgtggcgaatgaacggtatcccgtgtttccaggttgattacggcgacttctaaaaaacagttgacagtgagtgcgggtgtgataagatacccgcacaaacaaaggagaatattatggttattcgtgaaaatgaaaatgtgatggttgaactgggtgatcgtgttaaagttgagaatcctgttgaacttcaactgaaactcaaccagttaggccagcgcattgctgataaaattcctgctggttatacagtgaagattgtccgcgatggtcagttctccttccttctgggtattctgagtcaacgtaacatcgttgaacaacagttcgggattcagtggaatccggtaactaaattcgtaacatgggcggcagtattatgagtgacaaaatcagaaagatccatcaggcatggttctgtactgaaccaacgatgcttcgttatggttgtgtgtttgggttggttgataacgatcctcaacaggacattgcaacaagtccggttgttgaatacgcgattccggcgaacaaatcgtttgttgaagtggtgacacgttcaggtactacgtatcacatcgtcaaccctgataacgatttcatcaaagacattctgaaatatatggatgaccgttaatgaaattcaaagtaatgaatatgttgagagcaatcgatcggagtcaacgttctcaatgtatttcgaatcgtgtaggtgctattatcgcgataggtggtcgtgccgtcgcgtggggcgaaaataatacggttgaccttgattgtcgttgcaactcatgcaacaatcatatggtgaatgatgacggtaaactgaaagcggttgatcgtcctgaacattcagcatggtcaaacgataacgaaattcatgcagaaatgaaagcgctattgagtgcgcacacaagaggtgttatactcaaagacgcagcactttacacaactgcatcgccttgccctaactgcgcgaaacatatcgaatggtatgttgctagcggggcgattacatcggtgtattatctcgataaatacgatcgtggtaatgatgaatggatttcacgcttgcagaaatatggctgtgtcgtggaacaaattaaacgggaagagttagaatcgtttatcgacttttccaaagtagtgtttaacaacaatgagtaaagaaatgtctgaactgaaagtaaaagcatccggcgaatatgtgatcatcgaagctactgcgcgtccgcagggttccgaaatcaaatctgaatctggtatcgtggttggtgtacgccagcacggggaacaacctttttatggtaaagttgtttctgtaggcgtagacgttccaccagaagcggcagaacgaatcctgggtaaatatatcccactgccaagcgctcacatggcgaatgttcctgaccctgatctggttgcgggttacatttccgaaaaagaagcaaaagagaaggaaacaaaatacgtttccgcacattacaaagcaatccaggcaatctacgagatctaaaaatggctaaatctattcaagcaattatcgctgataccgtcagcaaatccaaaaagctgttcgacaaaggcgaaattctggaagccccagcgcgtattgacgtaatgacagcaatgatcattgatgcgcatcagggtaaacttaaatcccgtgccgatgaagtcatggcgtacatcgtccagttcgaagacgtatgtaagtacgcgaaagatgttgatccgctggttcgcgaaatctatcgcaaacagttctaaaaaaattcgcaggtgtagttcaattggtagaatatctggtttccatccagattgttgagggttcgagtcccttcacctgctccaattcgggtgcgtagcgcaatgccgttaaatggttcggaatatgcaaccatatcccacgggataggctctgttggtatccggtaataggttccccggaatgcggggtgaagtaaagaaacttccagcccactaaacaatgtgagatctatatgagaattcgtgaaaagacggtgtatgactctaagttaggcaaaacaatccatacgttcaaagagattacgccagcgcaattcaaagagcggtacggcatgacattcaacgaatggaaagcggggttatgtaaaaatgactaccgatataaattaaaattccgtgaatgttatgttgatgacgatccttatgcagcagatgtatgtggtgaaacagtaccaattatcgagaattcgcccgacgcactaatacaatcttgtatagacgcagcatatgaaatttaaaagagaaaaatatgaaaggtcttcaaaagctgtttgaattaaccccaaaaattcgcgaaatcgtcgctgcatcaactgaaaaagaaatcaacggtaaattgatgaaactgtttaccgaagaaatcccagatttcgataacgaataccgtaaagcgttcgatgcgtattctgttgatggtttctttgcatcaccgcaggtgaatagcaaacacgaatatcatcgacgattctttgactggtcgatcgtcaatatcgttcgtcgaactgatatcgaacctacgaaccatcagttgatctctatggattcttctgtattctttatccagtaccttatcactggtggatttaaagcagaaggtattccgttctgcaacgaagctctggaagaagaattcgcagaagcgtataagtatatcaaagcagttcgttaatcaacaggctatcttcggatagccttttttctggagaagcacatgcgctttttaaaatacgcaagctggcttgtactggttccccttgatattctttctggtgttctggctattctgctggctccttttgtggttccgttctacagtgaagaaaccggacacttacctaaagggttccgttggatggaaacattcgataacccgatcgatggtgatggtggacatatccggcgttgggctaacatccggtatcacttaggcgatctgggtgtgtatgcgcaacgtgtaggctggttgtggcgtaacaaggcgtacaacttcgcttatcacgtcttagggcgtgaagcacaatcagacttcgcctggaagggcaacccgaaaacagaaggtggttctgatccttcgcgtcacggttatctgttgatgtggaatgattcggcatgggggctttatgtcttcaaaccgtggcttaaagtcggaaaggttcagttctgcttacgcgtgtattgcgggtggaaactgaaacaggaagtaactgaccctaacgggctggatcgtgcaatgctggcgttccatatcaacccgttgcgttattatgtcgtagaaaggtaatacaatgaaagcatatcagattttagaaggtttacacactggcacaatctacctggaagaaggtaatgatgttcgtgtggtggtatccaaaaccctcgaaatggattcagtgatcggtaaagctcgcgttgctccattcgcaaaacgtgaagtcgatattgaatttcaacccactgttaaagtggaaggtggacaacacttaaacgtaaacgtgttgcgccgcgaaactctggaagatgctgtgaagcatccagaaaaatacccacagttaacgatccgtgtgtccggctatgcagttcgtttcaattcactgactcctgaacaacagcgcgacgttatcgcccgaacctttacagagagtatataatggcgattgaagacgtacagggctataagccccactcgaaagaaaagatcgacaaagtaaaccgcatcaaggccgcagaagttgccctgggcgaaatcttcaaagaactggatgaagagtattcaagtgattacgcggtatctgataccgattcattcactaccgaagaactcgatgcgatgcttgaacgtgtccatcaaatccaactggcgaaagaccgactgaaagaagcctctatgtgggcgtgtcgcgcggttttccagccagaagaaaagtattaaaaatcaagccgttgccgaaaggtagcggcttttttcgtttttatgcaaaataatgcttgcactgaatcgtgagtgtggtaaagtacacacatcgaaacgaaacagagaaaggaacgagaaaatgattaaattaaacccaatcgacgcagcaaaacatttcgtagtagttgataatggtgttgtggttgcagaagttaaggaaatcgctttctctgacccagacgcggaaatgaaaagaatgggctactcttaccggatcgagcacaaaaacggtgaagtagaatacgccgacgatatctctgacgttcaggcgaaattctaaaaagttgttgacctaatctgggggttgtgagaatatagccccatcgaaacgaaactgaggatgacattatgaaaacttacaacatgaaagaactggtttgcttcaacactcgtcgtgaagcccgtgcgtatgttctggctgctggtaaaaatacctctgctgtaatcgacctgggtactgataaagctgttggcgcacgttgggctgctgttgtggttatcgctgctcctgtgactcctgttaaaactctggttctgggtgcgcgtaaagccgaaactctgaaaaccagcacttgcaataacagaggtgttcataatgtcaccgtcatcaaaaaacgtagctttggtttgagggcttaacaatgagttccattaacacagaaaaagattttgtgatgtttgtcggggtacagactgtaaagaaagatatcttcggtaaactgtacctgtcgaacgacgatcgcaacccagcatcattcgaaaccgaagatgatgcatatatcgcgaagaacaccagcgataacgaagacattcgccagtatgcgcggatctataaccgtgaagtaacaacccgtctggagagagcgtgatgcgtgaaggtatcgaagtaagaacgtttcagttcgaaatgcgtcgtatcccagaagcatcaatgaatctcattcgagaacacaacgtgaaaatcgtagaaattgatgcatacgcgggtactgatctttataatgatgcgaagattgacagcattgatttagaccttgagggtgatattggggatctgaataagctggctattgcattgaatgcagaaaccaacaaatacgggtatacaatcaaatgaaatatattctcgaatatcatgagcatcaaattaccgaagcaatgatcgataagatgcgggtatataaccaaaacattaccagcatcaaaccgctatcagtgtgccgtgaatttgggggatactccttcgcgatgtacacaaattccgaagacgacgcaaccgcgtatctgaaaagtatcggtgcaatattcgacaaattcgaaaaagtatggaaggtaggtttctaatgaaaaagtattttattgaagcggcagatcgtatcgttcttgctctgttgaactggaaccgtcgccaggatgtctctatcatggcatcaaccaacgggacaacatatgaccgttatgatccggtgcgtggactccataagccttacgaggttaaagcgtgaagtattacggattcaaaacgagtcattacggtaaagcataccgcactgacaacattgatcgcaaacgtccgtactatgattctctggtacgtgctggacgcaaacgcgctcgccaggaagggaagaaggaagccgaaaatgaaacagaatagtgaactggctttgattgcttttggttttgctctgggttgtatggtttccgcgttactcgttaacttcgcggggtgattatggacatcggatcaggtagtcagtatccatcatgcgcgttgagcaacttcgccccgcatccgttcacgtttgacggggtagaatgtgcatcaatggagggctttttacaaagtctgaaattcagcaatccagatatgcaagcgcatgtgtgtacgctggttggtaaagccgccaagttcaaaggcaagaaaaagaaatggtatcgcgatcagaccctatactggaagggtatgccgattcaccgtgaatcagaagcgtatcaaatcctgattgaaaacgcgtacaatgctcttttcctgaatgatgggttccgccgtgcgctggctgcaaccggaaaaagtaccttgactcattcaatgggaaagaataagatgaatgaaactgtgctcactgaacgtgagtttgtccgaaatttaacccgattgagagatctgttatgataggttataaagattatgatgaaagagtagaatgcgcgttcctgttcaaaggcgcgatcaatccgctggcattactccacgcacagggagctttgagttctaccctgattatgggtgttatctacaaagcgggtgtgtattacgtcaccatcggcgcgaacaacattaacgtgatcaacagctacgttgaaaaatgtaagctgaaagatattgtgttcgataaagtcgaaatggatgttccaggcttcgatgctgtttatatgtacaagggttgataatgagttacgtaatttatttcgattgttcggatcttgatcctttcgttctgcaacaggcaaagaaatatcatcaagatatcactggtatcagtgttacgaacgatgatatgctgtgtatcgaatttgattattatcgtacatttgagcgtgacaaattccttgcggatattgaagcgtttaagagtacccttttctttgatcgttatgaggttaaatcttgaaaccagttattcttaccgacattgacgggatcgccgtgaagtggcaaagcggcctcccgttctttttgtctaaacacaacatgccgaccgatattgccctggatatggttacagatgaaaagttccgtgatatgaccgaaatcttcgggtgcgatcatcaactggcgaaaattctcatggaagaatacaataacagttcgtttattcgctatctaagcgcgtatgacgatgcgttgattgtgatcaaccgtctgaaagcccaatatgatttcgtggctgtcacggcgctgggaaccactcctacggcaagccttaaccgtattgcgaacctgaacacgctgttcccttctgcatttaaagaagtgatggttgtcgggcatggtgaaactaaagtacaccgctatctggaagcgaaagccaaatatggcaatcgtctggtttgcttcgttgatgatcttgcggtaaacttaaacgaatgtcataacgtcatcagtcagttgccgttattccatatgttgcgtggtgaacgtgaaaccccgtggtcgcctcaccagtcagttaaatcatggtttgaaatcgaagagaaattacatgatcttacagattctaaatgaactcgcttcgactctgaaaatttcagagaaggaagcgatccttaaacgtaatgcaggtaatgaactgctgaaagagattttccgcattacgtacacgaaacagattatgtttcacattaagaagtttccgcaggtggacggcaagccaggcacaaccccgctatcgaatgctatcgcggatttgatgtctgatttggcaacgcgaaaatatacaggcaatgcagcccgtgatcgtctgctggatatcgtatcatcggtgaacgagaatgaccgcgaagtgcttcgccgtatcattaaccgcgatctggaatgtggtgctggtacaacgttaccaaaccgcgtatggaagaaactcattccagaacagcctcagtgcctcgctacgccgtttagtgagaaagccttaaaacgtattcgcttccctgcttactcgcagcttaaagccgatggtgcgcgttgtatgtccgatctgctggaagacaagatccgcaaagcatcccgcgcggggaatgagtacgaaggtttggtgaatctggacaaggatctgaaaaagattcgtgattatctgggttatgatgttgtacttgatggagaactgatttatgtccctgctgaaaaaactgctgtcgttccttcaaacagagttccatttagtcttgctgggtttatgggcgatgacgacgattctgtttctgaccttgtggcagatgttaggcgggaagctaccgagaacgagacacaagcggaagcgaaacgcgaagagggcaacgggattgtaaacaaatccctgaaaggtactatcagcgacgaagaacagcgcaatatcgtttatgttgtctgggatatcgtaccgtatgaagtatactatggcgatgctccgagtgttcaaccatattgcgatcgctttagcatcctggaaggtgcgctggctggctctggtgtaacatcggttaagttgatcccttctatcctggtacagaactacgcggaagcgaaaaaggattacaacaattaccgcaatgacggtaaagagggttcaatcctgaaaaacgttgatttcaaatggaaggattcacgcgttgcggatcaggtgaagttgaagaacaaaaccccgatcgaactgcgaatcatcgacgtgtacgaacacaccaaagaacctcataaggttggcgggttcgtggttgaggacttatcaggagaagccagaacgaacacaggttccggtctgactgatacggattaccgatacgatgaagacggtattaaccgcgtgtacatcccgttagaagaacgtggtgaactggatcgcgaatacatcatggcgaacaaagatgactatatcggcgctatcgtcgaaatggaagttgacggactccagaaatcgaaaacgcgtaagaagggcgaacctgagttcagtttcttcctgccaatcatcaagaagattcgacgcgataagaccgaaccagatgacattcacgttatcttcgctgatctgttttaaatagcactttttgctaaagaagccccttgcatatgtgaggggctttttgtatattacacacatcgaaacgaaacagacaaaaggaacatcccatgaaaatcactaaagaactcgaaggcaaagtaatcaacctggcagaccgtgcgcgttttgaaaagctggcgaatggtggtgagtctttgggcgaagcggtagcattattcgaaagacttcgggttaaacgtgttgttgatggttgggttgttgctctgcctgttgcagacgaagacaaagcagtatatgacccagttgcagattcatgggatatcgcaatctgcttagttaacgttgaagtagaactttgcttcaaagaagaaaattgaaaatagtgcttgcggtgtgtgtagggtaatggtatcttacacacatcgaaacaacacggaaagaggaaaaagattatgtcaatggctcacttaactaagaaagcggattttctggctctgattgctggcatgaacgcaccgcgtttaactcgtcagaacattcaggtgtgggtgtacgacgagaagccaagcactagcgaagttgagatcccgactctgatctattgcgcttccaatttccgtgaagaaagctacatcgcagcacagaacaaattgtggaaattccgcgattggatgaacgaggcgaaaaatggttgatatgagtaaagaagccgttgaagcacgggttgcggaagcgctgaaagatattgatttcggtcgcttccttgataacgctccaacgataccggatacaatctgccttaattgtgggcgttgtgttatggttggaaaatgctgtgataacccgaatattgttatcatggaaaggaaagaagtttcggaagaagtctgggatcagattcaggaaatcattaagaatccaccagaaccgacgaagcgtttgcgtgaaattattagcaggaataaattatgaaatcagaaccaagtaaaactatccgcctgatccgttgggaaggacaagaaatccgttatgaagatcaggatcgtgaattcgtccatgaaatgcttgcgcataatctgggattcaaaaacgccgcactggtgatgatgcagcaaaccagtgatgaagacacctggcaatgcgtcattctcgatctggataaaaacaaggaatacaccgaagatgaactgtttgcgctcacagagaacgctacagcgcgtcagaagtgcttcatgatcgatatgcctcgcgaaaactacgagaatatcaagaaagcccgtaaacagaacaagaacaacgtgttcgacctgttcatgggctatcatgaagaaactacggcctaagcctcgctggttttgctggtgtcgttcgtagccgctgccacctgtacacattccaatgtttgcaggtggaaatcttttgatacgtcacggatacattcaacgatcagatacttccctgaatattcatcccctaacacctcaatcaatgcccccactttaacatccattcgaccctgattgatatcaaaccgaatacgtttttcataactggataacgtttgacatttcacagcctggaacggttgaccctgtttgtctgggttctggaagttgttctcatataccgcgttcctgttcatggtgatccatgcgttttcaatatcggtactcgcaaggatatcactatacagttttttatccgtcatcgagaaactaaagaaacttgcatcccctaacagggtagtgttatccttatgggtaatgtattctgctttagtgaataccaaagcgtcacctaaaaacgggttacttacgttgaacttgtaagcctttaacggggtttgtgcgaggatctccgtattgcttttcataaagataccggaaccatcttcccacagataacagaagtcagacgaatctacgctctgcccgttgtcacggatgtaatcaaacacggtttcatacgtcccgctcaggcaagccggaggaatacgcacgtttgatgcgtcgatatgcggcgtgatcaacttcatatcgttatacagtgccgtcatgcactctgtaatcgtctgtacggcgttgttactgaacgaacgggaaaacttacgacgaaacaccgtatgcaccggagaaaggtttaggcgcagtatagagcggttcatatcatcggtttcgacgtttgaatacagaacaccgtagtaatgctgttctaacgtttcgttatactggaaggatacctgaataatcggtttctctgtcaactgatagattaactggttatcatagatctgcatcaatgtttcagaagtaccgttaatgatggttttctcactcattgagacaagggcaggtaacaattcaagatagacgttatcagcgaacttttcatatgttggatataatttaaccgacacgacgcggtttataactttactggacattagacatcctccctttatattctatttactaaatagtaaatatcgggatacttgaggcgatcatgaaagagaagaaaaacacacttgataaatttatggttacgcgtttaaacatcaagaacagcaaaaataaagtagtcacgttgcctactggtgaacaggttacgatcccccgtctgggttatcgtcatttcacccagattaaagcaatgaaagacccaatgcagttgcttgagtatatcatcaaagagattcaaccgcgcgaattaaccgcagcagaaaccgaattccttttgattcacctgcattatcataatgacgataaagcaatggctgtattgaaagagatcggtattaatctggatgatatgaaaatcagcgaagctaagtatgaacatacttttgataaccttcgattggtcttcaacaaaccgaccctaatgctggatgatctggcattactgcttaaagaagcgtatgacaacgggaagccgatcgaactgacggacgaaaaccgtattcaattaattaactgcctgtatcgttatgaatatgacgatgtaaaacgtggcgtactccaggaagtctatattgtgcatgaggggaaaaccattaaagggcttaacatcatcggtgaatgataatggctagcaatccatattttaacgaagaacaacgtcgccggatgcagaatccaccaaaaccacaggcgcaaccgactgttcgtaagatccaggcaacgttagataaagattcgatgcgcgagttaaaggatatcaatgataatacccttgaaaccgcgctgaatacactggacatcaaagacagtgtgaaatcctttgaggatcgtttcaaagagaaattcgctggcttccaggaacaatacgaacaggatcagcaaccacttgctgaacagttgcccgattttgttgggccagcgcgtccaccatcattaacagacaacagcacaaccagtgttgataactccgtcagtgtatcgaaccagcataacccatttgcgaaaatcgaaacatacaccggaacgattgcagaagcaatcaccaagtttatcgaactcgctgaaaagaaaccagcccccgcgccggaacctgaaccagtaccggaagaggaaccggaggtcgatcgggacaagaagaagatccgcgataaggataaagacgagaagaaattcagcaagaaagtattgtctttgctgggtgcaattaaggataatacatccggtcttctggctcgctttatcggttattctctcgaagcgctggcgaagtttgcaaaatggactctgattatcggtagtatcgtatttgcgatcgacgtactgagtaaggttgttcagaagtggttccaggatattcttgcagagggtgaagcctcgaaagaattgtttggttcatacttcgggaatatcaaaacccttgctgagaaaatcaacgaaggtctgcaaaacttcgatatgagtaatttgggcgaatcgctgaaaaacttgttccttgaaccgtttaaggttctgggcgataccatcaaaaccgcaatcacggaaggtatcggtaatctgatttacgctctgggtgaatataccggatctgaaacgattaccaacgccggacgcggaatgaaagtatcagcactgcgcgacaaacaaaaatacggtcttgaaattgatcccgatgacctgattctgctgaaacagcaggagatccaggatcagaatgataaagtggttgaggcacgttctaaggttgtcgaacaggttaaggctacccagggcgcattctcatatagtttcggacagcaaacagacgcacagaaagcattgtctaagcaattggaacagatgcgcgatcgtgtggctattgaagaaaagatcaccgaagagaagaagaaagaactgaaagcattgcaggaaaaccccgcactgttacaggctgaggttgataaagagaataccgctaaccgtaagcgcgtggacgaaaccaaacagatcgaagccgcgcaagcgaaagcgaaacctaaagcggataatgaattcgatcagggtgatgaaatcctgaacaaagacaatctgacgggcaacgataaaaaggtaatggaaaaactcatagaatcgcttgaagagaaaaacaattcgaacaagctgaatgaggacgacaaagaccgctatcgtgatatgatctcccgctggcaggaaaagatcaccgcagtaccggaaacgagtgcaagtattgacaagcaaccggaagcagtgaaagcccctgttcagcctacaacgcctaacagcgttcaggtcaacaacaaaacagtaaacaacacggttcagcattcagtacaacgaactgaccgtaaaccattgattgcattagcttaaaggaaatttaaatgaaaattacagtattgcaagacactgtacaatcatttgctgaaatcaaaaatgctggcatcccctctgggggtgctgcaacaactaaaaacgcgttgactcaaccgatcgtaacagcggaatttccttcccaacgtgcagcaggtattgataacgcttataatgcatcaagcctgtataataacggcttgctgttcacagcatatgatttcacgggtggacttgcaccaggcagtaaagacaactaccgctcattacgtcaggcagcacagaacgcgcaacagatccttagtgctaacactgggaacgttcgatacaaacaggttttgaatacccgtactatgggtacacttaaccccatttgtcaaatacttttaccgcgaagcctgaacgataacgaagtgaactcacaccgttatcaggatgcaaccgatagtattgttgctaaaggtttatcccgtgcggtatcaaacgttatctggggcgctgtagaatccgtttctggtggtattctggcagaccgtagggaagcaatcgacatcggtacgaaagcagcgtttcaaggctctgataagcgcacaaagatgtattacaatacattcgttatcgaaagccgttatgacctgctggaactgattaaaatctattacctgttcacggtgctgggttatggtactacttcgggcggtactccagcagaattagccggactggttaaacaagcgtataattccagtgcttcgaaggttgcaaacgtttttgcaccatcaacaaaccagacgacagcaagcgatttcaacggcagcatcggggatcagattgttgacttcgtatcgaacgttgaagttattaaatcgcctcctgtgtggtttattcgtgacttccagacaggcgacagtttgcggttccctcattccacgttcgggccagcaggtattaccagcgttcgtttcgggcgtacaatggacaacattgtaaatacgttgagagaatcaccgaacaccccgatcgcagttgaaatcgaaattcagtttatggaactgatcgatatgcgtcaggattcgatttttgatacgcagtattaagggggaacaatgttctatagcgtagatgaatttttgtcaggaatggcaaatagagacttccagcgaagcaacctgtttagtgttgtattcgcaaccagtccagcatcacgcattctcgacagcacgatcgggagtatccgcgatactttaattgatggtactatgagttccattaacgcaaataacccgaacgagttcatgaacgctattacagggggcgtaagcaagttattcagctatacagttgataaagctattatgtccctgaacaaaacaggtttcagtaaaatcatgggggcgttaagccctcgtttaattacttccctgtttggtgatagtgtttacggacagatgctaacagaattccgtgacaaaatgatgtataatatggggttgagcatcgttggtgttcagttgcctggtaaaacactgggttatgaatacgtgtataatggcggtgtaccccagatccgattcacccgaccggagaatggtgaattatcgctaacgttccgtgtggattcagaagcgcgtaacctgaaagtattcaacgaatggttatcagctattcgtgatgatgtctcaggccagttcgcattcattgatgaagtatcaagcgcgatccaggtaaacttacacaatcgcgatggtgtcccgcacagcacgtatgtattccagaagtgtttgcctgttaaagtcagcaacccagaactgagttatgaaagcaataacgaaatctggacattcactgttgactttgcttataaaacaggctggcttgttgaagcagataaagaaggttgggacggattcaaacaatcacttatcgaaggtgcagcaattgccgttcgtggtgtggttacaggacaataaggggcgaaagccccttttgaggttaaaatgattgatataatccgcgtaaaactccctggtggagtgaagcgattccctatgtttaccgtgcgcgatcagttgagtttcttactcacaagcgcggacatggaagggaagacgctcacagaacagcaagaaatgctggatgaaattttagatattctgtatccgggttattcccgcaccgaacaggaaaacattttcactaaggtgtattgtgtatcgttcggtaagaacgcaatcaagatccgaatcaaaggaagcagcggacaatcagaagcattcatgcatgtaactgattacgttttgcaaaatgaatatgcccttgatgattcgcttactctgggattcaaattcccgaaacatcgtaacaacagtgaacaattattccttgaatgtatccagtatgtcaagcaggacggcgaaagatacgaatggaatgcattagacgaggacacaaagaacgcgatcctggatctggtgtctattgaagatatggaaaatatcgttaaactgttacgcaagtcctgtcatgttaccgtgcgtgatattgagttcagcgacttattgacactgtacaaaatcctgttcaacaaatcagaactgaatgagttcttcaaaaccaactatttgttaaataagaataccgtacagattgaacctataatgaatggaagcccgatggaacgttcaatttacgttgcattgctggcggaagacttgaaacgaaaagagaatgcaaatgcgtaaacatacaccccgacatatcccaaaatataatgtgacttatcgcccgttaaccattggcgatcttgatgacacggataacttcattattgaaggtgatgtgttcaagcatcagcgcgattatgtttacattatggctctgttcgacagtatcaacaaagagactgtagatctccaaatcaaatgccctgaatgcggggaactgattaagtttgtgctcaatcgtcatcatatcatggtggatgaatatgaagaaaagctgtacggcaatgagatcaagatttcagtcgaaccacaccgcaccggaaaggaagagttccccgaactgattaagtttgtagtcatcgacggtgaacaaatcttatgggatgactgtaaagagtcagagaaagaagccgttctggatagtatcgactatccggtctttaaatcaataaatagcgctctggataagccagcaatcgttgcaaacattccggtaaggtgttcgtgtggctacgagcatatcgttgcactgagaggcttagaggcgtttctaaaggtggttggataaaatgggtgttaaccttcgcttactgtatagcgatatcgatcccaacttaacaaaagactggaacaatgacgtaaccgcctcgaaaggggcggcagcggtaaagaatagtctgatcggtatcgtaacaacacaaaaaggcacacggcctttcgatagcaactttggttgtgagatcggggaacagattttcgagaacatgaacccgctaacagcggaagcagtaaggacttcgattgtctccgcgatccgcgcatacgaaccccgtgtttacaatctggatgttgaagtgattccgcagtatgacgaaaacgcaatcaccgtgacgatttactacagcatcattgatgaaccggaagaagtagaaagaatcaaactccagctatcatcctcataacaaaaagccccgaaaggggcttttcttattccatcacgatccagcccattagctgttgatatcgcaattcgaacggggtgatgaaagagcggttattgataaccttcgtcccgttgtaggacttaatcacttcctcaccacgaagcacatattcatatacttcgtccatagtgtcgtaacgcacttcttcgacttcgaagcagaagttggaatattcaatcattccgatcttgttcgcgtaacggcgttcgatgcagccctgtttttcaatctgagtgatcgcagtatcaatgaactgcgcaagtgcttgcatgaaattaccacattcgacttcacgacccccgcttgagatagccaggtaaacgcggctcaatccatcattgccgatgtaaccgatacagtcaccgccaatatagacagaccagactttacccatcggccccatacccatacgattctcactacgagaaacacctttcagtaacagtgccatgataccgccgcgaacgtaattcattttcatgataagccccttattttttcaggttgattaaccaagatggttgggtttctaaactaaccgctttccaagcatatgcaacactataaccggaatacgtctgacatacaacagcattttcatttaaatatttcactttgtgatctgcctcttgttcatccagggcagcacacacgatattcttttcatacactccgccgtttggctggataatggtttcttcaatcagataaacgctgttcatgctaattccttctcgattgcttcgatgatgtggagaacgtaaccgttcagttcttttgctttatcagcggcttcaaccataccgtaacgaggaacttctaaaacgttcgcaccttcgagcaggttgctttcgatgtctacgattacgtagctctcaccgattactgcgccttttctccagtcttttacgaacttcaccattttagctttcatgttctcgttccttttggctgttccgtttcgatatgtgtaatataacaaagccctcacgcgaacgcaagggcttttttggattaactgaatttattatagagagtgaaattaatccctatagaattcaatgctttacatgttgcatcaagatcggttggttcgatttcgatgatgtatttcaacgctgtgtttactggaatggtttctggttcttcgaaagatgccagggttggcgctttcaccgtttctggttcagcaagcgcggttttctttacgtcaaacgcttctttgaacttgttgatcctttttagcagatcatcaatcaattcgatgttggctccgtcgaattgtttggtttgttccagcatactcgtaatctttccgtatgtagtgcgtctggtttgttccgtgtaattccctacttcataacggtcgatccggtcgatgattgcccgaacatgtccaagattcgcgcgatcgaaatacgcaatcaacttagattttctgaacacgaacatatatggagcattaccgacaatgtaatgagttgccgttagaccaaaactaggatcgatcagaattttaaccgtgttgaaatacgggattaaatttatttcacgttcaggcaaacggaaaacttcatctttaaagttcttcccaatccggtcgatctcttccagagttttacccatcatcgacgaaattatttcaatttttttagatacataagccatttttcaattctcatttaattaatgcataaaagatttgacgtacttcacgatttcttcacgacacatatcgaccggagtatcctcagcaatagcagcatgacagaagatttcaccatccagccagaacgatagcatgtactgaatatcccgaccttcgttttctttctggtgtttcttgatgcgattaaatgcatcatccatgctttcggtagctgtaagcatttcagattcacccgctacagcagccatttccccagcttcatcactgaattcgctttccaattcttcccagtatactatcgttatcatggattaccccaaacagattttacatttacagagaggacattccgcctctttaacgcgcaagcgctttgttgctgttcgcttcgctgtgttgtgatcatacacatgcaaacagcgataacagatcaccaatcgtttagccgtcataaccaccaccgcaacgaacatcaccttcaatgaacagttcgcggttatctctcaggagattgtatttcttttcgagttccggcccgaatgcgtccgcgtcgtcataccagtcatagttataacttccggtttcctcgtcgtattccggttcgtcgccgcactcattgaagtgaacgattttaacatcatccagattcagttctttcagcttgtcccagatgcgggttatttcgacgctattacatccgaacgcttccagtgtgattgtaccgtcatcatgtacttgaggaacaccccagcgcggacgatgatgaatttcggtgatcatatccatcagcgattcaatgtttgactcaccgtaaatctttgcaacttcctgttctttaccagggcggacaagtcctatcccgataatgaaactactgcttgagctattgctcacgaacccagaacggatcttcatcgccttgcctcgtatttcgcgttatctgcgattttctcatgatacaggttgtatgacaacaccagcgggatacaagctactataagcccgatgatagccagttgatattcgcgtttatcgaacgccatgaatgtaatcgtagcgcccagaataaacacacctaacgcaatgatgaagaataatgtcattttggcagggtatccatttcacgagattttgctttcaggatgtcaatcacagtagtcatcgcctgttctacatcaccatcatagtgaaccaggaatgttttgtgaagtcccatgatcagacgattgatgatataagccatttctgacggtaacagtttaccattctggcgatcgtactttccaaacaagcggtagagttctgcgctgttgcctggcttctcaatgctgaaattatgcatcccagacagaataccatccagatacagaacagttttgttatcattacgcaggtgtccgccgaccttgtagtagttgctgaatacatacggtttttcgcggatatcttcgatatcgaaatcaccatgatcttcgatgttgccaacatgggcgaagaaatgatgatcttccagttcgagaaggattgcaccctttttgtatgggaatccgactaaatcgatctgccagccattttcaccgacaaatacatcatcaacaaccacgaaatccggcagcataggcgcgtatgcgtggttcttttcgttgttttcacgataggcttgtggttcggacagatacaggatatcgccttttacaacttcaccccagaatacgttacgtgacatattattttcctcaatatgccccctttcgggggcggtcattgttagattttgacttctttttcttccaggacgatttcacattcgaatgatgtggtttcccagactttccagaaatcggatggaatattatcttctttcggaagaatatcttttgcagcgatagaaactttggtttcttcgaagtccagatccgcgaaccatgcatgggctactacaacaccgtacattacgcgacttaaacgggcattcagtttacggacttcctgaatcgttgcctttgtctgcttatcaagatactcgactacctgatctttgtcaagcgcatccagttcagatttcacctgatcgtaagcccacaggataatcaggtcgccgttgttcagtttcttcttaccttcgtcacgtttcgcgacggtagccgctacagcaggaagggaggaaacacccttgattttcacgttcagttctttcgacatgtaaacatcagtcgattctgtgcgctcaaccttcggagagaacccgtaatcacgaataccctgttcagacagccattcacccgcagcctcaccaaagcgctgtttcagcccttctgcgttgcgcagtccgatcgcgttgtcacggaagaacttcataaccttctgacggcctttcaggatttccagacgcacgttatcagtcacgaactctttaccgcttaacccgcgagtcatgccacggttaaccagaggcagagaggtaaagtctaccagaaccgacatacgatcatcaccgattttttccagcggcttgatagtcaggccagaagcacgaaggtttttcagtgtcggaatatcggtttccagcggcagaactttaacgttcacgataccatctttaacgatggtgaagttacgcacctgcttagtttcgactttttccggcagaccgaattctttctgtttgctttctgggatagtcacatacccttccagatccgtgttgatggaaatgttcggacgggaactgttacccaccagatgtttaaccgatactttggttgtggtttgggtaaatttcggtgtccagacttcatgcgctaccatttgcgccgccagtgctttacgttcttctggggttgcagcgtttgcgatctgttcggtcagttgatccagtgtatcatcttctttctgtacagtctgacggcctgtgcggttatacgcccagtgctcagaagacaggtcgatcactgtgtcagtttgtgccagcagttcgagcgcatcaaccagagtgaacgcgttttcgtctggaaccatgttgtaatcaataccatcaacgaaacgctgtgatggatctacaacagcctgtgcaatcaggtctttcgcgttggagtagtcctgtttggtaaagcagttgtcatacgctttgatcagacggacatcacccagcttttgaagcactttccatgccagatcagggttcattgtgtgcagtgcatgataaagcacgacatacagaacttgctgttcgctggcgatgttcggatcgaatccgtcaacatcattaatagcgttttcacccagcgcccagatgtttttgatgtgttctggaaccagcacaacaccgtttgcagcgttcaggacatacacgcgcccttcgtccaggtagatcgcatgggtagcatcagcaactttgacttcgatacgcgcggaagtctgcgcggtgatgatttcgttaaatgctggttcgtatgcgtcgaaaccttcaacgaatttgtgcaatgcgttggttgcttctgccattttttccagcagaggacggtttacataataaccgtattccaggaacgcgatactgttgaaagtcagtggcagaaccgcacacgctttcagaatatcatcggtacgccagcagttatcataaccgtctgtcaggaagatcaggctgttcaggttgccgttttcagattgcagatcggtagcgatttccgcagccagattcaacggctcaacaaagccagtacaacccgtaggtttcaggtaacggtcgatagccgcgcagatgttagacaggtcagagacattgctaaccttctcaccacggaacaccgtgccgtaatcgcctttgctggagaagtacaggatcgaaacggtgtcatcctgtttaaccagactcgccaggtttgctttcaggtgtttacggatcttaggcagttcgttgtacattgaaccggatacgtcacacacgaaaacgtggtttgtcggggttggcttcgatacagcgtttttgaattcgatatttgtgattgacatttaaattttctcgtatttgaatttttctaaaatttcgttaactttattgcttactgcttcgactgtacgatcacacccgaacttacgcgccaggagttcaacgtattcatccatcgtagtgagtttggattcagcaacgtcaaacgcaagcgcatacattaccggattccatacccgaacgatttggagagtatactcgttcagttcaaatcgttcaagatattttcgcaaagaaaatacatcaaacggtgcggggcgatcctggctaaaggggatcgactcccctaatgcatagcgaggcataacaacacaaacttctgttttcagtttattatccatcagtgatgactctttgatgtgtgttcaaggttacggaagatgtttccatgttccagttgagttccgatcgggccgcattcatcggagtacgtgaattcaaagataaacacgccgtcctgattgccgaacttcgtgttgtattcttcatacaaccacattttgatcagagcgtctttctcttctgtgtccagatcgtaccagtctcgcccgtcatacgcaagcgcgatttgagggtttgaacggtagcgggtttccgcgttttcttcggtttcccagtcatagcgcttatcgtcgtagaacgattcaaagctattacccagatgaccgcctaagtcacgatgaacgtgattgaccacttcttccgctgtcaacggcggatcgtagtaaccacaatcagggacgcaatcgcccatcatttcgcgcaggttgtcgatattagtcggatctttcgggaaccggacgatgaaactacttgatgaactattgctcacaaaaccagaacggattttcattttacatcctcaaattgtaagttttctttggttgcgttcgcaatggctttttcgttgctcagtgttactatgcgcagacgttcgccagtaaagccgtcgcattcagtgatactcacccagtcaaaaggtttagccatttcaatcgcacgttccagcgatacggtagaaccgaccaaatcactaaatgtatagtaatcttcgcttaaactttcaacagtataaattttcatgatactttaccctttgtttcggatttcaggacgatgttactgtaaggatcttttgctaccagttcccacaggtcgccaggatgttccccgctacggtagacggatgaacggatgatttcgttaaacttgctcagggcttcgtcgatgtcgtcatacccgcgtttgaggggcttacgattgcaacgaatgaagaacatttcgttggtattctccccgcgttcggcgtttttatttttcattcgatcaccattttaccaataacttcttcgtaggtcacagggttcggttcataaccgttagcgcctattgtatcgcctactctgttccccaccaatacagcaaccgcaactttcttaccgtctttccatgcgatgaattcgagatcatcggcaacatacgggaaggtttcgtgattgttcactgcgtcgatacagtccagaatagtatccgatgcgcaaatcagattaccaggctcacaatcaacaagacattcaacagtatagatcataataacttcctcacgaaaaaagcccctttcggggcttgattaatcagtgtccgaacacaccacggatagactctgcgaaagcgtacagttcagggtttttcgctttcactgtttcgatttgttccaggatgtaatctggtttgtatttcgcaccgaaccagcagtaagagaaagaacgatcccacatgaacacgttgtagtattcaccgttacgcacttcaaccatcacgtaacctggattagaacccagcgggtaatctttcaggagattgaatttcgcaccagcgccagtacatccgttaaacaggtcattaaaagtcatggtatgttccttttcagtttcgtttcaacaaggccaatatattacacttcgttaaaccatgcaagatatttcttctcttgtctgttcaaaacgtcataacaagaggcgacacaaacggtttcccacacaacttcatcgtaagcattcacgaagcgaatgatcagagttttgccattagtcatcaaagccggagtgaacccaagttctttaaccgcttttactttcttctggaataacgctttagtcatgttagccattttgtgtctcctttgtttcggtaaagctacgataccactatcaactaccggatgcaaacacttttttgaagaattttgtttccggtctttctttgtacggacgcattaccaaatctttaccgtccagcacggttggcttaccttcgagttcgatcaggatgaagttgcctttctggtacttcaatacgccctggctggcagaccattcatcattatcccagtggttgtaatgccattcaacaacggtatcgatcgggatatcgggttgatttctcatattctttttcctttgttcggatgcttctttcagttgtcgtatttgtgggatcaacctttgtggaggcacggtgtctgcttgtttcaatgcctttcgaacttgttcaacaaaccattcatattttggacggcggttgagttcttcacgcaatcgggcattctcttgttcagcaatacccgcgcgttttctgtaatcatttgtcatgacagaacctttttgatttgtttggctatcgcctcgatgacagggacagaaacggagttacccgcttgtttgtatgcctgtttcttactcgatggaataataaacgaatctgggaagccctgcaagcggaaacattcacgcggggttaatcgtctggggttcttcccgtcctgcaataccagacattgaacaccgtctttgtaatactgcgctgttatcgtcccagtgtgcgcagaatcgcttgtgacggcctgataaccgaaacccttaccgtttgccttatttcgttccttacgctctctaaagcctttccatgcgttatctgagagggtgaatgaatcatcagcatcttcgaggatgtcgcctacgcgtgtaggtgtacgcgggggaacaggaaatgaaaagaatacatcatccaggaagcagacaataaacacgcgttcccgtctttgtggtagtccgaaatcctttgtgttcaggcgttgatagaatacgttgtatccttcggcctccagaagcccgtaaatcgttctgaacgtcttccccttgtcatgggttagcagttcaggcacgttctcaaaaaacagcacacggggctttttagcgtgtataatgcggaggatttcgaagaacaccgtaccgcgtacatcatcgaatcccagtttcaatccggctttactgaacgcctgacacgggaaccccgccagcaggatatcatgatccggtactttgttttcatcaatggcgaatagatcaccctgtaggttatcatcgccccagttttcgatatatgtttgctgtgcgaacttgtcgatttcagacgttaaaaggcattcgacaccgccgaacgccttatcaaatcctaatcgaaccccgcccacaccagcgcagaggtcaattattttcatacgtcaaaatcaatctcgtcaattttgtatgagttttcatcaatgtccgcccatagggttacattaacgtgtttgctatcttcgtacaactggcgaccatcaatcccgcccgtgtaattgctttcggtacgttcagtaacttccagtcggaggctatcgcgcatgatctgaacaacagcctgttccagtgtaaccgcgtctgggtttttggtatcgcccagtacaacatctttaacgttcaaaataacatcagtcattagtgccactccgttttaataccgtgtcggtatgcgtcaatccccagtggggtaatcagcaaccatgctttcgaattatcgtgataacccgttacccttcgagcgtaacctttttgaatcagggcatcacgccctgatttgctgggtacgtcatcgaaatctaagtctagcactttagttgcgtatccgtaaagtttatacagaacatcaatttcagcgccggacaatttaggatacatcatttgtaataccccacaacatgatcgctgtatacgcgttcgatgaaatcgttccagaattcgcgatcaacttctttcggatatgttgaaatcgctgcaaggcgttcgacttcacccatgacttcttccagtttttcctgtacggttgcgaacggtacgccgccagctttaaccagtttcaggaatgcgctatcaggcagaggataaacgatatcaccatctttgtaaatctggatcaactgcataccaccgcgcaacgcgtgacttaatgctttccagtcgatcccgttgttggcttctgcttgtcgtgcgcgttctccgtattcatcccagagtttatacacagacttacgcatttcatcggctttgatcgtgaactggaatttacgccccagcacttcatagaagtcctgacaaccagatttcattgtcgtgtcggtaacgaatcggcagaactcgtttgtagggaaacgatccttgatgtcagacactttcacttcacgcgtatagcgtttcatatctggcgtgaattcctgaataccaccgatcgtttcggtttctttcagtacatcgacaacttcgcgcagtgcagccagtcgggaacccttcacgccatatttcgcggcttgcttacgaacataaccgaacaagccagttagttcagtggtgtaaaaacgccagcggttagcgcggatatactgccagatttcagagttagcgatcagcttgtcatccgaagcgtgaagcatatcgagcgctacggtatcaccatcacacgcaagactaatgaacttagtcagactatacaactgacggtcaacgtcgtctacggtgtttttagagcttttatcgcctgtgctggtgtcaatagtcttcggggctttccccaggagaatatcgcgcgggtgcgggagaaagatccctttatagtctttgtcgcttgtcggtgtgttcagtccgtacaggtgagaaccgaacacggtttccattacagttttcaaaattcaacccccagggtttttgcgataccgcgcagttcagcggtagtgatatttggtacacgcgttacatgtccacgaccgaacgcgtctttgattttatcagtaagttcgacacggtacaaatgttctttgtattcgtcttcgctgtgataaccctgtgtatggttattccagtcattagcgctaccagtttttcgatccagtcgctcaacacggaaatctttgatatcggtaatattcggatcttccgacgcatacagatattgacgggcaaccttgatcacatgcagggtgcgcggtcgtggggtgttgtgatgactgtatcgacgaataccaggatcaaaaagggtatcacccactttcacatcagttaaatctatcatttcattttccaacgttttgacttttcacagtagaacaccggaagacgtgccagaactggcttcactacgtcttcccctgtgttcgtgttatgaactacttcgattgtaagggattgcccttcggacggccttacgatgtccagttccaggatctcacgattaccctttgtattgatttccgctacgtagtaatcgtgtccgttgatgtttacgacatcacccataataacgctaattgtgtgaatcatgagtatgcaaacttaattttaacattcagggaatccagcaggatcgcatcacgtccatcaatgatagtcaatcccatgtatttgttatcgtctgcgctcttacgggagtacatgcgacaaaccagagaaccatcttgtgcgatgtattcaacgtggtattcacggcgttctgacgtgaagatgtcaccaactacaacaggacgatcaacactttggcgtttagtcccttcataggacagtttgccgttaccgtctggggtacattccgcgcctttcaacaggatttgtgtcactcggacagattctacggttcccgcaatcaacattgctggatcagcggttcccattttcaggatcagcgttgaacttgttttgtatcgtgatggttcagtgacgaacacgtaaaccatatcgttcttatcacgggcaacagattgcagcgtgaattgcatttgacccggaatacccgacatcgcaatgtgaacacgattaccaggttccagcgccatacgacattttacatcagtgatcccgctaagggttgctactttcatgatttaattccttcaaagtcttcattagatttccagtacacgttaaagttacggcaatcgtgatcagaagtcaacgtatatttttcttttgttttctcgtcggtgatcaccatcgtttcattttcgatggaatccacgccatagacgaacactttatcaccgcgcttattcaggaacgcgtcacctgtttgaatcaactgccagcagttgacaggtaaaccacccgcgcagataggacgggttactaaacagtaagggtgtttcatcaatcagccagccttatattgtttggatcaggaacgaatgtatctttctgggtaatcatgaacaccaggaaagcagcgacttcgggatcttcaatcacattgaacttgcgattgcctttccaacgtaccgcgattttaccatcatcgagttttctgatttcggctacttctgatttcttgctcataattacccccttcgtttcgatgcccctaatataacaaaagccctcacgcgaacgcaagggcttttttcatcttttatcagagtcccgtaaacgctacgataatctgatagtggtcatcgaagaactcaccacgattttgtttgacttcgtgcataggcatccagaacgcgtctaacgcatcgtcagaaccgcccataatacggggcagacttccatcattgttaggttctaacttgatgtactgcgccacagtcggttttgagaagtatacggaacgtttcggatgatcgaacagcatcgaattacggattgaaccacgaataaccttttcaggaaccttgattcgtacctcttcgagcagttcgcggattgcacaatccaggaacgtttcatttgcgtttttgtgtccaccaggaagggctaacgcgtctttacctggtgcgaacttacgacgaattaccagcaggtgattgttacacacaaccacactatcacccgtgcagcagttcagcgcgtcggggtatgggtagtttttgaatttctccaattcgctttcccatttctcgtattcgtagaataaacgccagaacgtgtcttccatcatccatttgtcgatataatcgacggttgcttgaggaacaaagcgcaacagtttcttatcccatccgtttttgtggttgaagataatcggacgcagatcggttgctgatagatccttgccgtcaacctgaacaggatcaacaggtacgtgtgtccatccgaacgctttaagccagtatgaacccgcatctttttcgtaaccgtagatagcgattttgtcgcctttggtttccctgatagcagtacgaacagaggttttccatttctcttcgttgtaaagataatctggaatatgttcaaactgaacacgaacaacatcttcgatcgggaagttagcgtttaaccatgagaagatcatcgtttgacgctcacgcgctgtcagagggtttaaaacgttagggtaagcatatgctgaacccagaaggatgtaaacgatctttgcttcttcgagtgctttacgcaccattgctgcatgaccattatggaagggttggaatctgccaattacgacagctttatcaaattgtttcataacgtgctccacgtttaaaggttaatcataaaacagacgcaatcaccaatacaccaagaaaaccgccaataaagccgaagaatagcgaaatgaagatagtaaggatgatctgttttatgttcattatagtattctcgttttaggagtcaagcccccagagtgggggctttaaaaccttatttacgagaatcgaaaatcacttgtccatcgtaacccgcacccattacggtatgtggaacaccgccctggtatttctctgcgcgtttcatctgaacgtcaagttctttccagcgaatcatttctggtgtaatggtacgctgcaacacggcgttcgcttcggcttctttcttagccgcatacagacgggcatcagcatcacgctcgttagcctgtgcagcattgctacgggcttctttatcggcaattgcctgaacaactgcctgttgagcgatttgctctttacgtgccagttctgctttttctgcgttcacctgttcttcacgaattttcgtgttttcaacctgtttcttaatcgcttccggcaggtcgatgtcctgcaagaatacctgtttcacggtgtaaccgtaaggacgggcatactcttcaacttcctgctgaattgcgatctgtagctggctttgaacttctgcgttatacagatcctgtgctttcggtacagatttaccgaactcacggacggtagacagaagtttttcggtcacgtacttatcaagcgcctgatcctgattacccgcgttgatacggttgatcggggctttgttaccatcgaactgcaacatcacggtcatatccacagtggatttgaatttatcctgggacggaacctgcaatttgtcaaacttcattgcgatgtctttggtgttgaatacctcgaaatcagccagtgggtttaccaggtggaagccaggcagaacaggcttcggtgaaactttacccatgaaggtttgagtttttaccgtaccatcctgaacgatagtgtacgagttcggaaccagccacagtgcagcgattacgcccagagcgatcagagtggttttctttgggttgtttacgatagtgtttaagttcatcattatttccattgggtttatgtttcaattcgatagttattctatcatcactttttcgcgtgtcaaactctttttaagaaagttttgtcagcttgtaaatcgtttgatagcacaagcctttgatctcgtccagaatgttcttcaatgaactatctactgaatcatagattgtgtcggcttcggttgctattttacggagatacaccaccgtgtcaagcacattttctgtttttaatacgggtttatatcgaccagtgataccaatatgaatttcggtgaatttatcaaccaaatcctgcatatcttcgtaaaaactctcaaacgctttatgttgagaatacgatccggtcgcaaagtgtgcgctatgcatgtatgttacagacatcagacacataccgataaaggcatctactttgcttgagttatcacgatctgttacttcgttaaatgtttgcatctttcatcccttacgaacgatgaatagtagcaaattcgtttgccaccctatagcccaggtgtttacattctggttcagtgcggcattgtttttgctgccattttcgttccatatagttatagaacaattcactggtatttacactgggagggattgtgtcaagatagacctgtagcgctgcattgatgtaatagtcgaactctttcgggacgacagtatttcgatcagcatgtgatgcaggagacaagattaacaatccaaacatcatcgcttgtgatatgcgtttaatgttcataaacatttctctacgtacacacggatcaacaatagatccgttcctgtatatatttatagcaaaaaaggggcgattcgccccttatgtaaaattagtctaaaaatacatcaagttatctcataccagcataagctacgctcaaaagcgcggatcttatttgcgttctcgatattttcatcccatccaatcacgccagctttcatccggcgtaactcctgacgcattttagcgcgtactttcgaatcaatctttttgactgcgatcgaaagcatcgcggagatatcaccatgagctttgttaccgtcacgattcaggtttttatcgaatcggatatatgcgcaacctgatttgtgtttccagttggttgagtaccaacgaataccatcaggactttccccgtgctgtgcataatactgtgaaaatgcttttgtctcttcgatctgttcgatagaagacttatcacggactggaacatatttcttacggtaagtacggctcatagtgttctcctttgtttgtctgaatacaccttaacagttcagaccaacattatcaagaagtttttcgtgataatgtttgcgacagagcgaaacgtatttgtcttcggctccgatctcaacctgctccccttcggttacgaagttgccttgtgcgtcgatacgtgcaaccgtagttgctttacgcccacagtgacacattccccgcagttctcggatctcgtctgcccaggccagcaaccagtaagaaccctcgaacagattcaactggaaatcagtacgcagaccgtaagccattacagggatttcgagttcatcaacaacgcgacacagatcgaaaacgtttttcttcgaaaggaattgcgcctcgtcaacgaagatgcaagcaattttattccggcgctgaatgtcccagaacagatccatatcaggcgcaatcaattcacacttttcgttcagcccgatacgcgaactcactgtgtttgatgtgcgggtgtcgattgctggcttatagattacaacacgcataccgcgttctttgtaattgtgcgcgtccgtcaatagtcgcgcactctttccagcgttcatggatgcatagtgataatacagtttagccattgacacgctccacaaacttaatatgattctggaatttaccctcaccttcatggtttttgcatgttttgtttgaacagtatatccaccaatcccactcgtcgtaagggggtttgtcaatgttcatgacgcaaatcaaagggaaatgacaatcccgacaacgaactttttctataatgtgtgcgttagccaattgtaaaccacccgttacccatgagttttttgttacgtcgcgcaagatgctctttgatttccggcatctggatagcaatatcatactcttctttcgtcatggtatgatttgcacaacccatacacccgcacacctgcgcgttacaccaacggagtgttccgtatgtcgcaatcaccttcattgctttagctttgattttgtcagtcatgattataaccgcccatttcgctatcttgtgctttatggatatcaagataccacatgttgattttgcttttcagttcgcccatttctttatccagtccttcatcaacaagacaaagaatgtcaaccaccgttttacgctgtgtgatgttgattttgttcgctttcatggactgcgccagcgcttcacaggttttcaccagtgcggcgcgttgtcctttgattgcggcgatccgtttgttcgctttcttgatcgcccgacctgctttgataggatcaatcatgataaatccgccttacgtggatcaaccgatggatcgaagtgaacgacgatgatcgggtaatctcccgtacactcgtcaataatggcgctaatacgcagccaatcgcccccagcaagccccgcaccgataagaggggtaatgataggcaatttctcaggaaacgccctggcgcgttctactgcgctcacaaagcatgaccggattgcatcataatccacttgtgggccagtaccccagaatttaaactgagtgtatgcattgaagacaatctgaccttcttccgtcatgtagatggagttagtgcctaacttccgctgatcgcctttcatagtcagtgcatcaattttgaacgcaccagggattttgtgcttcacttctttagcaatacccgcgcccatgttgcaataacagttacacccatgaatcaagtgtacttttcgtttcaggaacaactctacagcgttccctttgatttctttaataatcattttcatcacctgtatagtggcggtaagccagcacagccagccccgcgatcacaaccacaacacacattaagatataacctgtgttcatttaaattcatcgtcccatctttgccacgcttccaactcgtcatcatatacagggaacgagctttcgtttggctttttaacgtaataccagataatgattgcagcagcaatcacacacccgtaaaagattactaatcccatcatcagtataatcctatgccagcaacatattcatcaaccaggtaagtacggagtttttcacaacgttccttatttggcgcattggtacagaggttcatcattggttcagactgtaaaaactcatgcagtttaaccaacttctgacgcttgaagaggtgcgcgttttcttcaccccacacataagccgcgtccagttgttcggcaatcacctgttcacataccgcaacgtctttaatgtcacgattattgcagagttcagccagtcgatcatcagcatgtgcaaagccagcaaacagagtgagtaacagcgcaagttttttcatcgttttaccttagtatgaatcttcttcgataggggtataataatgggtttcgcagatatacgcaagcactgatcgcaaactatcgctttcaaattccggcttttgattgcgtttcaggttccaacccgtgaaacacatccagcgttcttccgcaatatcaaaggctagccaatatgtgctgaactgtgaacatgtatgttcgaagatatcgaacagcaatttaccgccgatcggcttcacatatggcttcacgcgttgaagcgatttcaggactgtttcgaggttactgcgatcctcgttcatcgcgatacggagaatatgttgattggtttctgggttatacccgtcgatcgcaagccccatatcctggaagaacttagtcgcatcacggaaaatttcatgtccgctgttcggtgaattgatgtaaaactccatacgttgttttggagtcatcgctcggacacgggaagcggttttgtgatcgatctcgtctttgacctcctgacgggctttcagcaacccgttcagcttttcctgatagggttttacaatcgctcggatttcgtcgatacgttcatcaataattgctaactgctgttccggtgtcagtttagtttccatgttaagcccctacgcgcacaaagcgatcttcaattgcatcattaacacattcgtaaatgctaacgtcattcgggacgtgcttacgaatacccactttcacgatatccatgatctctttgttgctaccccacacgttcaggttgaagtaaacaccgccgctatg

SEQ ID NO: 2 - DNA, 177973 bp, Unknown
  source: /note="Description of Unknown: 1.2-4s Bacteriophage Sequence"
gtctttgtttgcgttctcgttggtgatctctttgttggacagattcaccatgccggagatatctttgaacagcttacttttctgttcacgggcaatatcgcgatcgtggcgatattcgatgtatgcacgggcgaccgctgggttcgttttcatcagggattcttcaacgagttcctggatacgggcgatcttcattgcgctaccatcgcggatctgattgtactgaaccagcatgattgcggcatcagcatccgtcatagtaccgccagctttttctacagcaatacggattttttctttatcgaaatcgacgtttttaccgtcgcgtttttctactttcatttcgttgccttcattaattgctttctatatttcgcggttaaggctttgcgttcgtctttgtcggcgtactcgaagcccatagaaaccatttcggcaatcatatcaggtttggtaagtcttgaaaaccattttaccttatctggtatgaatttgtcatgaatacggttttcggaatagtcttgtttcagatatgcaagcaagttctctaaccactggatgtaatcgacatcacgggacaccagaccggatctgttgaatttgtgcttcacaataccttctgtaccgttgcataggttacaaagtaggccgcgcacacgtccggcgttttcgccgtctaaagcatggtcatggtcaaggtgatgtttctcgatctcgccctccaggggacgtttacagatagcacaacagcccccctgtttttcaaagagagcttgcttgatagttgggtagtcttttttggtaattcgtttcgtcagcataataacaacattcagtaaggtgtcattatttattacagggtgcggacgtactcacgaagttggtcgaatccgcctacatgtttcccgtcatggaaaatctgaggcatggtcatccggcgcgtaccaacaagcgcttcgagttcatcgatcaccgcttcgttcagtacaggtttaccgtcttccacggaatccgcaacagacacgaactcatacggatgttttttcgcgtccagcaagcgctttgagttcaggcatggagcgcagttatacacagaagggatatagccataaattttaaacatgttaacctacattaaatcgttcagtgttaaagggaatgtatttacgtcgcgtttctggtagttgcacacgtagacttcttgcgttttgttttgctcgtaagagtcggtatgctggcctaacagatactttttatccagattatgaacgcggtatttctgcatccattcaatcaggatatcattttgttttccggcatggtgagtcacgttggacagtccgaacatgattccttcgctgtgcagttcatccaggaaagcatataactcacgttcgcgatcttcgttccagaacttgttatacactgcatcggtgatcaggtacggaggatcacagtacacgaaatcattttcacagatatcaatgtcacggaatgaaccactggaaaactcaatgcctttcacattctttttgaaatgttcaaagcgttttactgttgcatcgttgagcgtccggcatccgaaattagcgttgaagtcgcctttgtcgtttgtccggttaacgttgctgaatgaatgcaggatcaggacatagagccataacggatctttgttctggttgtattcatcacggaatttcaaatactcttctttcttgtctttccccagcccctttgatgcaatcaattctcgcaccggagacaggtcaggaagcgttttaagacgctcatacatatcaatcagcgtcttatcgtaatcgttgcttagaacgggtttagggacgtttaacgacacactaaggccaccgcaaaaacaatcaatgaaacgcatgtatgaacttctttcggggaacagcttgaagagttcaggcaatagcgattgtttgttacctgtatacgggataacacccaaataactcatagaaaagattccagattgttaacgtatggctgaacacgaagaatagaatcgtgataataattctccatcagttcgaagcctttgaaccgtctgttggttagtatcgacattttcataactgtaccagaaccagagaaaatatcaagaaccaagtccccttcaaccgtccacgttttaatgtgatcttctgccagttgttcaggaaatattgctgggtgtttgaatgcaatctcgtccttcgttgagtgattgcgccctacagcgtaataccagatattacccttaattttatccttgccaacaggtttacgtttcttaccggaacgggctgaacggttcttttcgttggtttcggaaaagtagctgttttgtcgtgcggtttccttttcagggaacttacacggaatgcggattgggttgaatgtttttggtgcgccttttgtccacacgaacatgtattcaaagtcctgttcgtatcggttatggttcttcggtagagcggttttgtgatagatcatcgtatcatgcaaccgaaaaccttgttcgatcgcgtacaaggcttgacggaaagatgtacccgtttcactaccgttgatagtcgcgtcacccacaacccacacaaccacaccaccaggcgcggtaacgcggtacagttccgatatcaactctttccatacgtgttcaccccagacatcaccagagccgttataatggcgcaagttgtcatacggaggcgaagttatggtcaagtcaacagaaccagattcaagctgtttaatcagctttacggagtcgcctaaatggaggtcaaccccttctttaattgtggtaatcataattcaccaagtcctttctcaaataaggcgatcgtttcgtacttatacccacgattcaccacgaagcaataattttcgcctagtttctcaagcattgcaatagcacggtgttcatcttttttatctttcagtagataagcaattcgaacaacctcttttagtgtcgcgttgtccacctgttccaacttgaacccgtagcccaccaacttacaaaaaagccccttgcgagcgacaaggggctgattgttgtagaagactaccgatccgttatcgttggcgcggatattaaatccttgctcgctcacggataacccctactgtatcggaggtgtttaatacaccgttgtcgtaatacgtaatcatcgcatcacgccacccgtcaggaatctcagtttccagagtgtcgattgttttgaattccacaccgttagtgatggtcatcagcaaacctttcttactctgtttccattcggaacctttcgggcatttgtaaacgcctttccacacaccattcacgcggatagcgcacagtttttcagcatacttttgagtgtcgcgggtaacttcttgcagcaaaccgccacccataccgaacgcgatgttctcactcgcccacttgttcgcttccatccaacttaacacacggttgattgtttcaggtccgtggatctcgtcgccctggatgattcgaactgaattatgcagaactttgtaacctttgctgtttacggtgtaaccgaagatttcgcccagtttacgcagggtgtacatgatgttatcaatcatatcaccggaatcaggacgaacaaccagagtaccacccgcagcaatgatttgctctttatattcagcgatgcgatctacagcgcctttgtagtcccaggaatcgtacacacaagcgtagaaccctgtaccgaacatttcgatgctgtttttgtatgcttcgtcttcgttctctttaccgtaggaaatcgtagtcgaatgttcgcgagccggaattgaaacaccgattgcttcgacgttttcaacttcatcaaacagagtttgatagtcagcaaacagactgattgccataatcataccttcaacggtatcagtcccgatgaagttatagaggtgtgccagcccaccaatacccgcagattcagcagaggtcgcgccacgcgccccgaaatcatgcagacgtgtacccagtgtgatgttatatgcttcaccagtcaggtcagaagtcatatcaaggtaatgagccagaacctttttacactcacgcgatagcgttgctacagatgacggataccagataccgcgaatcgtcattgtctccagccacccagccaaccatgagaattcatgttcggcgtacacagtcgcaacggcatttttaaccggaacaaccgtaccttctgggatcgcacggaaagtaacagggacataacccagttctgcgatcttcttccacccttcgtagttgaaaatctctttcccaaagtgcttacggtaaagtacccgtgccaactcaacttgtttcatggtaattggttcagcaagaacccgcgcaacgaagttaacgccagcggttactacttcatcaaacttaccaccgcgagattcaatatagaacatcgctgcatcagtgccttgtggatactgcaaccagtgggacactttgtaggaatcagttgaggtgatcaggctattcagttcattaaaagttttcatttaaacgtactccacgttttgatttaaaagatacgatccaaacgttctggatggatcgtgttccagtatttactcttacagtctttcctggattttttaccattagagcagaacaccttatgatatgtcgtcttcttgtgcaactctttgcacgtaggacaggtgatcatggttcctactttagcggcttttgcaacatcgtacaattgtttgatgtccttctgccgctcggacgtaatgacacgcccgtttacttctttgacaaccgtttcagttcgaatcgaaccatcggaatatttaacttgttgtttctttccagatccaacagtacgccccattgctaaacggcttcgaagttcacgctttgttctttcaaccccgcgcccaacacagaagaattctccatcttcattatcgagatcaaggtcatcaaagtcagcccaatcttcgagcgcttccgcttctgaacactcattcattccaaacatgttcgatccttaattgctggtcagtaagaagacccggttgtcgctatagtcgatgtagcaatcccaccaacccgcacagttaacaccatctttttcaaggcttatgattttaacgctggttgcaacgtcatcatattcataaaccgcacccagttcgttcagcattgcttcaacgttagcccgtaagcctttaccgttgtgtgctacaccattcagtgccaagcagtagccagcgcaagtaggtactaatttgatttccatgatgttttccttttaggttagtgtcttgtctacgggagctatattaccacactcataactcccgtcaacaagtttttcgaattattttcaccaggtgatgtaataagtcagatcgctatatccgtcacgcttaggatcgctaaagttggtaatacgacgcgaacccgcgaaggtattgagtaacgcagcttgtcggttgcgctgggtatcgaaagtaaacccttcttccgccagccattcacccagatccgcatatgctttttcggtacattcctgatccataaccttaccgataaaacgtttcatatcaaaggtatatgcttgtttagtcggatatttcaggacatactcggaaatgtctttacgggatgcttcgaccattttcgcgttgatttcatcaaccagtttacgcgcacgttccgccagtgtcgggctacgtccacagcggggatcatcttgtgtttcgcgtttgacccacgatgtcccgcttcccgcctgtgcgttcacaccgattccattgatttctaccattatgtttcgccttttttaatgcctcttcaacagagaggcgttcgtaattacgtgattgttcgggagttatcaccagagaaaatccagagtaggaggtttagtgttaatccctaaagtatcgcagacttcatccagaacgttttgattccaaaggttgaacgttggaactttatacaatctggcaagccttgcagcgatcgcagtaccacccttaacacaaaaatctttctctaccgcccagaatagaacaaaatctgtaggtttgtccaggttttcggttaatacctgcattgaattgcgagcgtatcggcgttgtgtccattcgctttggttgtcgaagtgtccagctacctttctcgcttcgtcagcggctttgtacgtgtcgtattctgtatagtcgatgatatccttaccattcgaatacaacccgttaaaaccgttctcagggaggattatacgccgtctttctggtgagtagtcaaacatgaaatggctatccattccaggagcaccaccagagtaagcgaagatcccccgatcacttaaagcacgtccaatctttatggctatactcgcgatacgttcagggggttcacggctaccgatcagggtagccgtttttgcgttttcgagaacagttttaaaattcattgttcaggattgcgccccagttctcacgaaccagatttgacgcttcgttagtgaaggttttcttcgccagcgttggattttcgaactgttccaggaaaggcccgtagttacgttcgatttcttccagcgcgtcctgtaccgtaagccccatcacgcgaccgaaatctttcgcggtgagattcgcgctgtcaatttttgacagaacatttttcacacggttttcagtcaggaagcaggtgaattcgttcagcttcactttgtctgtttctgacagttcagaaggagcattgaagcggttcgcttgcttgttcttcttctctgtgaacttcgtcgttttgcatttgattgcaacgcgttcaccgtttggcatgaaagcgggttgaacaggcttcatcacgaaaccttctgcgatgttctcaccttcaccatctttcagcgtcatgaagtttttgaactcaggttcaacgccgttctttgcagggatcgcaccggagttcgccaggttaaccaccgaatcaaaggtgataggcaatgcgcggatctcgtcaaacgtaccgtatgccagcagtggagccattttcaggccaacagcaacagcgtaatttgcaacaacgttatcagggaggaactgaccattgacgcggatatcaaatacgtagaaatctttttctccgtagtcaacatctttctgtacaccacgccccgcgaattcgccgtatacctggatcaccagttcatcgctatactcaccgcttaactgacgcgcagtagagatcatttcccacatcttacgaacaggttcggagtatttcgcaactacgggttcgcaaccgtagaactgttcagcagggagaatttcaccgctacgttttgccggaatgactttgataccgtccgaagtgatcaggctaaagttagccccgtggatcttttcacgcgctacccacacgccaccagtcaaaccattcatgatcacaccattgatgaatttaccttcataatggttagtcagagaagaatatttcacaaacataattaacccttgattttcagttgtttttcaatttgatacgcagctttgcgtaacagtttcagttttacttctggaaggatcacagaacccttcataaacgcatcgagatttgatttctcgctattcgcggcgctggttactgcgatcgtgttttcaaccgtgtatcccagagaagcgttgattcgttccattgttcgggagtcagagcaaccgcctttgttgctaaacggtctgccggagtaagaacatacgggttcactcattagcttcgcccagtcgcttaacgtcagagcaaattgaaggttgcggttacgcgcatcatcgtttttactgttgtatgaacgagcgacacgcagatcgaattcaatttgctttgcacggcggcggtgttctaactcagcaggatcgagtgataccatagtttgaactttttccggttctactggctttggttttgcttcaaccttcaccaaatcctttttgatagtcgaagttatcacgcccgaccagcgattcatcattgaagacatataaaccccttacaccaaacccgcttcctggaacgccagcgccatagcgccgttgattgctttacgtttgttatctggacgcggatcgcgtttagctttggtcttaggtttacgctgttcttcacgatgtttgttgatatacacacgacgcagaacatgtttcacttttggattttctgcgcggaaagcacgaattcgctcaatttcctgaacaatcacgtaaatgtcgccgttatcgagcatgtgctcacgggcgatctgtgcatagcccagtttcagatcattgaatttgaaatgaatctgtactttttcctgctggctaacttcgctgatattacgctgaacgattttcatagttactttcctttagtagaatcaattttacgaataaactctaacacttcggcatttctgctgtcaacatttttaagaacaaaagttacaactacatgaacaccggatgcttcgttccaaccatcagcacacgggatcatcagatcatccagagtgttgacaaggttttccatatccgcagggtgatcgacaaacaaagtttgcgtttcggtgatactggctttgaatcgtttcccgatctgtgcttcgagttcgtccagcataccagcagataacgcggcgatgtcgatgtttttcatcccaccatacacaacatgaaatagtttcatatgcaactaacctcattttcatatttttcgcgttcgaaacagtcgggttcgttccagatctggtcaaactcacgtttcgtcatgatatagccacgggcgattttgcgagttagatctgaaccgatcggagcataccacaaaatcaatttacacaccattccctgaaccagacaatcatacagccctttttccagggtgcgtacatctgttacgctatcgactaaatcgggggcacttcgttcaggatggtctttccactgactttcgatgatgtcgtttagttccctgtgaaaataaatccacgattggaacgatgcatcaggcggatttgacttgcaaccagcaggataaaattcaagcattttgatcagcctcattcgcaatacagatcgccataaaggtaaacataacccccaacgcaaccatccagatcgcggttaaatccccatacaaagaagaataaccacccatcacttcaacgcgatatcccagcaagaaaacgagatacgctaacaccttatctttcataattcctcacagaaagcccatgcagcatgataaacgcttgcgcctttgtcatcgttcatgcataccacatctaccggacacacaacccgatacagtaccggatcaccacctattgaacgtgcagcccttccagcatagatacgagccagcccgatatcagcagtgaagaaaacacgatccagatttttctttctgcctttttcagacagagtatcagaatcacaaggaggcaacaacatgctttcgattccggcagcagtacatgatccgtgatagaactcaacgaactctttgcggcagtgaatggtattcatggttatctccttgttttcagagattacagcttatcgctattcgcccgacaagtcaacaaattctttttcaacgtcttcttttgttctgaacaggtaatcagtaaggctacctgtcatcaattcgcgagttttagcaactgaacgaacacggcgttcacgttggctttcggcatcaccaattccgtgacctggttcccacccttccatatccaacataatgcgcgggtgcatcatcacacgaatatcgtttccatatgaatagctgttatattgcccgaatacaaatcttttgaatttttcgtggtgaacatcatcaacttcgacctgttctccgtagtaaacaatttcatcacagaacgcagaaagaacaagcccaccagagttttgaattttcaggattgcatggatcatgcggtgacgtgcttctgcaattatatcatgagagccaaatccaatctcttttgtcccgaagcgacagaaaatagaataggtgatgttcagcaggtatttcgcgacgatttgccattcattatagataggattgggattgacacggtatgctgatttatattcgcgacgcagttgaagaagtgtttctatgactttagcaacactccacccgttcggataagtcgaatcgttgcgtttagcaacagcaattgttgaatttgcgtataagtggttgaaagacattacgcggacgttatcgacgtaaccacgatcgcgagcactccatttgaagtaatcccattttggatcacaatctggacgcatagacggggtatgccagcgcttgaaccccaagagattacagaaatcgtcaattagggtatcgcgacgggatttatattttgactggtcgccaagagcagcggcgttgatgaattcatgcagttcatttttcataattgttaccttatggttaaagttcttccggcttatccgtcgaacaattgcactataaacgcactcataaaccgtgtcaataaatacttttaaataaacacctggagttctaagatgaaatcattcaaagactttacgagccttgatgaagcgctgatcaccttcggcggtaaggcttatcctaaatttggtcaggtagtcatcctggctggcggtgcgggttctggtaaagggttcaccctcgaaaagctgttaggcatcgaagggatcaccctggacgttgacgcactcaaaaaattggtcatgggtagtaccaaactggcagcagagatcaaagcgaaaactggtcacgatgtcaaaacaatgaacctgaaaaacccggacaacgtagcaacactgcatcatgtgatcgcagacgtgttcaacgtatccaacaaaaaccaggcgcgtgtgtacgctggtatcacagcagcaccggaagaccgtaaaccaaacctgatctttgacgtaaccctgaaaagcatgagcaagctggcaagtatcgcccgtgatgttgaagcgctgggttatcagaaagaaaacatccatatcgtttgggttatgaacgatgttcatattgctatgcagcagaaccttaaacgcgatcgtgtagtgcctaaagaaatcctcatggatacccacgaaggggcagcgctcactatggcgaagatcctgaatatgggcgactctctgaaacagtacatggacggcgatatctggatcagcttcaacaaagtaggcatcgacagcgaaatcaagaaatctgacaaaggcggtatgtttgttgttaagtctaactacatcaaagttaaggcaaaaggcaagccgcaaaaatccattgaccagcttgataaagagttagtggctaaagttgcagcatacgcaccgaaaactgatacatggggttgacaataggaacatatatgaatatgatgcacacacaaaccgaggaattgatatgaaaaagtttttgttcgatatggatggtgtactgttcaactgggaaggttcttttacggagacccggcgagaatgccggaagaagaattgaaaaaagcgaaacaggctatatcacaaactgacttctacgaaaatctggaaccattacaagagggcatcgacctgttctgtcatttgagaactttaggtcaggttgcgatcttaaccagcgtagggaaatacaattccgatgcggtagcagaacaaaaaagaaaagcgttgatgaaggtgttcggttatctgcctgaattccactacaccaaaagcagcggagagaaagcagcatatgcggacaaaggtatactgattgatgacagggcaaaagctgtgttgccattcagaaaagccggaggtaaagcgattctcttcgttggtagcaaagaagaagcattgaaagaaatcagaaaaattgcataaaagaaagggaaccattgcggttcccttttttgtttatggtgtgtaatccgcaaaggagcggttcacatcctgaatagtgatgttcatatcgtcgttcaggaaaacactacgatatttccctgcgctatcccatgcttgacgatgcttatcattgcgggagatcagagggcaacggtaagcgtgggctttcagttcgttcagatcccgacaagtccagaagtctaaacgtacaatacccatctgtgcgcatactttatccatgtacgcgattttttgactattcacccaggacgggctttttgcttcgttgacgagaataaaaccgacttcgcgatcgcgataggtcatgccccatttcatcatatcccaacccaacacctcgatcgccagtttttcatagaaatctgtacgaaccagggacgatacagcagcttcatattctgcatctgtcatgttttgtgggcgtttgccaaatttggcttcgattgcgtcgctgaattttgcgaatacatcattgaattcaaatagtagcatttttaccttcttagttgttattatggtgcaggtttaacgtttaccgtcagagttgcagtaacagatccagaggttgctgttacgacaacatcaccttcactaaccgcatgaagtttaccaccaacgatagaaccatgaccggaagagtcaacactcagagtcatttctgtaccagaaggatcgatggtaaacagatcagttgcagccagatccgcatcacctactttgaaatcagcaggagcggtttttggtgtaattgttacgacaggatcagcaggagtaaaatcactcagcttatacagataaccgttacgagattcgatgaaatcaacatcggtgtaatcaatatacgcctgtttcagtgtgtcgaattctttcgcatatttttcttcggcataatcacgccagtcttcgcttgcagcattcgcagccacgatgatatcaaagatccaccacggcagataggtaaagctggtgttacgccacgggatcgggtgtaccgtagtccatttttctgtagccattttcaaaacctcttagtttttctctatttagagaagtaaaattttgccgtcacaagacggacatttatcatattggttcacgcgcccatagccgttgcattcaggacagaacgggtttgttacacagaacacattacggatcgcgtaagtggattgttcttctgtcagccctacgaacccatcggtattgatgaaatgttcactctgttccggcagcatatcggtatcgtcatcaaggataaggtaattcttacatccgaaggtgtcgatccatgctttgatttcatcaccgcgtcctgcttgtcggtctgttagattcgtacaggttttcccaatgatacgatacaatccccacgggtagaagatttcccgtagagtatgggttgtgttgccgatcctccatgtagaggaaatgacaatatcacagttcgcatgatttacgatccggcgcaggtgtcgagcacattcaatgtccatatgctcaccaaatttcatgcaccgcatattatttagaacgccgtcgatatcaaggaagatgacgtttccgatctctttaccttctgataagtctttcaggcattcgtgatttaattcagtcatattttacctacaaaaaagggggctacgccccctttgaattttaatagaaaccgcgagcttcgttatccaggcgacggtctgcaatcatgtgcgcttccatttggcgagaaacataatcaggatcgcattccatttttgcttcttcgtagttgtcccaggtatcagcaacccattttgaaccgttccaacgagcataaccaggttcagcagggacaggataatcagcttcgtaagcgtggcgcagtgcttcttcaacagtatagtaaggagcatttgaattgactactttcttcactttaccatcagcccaaacaaacagaactgggtaataagcgtttttcatcatttcgtttttcattttgctttccttcttcactgcgagagccattcccccgccttcgagtacaaatatactttaaacgagggtatgcgtcaacaagttttttagcaaaaagtgctaaaacttaaatgtttcgaatcggctatttctggtttcgcgaacacgaacttcaccatcgcgcacgatatagaacgcaagtgatttgattgtgtcgattgcgcttgcatgtggacagctatcaggatctttgtaccagtctggggtttgtttaatccagtcatagatccaccacggacaggtataatacccgttagaactcgcagagcgccccatcatgaagattgtcgggctaaacccttccaaccataccagttcgcctttggactcgtcagaagcgcttacaggagcttctacgacatcaggtactaattggatttgatcggctacttccggcgcgacctctttaacgtactccataaaatccgcagaagcatcaataaccacatcgggaacgttcggggcttcgatgacaggttcacccatagtcacctcacctttatatgcaacgatttccggttcaggggaatcgatcagcagttccggtttttcttcatcttccggtaaagcagcaaccagatccgccagcatgttatcgaaggatttttgtttgttcagcttaacagcaaacacagtcattgcgtaatcagctaacgcgcctttctgttcttttgcgtcgagggtacggaacccatcaactttttcgtaatcaatgttcattggtatctccaagtgtttatccaatatttatgacataaatacgtatatactttgtacatagggtaatcatagtggatattgaagtcaaatttttaaacacaagccacgtacagattcaggcagaaccaaacattgtctatgaactgcgtgactatttcagcttccagcccccaggctatcagtatcaggccaaatacaaatatggtggatggaacggttacatttacttgatggactacaacgggaaactcccgtatgggttagcctatctggtatccaaattcgcagaatcacgcgggtattcaatctgggttgatccaaagatccacgaaacagaggatatcacgcaagaagattttgataagtgggttagcgaacatccggtttatgacggcgacaaacagatcgacccgtactggtatcaacgcgaatcagtgttccacggtatcaaaaaccgtcgcggtgttctgaacctgccaacatcagcaggtaaatctctgattcaggggcttatctctcgttggtgtctggaacattacagcgggaaagtgttgatcatcgttccgactaccgcacttgttgaccaaatgatcgaggacatcgcaaactatcgtttgttcccgaaatcggcaatgctgggtatccgttccggtacagcgaaaaacagtaatgcactgatttacgtttctacctggcaatcagcggttaaaatgcctgccgaatggttccaacagttcatgtgtttgatggttgatgaatgccacctctcaacaggcatgagcatcaaaaagattatcgacacgatggatcaatgtatcttcaaactgggtttatccggttccctgaaagaagggaaaacgaacatgatgcaatacatcggtgcgttcggcaaagtctttaaaccagttgatacgcgtcgtttgatggatgatggacaagtcaccaacctgaaaattaacacgatcttccttcgatacaaagaagaagaggtcaaaaaattgaagggtgcggactaccagacggaaatcaagtacgtaaccagccacacacggcgcaacgcgtggattctaaaattagcgctcaaattagcccgtgagaagaacgaaaacgcctttgtgatgttccggtacaaagagcacggaaaatggctgtacgagcagttgagcaaggtttacgataacgtggtgttggtcaatggtgatacagacattgacgatcgtaacgaaatgaagaaaatcgcggaatcgacgaaaggtttaatcgtcatcggttcgatcggggtactgagtacgggtatctcaatcaagaacctacaccacatcatttttgcgcacccttgcaaatctgctgttgtggtgaaacagtctatcggtcgtgtacttcgtaagcacggatcgaaagcgctcgctactgtatgggatatcgttgataacctggctacgctgtcaaagtctaagacagccaaaaataaatacagtgcgacaaactacggtatgaaacatgctatggaacgtgtgcggatctacaatgaagaacgattcgactacgcgatcaaacaggtagaaatttaagaggccaaaatgaaaagttttactacattcgtaaacgaagcagcgattgatgatttcatgaataaggttgcttcgtgccggacactagaaggtttgaaagaacttgaaaagtattacaacacccgcgtgaaagaagtcgaggttgcagcatccgatgacatttcaatgcgtgacgcgatcaagggacggcgagaagaactgaaagccgaacttgaaaccggagaagaagagaagttttaaaaagaaagccccaaccgaaaggaaggggctttttaatttcggaaaccgtttgttccgacacgtacatttattttatttcagtgctgtactattctgaattacaattaactggcctttactcgaaggtatcttaccaatcaccccaccgaaagtaaattctatcggacggcgcaaatgggtacgccacacggtaagcccaagccccacaaggggtacacatctatttactgctataaatctgggcgttcgtcttcgatacaaccgctttcaaacgaaattcgaagtgcatgaaccctggtcacacattcttccatcaatcccagcaaacgaaatacttcgttaaagtcgatttttgaatagtctttcatattcacacctacagcaacatttgaacttcgttcagatcgtcggcttcattgataccgcgatcattcctttcgttgagatattgcaaacatacgacaccgcagatcgggccagcttcattgacaaacgccgtattacgggagttcatcggttgtttgcacacaacgcatttgcaatcaaattcttctgccattttatgcaccactctcaagtttacggatctccaacatgtttttgatggagtagcctttgttcttaacgatatccagcgcttttccggtaaactctgcaatcagttcgaagtattggatcagcttgttaacttcaacggtcttaggatcaccggagatagcaattttgatttcacccgaaccagtgtaaatgacatcggtcatttcgctttcgtgtctaccagtgtagaacagtaaccgatcttttacaatcgcttctttcttcgcctggagttgaataagttttttcttagcattcgaatggtatcgaagccattttgaccaaatcttcggaatgtctgctgattcgctttgtaacttcaacggatcaatacgcatatcctcttcaagttcagcctgtagatcttcaagttttagttcagccatgtatcacctcaaaacaaagtaacattataaccagttagatcaagaagtcaaatctacgagcgaagcgagtacatgaacgaacgtagtgagtgaatgttggttaaaaagtatacggaaatgtactgttttctctatatataaaatataaatattataaacagtacatcgtacttacccatcactcacttcgttcgtgaaaactcgcttcgctcgtttgaccttatagatctttattactataatggtcttctcaaaacaaaacttgttaacccagtttaggtaacttaatacctacgatctgactcagcttagatttacctgcaagagcagaccaatcatcacctttgatcaggtgatcggattcgctttctgctgtgtatgggttcacggaaagaccgtaacgcatcagaatagcaactttcggttgcagggatgccggatctacggatactttgattgaacctgcttcatcagcttcggtatacggagcgaagaacagagagcctacgtgatccatatcacccagatcatatttgcaaccagtcagcatataatcgaacgggctgttggtgtctgtatagacataataaccgttgttcagcttacctgttgccagtgggtgttgttcgtcggtttcgtgcatccaaccagacgcagccagaatgcctacaacacgcgctgttgcgaggacgtaggtagcatcaaatgaagtcgttctattcatttcctgccccatttcacacgctaattggtacaggatacgacccaatgctggagcatccttcgcggtgtatgcggtagtaccgtcaaaaataccatccgtaacgagtccatcaacgttgtaacgtttggaaacggtgatcagtgtttgaataatgtctttgttgacttcttcacttgccacggttcccaggatgtcttcgatcaccccatcagcttcgaactggttcgcttccaaatcctgcatcagttcaaccgtcatttcggttttaaacttacgcgagcgtaccggaatattccagcgatccatctggaaggaggttgacgcgatatcttcgctggtttcatacttagaagtatcagcggcttcgctaaccagtcgaattttgctttggaacacagctttcatgatcgcggtgtctttgtcggtatccagagtgttcagggtaatcggttcgataacctcataaacaacgtcagtaccatcatgcttgaacaaatcacctttaacgtaggctttagtcagatcgatttcgtcgatgtctgtacgtccagagattcggcctgaataggttgcagcactggagaaagtcatatcaccgttagggttgcgatagcgaacaccgaacagtgttgcaacagggagttctgtttcttgtacagcaaccagttcatgatagatcaggttgttaaccgcgcgagtcaaagaaaccagttctgggcgcgtgttctgtacgttgatgtcggtcgtgcctgttgcttcgttgataactttttctcgtttaccagacggaagcgaagactgacgcatcaacttgtgaattgtgtagtgtttatcactcatttctttggttcctgaattagagggctttttacctgtatctatttacaccaacaaaaaaggcaacccgtaggttgccttttagtgtaaagtcgattacagacctttaacccagaccttacggaagtatgcgtttttaccgcacatttctttgctgatcataccagaggtgatacgatctgccggagcctgagagcgagagttcgcaaacgggttgatgccgataccgtaacgagttttgaagcccattactggctggaagttcttaggatcagaaccacgcagcggagtcagcgcaacgtatggagcgtagtagataccagcatccatttcgttatcacccttgtagcccacggtgaagtaatcctggcgagcgtactggtcgatgtacactttgtaagtgccacccagtacaccagcgaataccgctttagtggtgtctacgttcagagttttctggagaccctgacctgccggagtgatgccgctgtcgatacgagccagagcggaaaccacgttacgggaagcgatgatgaagttaccagcaccacgaccagtttgacgcgcgatttcgttcgcttctttgtcgatctgaatcagcagagctttatagctttcaccagcccaacgagcgccgcgaatatctactggatcttggaagtcaaacgcaccagctttagagcctacggtctgggtgaaaccagttttaccaatctgcgcggtgtagttgatcaggtcaacgatttcgcggttgatttccagcatgatttcagttgccaggattgcagacagttcggcgtcagcgtccataccgtgtacagcacgaagatcctgtgccagttcaacggaatactgtgctttcagttgacggctacgagcttcgataacctgtttgtcgatacggaaagccatttcgttccacgggttagcgctggaaccgttgaagttttcctggagttctgctacgctggtagccataccttcggaaatttcagccagagtgcctttctcgttttctgcgattacagcagcatccagagcagcagcatcagcaccagttacggttacgttgccggaggttacgttctggaagtacgcgacaccagtttcctggaatacgtgcttaacgatagcgccggaagcgatagcaacaccagttgcgatagcagcaaacgcggtgtttgcaccttcaccagaatacatggtgtctggagcgaacatcggatggaatgcttcacgaacgtttgcaggagtaccgccagccagaggatctttaccgtatacagcacggagtgcgaacacctgaccagtagggccagtcataggctgaacaccgcaaatgtcgaatgcgatcaggttaggaatcgcacggcgaaccataccgattacagcagggccgatgttggtgattgcaccgctggatttaccagaggcaatgttggttgcgtcgtaaccgtggtcacccgcgatctctgcttccgccaggaaaccgccgaaggattcaatgattttttcgtcgcgatatactggatcagtatcagcatccttttcctgagtttccagaattgctgcaaccagttgttttttggatttggtagcgatatccggtaaaccttcctgagattccagaagatcgttccatttttccatcaattcgtttttcttagacattgtttcttaccttataagattaggaaagggctttagccgcttgtacatatttattgatcttcgatttctctgctggaggtgtattttcattcaccggaacaaagtcatctttagtggttgtctgagtagtggtactctcttcaacctgtttttccgctttagtcgctaccatttcaacgattgcggtcagtttggattcgaacttgtcggaatattccaaaccttcgatcaggttctgaaccttttcaatttgcgattcagtcagatcttttgttttttctgaaacgatggtatcgcgtttcatgttggcgatctctttagcctgagcctgattagcttcgaacaggcgtttaacttcctgctgattctcggtcagttcatcttcgagttctgcaacaacatcaacctgcgcttctgggataactacgttgtgttcaacgaacagttctttcattcccattaccagagattcgaacagatcggccttgatatcacgggacacagcttctttgttttcagagagccattcctgcgcgatgtggtcgaagtatttattcgcatcttcgtacagtttattttcgatttcgccagctttttcggcaacctgggcttcaaccagttcatcggagcgttccgcgatctgggcgatgtgggtttcagcgagtttcgcagcacctgcttttacagcttgttcgaatacagtggtgaagtttgctttcgcatcatcagaaagttcaactgattcgaaaatgctgtctaactcaactggggtatccaggttctgggcttctgccaacagttgttctttaagcatttctaagtttcctgtttgatatgatattatttatatagacttttcaaacgttcagagagttttctgaaagcgtcatcatcagcactattattctcaacaagcgttttgcttgactgagattcggtaatcggcttaacgtaagcatctggagcacttggcccccaaacaacatcaacgcctaccgccaatttaaacccttcttgtacgataccgtaaccttttccagaatcggaaagtttacccagtccgcgagaagaaacacctggaacccaacctgcgcgaattaacgccgcgagtttatccccatcaccgttatcaccttcgacaacaacagcgcgaccccaaacgtcattacctttccaccataatttttcaattaggatgcaagcattacgcggatcgacattcggtcgcggcgggtgattcatttcacccagagcttgacgggtattaacctgagttctgatataatcgtttactgcttcttctaatacttttttcggatacagtcgcttattgctgttaactttttcggcctggaggaaaataccttcaatccgaagtttaccgtctttttttgactcaccgaccgattctaaaattgaatcggaaatatccgcacaaggtaaaccccattcctcgattagcagcatatcgccgttttcattgagttgggattcattcatatttatagccctaatgcggcgcgtttacggagcgcttttttacgcttacgctgtgcgcgggttgtaatagaagggtttgcacgttttgtttttagcgcacgacgcgcaatttggcgacgttgagatttagttaaaccagttgtttgatacgcattacgttcacgggttttacggtcttttttacgttccacattaccgcgcgaatctacgtgtttaacaatgacttcatctaaactcaaaccctcgacaatggacatcatagccagggctaaatgaggttcattgaccgccaaattttcgatgatcttcacagtgccgtcatcgatccccagaacatcaacacgggctttcgcttcggttaaatggggttcgagatcttcgacgctgatttcttcgagttcgagttgcattatttacacctcttattcgtctttatcgtcgtcttttttatcagacggctttttgtctttgtcgtcgcctttatcatcgccgcctttgtcgtcgtcatcgtcatcgctgtcgtcatcgtcggtttcaccttcgatgcgtacagcttccgcgagttcaacgcgcatttcttggcgaagggcttcggtacggtcttccatgatggaatagaattgcttcttcgcttccaccagatcaccgcttttgattgcttcgataaattctttcatcaaaagttttcctcttcctcttcgggatttttgaaccgttcttctttggattcttcttcgatcagcttcgcttgttcgtcaatgtcttcatcagacattcgaagaatctctttcatgatgtatttatgggagacatatttcccaactacaccttcaacctgtgacatcaacgttaggcgacgttccataatctcaatatctttcacttccgcgtaatatgaatcctgctggaaaatgaaggaaattttactaacgttttcttcccattcttcctctgtgatgatttttttcgcgatcaggttagtttttaacggatcggaaagcacagggctgaactgaatttgcagtgtgcggataaacttactgaatttcagttcatcacgggtgatttcaccacccccaccaatttgcatacccccatcatcgcgaggcatacggcttaatggcacacgcagtgcttcatagagcttacggttaaaccatttgatatcatccatatcagagaagttcgcaccgcctggaagcgtgtctacttcggtgatagctttaccgtcacgacgcattaaccagtaatcttctgtcattgacaggttgttttgctggttcttaacagtacccgttttagcatcgtacacaacgcggtttttaagcccctgtgcgatgttatttacgtactgtgtcgctttgttgccacccatctgacctacatcgatgtagaacacacggcgttcaggtgcgcgggtgatacggtagatgaccatcgcatcttccagtaaacgcaattggtttgctggcttgactgcgcggtgcagatatccgataatgttgttactgcaatcttccagaccagaatgcgcatacacgatagcggagcgcgggattttaaccttctggttatgctggtagatctgtccgttgtatgtatagccatttttaggagcgctatacacgaaaaattcgcgataaccacggaatactttcacgccaccatcgagggtttcagtgatagattcgcggatcagttccatcgaacgcggatcgagttgacgcagttcgcggatacctttgctttcgtctttatgcatgattttatggaagtagatacgggaatccacataccaatcacggaacagacgcgcacccatgttatcaaaatcatagatatttagaacgttatcaaattcttctacgattttgtcctggatcgccttactaaaatctgttttggcaagatccaaagtaatgatatctttgccctgttcattcacgatagcatcgtcaataatttcagaaacagcgttttctacttctgggtaagacatgataccgcgatatgtattgattaattgttctttgttctgaatcgccggatcttgtccagaataaaactgctggaatacgcttgcgtatttctgattagtcagatcagtttcgatttcataagcaccatcattatttttaggaggcgcgaccgaacctgtatcattttttaattgctgttcaagatctaattcgtcctcacgggcgaaattcttgaaaaagctaagtacattgccaaagcccaaaaagttcatagtaactccgaaaaataatgataggggtattgctacccctgtatttatagcctttattcccaccagtccagcgcgaaagtaacctcaaaggttgacacttcgttgttgctgtcccagtccagggtaacttcgcctacgttagtagggaaaagaccgtgaatggtatgttcggcggtaatttcatcgttacggtttttctgtttcaccgtagcggtttttttgtagttcgctggaatatcaccactaatctgatcgcccattccgtgcatcatgtttgaccatgctaccagagcgtcacgcgtattatgcgcgtcatcgttatagatcgtgattgtccagtcatcataggtacggtcaccagcaacgttgattttgcggttttggtatcctaccggaactttttcaactgtagccgctggcatggttgccgctttacacttgaatttaaagtttttgcccagatacgggatctctacttcgaacaggttcggacgtgcgaaatcaccggattcaaaggcgcgtaaaatgtcagtaagcatttttaacctcggattatttatgggggcttttcagcccccttgacgttatacggcttgtggccctaccagttcatcgaaatctgcgcccgtagacgttgctacgaagttcagagtgatgtagttgatagaacgaggcggtttcacgtagatcgttgctacaaactcgttacggtcgattacgtccggcgtgttgttcgtggtgtcgcagattacacggtaatcgtagcaaccacccagcgcacgaatattagtcatgtactgacctgtatccatacggaacgaagaacgggtgaaatcgtcgttgttttcaaacagtttgtatttcgcgttatcaccgatgtctttcttgatcatgttgaacaagcgacgaacgttgatacggtcaaatggactcggtacgttagtcagtgttttatcaccgaacagaacgaagccggaaccacccgcgaaaccagttaccgggttaatctgaacctgatacattgcgtcacgatgtgctgtgcgcggttcgatagccagtttgatacagttgcggatctgaccacggttgtaacctgctggagacatccacggttgagcaacgctatcagtgtaaacacacaggccagcgatatcacctgccagcggaacccaacggttcacgtcattgtatttatcatactgatatttatagttaccatccaggaagccataacttgaacttacgttcaggttattgtcaaccggagtaccaccactgagtttatatccagtacgccattcaatgatgttatcaaccgctgttgccagtggaatattcaccatcagagagcgcggaggcgacacaaacacagtacaatcctgacgttcatcaccgatagagataacgtgtttctggacggtagacatgatctctacagtttcaccagcacacgcaccagcaatcagcagaggtacatgcagcgcttcacgatcagcgaacatatcccaaccagtcatcagttcatcagcgcctacagtgtcgtttgaggacaaaccaccgccgaactcaaggataccggagaagcctttaggccagttcagggaagtaccgtaaacgtactgagagccaccgttagcgaaaaagtcatccatgaagatgtttacgccgtagatatctttatcggtcttctcagttgacacgatgaaggattcctgtacaatgccaccacgacgcacaacaaaagcgtactggttgtcggtctgtggcccgtaggtcattacagaacgaccgctattcttaacggaaaccccagaagggtagcctgaaatcatagcgccagaatcgtaagcagctttggagataatctccacctgaacagttgaacccagttcaccaggatacagagccacgacagacgggatctgatatttctgggtaagagtctggaatgcggttccctgaattgtttcttttgcaatatccaggttcaacagagtgatccctgaatcgctttcgatgccgtcaatcgtaatagacgcagaaacaccggaagactgagaaacaatttcggtagtccagccagtagaaatatctgggtaagtgccaatctgtttagcacgggcaacgattttttcgcttgggatgattaccgcgaggatcttgccgttactgtcaacttcggacactttaccgttttcttctacaacaacgctgttgtattttactttaattacatcgtttacagtgtagttagaaccctgtgatgcgatagttgttttgatctggttgaaaattgcgcttgcgtttttagcggcatctttatcgacaacgcgaaccacacggagatcattaccgtactgcaagaagttaacagcactcatgaaatagtcagcggtcaagttgtctggggaaccaaaatagtttaccatttcgacttcgttagaaatctgacggatctgataagctggcccccatgaaaatttaccgacaatggcagcgcgaccagttgaatttcgaacaacggtagattgtaccgatgtttctttggtttcaatacctggagattgtaaagccattatagaatttcctctaatttatataaacgaaataccgtgagaaccaaccgaaatcgtttcatcaccgcttgtaacgataaccggacataatgcgtcttcgtatagctgttcgcgttcccgtgcaaaaacttcattggctagtcttaaatcgtctttctcgcagaattcggcaaatttcatttgagttgtaagccaaccgaaacaagcaagcgacataacgaggtcatcgtgatatccttcttccgcagcccacgaaacgcctttttctgagaaagtacgaaattcgagtattgtctttttgttatttatgatcaatttatctttctcgatcaggtctttcagcgtcgaacatcccatagcttttgatcgcttagtctgtttcatacccagatcgttgtagctgtcacaaataacattctcatattccagttcggaaaacagagatttggcaactgaatgccctgtgctatttagctcaatgtaaatccatgcctcgttatacatattcagataacgtaacaggatatccggcaaaataagatgcgacgttttgtttgagtgatacaccgcaacctgttcaaatggcatcgtcgtaatgtcgatgatatgcattgcatggtaatcctgtccgcgaccttccgctggatcaagtaccgcaacatatttatgcccctctactggacgtttatactgatagaagttcgtttccgtttcatcaatatcaatccatgtgagttttgacaacttccagccagcgatcagggttccactggttcccatgaattccgcgcagtgttcctgcaaaaatgcctctttgctggagccagcgatcatcttcgcagaccacgaataaccgtcatcaaatgtaccgttgtcgccgtctgtatacaatcgctctttaaccgatgtccagatcgccgtgtaaggcacgaaaccggattttccttctatagcagcgttccagatatcatagaagtggttaagcccgttaggtgtcgttgtgataaggattttcgatttacgaccagaagagattactggttgaatcgctaaccacgcatcaacaaagttcgggataaacgcgcattcgtcgatgtagatcatcgcgaaggagttaccacgcactgcatcgggagaagatgcaaacgcaccaattttacatttgttgtcaagttcaatagaacctttgttccattcaacaataccaggctgcaagaagtcgggtagtagttcgatcgcctgtttggtacgatccagaacttccgcagacatcgaggctttgtgagccagcacaccaacatatttatcttcgttgaaacacacgaagtgagccaggaagattgcaacaacggttgttttacccaactgacgcgacaggttacaggcaaccatacggtttttgtgcatttcgatcagcatttcgcgctgatagtcacgcaactgaaccttgattgtaccatagtcaatgtgggtgatcgcacaatatgtttcagcaaaataaacgatatcatcacgacatttcacccactccatcaacatttgttgcgtccatttagtctggatatacgcacgtttcaggtttgggttgccgttatatcgggttttcttgttgcctttatttttgtacgtggcaaagttcgaactgtccttagactgaatatcgaccttttgaatgccgttaattttcaggtagtcactgaacgttgtcggataccattttttatcgtgttcgctttgtgtccactccatccccaattcatcaattttctttttcagatatttgggatgcattaatccgatagggtgatctgattccttactcggatcgatcgtcggttccatttccatcagggtttacctctacagcttcaccattaatgaagccctctttgggttcatatgcactgccgtatttctgcatcagttccgtaggggaaccaacaaatacggttgcattctcgatattcatttcactaccaccactgcccttttcagcacctggttttgtagtctcttccgtaatctcacgcatttctttgtgaatcttcatcaggccaatgtttgaaacgtttaactgattcatcaggcttgtgaatacctcgacgtggcgaggcgattcggagttcttcgcgttgtgtaatgcgatctgcgccatatccatgatcatctgattcatatggtgcgcagtcttacgcgcgagcgtataatcctcttccagatccggtttccggtctgctggatgtgattgaacgtcaaccagttcaagtttttcgtaaacaaccacatcctccccagactcaacgccgccagggagggaatcaatattcagcaattgctgcaaatctaatttttcatccattctcattccctcggcttaggaggttcatcaccagacgggatcggcttatcgtgcgagtacgtctgaatatattcttcgcccgtgtagtcctgcataggcaaatctaccggatcggcttgactatccacggattcgaagttatctttatctaacgggttcatgttagagaagaaatccgtgtaaacggttctgatttcgcctttaacatcagttacaggcgggtacagataaccctgtaattcaaacatgaatgaccactcaacatgacggcgttgtgatgcttcgccctcgaatgtggtatccggcgcaaccgactggagactgattttgatgtctcggtcaactgtgatttcgttcttatgcagttcggtaatcttgcagttgaaatgcggttgaaaatacggcaaaatctgttctgcgatctggaacatatcatcttcatatcgcgtatacacacccagttcgaaaatcagacgatatggcacagggttaaactgtgtgatcgtttttcgtggggttgctaactgtgtcattttttggttgaccgcgatactggttttacggattgcgttatattgcagatccaccagtgataagttcatgcgcggtaaaatcgtttccgttttagcaacgttttcctgactcaacgtgtagttaagtttgttcatggaagcgagaaacttctctttcgatgcataggtgatcggaacctttatgtatttttcttgatcgccgcgtactcttttaacctgaacgtgattaaaaagcgcccccatcaggacgatataattacgcagcgaactattataccaataaccaaacattttattttcctgtatgggttgttgggtatagacttccgcctatacccatataacgtatttatggcagacttgcaaacggtgaaccgcgtccgttgacaacatcaaaagattcgatgaattcatcaccttctctttcaaattctttgtcttcttcgtactgttcaatgttgatatcagccagcccgtcaagatttcggataggttcgagatccagttctgcatcaggttcgatgtggattccttcatttcgctgcaattcaggagccagttcttcacctgtgtagatgaatttcgccaggttgattttgcgttgaggacgatcaccgaactgatagaacggatcggcttctacccacgtaatttcaaacaggctattgtccatagggaaataaaccagatcccccagaacaggaataccaccatcagtttgatgtgcgaacaaacgagggttaattaccagcgtcatttcatcgtttgaactcagaccaaatttactaaagaaatctcgttgtccttcataattggcatatgattcaatatatgcagcaattttccatgacttcgtaaatttggattctcggtcttcgcccaggatcttatcaatattcacgaagtcacgccggacgtaatacatatcaggcgatttcatctggattgattctgctgtcagtgaatcgtgtagctgttgtgtcgggttgtatttgtaccagtttacatacgggttagtgacctgatcctttaagttgcgatcaaccccttcccccgtagacaactgagcgaataaactttcatcccagttttgcattattccccctacaccataatgatcggtactgcgtcatacatagaaatcagttcatcgcgcagactttgcagtttggtttccgcttcctggatcagtcgcgtaccatcaggagcaacaccgccaggcaattgcatcccctggaatttagccagaatttgtccgttgatctctttcaccagtgcggtagagtagtcttttacccagcggttgttatatgcagacgttccgcccgtaacagttgaaccctgtcccgctcgtacaccgcctacaacgctgttatacgggttttcgtagatgtcggctatggattggtcttccactgcgttagaacccgctgtagcgtatcctgcgacgcttcctacggagctagggacatcaacgaaggaacgaaccatcgcttcaataacgataatgtcgcctttgttcacctgcccccatgcgcagaactgaccagtatcatcgttgaaccagtaatcaggcagtggagccagcaggtcttgcattgagcgttgataggacatcatctgggtaaagtagcccatatccgcgccgtatgcgttcataccgtacacactcgatgcacagcgcccacccagagagccaccagtcaaccccatcaggaaatcggtaaaccacggataaaccgctgtaccgtccattgtggtcaatgaacccatgtttgtacgcaacaccttcgtgatcgcgaagatgtgttctttgctcaagtcgaacacgttgcgcgggttatcatcacccagtgtcaaaatcagatacgttttgtttgtgccgttataatgatattctgcatacaggtctaaagcgcgttgaatgcagtcataaatctgatcttgtgtgatttcgattttgatgattggtgcgcccagacgacgaagaatttcatcctttaactgttctggattattcgtaatcatatgatcctcaaaaggggcttgcgccccttgttaaaattatgctaccgtcacagtacattcagcggaggtgatggtcgccggagaagtcgcggaatccgtaacttcaactttgtacacacccgcttctgctactgtagccaggcttgcgccagtttccccagtaacttcaaccgtatctttaaaccatttgtatgtatatggtgttttgccaccagtaacaacaacggctaaatccatattatcgcctgttgtataactcttcgttgccggaagatccgttgtaaacgccagagccggacgagtagttacagtcacagtcgcggttgctgaatcgttggtactgttcatcgcgtcagttacggttacatagtaatcacccgcatctgcgctggttgcagcagacttgacgatagaagaaccagtttcaccactcaatacagatccgtctttatgccatacgtaagtgtacggagttttaccaccgctaaacactacttccagagtcaatggatcaccatcaacaacagaaatatcgctcaagtttgtatcgaactgaggaaccgtatgtaccgcaatgtcaagttcatcagaagtaatcacggtattttcagcgtcggttacgacaactttatatacgccggaatcactcgttgtgatgttctggatcattacactcggtgaatcagtcccgatatttgcggttcctttcttccactggtacacataaggcagtttaccacctgtaacggtaacagataaagaaatatcatcaccctcgatataatcgttacgaccgaccagattttgagtaaatgacagtggaactttcttcgcttcgtatttgttatccgcttcaacttctgtgatatacggaaccagagcatcagcaacatcctggcgagaggctttattctgttccagatcgtccagacgttgttcaacgttaccaccaccgccagcttcgagagcagcaacacgcgcagtcagatcggaaatcagtttataaatccctgtttctgatcctgtagtattaacgccgatcgcagttttgttatcgcgagccgttttctgaataccatctttgaggaatggatcagaactggttgcatcaccataaacagctttacccatcgcgatattagccgcaacgagtccagttgacgtattacccacaattgcggtaacatcaaccagtgcctggtgatcgtcgcgctgtgtgttttccacattcagcagacggcctttgatgcttgttggctgggagtcagtaccgatatcggtcataacctgcgccatttcaccgcgcagaccatcatcacttgtttcaccaacgatcatattcagatcgctaatgctacgtttcattgtgctgatatcgtaacggatactacctggaacctgtgagttaccaacagcgctttccagaaggattacgcgaggcagaacaccaacaaccggatcattcatctgggtttgcagagtagtaatgttcgtttccgcagtttccatgcgggaatcaatactaccagaaccacctgagcctgtacgcccgatataagtgttgatgtttgacagttcggtattaataccagtgatatcgccaccgataccattcagacgaacatacacagattcgaaagtggctaaatgcttcggccccatttcgttacgcagatcggtaacttcatcggttaaattacctacatctgagtttacccagtcatcttccagcttagtaatacgtgcttcatggatagataccgcctgagcgttagccattaccttgtatttcacgccggagccagtagaggacggatcaacatcaccatcttcgttaaagccaggatatgcacccagttcatctttcaggaaaataatatcttttcgaatggtacgatgtttaggatcggttgacgcatcccatacaccaatttccttttcgatatcctgaattttcagggtgttgcttgctgtagttgcctgtacagcagacatatctactttcagcacgtcaacatcagcgacaactttatccagtttgtcgatcacactatcatcagagatcgccgcgaggttttcagtaatgaggttaacctgatcgataacttcgttgatttttgatgtctgggtagttgtatttgcttctaattgtaccgcgttcttttgaaccagaacaccgcatctgtttaaagaaccctcgttagtggttttggtttttgcaccatcgagagtttcgccgttaacaatccaattgatctgggtttgtgtggtgtccgcagggacaccatcaacaaacgggatctttggtaacgggttaagttttgaaatcatggattaacccctttatcgtactcgaattacgtagttgaccgcaaggtttttcattcgcgtttcatttccgccagtacctaatgctttgctgtaatcgttattcaggtgcataacacgttggtcatttttttccgcgcctttcagttcataaactgcttgactcttaggaagattaccgccgttctggtaaatcatctggagatcatgttcgtgatacgcaaacatatcagcctgatatgtaccaaaaccgcgacctgcatccacaccacgcccaccatcaaagccgcgagctacaagaccgcgcatatcaggcaagttgaaaatatcaccagaaccgccgtatgtataaccaattcgggcaaacagttctgggtttgaattgcggttcattgctcgcccgttacagataaacaagttaccaacatcggcgttaaacgctgcaagcatcatacatccgatcgggatatttgcgtcaacatctgtctttgtctggtatttattgtcagcactaatcgaaccctgatacaatgcaccaccagtaattgcactgtttttgttgctcggtactacgttagcaccagcagacaaagcagtattcgctaatccggtattgatatctgttgttaatttaaccataccgaaagtagagccggaacccttcacagcagcgagtttttgcggggtgatcgctttggtgttatcagtacccgcgtttacttctgcctgggtagcgatacggagtaaacctaaatcactttcgcttgcagtcagacgaataaacgtgtatggtgaaatcgcaaacccatcgcgaatagtacccgcgcgaacttctgcaacagttgctaactgaacaagaccaaacgaactttctgttgcgtttgcctgtaccggaaccagagcagagatcgcttgcttcactttaagcggagtcattgcggtagtgtcatcagtaccggatgttgcctgagcagttgttgacagtttcacagaaccccaaacgttttcttttgcatggcgggtgttaaacacatagttcaacgagcgcggagtaagagaaaccagatcgtttgttactgttactgattctgcatcagttgcgtaacgagtgtaaccccatacggtttgtgatgcatgagggttttgcagacggtattccagcaaagcaggagttacgatcgtctgggtatcagtacccgcatcaatcattgcctgtgtcgcaatagcagcaataccgcgcacaccaggcgcggcattaggcaaaccaacatcagtacgcgcccacggcccaatagcggctaatgcctgttgtacgttcttaaacgtgctaggccattgcgtaccagcaggatcaaatgtcacgtaaacggatttatcgcttacgtggttaattgtattgttcatttgttatcctcatgcaatacgcttgaaataataaatcggaactgctggagtaacagcaaggtcaatttcacctaactttgtccatgtaccgtaaccagatttagcctgtacgtcgattgttcctaccatcgaaattccgtattcagttttattagtaaccggatgcggaactgaatcaataaaacgaacttccagaatttccccgttgagacctttacgagtaaccaaatcgaaatatttttcatcgttgacgaattcaacgaatttgttatagactgtctcacatacggtagaggcgttcgttgtattgtcgaaaacgaacgggaaaccataaacgtgaatagtcgcctgtgtttgatctggatctgggtttgaaaccgtcccatcaaacgtaattgattctacctgttgcaccgcagaaggggggctatcttccgtcatcatgattaccccattgatcgggatctgttgagacaaagaatacaggtcatcaattgctgattgtacgttagggtaatctaccccttttcgaagctgatcgacgtttgcaccaccaatagtacgtttaccaccaatcagcggttctttcgtacccatttcatattgcaaaaagtctgcttcacgggaagggactttcgccccctcccttgttttggaaataaactgagtcatttatgctacccttatccagcggtgaacagtaatataaggcgggagcgtttttagtttatctggagtagtgttcccccgatttacttttaatacatcctcgcggtatttagtgtaacctggccctgttgcatctgggtcaacctgacagccaccaataataatgatcccgttgtcatctttaatcaacaccttatcggttgactgaatttgtggaaagttgatcggtttaatttcataaccacgttcgccaccagtaccaccagaagtgtgagttggttgaccggaaccatccagatcgttattgttcagaccaaaatcgctatccgatgcatcggttgtccaacctgcaaggaacataccttccgcgtaacgtgtccagataccaaagcccatataatcgcctgggttagcatcattatgcgcgttttcgtagattgtcccgattgggtgaataacatcaaagaacgcttgcagatccagaagacgaccgctaaatgtatccgctactttacgcgaggttttctgcgttgggttgttataatcggtatattcgatctgattaaccagcgtcacttcttcttcgttgttcaggtaaatcttatcggtgtgttctttaataccgcctacaccgtcccattccattacagtaccgatatcattgttgaaccagcgaatagttaccacatcacgggattccagaggttgagcaaatttaatgccagtaaccacggagtcaacaaaaatcagactgtaatcctgtccagaaggaacccacgcgccggagttcgcaatacagctatcttcatcataaccttctgcgccctcacaaacaaatgtcgggagatccgcatcgcctgctttaacaagctggcgaccgttcagcagcagttcgaacgagttcgggttaatcaaaattcgcggactgataccaaattcagcattagtgaacgtgcgtttgtttggtagatcaccaacccagatttcaccagggatactaacctgttctgtgtctcccgtgttatatacgcgcatggtatgcgcttcatacgtcgctcgccatgcggcaataccatccagataggtaacgaattgaagcgtgtcaccagcgttacacgggtttttaagacggatatttacaccatccagatctaccagttgtccggcgctcgcaccaggtgaaccgtaatcgctgtttgatgaattaaacccgttcttgtcgtcgatgtacagcaagttaccgcgatagtaaacttccagtgcgcggacgttgtacgagttaccagggccgaacacgttcaggaagtcagtttgtccctgagtcgcgatatacgtttctttcgcaacggttgccagatccgaagttgtgattttgtcaacctgtttgttttcaacatattcccaacgtccaggagaacaataaacaagttcaacgtccatcaggtctttgtacagttctttgtaagtcggtgagcctttgatggtatcaccgcttgcagggacgatacggacgttgtttaccgcccacttaccccatacgtcacgtaagcgaataaccttgttataatcgcttacactgcctttagggaggtttaccgtaatacggttgttgctggtattcagcgcccatgattcaccgaaaataggggtcagcgtaggcgctgtgtgcgttttccacgcacccgctgggtgcgggatactcccgtcacccagtttattatataactcggtaaagttggcgttagtcttttgaccaccacgacgcagataatcacctgcgccgtcatcaaccacgttaccgataagaatttcttgtttcatgctgcgatccctgatttaatggtgtcaaccgctttaatcgagaatttaatgcgatcctcggttttggattgtacgtttgcgtaaacaatatcactcgcaccaacagtgaacgtaagcgtgtacatttcatcttcgctatttttgagaactgcgtattcagttgaatacacgcccttagcgacacggtcaacagacaaaagaatttcagccattttattgactgtgcctgtcatattctccgcgtacacgagaattttcgccccactgaattcactataaccaaataaaggaattgcggtcggtgatgctttcagaatgagtttagtagtatctacaggcattgtttttgaaccaaacattgattcaacagaataatcccatgtagtaacggaaccttctttcttcacacaccagattttaatctgagtatatggagaggtcacgtaaagttgatcctgaacccctttgataccatcaccaacttgcggacggaatacaacaggacgatcaacagaaatactaccgttactatttatgaaatagaacccttcgccgggtttacccgatggaagaacaacagtaattggccctgttgaagtatccatatcatgcaatgaacccagttcgatcgggttgcctgaataataagttcgcggtaatttctggaaatatccggtcgcgtggagtaacattgtacccacaccatcattcgcagtcagtaaacgcacatcaccaaacgcgttgtatacgttggtgatgatttcgttaagtttaacaccgccgtcatacagcgggtcaccagttgacgggttgccgatttgccccacgtcaattaattttttaccagtttgatatgccattatggtttccttagaattcgaaaataatactgacttcttcggtctgatcaggagaacgaataatcggttgacggttttccatgtagatcatttgtcctgagtcaagttcaagctgtcctttcgtgtaatactgccccgttgcttttacttctgggtcggatggttgcgcctttttcaacagcggatttacaataacgctgatttgacggaacccacggttgccaggtaaagaggcttgcgggaagaacagggaatccatatacgcgcggaatcgcattgagtgaaccttcattcggtacaccaaatcgtacatatcaggataccatttgatcacgttatcataaccccaacgaaccggatcttcttcaagttcatcagggaacggaacaacgatatgttcatttgtacagcggttgataacaacatctggtggaattgtatacagatattcccagatatagccgtcgcccatgtcgataccgttcgcttccccgcgcggaggttcgatcgattcgtgggtcggtgtccaaatgccaccaatgcgcacacattcaactttacccgtgatactggagattgaacaagatccaatatcaggaacgtctacaacgcggtataccatccatcctttaccgtagtcagtacggttataaggcgcggagtttacaaccacgatgtcattaatgtaaaagatttttgggtttggatatcgagtatcgccccagtctttacgcggaacgattgcatcaatcatttcgcctggtactttcgtcatcccgatcatatgcgtccacatatcaacgataccatctgtatcatcgttcggataagggggagcgaattcagggtcggattcgttatccgcccattgttcggtacgcccgattgacatataaatcgagttatgatcgggggtgtccccgatcatttcgcgaaagttcatcatgttttccgtgcggaacttaccagttacgaccgcacggtagatgttttgttgagccattatgctacctttctctgagtcggtggattcggatcgcgaggattacccgcgtcgtctttcaatcgtttttccactaagttacggaactgagagtatttaaccgctgaactatcgaacagaggactttgatcaaatcgacgcgcggacggcagtacaccattcagcggtttttcatcaatgtcatattgtggcggaacatcaaacggttgtcccgctttcgggtgcgggtcgtacaatgcttcaccagttacaaggtcaaatgtctggtttccgttaccgtccagacgtgctacgcgatcaggccaatacttcggataaccgctatcgaagcgataatttcgaagaatgtcaatgatcgtttcactatgcgtcatagacaaaccggagttgatgaacaccgttagcatggtgatcccgataaagccaaagcctaccggatgcacgaatcgtaaaacgtcatccttataacgggacgctggcagattcgaacgaattttcatcacgtagtaagaacgcccacggttgaagtagtcgatcgagttgttcgccatttgcttaccacgcacaccacgcagaatagtacctgtgaagttagtcttttcagacttgacaacctgcccttcaaggaagttaccgatcacgttgtgcagcgttaccgaccaacgtaattgaccgtcatcatactggcgttcgatatacgtcacgtttgctctcgctgttggtgtgtaaatcgtccggcctacaatgtcctggttgatatttgttgaatgaaccagaatatcatattccagagtgttcgaactttcgatttctacacttacatcttcgttatacaacagtttgaacaggaatttatagcttgcttcgatgcctttcgttgaatagaaatcactacaacgagattcaaagaaacgaaccacctgatcacgcttcgttttatccaggtagatattacggcggtttacttccgaccacagatattctacgctgttcttctcacgcggatatttgttcctgatcaggttcagcagcttgttatagtaggtgttttcacccagcgaaacgaactgcaaatagtattccccgaacttctcgaaatactgctgttccagatagctttgaggcgcaaagcgcgtaatcatatggcttaaatctgggtcaatcaaaccaggtgacagatccggttgatacggtttttcgcgttcctgctgaataagatcggcaatcaataacgtattgtctggtttccagaaaatcgttaagttatcgcgagcgcggtaactcagttcaaagaacccgatgatttcgcctgaactcttatacagcaacacgccgttcgtatactttgtgaatccggtaaacttaatgttgttaatgtaaatcgtaacatgtccgcgatcccatacctctttgttcacacgaagcgatgacgaaggaccagcactatcggttacaaggctgtaggtgattttcggatacaccaccagaggacggttatcattagtgatccatgtgcgcacagagtcgcggaagaaccagctataattcgcctcgttgtaatattcctgcgcaccaaatttccaaacagtcgggtcgtcgatatgagcgcgaatcgtcgcaaagttaatcgcaaggctggcagtatagccaggacgcaaatcatattttacagcaccaaccagtgcagggttctcgatcaacaattcaggatcgggaagtgtgcctggatatttgtagttcgctacggaaataaaaatctccgtgccgttcgttgacatattggtgtattcatgctggatataaaaacgttcttcctcggtgttcccgtacaggcgcacaaaggttttcgtgtcttcttgccattgatacacaccagcagcagcggacggaaccacgttagcgggttttgtaggatcttgcagagcggttttcacttcacccgtaacgagtgcataaagaatcccgttcatcacatccattttcttgacaacgatcttatcatttccagggacaactgtatagcttgctgtatcgaaaatcttttctccgaacgtcggagaactcggatcggtgtcgatcggtgtctgtttcagtgcgatacgacgcacaacgtttttcgcaaccacataaagccagtcatcggaacatgccattgcttctgcatatttcgacacgttaccaggcagtttagcgaatgtgttgtatgagtctacgtcgaaatcaaggccagtctggttccccagtttggcaaacgtaacgtcatcagcagagaatcgcacatcgtccgcagaccagcgaatatccgttgaggtgcgcccgtagaagatacgatcgtaacccagtacataggttgtgtttcggctttggtacgcaatagagcgcgatacagggtttcctacgcggtcgttaaatgctttgtagtaatgccatgtctgccctttgtcgtttgacacctttgccatgttctgaaaacgttcaaacaggtacagcaaaccgtttgacgctaccaggaaagttctgttaatgtcattacaaacgtgttcaatatgatcctggatttcgtgatagttttcttgtgtaagaattttatcgctgatctgggatacgtcagtgtaaagtggagaaaacacaaagtcttctttcatcaacgctgccattaccacatctgtattgaagttaacgtagttctgattgttctttgcgaatttttcgtttatgaatgcatcacttggcgtaaattcacgcattgttgaatatgcgtaggcgttaaggctgaacgtccataattcatctgtataaacccaatcagacggttcaaagcccttgtgcgtaaccatgacgcggaatttataaaaattgtttggctggacatcggaagaaaaccattcattcaaaaaagcgtaacccaactggaaccaggttaaatcttcatctggaatagtaacaccacctgccccgcgagtttctgccatttccacgacatagtaaaaatccatgccgacgctatcccacttcaaataaacgaagttagcagccagtttatcaacgcgcaaactggtaattgacggcgctttaatcattatgtttctccaaatttgcgttacttatatcccatatttagcaaacaaaaaacccctgccggatgacaggggttaaaattattgactgattggattcattgtcaatgttgtatattgaggacggagatcgttttcaaacacaatcagagaaccatcacgggtgaaaatgttctcttccaatggtgtaccagtcagttcgatataagcagcgctgaatcgctcggatggaacgttcaggacacccagatcgaaactaatgaaatcagtgtagtgttccacatagccgacttcgtaatatttattacgatcggtcactccaggatatttatcaaaatcggttcctgtataggctgcgatactgatatcaccgtttttgaatggcccgataacaatttttgcacgtccggttgtggtgttcatatcggttgatgcataacgcacatcatacgaatcaccagcagcgtttgtgtatttgaacccgttcgaaacaacagaacgtgatttcacctggtttaagaagtgaataccagacatcggagcgctgtaatagttatcaagttcacgcaatagctgaatagtcgcagaagaaccaatgatcgacacgtccgcgttatcaacataggttaacattttggacttactgaatgatttgttgaaaatttcaacgttatcagtataatatctgtcaacctcattgattacttgaccacgcaaccattcctctgattcaaccaacttactgatatcatacgttactttgatactttgtacgatgtacagatagttcgggtcaaggatcgacggcgtaatcgtcgcaaggttatacttcgccagatagttttgcatatcctctttttgaacagaggtcaaacgcaaccctgatttcggtttaaccgcgatgaacgcatagccaggtttttctttatcagtaaagcactgaaccgcctgaataacagaaccgaaacggtgagacaagaacgattcataatccgatgcagtaacacaacggcgctgtgtctcacgcatgataggcgcgagttcgcgaatacgttcgatatcttccggttcaccaccaccatcagcgcctacatagtccgctgaattagtcgggttctcaacaatactcgtaatgctaatgtttgtcaacgtatccacgtaaacaaagttttcagcaccgtttgcttcttcgccgttggttgaaatatattcaataacaacggttgaaccgtttgcaggtttcaagcccccgatgtaatcagcagtcagagcaccacccgcgacctgttggctggtttcaccttcaccaaagtaaacttcggtatgtccatcaacagtttcacgcatatagaaaacagttgatgcacccgttgcgtttacgatactttcgtttgtccagtcatcccattgtgcgccgttgacggtaacacgaacctggctacggtcgatgtttggatcacggatcaggatagtcgaaccatcaaagatgacttcggtacggactaaacgcccctgaacgatgttcaacatcgaaacatagttattgtttttgtcacgaacgatcaccacgtcatcggatacgacgaacgggaaactgtttgtttctttcactgtaccgatgaatttcgtaccgcgtggaatacggatcgatgttgggttcagtgggtttttcgcagtgatcaggatcgaagtatttgcagcggtgcgggagtccggcatatagcccaaatcctgagcctgttgaacaacagaactacgcaatgcagcggtacgaataaacgattcgaacagtgcggtgttactcatttgctgaatgtacagtgtacagtatgataacagatccacaagtacgttcatgcgcgagccggagaaatcataatccttgaattcgtcctgacctcggagccagttgattaagtcagatttgatttcgtcaaaagtagccccgacaaagatatcggggatctgattaatttgtttctttgtagtagccattattacccctcgttatcgggtatttagtattgaaccatagggacgcaaacactaattgaaccgaatgtgatcgcgagtccgattaatgacaataatttgtttacgtattgagttaccttacttagagcaagcgtacaaatctggttataaatcaccttgcatgtgtccttaaacgagcgggaactgtcaacaaagtttttatatagcgattgtgcgcccgtcagcgcgttctcatacgtttttaacaggtcatcgaatgcaaccccacagtaacctaagaactggttaatctgagccattacaggcagttttttgagttcagccattgccatgctgtaggtgtctttcatcccatcttgcagagtagcaatctgtgctttgattccctcatatgcggccttagtcgcattcacagcagcgttagcggcatcaagtgcagcctgataagcagcggttgttgcttccgttacaggttcccacatccagtttaggtactgatcgaacttgcgtttaatcgaatccctttcctgtgtctgtgttttcagggtgttgaatagttcttgcccctgatcatacaatgcggagatctgcgcataggatgcatcaatgaacgctttcactttcgcttgtgcttgctgatacagatccattgctgtaaaccctgggaagttaccgcccagaatcacatcaagaggtttaatctgtcgcatgatgttacggatagccagcaccgcagaccaaagcgggtttggtgtttctggaggcattgaccagatctgcatcatacgcccgtacaaatccaccagagcaacgcaaccgttttggaacatagtcaaacaccagtcaaataacgcgctacaagcgtctacaaggtcgcgagcgccagccttgacatattcaacggtgtagttgtaagaactgcctatagccccgtagattgcgtttatgacgctttcatacgtctgtgcgccggagtcaatcagagcctggaaagaatctttcagggattgaaccgaactatcaccaaacaccagatcgtaaatgttgattgcaacacccaggatcgcaacagtcgggaggaagttattgatcagactccatgccccacccacgatgttaaacgcagagctaatgatctgccggaacaccttcattgcggtttgccatgcttgctgtgacaatgccagagcacccgctgtgatttcttccatcccgatcgaaagcccgtcaaacatcgtcgcgataccagagccatttttaattgtacccgtcagcatatcgaaagccagcttgaacgttttacgagtctcgttccacgcggaaagcatagcatcgctgatattcgtatacgggaaccctacggtcgccggaatacagcccaatccagagagagcagaaaacaatctggcttcactcggtagcgccccatacgttgacgggagagcagggggaaccggaggaatgctggtatctgcgttcgtgtttactgacatccctgtatatttgcactggtgcgcgggggattcgtcgtgtttcatgtacgcaatacgattaccattccagtagtaatcaatgctggtaaacgcgcctgtagtctggttatatacctgtcggattcgctgatcgcaacgggggccggaagtcagcaagtaaccaccggagttttccaccttgtacatcgcgagttcgccagggttcttgaacagattcgcttttgatagatccgccccgtaccagtcattacccgcgagcttagtagccccgatagatgcgatataggcatcaatatccgcttgactggcgaaatagtaaccaatcttcgtaaccagaatgtcagtagaaacccctggggttccgtctgggttcgtgggtacgtttggagagttcaccaccggaagcggatcgcttttctgcccgaaaggggaactcgtatacaggtgagttccgatcgggatgatttcggtcgcccattctaccccaacagcagggtaattttctgtgtgtccctgccagataacgcgtctgtaatatccagcggggatctcagcatcgcaaggatgctgaaagttttgcataatcccatcaatgatggtttcataatccatgatcatgtttagcctacctgtacagtaccgccagtgatcttagtcagtgcgccggaatcaatgaaagtattattcgatgctcgcatgttgatattacgtgcgccaatatccaaatcttgctcaatatcaatcagagcattttttgcggtaattgttgcatcttctgttacggcaacggttgcattctgtttaacgttagccattaaattctgattcacgtttacggttgcatctttttcaacggttaattctgcgttgcctttaatcagccccacatattcaccttcaacggtttgatttacattaccgcgaacgaactcggtcacgttaccatcaacggtctgttgaacgttacccatattgtaaatgaacgcatcaccctcgataacaacctgcaaattacccttaacgtttaatttacggccttgcatgacgatttgataatcatcaccaacgattttaacaacacgggttccatcagggcgaatttcttcgtatgatcctgctgggtgaacacggttgtaacgttcaaagcctggtgtatcgtcgaattcctgaatgtgtccagaacgggattcgaataccatgttgtatggatattcagcattgtatgcggatttaggttcctcgaacattacgcgagtatcaccaggaacaaaaggatcttctgggtttgatgcagccaacacaacagcattgtatgcagcactcaatgaacgcccttctggatctggaacctgaacaccgtatgattcaaggttgcccgtcagcacgattttagatacgcgtgaagaacgtcctggtgtctggttagcccatgttgagtttcgcagttcgttgtaagcggtttgccagtcctgacgcttcatagcagccagagcattagtaaatttggcaacaccaccaacacccatctggaagcacatgttttcgattgccatttgacgaggacggtttaacgtcacgtatacttcgcgaacgtttgaagtgttgctgatcccctgccggacttttgccaaatcctgagcaaacagcgttgaaacttcttctgctgtgatcgttccattggttacttctcgaccaactgctttactgatcgcggcgttaatcttcgcagtatcacgggttttttccatgataagcaaatgcccgatcccgatagtcggataaccttcactatcaatataccattttgtgcggataccttcatcctgtttaagcatggtttcgatagtgaacccgccagtatcaggacggttatcttctgggatctcgtcaagtgggcgatcatctggattgacagctaacgaactgttagcatcacgaataatcacgctcgaagaaccgcgcccctctgcgccaccgcgagccagtacgttgacatcgttacctacataacgaggatactcaccaaacgggtcacagaagcctttctgggtgtccggcttctctcggtactcaccagcaaaggttcccagtataacgccgtcctggtgccatttatcgcgccagtaaccgataacgaaactaccgcgcgtgataccagtcggggaaaaaccaacaccagaaatagcggcgctgcgaatatcctgaataggcatcatccacggcaattcctcaaccggaataccgatagtttcagatttttgtttctgtgccggatgctcaccgaatacacgcacctgaacacgccccaatagacgaggatcatcgacttcttcgaccaccccctcaaagaaaggggagtatttatttccaccgtatttcataggtttgccttttccatttccttgatataatcacttacaaacgattgaatatcagaggggttaataatcttgatggttcgttttgcttcattttgaagcaccgcatcttcataaatatctacagggactaatgttccctggtactgcaaataacgcatgttcttatcgcctttgtcataccaatgaccgggattcgtagggtcttcaaccaaattgtaataacggttgcccttaccatccatatgataaagaacctgttcaccacctgcttttgaataacgctggatagcgcattgataagccgtttcctgatcggtaatccatccgtaaaacggatcgtaattatcgttaagcatcaggataacccagtagtattgctggtttccgtatagcgtttccgctaattgttcgggtcttaatgaacctgtcagttgatatgtacgcggcttataattcctgatcacgcggttaaagtaaaaacgataatcgcggtagatatcagtagttggtgtgcctttgtaatcaactggtggaaagaacgaaaataacattgtaatttcccctatctaatgtttactatatttaggatctaaaatggctggaagacagacatacaaggggtcttttatgccccagaacatacagaaatataagggagatccgcgaaagataacgtatcgttcaagctgggaaaaatatattatgaactggcttgataaaaacccgcatgtgaaacgctggaacagtgaagaggttgtgatcccttatttcagcaacgcagacggaaagcgacggcgctacttcatggatttctatgttgaaatggataacggtgtgacctacctttgggaagtcaaaccgatgaaagaaacgttgcccccacctaagccagcgaacaacaacgttcacaacaaaaagaaatttgttgatgcgctgtatacttatgcggtaaacattgacaaatggaaagccgcgaatgcagcagcaaaacaaaagggctgggagttcaaaatcatcacagaggacacgttgaaacgtgtgttcggatggaaagggcaataaataccctaaacggagggaattatgagttttatttttgagttcgagatcatcgcagaagaagacaaaccaaaaccgccaccgaagcgaaagctgggtgaatgggttgaacttggtatcaaattccgacgcgcaaaattaaaaggcatgacagccaaaaagttcgcggacgaaaacgggattgcatacgcaacgttcacaaagtctatgcaccgctataagcagcagattgatgatgaaatcgaacgccgtaaagcagaaaccgaagcccgacgcaaacgtaatgactatcgtaaaaaacacgcggttgatatcgtaaacgatttccgcaacagtttgaagaaaatgactgttggtgtaaccgctgcgaaacgtcagaaagattcgaccgattggtttggtgatttcatcaaaaccagcattaagacgcacagggttgcgaaaccagcaacgggtcgcttgtatacgttcatctacgatgcgaaatacaaagacacccttccatactgggatcggttcccgctgatcattttcctgggttcaggacgttcgaaagcgggtaacttggttctgtacgggctgaacttgcactatgcgccaccgcgagcacgtcaagagtttttagaagaactcctgaaacgtggctacggatcaacagatcgactttctaacaaaaccagactgaaaatcaattggaacaacgtgaagggaatgcgcggggctgatcaaatgatcaaagcctacctgccagcccatctacgttcaccacttgcagagatcgccccaaaagattgggcgaaagcagtttggttgcctacacaggctttccagtccaaaggaaaaccatacagcgcgaagaaagtttggaacagatattaacaaaaagccccaaccgaaaggaaggggctttatttttacagggtactcacgatttccgcgagttttccaggggttgcgccaggtcgaaccttcatcgcatctttcaggtttttatcaaccatcttttctgcgtctttttcgttaaacccacgtttcaccaacaccgcaataactttttcgcgaatatctttagcggcttcgttcaaatcttctgattcagctagaaccagtttagacagaacatcacctttgtattcctgggtaaaacgtttacccgataccagacgaggcttaccagaggcatctacaaccgtaaacacggcgtattcacctgtttctttggttttggtacgtccggtatacagcaagcacatatcgttacttgggagcttgtacacctttcctttcaccaatgcttcatccagaggcagatcaatttcgaaatcttccgccaactgattatacagatccaggttttcttctgcttctttgtacagagaagcgcctttgaatttcagtggcttgtcgaatttcaggtcatcagcaggatcaccgctgtagaatgaaacagtacctttcgcccagtcaatatacgctgcctgagtcttgccagtggttttacctttcaggcggacaacacctttaccgaagtaagcgagatcgtgggagtccggcgcatacacatcgtaatcagcaccatgtgcaaaatgcaggaaaccaatctgaccttttgcagcgttaccacggtcaaccagatcaacggtcttagcaaattttttgttctgaacagattcagaaagtagttctttgaatgatttcatgttttcaatctcttttgaaagtataggtatagtatacctatttattgaatatatcaactaaaaattagatcgcgagcgaagcgagttccgtcaagcgaagcgaagacggatagttaacgattgtataaaaagtatacggaaatgtactgttttctctatatataaaatataaatattataaacagtacatcgtacataacactcacttcgttcgtgtgttcgcttcgctcacggtcttgatctaaatatctataaaatggagatcatcatgaatacaactgctatgatcctgaaccagatttcacctactaacttcatgttagatattcctgacaatgattatgtaaaagggttgaaactacaggttcagggtgttacactacctgctatcaacattccaattacggatgtcccactgaacccaatgattcgagggaagatcccaggatctgcaatggagttcgatccactgactattcgttttgctgttgatgaagaactgcgatcgtatcttggggtttacctttggatgctcggtactgtcgattttaacaccttcgattccgtgcgttggagtgaaccacaacaggcaatggctttgcatatcctggataactcgcagtcaaaaactgtagcgacatttcgcttctatggcgcttggccctccaacctcggagagcttgagcttatgtataccaatgattcggatgaagccgtatcctgtatgacgatgttcaacttcgctcacatggaaattgagatcgacggacgggtgatcgtgcctactccacggaaaacgcaaaaatgatttatggtatttgtggtaaaaagcgaacgggtaaagataccgttgctcaaatggttgtgcataacttccgcaatgttgaagttatcgcgttagccgacgaaatcaaagctatcctgaaacgttctatggaacatcacgataacacgcaattgcgagcgctggcagcgaagaacccattctatgagggtgatcgtgaagccccgctggtgatgtccaataacgatgcatacgcgctgttttctagcggtatcaaaaaattaagttctcgcgggttcttcatgagtaacgcagatgttatcgctcataaaatttgcgaagaaaacagccagccctggacgattcgccgtttgatgcaggtgttcgggactgatattgtttgtaaaatagatccgtctatctggacttcaattgcgcttcaaaaaatgttgaaatcctacgcggatcactttatcattaccgatgtgcgtcaaccgcatgaatataaatacctgagcaagttcgggactcgctttgtgttccttgaacgtgaaactggtattgaagataatcattcaacggagcaagggttgacacctggcttgagtgattatacaatcctaaataatggtacgttagacgatttgaaacgtaacgtgcttaatgtattcaatcttttaagagtgtaaacaatgactgaacaaaaccaaacccaacagcttcaaaacgatgtcctgatcctgaaagcccgtgtattcgacctgaacgaaatcattcagggtaaagaacaagaactggcaaatcaccgtcaactcgtaggccaaatttgcagtcttctggaaatcgacggttcgcagggtgtatcccctgatgccctggtcggcgcgatcaaagcacttctgccagcaacagcagaaaccgctggcgacgatgaagcgattgatgcatcaaaagcataattaacgcttaggcgtttaaccactgggggcgaaagcccctttttcatttggagtacacatgaaaagttttattgaagtagcgaaacccgtagttgatccggggatctatatgtgtgcgaagttcgatcaggcttcctgtgaagcgctcgcgaaggtgcaaaaacttctgggtgtagagaatcctgtttccgctgcaaagctgcatacaacgattgtgtatagccgtaagacggttgatctgttccctgcatccggtatctctgaacctgcccgactggttgacgtggagaagtgggaaacgaaatacggtaatacgatcgtgggtgttctggagtctgattatctccatagccgcttcaaagatgcaatggatgctggagcaacatacgattatgacgattacaaaccacatgtaaccctcgcgtatgattcccgcatcgaagatatcagcggagttaaaagactgttgacattgcccgtagatttgactatcatccaggaagatgctgaaccgctggatctggataagaaagtcgaagacatcacggagcacatcgaacatcgcggcgataagtgggttatactgaaccatgatcgcacgaaagaacttggtgaatatgattcgaaagaggcagcggaaaaacgtctgcgtcaaatcgaatactttaaacataatgggtgatttatgaacagagcacgattgatgtatgttatcaataacttacgcagagaagttaaccaaaatttcagtaaagcgttaagtgattggtatgtgacaaaggtttcaatgactacagatcacatcgcagaccgattcctggatcgttccgcgtcagtcaaaaaagactttgcgatctacagtgaaattcttaatagtctcgctaaacattattcgtgtaacgttctgtattacgcggtgaaagcgaaaaacgaaggtatgcaggaagtcattgcatatcgccggatcaatggcaaagtgtttgcctgtgcgttcaccgtccagatgttcgaaaacatggatgattcggttgctcacgaaaaaccagtgattgctgtacgattccgaaccgttatccctgagtacacgttgagcctgaacacgcgaaacgcgatccatgtgaactacatcgcacccaaaatcaagttcgagtatgacggctacagacgcgttatgtcacgcctggatcgcctgattgcttcaaaagattgtccgcctcaactacacatgttgaaaaatatttgaaaaaagcccttgcattcgtgcaggggcttttgttatattaggggtgtcgaaacaaaggaggcaatcatgaaactttactggctggtgttctcaaacgggtttgtaatgaaaggcactgttcactgtgcgaaaacttattgcaaatggaatgaatgctctttccgtatcctgagcgttgcatcttctcaacctgtaggggattactaatgactggtgataagtgggttgataaaactttgttgttgacagtaatctactttctggtaaaatacctggtgtagacaaaggagggagttatgagaaacttactgaatatcgcggaaatcttttgctatggtgtcgctgtgtatgtcctgtttaacggtgacggcgcgggatactggatcatgttcggtggtggcttgttcctctctttcatcaaaaaattttttaagtgagaaatatactatgcgctcaaatgtaccgaaaaacctgtataccgttattgatgctggttcgattcgtattgctgatgtaatggcactggtcgaacgcttcgatcgttcaacaacgctggggcaactgctgagtatggttaaatcccagtacccacacaaatgcccgaaatgcgagggtaaagggttcgaagtcaaacgtgttaacacgtatccttctggcttaccggattctggctgggttgatcagatggaagacttcaatgttacttgtgatatctgtaacgggcaaggcttcactaaagaacgccttatcgcaaaacctgtcaaagtggaatatgtacccgcatgaaaaacaaaatctatgctcatatgtctgagcacacaacggttcgtgttatcttggtagatgggccaatcgctcaagtagaaaccaacgataaacctttctcgttgcctttacaaaccagtgtcggtactttcgatgaagttatcgaagaattgacaaaacacgccattgtttatctgtgggaagcgcaaagttatccatacccaactcctacaagtccggcgtcagaagataacgtaaaaattcgttggggatatattgaatgaaaattaccgatctcgtaaaagcggctaatgcgctggtgacaagcgaacattacgccaactactgcgagcaataccctgttcccctggaacgcgcaattactcaatccggttatgacggtatcagtaccgtaaccgttgaaaacctgaaaacgttcatcgtgtttgctaacacgttctggatgtacttacccgataatatcggaattcgccagcctacattcttcacgctgtgtatgttctgcgaaacctatctcccagaatgcgaggattacgaagaacattatggggaataagatatcaatgggtaacaaagtatccctgatgcagtttgataaaaagctggggtttgtattctctcacggattcgccccagacgcggaaaccatgtttaaaatggcttttggcatcgatccggctaccctcgatcaagaggtgttgtcagacatcaacaaaactggtacgctgtattatgcccgtctgccaaatccagaaaacggcattcagtaccaatcgactctcgaaaaactcaaaactgaactgaaagaaataggtgaattatgacttctacagctattcaacaacaaaccattgatcatgatgctgaattcgcacaactgatcaaagaacataacgcttttgcggcttctcgcgtcaatgaagaaagcgaacagacccgccgatccctctgggttgccatttaccgcgaagtgttcagcgagaaatccgctaacaaacacactcaggcagttgatgcagcagataaagcgctggcagcatacgatcgtaagttcggagcacagtaatggaacggtctgctggtattctcttcctgaataacggcagcgttttaatgggccacgcaaccgaaacgcctcattgggacatcccaaaggggcatatcgaaaaaggcgaagaacctattcacgctgcgatccgtgagtgcttcgaagaaactggagttcttgttgaaccgcacgaactggaaagcctcggaagactggattataccagtaaaaaagagctttacttattcgtgtataaaggcaataattaccccgaagccgataaatgcttctgtgcgtcaacgttcgtgaagaacgggcgaaccatcacagaaatggacggtttcaaatatgttccgtatagccagatccgcgatcatgcgcgtaagactatgggacatcttctatctaaacttgtgggatatacatcatgaaagcaacaacttttcaaatctgtcaaatgatccttctggctaccgcaacccgcgccgctgaacctatcgcgtatcagtcatggggtgattcattcaccgtgaaaaatattcgcgatctgcctggacgcctttacgcttcccctgatttcgaacccgtcgatccgaatgatttgacgctggaagaaatgaaaaatctgggcttccgtaagtggagcgacgattcaaacatgatgctgatccctctgtatctgttgccatacctgaaagacggtttccgcgctatcagtatcagcggtgaagaatttgaatttagcactggtgaatcagataacgatcatcgtatggggctgctgtctttcggggcattgcctaaatgagtcacgttgatttcaacaccttatctcaattggggctggtatggaaaatcaataaagatatcctgcatcccctggggctggcgttgacgcgtgatcctgaaactggcgtatcaatcggtgcgctggtttccgatgatggtgtctggtcgttcagcgaaaaatcagactttgaaaacatcgcaaagttgaataaactttatgctttacaggccgaaggaaagctgttagagttcttacaacaaaacgtgaaagagtgattatattatgaatggtgaacgtgtaattgtcattggcaagtcgaagcataaagctaacgcgaagggtgatcacttgatcatcaacaccgatcgcggtgactggtacggcgcaacgcaagtaacgagtggttatgcaaccatcgttgaaaaagatgcagttcgtcccgcaaccgctgctgatcctggttactatggaacccgcgaagagttcgaaagtgaaaaggatcaggagatcgcagaactgaaaaccaaagttcacaacgcgcgggtgtatgcggtgatttgccttaccgttgcggctatcaatactggtttgttgggttgggtggtgaatcatgtctaaagatgatattccggttcataaccgacttcgggaactccgaacttttcgtagtcgcgatcatgcgatcatggttgggagttatctcaactggtggaagcataatgatctggatctgaatccatcttatcagcgcccctacgtgtggacgcagaaagaacaagatgcgtttctgactaccttaatgacggggttcccttgtggtgtcatcgcgatcgcggttgatagccagttcaatgaaactcactgggtagaagtcatcgacggtaaacaacgcctgacgacgattatcaaattttacgaaggtgaaattggtcttcctatgccggacggttcccgtttattctggcatgaactaccccgacacgaacagcgaacctttgaaaatatgtcattacctgcactggggctggatgaatgcaccaaaaaggatcgtctggaattcttcatcaaactgaacttcgcgggtgtgcctcaatcacaagagcatatgaaccgcgtccttgaaatgtataaggctgcaaaatgaacaaagacgaagaactgaacattgattcagtagaaccaaatcagtttatcatcggtaaagaagatcatgaactgttacaagcggttaaaaacttgctgacgtatgctcatatccgcgtaccgaatggcgataacgcaaaactggaaatcgcatgtgctggttacggttacaccgctaccgctgataaaatcattagctattccgcatcaagaacccgtgaactggttcattaccgcgataaattgagtgaagaaatccatcaaactcaggtaattgtagatcagttgccaacaaatttcgaataacttgaaaaaagcccttgcagaaatgcaggggctttgttatattacacacatcgaaacgaaacagagaaaggaaaacatcatgaacatgaacaaaaacattgccgctgtagttggttgtgaagtttctaacgcagaacgttatgacaacggtttctctttctgtgttccgactgaactcgatgcgtacaaagccgcttacaaataccgcactatgccgatggtaaacgttacttacgcgccgaacatcgaaatgtggctggttcaggtttacaacaaagtatgaacttccacgaacgcaaggccgcacgaaccgattattacatgcggttcgtgtatggctggaaattacggaaatgtgttgcatgtaacggatcggggcgatatgatagcgaccgatctccgaaatgcagttcatgtaatggaaccggaaaagaacgctttaaacctgtgaggaatatattatgcaacatgtgaatctcaacccaaaaatggaaaagtatctgaatcgccttcatgacaaccaggcgcaaagggatcaggaacgcgcgatcaacattgaaacggctaaactccttacccagatgttccgtaagtttcctagcaaattcccatgcaattctatgcattcaagtaactgtatcagcgtagaactggctgataagcgttgtatcagggttaacctggcttacgggttatccgaagacggatataacctggtgatgggctggacatcaatgatcggtaacttcgttgaacagaacaatattgagttcaatatgatgcgctctgatttgttccagtgtccggtcgattcaatcaatatcggtagcctttacgctatccttcgcgcacaatatgatttgtggagtacaaaatgaaagtaacaagtgaaaaacttgaagaaattgaaaaatcagcccgttcgatttcttctatgatgggtagtaagtggactctcgttgaaaatttaagcatccagggaaatcaggaatatggtttcaggggcaaagagtataaacgcgcattctcatatggtgttccatatggcgacagccctacacagattaaaagctgggaagaggatctcggaaaatatctcgaaactgtagatccgcaaactattctggatctggttgatgacctgtcattggcgctgcgagataagcaaaaagcagaaaatgaagccgcgcactggaaagcaaatcacgaatgcgaagtatcccgcgcccgtgtcctcaaagagcgccctgatatgcctctggagcgcgtcaacgcatacaaccgtatggttgagttagaagaggaaaacaaagccttaaaacagcgtatagcgagcctggaggatgtcaatcaaacccgcatgatgttgcagatgattcagggtatggtgattgatacccaaaacatgaaccgcgaacaactgcgctactggcaaacacatttccgcaatcctaacgggtggtaatatgttcggacgaaaacgagaatgtaaacatgttgctaccggatggatgcggggaactccttacgcctggatgcatcattccgtaaccgatgggatcgggcgtatacatggcgatatgtatgcaacatgcgacaagtgcggggagaagtttttgatgtgtaagatacacgttgaccacgcgatccgtgagctggcaaaacatccgatcacccgcgccgaaatccttcgaatcctcgaagaaacaaaatagcactttttgtttaaaaagccccttgcaaccgccaggggcttttgttatattacacacatcgaaacgaaacagacaaaaaggaaatcatcatgaaacttgttcgcgaagcaatcaaactgggtaacgaatacaacggcaaatggtacttcatcatttatgacgacaatgcagaaaaactggaaaaagttgaagatgcattacgtgcgatggaaactggtgcttctgttggtggtaaagtgatgacctgggaaaactactgcgacggttgcccttgctacaacgatggtttcggttctggtttctgggttgatgttgaagatgttccagcgttcaaagccgcatggaaaatcgctaagaaaatggcataattagcacgaattgctaaaactccataaccctgatctgttattgtacacacatcgaaacgaaggaggatatcatggaaatcatctacaaaagccggaactacaaaaaagaagatgttgcagcggtttacatcaagtaccggaacgtgaaatgtgagtacagcggggcatggggttatgaaatcgttgttgaagaagtcaacgccgacaacaaaaccatttgcagtttcaccactaataccgatagccctctgttcactactgaacagcttgaacaggcttatgaactgcgcaaccaggcttttaacgcggtacgtatcaaatgagattccgtccttatatcgaattccttcgcggtatcagtgagatcctgaaccgcgaaatcaaacccagtccgttagccgttgagctttaccgactggatgcaacccccgaagatgcagcgaaagattacggagatcagttataatgttaacttttgaagagtacaaagcacagcgtgatcagttaagcaactggtacagagagatcggcgcggagttaagcgcttaccctaaaaacgaaatgggtatgacgatcgaatcaatccgcaatacgccggaatacaaagcgaaacgtgctttgtgcaacaaggttttccaacagcttcgcacccttaacgggaagtacattaaactgtacaaaaaagaactggctgacgaacgtaaactgaaacggagtgtaaaatgatgcagcacgaaatcaaaacagagattgacaaacgtactttcctggaaaagaataaaacggtaacgctgatgcattactccaccaaaaacggttcgagtgagttctggcgcgttaacattgacagcaaagagaaacaccagtcgataccgttcgacaatgaaagccttgctcgcgctgtcttccaatcccatgttaaattttgagaattatattatgaaaactgtcgatatcgttaccagcatcaaagcgccgtccctgttcatctatcaacacggcaatatgcgcttcgctcgctcgaagttctacaactataatttcaacgttgatactggtgaattcgctcgctggggtgcaacatattcccacgatccagaatacgcaccattccccgaaattctcgatatcgagatcactaccaaatgcaacgggccagcgggtaaactctgcgggttctgctacaagtccaataacccgaacgggttcaacatggatcttgccaacttcaaaaaaatcatcgacaaaatgccctggcttactcaatgcgcactcggtgctgatgcacaggggcaaacaaaccccgatatgttcgatatgatggcgtatgcgcgttctaaaggcattgtgccgaaccttaccattgctgacgtatcaaaagacgttgcagcgcgtttagcggcggttgctggggctgttgcggtatcggtttataaacacgctggttttgatgtcgctttcgactcagtagcgaacctgacagaagccggacaacagcaaatcaaccttcacttcatggttagctcgaaaacctatgatgacgcgtttaacgtggttgatgccgtgaagaatgatccgcgcctgaaacaagtaaacgcgatcgtgttcctgggactgaaacaaaaaggacgcggtaagaactgggacaccgttacccgcgaacaatataaaaaacttgttgaatattgcctcgattctggtgtaggatttggattcgatagctgttcagcccccgctttcgttgaagcgatggagggacacccgaacttcgaacagtacaagcaatacgccgaagactgtgaagcgacgatgtttagctcttacattaatgaacgtggtcagttcttcccttgctcgtttaccgaacgttgggttgaaggtggctgggaagaaggtctggatgttctggaagccgaagattttgtgaaggatatctgggaacacccgaaaacaaaacagttccgtaaagaactgacgggcaacaaggatcataacggttgccgtaactgtccggcttatgcggtatgtggtaaagatatgcgcgtacacaaagcccctgaaaccgatgtatatgcagtggagttgaaataatgttaatcgtatctcgtattaaatcatacgttcgtgatcgtgatattctggatgtgtcgcctatggttggtgaaactgttaccgtaagaaactatccggtgaatctggatcacgtaacctggatcgaagatgatgcaacaatcgttgttgaagggaagagacacccagcaatcacttttcacctgatctgttcaaccccgattacctgggctggatatgaaaacaaagaacagcgtgataacgctatccatgcgattgagcgtagaatgcagtttgcggagatcacattctgatgatttatcaatcccataatgattcaacgatgcgaatggttccggtatctattgacattccaacaaaaccgcgtacactggaatcgttgattgaaaaatactctggaatggttatttgtccttctaccgcacaggtggcaatggcagaacgcgatgaaattgtatttgaatgtgatacgaaaggttatcacaccgttgaagatatgcagatgattgaatatctctggggaatccgaaacgctgtagtacatcacatactgaccgctgaaaagaaagccgaagccgtgagagaagttgaacagcgcgaagagatccgctataatcggatgtctgcacaggaaaaggatgaagcatatgaagtgtgccgccgtagttgatgaattaatgagcgcgtttaaaacgcgtcgtacagatgggcgtattaaagatccgaagtcaatcgcgatcatcgaacggtacgcgatgaagttaagcgaacaggaattcacgccaaaggcgctcaatagcctgatggttctgaaactgctgatcgcttcgggtgacgatatgccgcacgatgaaaacagtgctgaatcattccaaaaggcttatcgttcatggggagtgatttactcccgctcgctgggttcgtatgactccgttatgtggaacctgatgcacctggatcgcctgatctgggaagtgctcgaagaagagggtattgtatgaaaattcgggtagttgaagttcatacgcctggatgggttcctgaaagaacatacaagttagagaaacgagtatttgggtttttctgggttccgttgacttttaaatctggtattcatactatccaatacgatggaagaaccccagaagaagcgctggaattattcagactaagaacggaaaaacatttaaccgttgttaaggaaattgattatgaaactcgatcgtgaattaagcatggctatccgcactattgaaatgatgcttgataaactgagcgcaaaagaagagttttgtgtaagtgatatcgaagcggatttagttgaatggcgcggtgcgctttacgaagcgacaaagggcaacgatcccctcttcgatgaatatgacgtgtataacgtcaaggtctggaacactgaataccgtttcaagtggcctggtgacgcttacgggcatattcaaaccatttacgtaactggtggtatggtgtttgcaaccagtgttggggctagtgaacttccgatcaatcccaatagtaaagtaacgacaccgaacccattaggacatactaccgtttgtttgggtatggcggaggatttctccccgaactattcaggctggatcgaagccagcaaaactaaccttaaaagagtataaattatgtggaaaattgttgtgtgtattttgatggttgtcgttgttgtgttcttgcagtcaagctgtactgacgagaaagaggcacagcgtatcctggaagcacagggttatacgaacatccagttcacgggttacaagtggtttgcgtgttccgaaaaagacacatattcaaccggattcgaagcaactggtgtgaacggcaagcagatcaaaggatctgtgtgctctggaatgtttttcaaaaatagcacaattcgtttcgaataactgttgacactaatccccgttgtgataatatctctctcgtagacaacgaaacagataaacaaggggattaaaatgaacttactgaacgaaatgctggaaatggttgaagcgaacaaagaagcaatgaaagcgaaagaaggttgggtagttgttactgactgcttcaaaccgcaaagctggcttcctgtgttcctcaataaagacggtaacgaagaacacggcttctatgatgctgcaatcttcgaaaccgctgaacaggcttgtgatttctggtcttacctgagcggtgacaagcctttcaccaaatacggtgtttgccagtgcaaagacatttaatcccagccccgaaaggggcttttttgtaggtgaaatatgaccaaagcagaaagaattatcaaccatcttcaaaccggattcccgtaccagggagatttacagcgcgatatcatcgaactgttatcccagcatgacgggatggaagcggagataaaggaattgactcaccctgacgtgaacgtattcgcttcactgatggatgatgtgattgctatcgactcggacgaactgatctgcatcgagacaacgaacccagaagataagacgatcctgaaacaagcgtatgaacggatcgaagcattacacgatcgcctgttcacgttaactttcccaaataaaaacgatagaccttgttgacatcaaaacagattgtggtaatctgtatatgaaaactaattgtgaggaatacattatgaacgcttttgaaaaacgtgctgtcctgaaagatatcaaacctggcgcaatcctgtacgaagtaatcagtatcactggtgaaaaggcacagatgggtcgaaaacatatcatcactggcttcccgcgtgaacatcgtgggctggggctgtttgttaacggaatcactgtgtatgatgattgggaaaataaaggtcaattctctctggatgatcgtaacgtaactgggcgcaaccattataatttccatgcgttgttccgtagcgaagcagatgcgcaagcatatattgaacaaatcaataatgataaacttcctcctgatgacaaacaggagagtgttgaaatgacgattcgctggaaacgcgatcgcgcggaagatgcaatttggggttacatgtaaaacgttgcgcctcttaaaccgtaaataccctgtgtagcccatagggtattttcataaagaggtatgtatgtttaaatttagtcagaaaagcctgaacaacctgcaaggcgtgaagccggaactggttaaggtggtaaaacgtgctctggaactctcgcctgttgattttggtgtacgcgaaggtctgcgcaccgtagagcaacagcgcgagaacgtccgcaagggtgtttcccagaccatgaactcaaaacacatcactggtgatgctgtggatctgtatcctagcgttctccctgctggctggcagactaacccgaaagtgtggttgcctgtcctgaatgcagtgaaacaagccgctgatgaactgggtgtaaaactgcgctacggcatcaactggaagaacgatccgaaccttccgattgaaacgaaatttatcgacgcaccacacgttgaacttgcataaggcgacaatatgatttcacaattctatgttgacgctgtaaagcagtcacgtaacctgcaccttgcgcgaatcgttgatgggcgttgggggcaagaatgcggcggtgtgtctatcttcgaaactgcgctggatatgggtcggatgtcgggtaaaaccaaagcggctttcgatatcatcaagcagtctaaagggacactgaatatctacgttgcaccgacaaagcagatgggtatttgtgctgcggtagaacatggactggataagggcgctgattcgtctttcattctgtcgaaacgtcaagatctgacttccattttccgtggacaaacgatcaagtatcaggcaatcaacctgattttcgatgaatgtgacacgacgatcgacgaacggtttgaactggcaaaaacgctgaccttgtgtatgcgttcaagtcatcttcatccgttcccatatatccatattatccgtttgggtatgtaattgcagtgcgcggggtgcgaatccgcgtaccccgcaattaacaggaaaacttctatgaaatatgttctagataccaacgttttaatctcgaacccatattcaatcttctcattcgttgaggcgggtactgaaatcattatcacctctgcgacaatggaagaactggatcacctgaaaagtaaagagcgaaccgctcatgaagcacgattggcgatccgcctcctgtctaaagtaatcctggggcagaagtacgaagcaattacccaaacaggggtttcgttgaacctgacgaacccagcactgccggaaagcgtgaaactccgtatcgttgattatatcggtttagaagagttcccgcttgataaacaagatgcgcgaattatcgctacctgtatgcaggaaaacgcaaccctgatcacccgcgatattaacatgctgttgatcgcgatgtctaagggctgtcctgttgaacaatacacgggcgatgactcgctgaaagatagcgatgtgttgtattctggctatgtcgatatccctggattctgggatgatgtcgaggtgttaggatatgttggcgaagtagcccaaataagctattcctcgcttcctgacggcgattattacccgaaccaatacattctgtcggatggtgaactcgtagggcgtgtagtggctgctggagagtatcagcttgaactcttaccaatcaaacacgaatccgcgatgaagcgtaagctgatgaaaacaattcagcctcgcgatgcactgcaagcgtcattcattgatgcaattatggataaaaataccgatgtggtgaccatcatgggcgctgctggttcaggtaaaacaatgctggctgttgctggtgcaatgcacctggttaacgccggacactttgcaaacctgatgtatgttaaatcggatagtcctctgtcgggcgaaatcgggttcttacctggtactctgggcgaaaaactgcgtcctgctgtagaaccatgtattacgagcctgaacattctgtttaaggatcaaccggaagttgacaaatatgtagaagggctgctggagaaaaacgttgtccagttccctagcctgtattacttccgtgggcgctcaatcgggcatcctgatccgggtaaaggttcggttctgattgttgatgaatgtcaaaacttgagcaatcacgaaatcaaatccattatttcccgttgcggtgagaacacccttctgatactatgcgggaacattaaacagattgacaacccgcgcaacactgctgttaacaacggctttgtgtatgcggttgaaaaacttaaagagtacggtcattcaagtcatgtgatcctggataccgtatatcgtgggcgactggctgcattcgtcgaagagaacttttaattaagggggcttcggccccctttttcgtgaggtatacatgatcagcgttattgttagtccaaagctaattaccgtttgcgctaactgcaaaagtgggttagagtatgaactgtctgatgtacagaagagaaccgaagcgttttataatggtttcttccgtgctgctgattacatcgtgaaaaaacatatcgtctgcccgaaatgtggtagcgaagtgaaactattcttgtgaggttattatggtacaagttgtaagcattaccccaaaacaaactacctgtcgttgtggtgctgtcctgtcatacactgcacaggatgtcaaagaaaaggtatcaaccgattacactggcggtcgtgatgtgtatcgtgtgatccggtgtccggtctgtgataaggatgtagtagtatgaaacgcgaagaacgttatgcagtgtttaaatatgcggatattgatgccgcgttaagtgatagcgacaaactgcttctctctgcggtagtgaataaaattgatcgctatcgtaaagagcaaggcaaagaacccataaaaggggttgttgtcgagcatgattggcctgaatatgaacaggtctggaagatgatcgaaacccgtgttgaccgcgaagaaaacaatcgtaagtttgaaacgatgctggacaataaagaacgtctgggttatttcttcgtggttgagactcacacagggaaattcctgatcaccagtaacgcgcacagcacaagccgtctgaccaaatacagcggataccaataccgcgccttgttcagtcctaattgtggatttgatcacagcgaaatctttacgactagctggagcgtttactttaaacgggctgttatggtgtcgttcgatgaaatcgttgcactatacgatccgaacgtatcaatttcgaactataatcttgctgaattcatcgagaacaaactgagcgatgcgaaaaccatttaaaatggttgcataaataataagacgagggtatcatagccctctcttgttacaaataggtattacaatgaagaaaattatctttgctgccagcattttcttatgctctttttctggcaacgcggcgactgatccgttaggagagtttatccaaacactccccgctgtgaagtcaactttaccgctacaacaagcaacagtaatgaagaaagcgccagccaatgcccccagctatgttaaggaattggatgatattacaccaaagcagaaaaaggttttggagtacgctttcaggatcggaaatgagtacgatcgcaaaactgcaaagccagttgaatcggaaacatcgaaacgtttgggatatcatttagcggctattgcctggatcgagtctcgcgcatgtgagaacgtagggaaaggcaaaaagaatcatcatgcttatggttgttttcaagtaacagcccgtagcgcgtccgcacgaatggataaatcatattccaaacgcgtagtaatcaataagctcgaaacccttcggggtggttccaagtatgcacttcacgaactggaatactggcttgattaccacaaaggcgacttgaaaaaggcgctggcgagttacaacgcgggattcaagtattcaaagaaagaagcccgtgattacgctcgcatggttaaccataccgcgaagctgttagaagaaaaacgcattatctgataaaaagcccttgcaatttcgcaggggcttttttattatgtgtgtaccaactattgaggattaaattatgagcacatcacatcgagttattaccagtcacccgactatcatcaagccgaacatgctgcacatcattcagggtgtgttagatgaactgaacaaagatccaaaggttgaagtggaaaccatcacggtcgaccgtcatcgtatggaatcgttcagtatctacttcgcatatggagaagaaaaacgcaaactgtttatctgcgaaagtcaagatacgtatcttgacgttgatgataacacaattcatagcggcggtgtttacttcaacctgaacgtgtggggtagcaacaaagagatcatggatatcgtgaaagtgggtattcgtaagcacgtcccgaatgacgttagcatttacgaatgtgttaatgatgcaattgaagatcgctttgtgcgcgtaggggcttaacatggaaactaaactgacaccggaacagcagttagcaattattgatgaacgtatcgacgaaatccgagcgattgtaaaaccctatcaggaaaagctgaacgggttgctgaaagcccgtcaggaggtcaaagacgagatcgatcacaaaaccgcttcccgtgtccgagcgatgactccaaaacaacgtatggagttttacatcaattcaccgaacagcggacatgaaattttccgtgatgcgactaagttcttccaggatatggggcttgcgatcgacgggtataacccagaaaccaatcaacatattctccgtatcgcgatgaacgaggatcgcagtaacctcgaaacagtcctgaaatcgcttcaacgcgtgaagccatatgtgaagccgatcggcggtaaattgctgttcgatatcttcgaacatacatgttcacagttcagcacatattggctagcctttgatattgcggaagaacgctggatgtgtttcacgggttggaacctgaaacgcaatcaaaagccggaatttgaaagcgatagtttgcgatcagtgcttgcgtatatctgcgaaacccattattatacccctatcgaagaagattcatactaaggtaaaacgatgaaaaaacttgcgctgttactcactctgtttgctggctttgcacatgctgatgatcgactggctgaactctgcaataatcgtgacattaaagacgttgcggtatgtgaacaggtgattgccgaacaactggacgcggcttatgtgtggggtgaagaaaacgcgcacctcttcaagcgtcagaagttggttaaactgcatgagtttttacagtctgaaccaatgatgaacctctgtaccaatgcgccaaataaggaacgttgtgaaaaactccgtacttacctggttgatgaatatgttgctggcataggattatactgatgatgggattagtaatcttttacgggtgtgtgattgctgctgcaatcattatctggtattacgttaaaaagccaaacgaaagctcgttccctgtatatgatgacgagttggaagcgtggcaaagatgggacgatgaatttaaatgaacacaggttatatcttaatgtgtgttgtggttgtgatcgcggggctggctgtgctggcttaccgccactatacaggtgatgaaaatgattattaaagaaatcaaagggaacgctgtagagttgttcctgaaacgaaaagtacacttgattcatgggtgtaactgttattgcaacatgggcgcgggtattgctaaagaagtgaagcacaaaatccctggtgcgttcaaaattgatgcactgactatgaaaggcgatcagcggaagttaggcactaactccatctacatgacggaagaaggtcagattgtcttcaatgcatacactcagtttaaattctggggtactggcccacaagtggattatgatgcaatccggtcatgctttgtgagcgcagtagaacgcgccagggcgtttcctgagaaattgcctatcattacccctcttatcggtgcggggcttgctgggggcgattggctgcgtattagcgccattattgacgagtgtacgggagattacccgatcatcgtcgttcacttcgatccatcggttgatccacgtaaggcggatttatcatgattgatcctatcaaagcaggtcgggcgatcaagaaagcgaacaaacggatcgccgcaatcaaaggacaacgcgccgcactggtgaaaacctgtgaagcgctggcgcagtccatgaaagcgaacaaaatcaacatcacacagcgtaaaacggtggttgacattctttgtcttgttgatgaaggactggataaagaaatgggcgaactgaaaagcaaaatcaacatgtggtatcttgatatccataaagcacaagatagcgaaatgggcggttataatcatgactgacaaaatcaaagctaaagcaatgaaggtgattgcgacatacggaacactccgttggtgtaacgcgcaggtgtgcgggtgtatgggttgtgcaaatcataccatgacgaaagaagagtatgatattgctatccagatgccggaaatcaaagagcatcttgcgcgacgtaacaaaaaactcatgggtaacgggtggtttacaattggctaacgcacacattatagaaaaagttcgttgtcgggattgtcatttccctttgatttgcgtcatgaacattgacaaacccccttacgacgagtgggattggtggatatactgttcaaacaaaacatgcaaaaaccatgaaggtgagggtaaattccagaatcatattaagtttgtggagcgtgtcaatggctaaactgtattatcactatgcatccatgaacgctggaaagagtgcgcgactattgacggacgcgcacaattacaaagaacgcggtatgcgtgttgtaatctataagccagcaatcgacacccgcacatcaaacacagtgagttcgcgtatcgggctgaacgaaaagtgtgaattgattgcgcctgatatggatctgttctgggacattcagcgccggaataaaattgcttgcatcttcgttgacgaggcgcaattcctttcgaagaaaaacgttttcgatctgtgtcgcgttgttgatgaactcgaaatccctgtaatggcttacggtctgcgtactgatttccagttgaatctgttcgagggttcttactggttgctggcctgggcagacgagatccgagaactgcggggaatgtgtcactgtgggcgtaaagcaactacggttgcacgtatcgacgcacaaggcaacttcgtaaccgaaggggagcaggttgagatcggagccgaagacaaatacgtttcgctctgtcgcaaacattatcacgaaaaacttcttgataatgttggtctgaactgttaaggtgtattcagacaaacaaaggagaacactatgagccgtacttaccgtaagaaatatgttccagtccgtgataagtcttctatcgaacagatcgaagagacaaaagcattttcacagtattatgcacagcacggggaaagtcctgatggtattcgttggtactcaaccaactggaaacacaaatcaggttgcgcatatatccgattcgataaaaacctgaatcgtgacggtaacaaagctcatggtgatatctccgcgatgctttcgatcgcagtcaaaaagattgattcgaaagtacgcgctaaaatgcgtcaggagttacgccggatgaaagctggcgtgattggatgggatgaaaatatcgagaacgcaaataagatccgcgcttttgagcgtagcttatgctggtatgagataacttgatgtatttttagactaattttacataaggggcgaatcgccccttttttgctataaatatatacaggaacggatctattgttgatccgtgtgtacgtagagaaatgtttatgaacattaaacgcatatcacaagcgatgatgtttggattgttaatcttgtctcctgcatcacatgctgatcgaaatactgtcgtcccgaaagagttcgactattacatcaatgcagcgctacaggtctatcttgacacaatccctcccagtgtaaataccagtgaattgttctataactatatggaacgaaaatggcagcaaaaacaatgccgcactgaaccagaatgtaaacacctgggctatagggtggcaaacgaatttgctactattcatcgttcgtaagggatgaaagatgcaaacatttaacgaagtaacagatcgtgataactcaagcaaagtagatgcctttatcggtatgtgtctgatgtctgtaacatacatgcatagcgcacactttgcgaccggatcgtattctcaacataaagcgtttgagagtttttacgaagatatgcaggatttggttgataaattcaccgaaattcatattggtatcactggtcgatataaacccgtattaaaaacagaaaatgtgcttgacacggtggtgtatctccgtaaaatagcaaccgaagccgacacaatctatgattcagtagatagttcattgaagaacattctggacgagatcaaaggcttgtgctatcaaacgatttacaagctgacaaaactttcttaaaaagagtttgacacgcgaaaaagtgatgatagaataactatcgaattgaaacataaacccaatggaaataatgatgaacttaaacactatcgtaaacaacccaaagaaaaccactctgatcgctctgggcgtaatcgctgcactgtggctggttccgaactcgtacactatcgttcaggatggtacggtaaaaactcaaaccttcatgggtaaagtttcaccgaagcctgttctgcctggcttccacctggtaaacccactggctgatttcgaggtattcaacaccaaagacatcgcaatgaagtttgacaaattgcaggttccgtcccaggataaattcaaatccactgtggatatgaccgtgatgttgcagttcgatggtaacaaagccccgatcaaccgtatcaacgcgggtaatcaggatcaggcgcttgataagtacgtgaccgaaaaacttctgtctaccgtccgtgagttcggtaaatctgtaccgaaagcacaggatctgtataacgcagaagttcaaagccagctacagatcgcaattcagcaggaagttgaagagtatgcccgtccttacggttacaccgtgaaacaggtattcttgcaggacatcgacctgccggaagcgattaagaaacaggttgaaaacacgaaaattcgtgaagaacaggtgaacgcagaaaaagcagaactggcacgtaaagagcaaatcgctcaacaggcagttgttcaggcaattgccgataaagaagcccgtagcaatgctgcacaggctaacgagcgtgatgctgatgcccgtctgtatgcggctaagaaagaagccgaagcgaacgccgtgttgcagcgtaccattacaccagaaatgattcgctggaaagaacttgacgttcagatgaaacgcgcagagaaataccagggcggtgttccacataccgtaatgggtgcgggttacgatggacaagtgattttcgattctcgtaaataaggttttaaagcccccactctgggggcttgactcctaaaacgagaatactataatgaacataaaacagatcatccttactatcttcatttcgctattcttcggctttattggcggttttcttggtgtattggtgattgcgtctgttttatgattaacctttaaacgtggagcacgttatgaaacaatttgataaagctgtcgtaattggcagattccaacccttccataatggtcatgcagcaatggtgcgtaaagcactcgaagaagcaaagatcgtttacatccttctgggttcagcatatgcttaccctaacgttttaaaccctctgacagcgcgtgagcgtcaaacgatgatcttctcatggttaaacgctaacttcccgatcgaagatgttgttcgtgttcagtttgaacatattccagattatctttacaacgaagagaaatggaaaacctctgttcgtactgctatcagggaaaccaaaggcgacaaaatcgctatctacggttacgaaaaagatgcgggttcatactggcttaaagcgttcggatggacacacgtacctgttgatcctgttcaggttgacggcaaggatctatcagcaaccgatctgcgtccgattatcttcaaccacaaaaacggatgggataagaaactgttgcgctttgttcctcaagcaaccgtcgattatatcgacaaatggatgatggaagacacgttctggcgtttattctacgaatacgagaaatgggaaagcgaattggagaaattcaaaaactacccataccccgacgcgctgaactgctgcacgggtgatagtgtggttgtgtgtaacaatcacctgctggtaattcgtcgtaagttcgcaccaggtaaagacgcgttagcccttcctggtggacacaaaaacgcaaatgaaacgttcctggattgtgcaatccgcgaactgctcgaagaggtacgaatcaaggttcctgaaaaggttattcgtggttcaatccgtaattcgatgctgttcgatcatccgaaacgttccgtatacttctcaaaaccgactgtggcgcagtacatcaagttagaacctaacaatgatggaagtctgccccgtattatgggcggttctgacgatgcgttagacgcgttctggatgcctatgcacgaagtcaaacaaaatcgtggtgagttcttcgatgaccactatcagattatcgtagcgtttacgggactctgataaaagatgaaaaaagcccttgcgttcgcgtgagggcttttgttatattaggggcatcgaaacgaagggggtaattatgagcaagaaatcagaagtagccgaaatcagaaaactcgatgatggtaaaatcgcggtacgttggaaaggcaatcgcaagttcaatgtgattgaagatcccgaagtcgctgctttcctggtgttcatgattacccagaaagatacattcgttcctgatccaaacaatataaggctggctgattgatgaaacacccttactgtttagtaacccgtcctatctgcgcgggtggtttacctgtcaactgctggcagttgattcaaacaggtgacgcgttcctgaataagcgcggtgataaagtgttcgtctatggcgtggattccatcgaaaatgaaacgatggtgatcaccgacgagaaaacaaaagaaaaatatacgttgacttctgatcacgattgccgtaactttaacgtgtactggaaatctaatgaagactttgaaggaattaaatcatgaaagtagcaacccttagcgggatcactgatgtaaaatgtcgtatggcgctggaacctggtaatcgtgttcacattgcgatgtcgggtattccgggtcaaatgcaattcacgctgcaatctgttgcccgtgataagaacgatatggtttacgtgttcgtcactgaaccatcacgatacaaaacaagttcaacgctgatcctgaaaatgggaaccgctgatccagcaatgttgattgcgggaaccgtagaatctgtccgagtgacacaaatcctgttgaaaggcgcggaatgtaccccagacggtaacggcaaactgtcctatgaagggactaaacgccaaagtgttgatcgtcctgttgtagttggtgacatcttcacgtcagaacgccgtgaataccacgttgaatacatcgcacaagatggttctctggtttgtcgcatgtactcccgtaagagcgcagacgataacaaatacatgggattgactatcattgatggacgtgatgcgatcctgctggattccctgaatgttaaaattaagtttgcatactcatgattcacacaattagcgttattatgggtgatgtcgtaaacatcaacggacacgattactacgtagcggaaatcaatacaaagggtaatcgtgagatcctggaactggacatcgtaaggccgtccgaagggcaatcccttacaatcgaagtagttcataacacgaacacaggggaagacgtagtgaagccagttctggcacgtcttccggtgttctactgtgaaaagtcaaaacgttggaaaatgaaatgatagatttaactgatgtgaaagtgggtgataccctttttgatcctggtattcgtcgatacagtcatcacaacaccccacgaccgcgcaccctgcatgtgatcaaggttgcccgtcaatatctgtatgcgtcggaagatccgaatattaccgatatcaaagatttccgtgttgagcgactggatcgaaaaactggtagcgctaatgactggaataaccatacacagggttatcacagcgaagacgaatacaaagaacatttgtaccgtgtcgaacttactgataaaatcaaagacgcgttcggtcgtggacatgtaacgcgtgtaccaaatatcactaccgctgaactgcgcggtatcgcaaaaaccctgggggttgaattttgaaaactgtaatggaaaccgtgttcggttctcacctgtacggactgaacacaccgacaagcgacaaagactataaagggatctttctcccgcacccgcgcgatattctcctggggaaagccccgaagactattgacaccagcacaggcgataaaagctctaaaaacaccgtagacgacgttgaccgtcagttgtatagtctgactaagttcattagtcttgcgtgtgatggtgataccgtagcgctcgatatgcttcacgcttcggatgacaagctgatcgctaactctgaaatctggcagtatatccgcgctaaccgctggcgtttttacaccactgaactaactggcttgttcggttatgttcgtaagcaagccgcgaaatatggcgtgaagggttcccgactggctgcactgcgcgaagttgtcgatgtactgaaagaaaccgaaacgatcggtggtattcaggaattcacgccagatatgaaacgctatacgcgtgaagtgaaagtgtctgacatcaaggatcgtttccctacaaacgagttctgccgattcgttaccgacacgacaatgaaatctggttgtcaggacttctatgaagtgctggggcgtaaattccagttcacgatcaaagccgatgaaatgcgtaagtctgtgtataaactctgggatgaatacggagaacgcgcacgacaagcagaagccaacaacgggatcgactggaaagcattaagtcacgcgttgcgcggtggtatgcagttgatccagatttacaaagatggtgatatcgtttatcctctgcctgatagcgcattcctgaaactggttaaagctggcggcgtaccgttcgcaaccgtacaggaaaaactggaagaagtcatgggtgaagtcgaacgccttgcagcgatttcaacatatccgaaagaagttgatcgcgaattctggaacgatttcatcgaacgcgtatacagcgatcatgttgtggggtattacaaatgatgtatcctaaattgtccggcgctgaaattgatgttctgtataaactttacggatacgcaactaaagtgctagacttagatttcgatgacgtacccagcaaatcagggcgtgatgccctgattcaaaaaggttacgctcgaagggtaacgggttatcacgataattcgaaagcatggttgctgattaccccactggggattgacgcataccgacacggtattaaaacggagtggcactaatgactgatgttattttgaacgttaaagatgttgtactgggcgataccaaaaacccagacgcggttacactggaacaggctgttgttcagatcatgcgcgatagcctccgactggaagttactgaacgtaccgaaagcaattacacgggcgggattgatggtcgccagttgtacgaagatagcaaacacgttaatgtaaccctatgggcggacattgatgaaaactcatacaaaattgacgagattgattttgacgtatgaaaataattgacctctgcgctggtgtgggcggggttcgattaggatttgataaggcgttcggcggtgtcgaatgccttttaacgtctgaaatcgacaagttcgcacagcaaacatatatcgaaaactggggcgatgataacctacagggtgatctattcgccattgatgaaaacaaagtaccggatcatgatatcctgctggcggggttcccgtgtcaggcgttcagtaaagccggattgaaactgggattcgatgatgtacgcggtacggtgttcttcgaaatcctccgcattatacacgctaaaaagccccgtgtgctgttttttgagaacgtgcctgaactgctaacccatgacaaggggaagacgttcagaacgatttacgggcttctggaggccgaaggatacaacgtattctatcaacgcctgaacacaaaggatttcggactaccacaaagacgggaacgcgtgtttattgtctgcttcctggatgatgtattcttttcatttcctgttcccccgcgtacacctacacgcgtaggcgacatcctcgaagatgctgatgattcattcaccctctcagataacgcatggaaaggctttagagagcgtaaggaacgaaataaggcaaacggtaagggtttcggttatcaggccgtcacaagcgattctgcgcacactgggacgataacagcgcagtattacaaagacggtgttcaatgtctggtattgcaggacgggaagaaccccagacgattaaccccgcgtgaatgtttccgcttgcagggcttcccagattcgtttattattccatcgagtaagaaacaggcatacaaacaagcgggtaactccgtttctgtccctgtcatcgaggcgatagccaaacaaatcaaaaaggttctgtcatgacaaatgattacagaaaacgcgcgggtattgctgaacaagagaatgcccgattgcgtgaagaactcaaccgccgtccaaaatatgaatggtttgttgaacaagttcgaaaggcattgaaacaagcagacaccgtgcctccacaaaggttgatcccacaaatacgacaactgaaagaagcatccgaacaaaggaaaaagaatatgagaaatcaacccgatatcccgatcgataccgttgttgaatggcattacaaccactgggataatgatgaatggtctgccagccagggcgtattgaagtaccagaaaggcaacttcatcctgatcgaactcgaaggtaagccaaccgtgctggacggtaaagatttggtaatgcgtccgtacaaagaaagaccggaaacaaaattcttcaaaaaagtgtttgcatccggtagttgatagtggtatcgtagctttaccgaaacaaaggagacacaaaatggctaacatgactaaagcgttattccagaagaaagtaaaagcggttaaagaacttgggttcactccggctttgatgactaatggcaaaactctgatcattcgcttcgtgaatgcttacgatgaagttgtgtgggaaaccgtttgtgtcgcctcttgttatgacgttttgaacagacaagagaagaaatatcttgcatggtttaacgaagtgtaatatattggccttgttgaaacgaaactgaaaaggaacataccatgacttttaatgacctgtttaacggatgtactggcgctggtgcgaaattcaatctcctgaaagattacccgctgggttctaatccaggttacgtgatggttgaagtgcgtaacggtgaatactacaacgtgttcatgtgggatcgttctttctcttactgctggttcggtgcgaaatacaaaccagattacatcctggaacaaatcgaaacagtgaaagcgaaaaaccctgaactgtacgctttcgcagagtctatccgtggtgtgttcggacactgattaatcaagccccgaaaggggcttttttcgtgaggaagttattatgatctatactgttgaatgtcttgttgattgtgagcctggtaatctgatttgcgcatcggatactattctggactgtatcgacgcagtgaacaatcacgaaaccttcccgtatgttgccgatgatctcgaattcatcgcatggaaagacggtaagaaagttgcggttgctgtattggtggggaacagagtaggcgatacaataggcgctaacggttatgaaccgaaccctgtgacctacgaagaagttattggtaaaatggtgatcgaatgaaaaataaaaacgccgaacgcggggagaataccaacgaaatgttcttcattcgttgcaatcgtaagcccctcaaacgcgggtatgacgacatcgacgaagccctgagcaagtttaacgaaatcatccgttcatccgtctaccgtagcggggaacatcctggcgacctgtgggaactggtagcaaaagatccttacagtaacatcgtcctgaaatccgaaacaaagggtaaagtatcatgaaaatttatactgttgaaagtttaagcgaagattactatacatttagtgatttggtcggttctaccgtatcgctggaacgtgcgattgaaatggctaaaccttttgactgggtgagtatcactgaatgcgacggctttactggcgaacgtctgcgcatagtaacactgagcaacgaaaaagccattgcgaacgcaaccaaagaaaacttacaatttgaggatgtaaaatgaaaatccgttctggttttgtgagcaatagttcatcaagtagtttcatcgtccggttcccgaaagatccgactaatatcgacaacctgcgcgaaatgatgggcgattgcgtccctgattgtggttactacgatccgccgttgacagcggaagaagtggtcaatcacgttcatcgtgacttaggcggtcatctgggtaatagctttgaatcgttctacgacgataagcgctatgactgggaaaccgaagaaaacgcggaaacccgctaccgttcaaaccctcaaatcgcgcttgcgtatgacgggcgagactggtacgatctggacacagaagagaaagacgctctgatcaaaatgtggttgtatgaagaatacaacacgaagttcggcaatcaggacggcgtgtttatctttgaattcacgtactccgatgaatgcggcccgatcggaactcaactggaacatggaaacatcttccgtaaccttgaacacacatcaaagagtcatcactgatggataataaactgaaaacagaagtttgtgttgttatgcctcgctatgcattaggggagtcgatcccctttagccaggatcgccccgcaccgtttgatgtattttctttgcgaaaatatcttgaacgatttgaactgaacgagtatactctccaaatcgttcgggtatggaatccggtaatgtatgcgcttgcgtttgacgttgctgaatccaaactcactacgatggatgaatacgttgaactcctggcgcgtaagttcgggtgtgatcgtacagtcgaagcagtaagcaataaagttaacgaaattttagaaaaattcaaatacgagaaaatttaaatgtcaatcacaaatatcgaattcaaaaacgctgtatcgaagccaaccccgacaaaccacgttttcgtgtgtgacgtatccggttcaatgtacaacgaactgcctaagatccgtaaacacctgaaagcaaacctggcgagtctggttaaacaggatgacaccgtttcgatcctgtacttctccagcaaaggcgattacggcacggtgttccgtggtgagaaggttagcaatgtctctgacctgtctaacatctgcgcggctatcgaccgttacctgaaacctacgggttgtactggctttgttgagccgttgaatctggctgcggaaatcgctaccgatctgcaatctgaaaacggcaacctgaacagcctgatcttcctgacagacggttatgataactgctggcgtaccgatgatattctgaaagcgtgtgcggttctgccactgactttcaacagtatcgcgttcctggaatacggttattatgtaaaccgtcctctgctggaaaaaatggcagaagcaaccaacgcattgcacaaattcgttgaaggtttcgacgcatacgaaccagcatttaacgaaatcatcaccgcgcagacttccgcgcgtatcgaagtcaaagttgctgatgctacccatgcgatctacctggacgaagggcgcgtgtatgtcctgaacgctgcaaacggtgttgtgctggttccagaacacatcaaaaacatctgggcgctgggtgaaaacgctattaatgatgttgacggattcgatccgaacatcgccagcgaacagcaagttctgtatgtcgtgctttatcatgcactgcacacaatgaaccctgatctggcatggaaagtgcttcaaaagctgggtgatgtccgtctgatcaaagcgtatgacaactgctttaccaaacaggactactccaacgcgaaagacctgattgcacaggctgttgtagatccatcacagcgtttcgttgatggtattgattacaacatggttccagacgaaaacgcgttcactctggttgatgcgctcgaactgctggcacaaactgacacagtgatcgacctgtcttctgagcactgggcgtataaccgcacaggccgtcagactgtacagaaagaagatgatacactggatcaactgaccgaacagatcgcaaacgctgcaaccccagaagaacgtaaagcactggcggcgcaaatggtagcgcatgaagtctggacaccgaaatttacccaaaccacaaccaaagtatcggttaaacatctggtgggtaacagttcccgtccgaacatttccatcaacacggatctggaagggtatgtgactatcccagaaagcaaacagaaagaattcggtctgccggaaaaagtcgaaactaagcaggtgcgtaacttcaccatcgttaaagatggtatcgtgaacgttaaagttctgccgctggaaaccgatattccgacactgaaaaaccttcgtgcttctggcctgactatcaagccgctggaaaaaatcggtgatgatcgtatgtcggttctggtagactttacctctctgcctctggttaaccgtggcatgactcgcgggttaagcggtaaagagttcgtgactgataacgtgcgtctggaaatcctgaaaggccgtcagaaggttatgaagttcttccgtgacaacgcgatcggactgcgcaacgcagaagggctgaaacagcgctttggtgaggctgcgggtgaatggctgtctgaacagggtattcgtgattacgggttctctccgaaggttgagcgcacagaatcgactgatgtttacatgtcgaaagaactgaacgtgaaaatcaagggtgtttcctcccttcctgctgtagcggctaccgtcgcgaaacgtgacgaaggtaagaagaaactgaacaacggcgacctgattatcctgtgggcttacgatcaggtgaaatctgaactggatgcgcttgacaaagatcaggtagtcgagtatcttgataagcagacaaaggcaacgattcaggaagtccgtaaactgaatgcccgtttaagtcgcgtaatgtacggtgttgtagtagcccatgcatggttcgcggatctggacttcgaagaaaccaaagtttctatcgctgcaaaagatattcttccgaaagaagataatattccatccgatttctggaaagtctgggaaaccacatcattcgaatgtgaaatcgtcctggaagaaaaagaagtcaaaatctaacaatgaccgcccccgaaagggggcatattgaggaaaataatatgtcacgtaacgtattctggggtgaagttgtaaaaggcgatatcctgtatctgtccgaaccacaagcctatcgtgaaaacaacgaaaagaaccacgcatacgcgcctatgctgccggatttcgtggttgttgatgatgtatttgtcggtgaaaatggctggcagatcgatttagtcggattcccatacaaaaagggtgcaatccttctcgaactggaagatcatcatttcttcgcccatgttggcaacatcgaagatcatggtgatttcgatatcgaagatatccgcgaaaaaccgtatgtattcagcaactactacaaggtcggcggacacctgcgtaatgataacaaaactgttctgtatctggatggtattctgtctgggatgcataatttcagcattgagaagccaggcaacagcgcagaactctaccgcttgtttggaaagtacgatcgccagaatggtaaactgttaccgtcagaaatggcttatatcatcaatcgtctgatcatgggacttcacaaaacattcctggttcactatgatggtgatgtagaacaggcgatgactactgtgattgacatcctgaaagcaaaatctcgtgaaatggataccctgccaaaatgacattattcttcatcattgcgttaggtgtgtttattctgggcgctacgattacattcatggcgttcgataaacgcgaatatcaactggctatcatcgggcttatagtagcttgtatcccgctggtgttgtcatacaacctgtatcatgagaaaatcgcagataacgcgaaatacgaggcaaggcgatgaagatccgttctgggttcgtgagcaatagctcaagcagtagtttcattatcgggataggacttgtccgccctggtaaagaacaggaagttgcaaagatttacggtgagtcaaacattgaatcgctgatggatatgatcaccgaaattcatcatcgtccgcgctggggtgttcctcaagtacatgatgacggtacaatcacactggaagcgttcggatgtaatagcgtcgaaataacccgcatctgggacaagctgaaagaactgaatctggatgatgttaaaatcgttcacttcaatgagtgcggcgacgaaccggaatacgacgaggaaaccggaagttataactatgactggtatgacgacgcggacgcattcgggccggaactcgaaaagaaatacaatctcctgagagataaccgcgaactgttcattgaaggtgatgttcgttgcggtggtggttatgacggctaaacgattggtgatctgttatcgctgtttgcatgtgtatgatcacaacacagcgaagcgaacagcaacaaagcgcttgcgcgttaaagaggcggaatgtcctctctgtaaatgtaaaatctgtttggggtaatccatgataacgatagtatactgggaagaattggaaagcgaattcagtgatgaagctggggaaatggctgctgtagcgggtgaatctgaaatgcttacagctaccgaaagcatggatgatgcatttaatcgcatcaagaaacaccagaaagaaaacgaaggtcgggatattcagtacatgctatcgttctggctggatggtgaaatcttctgtcatgctgctattgctgaggatactccggtcgatatgtgtcgtgaagaaatcgtgaagtacgtcaaatcttttatgcattaattaaatgagaattgaaaaatggcttatgtatctaaaaaaattgaaataatttcgtcgatgatgggtaaaactctggaagagatcgaccggattgggaagaactttaaagatgaagttttccgtttgcctgaacgtgaaataaatttaatcccgtatttcaacacggttaaaattctgatcgatcctagttttggtctaacggcaactcattacattgtcggtaatgctccatatatgttcgtgttcagaaaatctaagttgattgcgtatttcgatcgcgcgaatcttggacatgttcgggcaatcatcgaccggatcgaccgttatgaagtagggaattacacggaacaaaccagacgcactacatacggaaagattacgagtatgctggaacaaaccaaacaattcgacggagccaacatcgaattgattgatgatctgctaaaaaggatcaacaagttcaaagaagcgtttgacgtaaagaaaaccgcgcttgctgaaccagaaacggtgaaagcgccaaccctggcatctttcgaagaaccagaaaccattccagtaaacacagcgttgaaatacatcatcgaaatcgaaccaaccgatcttgatgcaacatgtaaagcattgaattctatagggattaatttcactctctataataaattcagttaatccaaaaaagcccttgcgttcgcgtgagggctttgttatattacacatatcgaaacggaacagccaaaaggaacgagaacatgaaagctaaaatggtgaagttcgtaaaagactggagaaaaggcgcagtaatcggtgagagctacgtaatcgtagacatcgaaagcaacctgctcgaaggtgcgaacgttttagaagttcctcgttacggtatggttgaagccgctgataaagcaaaagaactgaacggttacgttctccacatcatcgaagcaatcgagaaggaattagcatgaacagcgtttatctgattgaagaaaccattatccagccaaacggcggagtgtatgaaaagaatatcgtgtgtgctgccctggatgaacaagaggcagatcacaaagtgaaatatttaaatgaaaatgctgttgtatgtcagacgtattccggttatagtgttgcatatgcttggaaagcggttagtttagaaacccaaccatcttggttaatcaacctgaaaaaataaggggcttatcatgaaaatgaattacgttcgcggcggtatcatggcactgttactgaaaggtgtttctcgtagtgagaatcgtatgggtatggggccgatgggtaaagtctggtctgtctatattggcggtgactgtatcggttacatcggcaatgatggattgagccgcgtttacctggctatctcaagcgggggtcgtgaagtcgaatgtggtaatttcatgcaagcacttgcgcagttcattgatactgcgatcactcagattgaaaaacagggctgcatcgaacgccgttacgcgaacaagatcggaatgattgaatattccaacttctgcttcgaagtcgaagaagtgcgttacgacactatggacgaagtatatgaatatgtgcttcgtggtgaggaagtgattaagtcctacaacgggacgaaggttatcaataaccgctctttcatcaccccgttcgaattgcgatatcaacagctaatgggctggatcgtgatggaataagaaaagcccctttcggggctttttgttatgaggatgatagctggagtttgattctttctacttcttccggttcatcaatgatgctgtagtaaatcgtcacggtgattgcgttttcgtcatactgcggaatcacttcaacatccagattgtaaacacggggttcgtatgcgcggatcgcggagacaatcgaagtccttactgcttccgctgttagcgggttcatgttctcgaaaatctgttccccgatctcacaaccaaagttgctatcgaaaggccgtgtgcctttttgtgttgttacgataccgatcagactattctttaccgctgccgcccctttcgaggcggttacgtcattgttccagtcttttgttaagttgggatcgatatcgctatacagtaagcgaaggttaacacccattttatccaaccacctttagaaacgcctctaagcctctcagtgcaacgatatgctcgtagccacacgaacaccttaccggaatgtttgcaacgattgctggcttatccagagcgctatttattgatttaaagaccggatagtcgatactatccagaacggcttctttctctgactctttacagtcatcccataagatttgttcaccgtcgatgactacaaacttaatcagttcggggaactcttcctttccggtgcggtgtggttcgactgaaatcttgatctcattgccgtacagcttttcttcatattcatccaccatgatatgatgacgattgagcacaaacttaatcagttccccgcattcagggcatttgatttggagatctacagtctctttgttgatactgtcgaacagagccataatgtaaacataatcgcgctgatgcttgaacacatcaccttcaataatgaagttatccgtgtcatcaagatcgccaatggttaacgggcgataagtcacattatattttgggatatgtcggggtgtatgtttacgcatttgcattctcttttcgtttcaagtcttccgccagcaatgcaacgtaaattgaacgttccatcgggcttccattcattataggttcaatctgtacggtattcttatttaacaaatagttggttttgaagaactcattcagttctgatttgttgaacaggattttgtacagtgtcaataagtcgctgaactcaatatcacgcacggtaacatgacaggacttgcgtaacagtttaacgatattttccatatcttcaatagacaccagatccaggatcgcgttctttgtgtcctcgtctaatgcattccattcgtatctttcgccgtcctgcttgacatactggatacattcaaggaataattgttcactgttgttacgatgtttcgggaatttgaatcccagagtaagcgaatcatcaagggcatattcattttgcaaaacgtaatcagttacatgcatgaatgcttctgattgtccgctgcttcctttgattcggatcttgattgcgttcttaccgaacgatacacaatacaccttagtgaaaatgttttcctgttcggtgcgggaataacccggatacagaatatctaaaatttcatccagcatttcttgctgttctgtgagcgtcttcccttccatgtccgcgcttgtgagtaagaaactcaactgatcgcgcacggtaaacatagggaatcgcttcactccaccagggagttttacgcggattatatcaatcattttaacctcaaaaggggctttcgccccttattgtcctgtaaccacaccacgaacggcaattgctgcaccttcgataagtgattgtttgaatccgtcccaaccttctttatctgcttcaacaagccagcctgttttataagcaaagtcaacagtgaatgtccagatttcgttattgctttcataactcagttctgggttgctgactttaacaggcaaacacttctggaatacatacgtgctgtgcgggacaccatcgcgattgtgtaagtttacctggatcgcgcttgatacttcatcaatgaatgcgaactggcctgagacatcatcacgaatagctgataaccattcgttgaatactttcaggttacgcgcttctgaatccacacggaacgttagcgataattcaccattctccggtcgggtgaatcggatctggggtacaccgccattatacacgtattcataacccagtgttttaccaggcaactgaacaccaacgatgctcaaccccatattatacatcattttgtcacggaattctgttagcatctgtccgtaaacactatcaccaaacagggaagtaattaaacgagggcttaacgcccccatgattttactgaaacctgttttgttcagggacataatagctttatcaactgtatagctgaataacttgcttacgccccctgtaatagcgttcatgaactcgttcgggttatttgcgttaatggaactcatagtaccatcaattaaagtatcgcggatactcccgatcgtgctgtcgagaatgcgtgatgctggactggttgcgaatacaacactaaacaggttgcttcgctggaagtctctatttgccattcctgacaaaaattcatctacgctatagaacattgttcccccttaatactgcgtatcaaaaatcgaatcctgacgcatatcgatcagttccataaactgaatttcgatttcaactgcgatcggggtgttcggtgattctctcaacgtatttacaatgttgtccattgtacgcccgaaacgaacgctggtaatacctgctggcccgaacgtggaatgagggaaccgcaaactgtcgcctgtctggaagtcacgaataaaccacacaggaggcgatttaataacttcaacgttcgatacgaagtcaacaatctgatccccgatgctgccgttgaaatcgcttgctgtcgtctggtttgttgatggtgcaaaaacgtttgcaaccttcgaagcactggaattatacgcttgtttaaccagtccggctaattctgctggagtaccgcccgaagtagtaccataacccagcaccgtgaacaggtaatagattttaatcagttccagcaggtcataacggctttcgataacgaatgtattgtaatacatctttgtgcgcttatcagagccttgaaacgctgctttcgtaccgatgtcgattgcttccctacggtctgccagaataccaccagaaacggattctacagcgccccagataacgtttgataccgcacgggataaacctttagcaacaatactatcggttgcatcctgataacggtgtgagttcacttcgttatcgttcaggcttcgcggtaaaagtatttgacaaatggggttaagtgtacccatagtacgggtattcaaaacctgtttgtatcgaacgttcccagtgttagcactaaggatctgttgcgcgttctgtgctgcctgacgtaatgagcggtagttgtctttactgcctggtgcaagtccacccgtgaaatcatatgctgtgaacagcaagccgttattatacaggcttgatgcattataagcgttatcaatacctgctgcacgttgggaaggaaattccgctgttacgatcggttgagtcaacgcgtttttagttgttgcagcacccccagaggggatgccagcatttttgatttcagcaaatgattgtacagtgtcttgcaatactgtaattttcatttaaatttcctttaagctaatgcaatcaatggtttacggtcagttcgttgtactgaatgctgaaccgtgttgtttactgttttgttgttgacctgaacgctgttaggcgttgtaggctgaacaggggctttcactgcttccggttgcttgtcaatacttgcactcgtttccggtactgcggtgatcttttcctgccagcgggagatcatatcacgatagcggtctttgtcgtcctcattcagcttgttcgaattgtttttctcttcaagcgattctatgagtttttccattacctttttatcgttgcccgtcagattgtctttgttcaggatttcatcaccctgatcgaattcattatccgctttaggtttcgctttcgcttgcgcggcttcgatctgtttggtttcgtccacgcgcttacggttagcggtattctctttatcaacctcagcctgtaacagtgcggggttttcctgcaatgctttcagttctttcttcttctcttcggtgatcttttcttcaatagccacacgatcgcgcatctgttccaattgcttagacaatgctttctgtgcgtctgtttgctgtccgaaactatatgagaatgcgccctgggtagccttaacctgttcgacaaccttagaacgtgcctcaaccactttatcattctgatcctggatctcctgctgtttcagcagaatcaggtcatcgggatcaatttcaagaccgtatttttgtttgtcgcgcagtgctgatactttcattccgcgtccggcgttggtaatcgtttcagatccggtatattcacccagagcgtaaatcagattaccgataccttccgtgattgcggttttgatggtatcgcccagaaccttaaacggttcaaggaacaagtttttcagcgattcgcccaaattactcatatcgaagttttgcagaccttcgttgattttctcagcaagggttttgatattcccgaagtatgaaccaaacaattctttcgaggcttcaccctctgcaagaatatcctggaaccacttctgaacaaccttactcagtacgtcgatcgcaaatacgatactaccgataatcagagtccattttgcaaacttcgccagcgcttcgagagaataaccgataaagcgagccagaagaccggatgtattatccttaattgcacccagcaaagacaatactttcttgctgaatttcttctcgtctttatccttatcgcggatcttcttcttgtcccgatcgacctccggttcctcttccggtactggttcaggttccggcgcgggggctggtttcttttcagcgagttcgataaacttggtgattgcttctgcaatcgttccggtgtatgtttcgattttcgcaaatgggttatgctggttcgatacactgacggagttatcaacactggttgtgctgttgtctgttaatgatggtggacgcgctggcccaacaaaatcgggcaactgttcagcaagtggttgctgatcctgttcgtattgttcctggaagccagcgaatttctctttgaaacgatcctcaaaggatttcacactgtctttgatgtccagtgtattcagcgcggtttcaagggtattatcattgatatcctttaactcgcgcatcgaatctttatctaacgttgcctggatcttacgaacagtcggttgcgcctgtggttttggtggattctgcatccggcgacgttgttcttcgttaaaatatggattgctagccattatcattcaccgatgatgttaagccctttaatggttttcccctcatgcacaatatagacttcctggagtacgccacgttttacatcgtcatattcataacgatacaggcagttaattaattgaatacggttttcgtccgtcagttcgatcggcttcccgttgtcatacgcttctttaagcagtaatgccagatcatccagcattagggtcggtttgttgaagaccaatcgaaggttatcaaaagtatgttcatacttagcttcgctgattttcatatcatccagattaataccgatctctttcaatacagccattgctttatcgtcattatgataatgcaggtgaatcaaaaggaattcggtttctgctgcggttaattcgcgcggttgaatctctttgatgatatactcaagcaactgcattgggtctttcattgctttaatctgggtgaaatgacgataacccagacgggggatcgtaacctgttcaccagtaggcaacgtgactactttatttttgctgttcttgatgtttaaacgcgtaaccataaatttatcaagtgtgtttttcttctctttcatgatcgcctcaagtatcccgatatttactatttagtaaatagaatataaagggaggatgtctaatgtccagtaaagttataaaccgcgtcgtgtcggttaaattatatccaacatatgaaaagttcgctgataacgtctatcttgaattgttacctgcccttgtctcaatgagtgagaaaaccatcattaacggtacttctgaaacattgatgcagatctatgataaccagttaatctatcagttgacagagaaaccgattattcaggtatccttccagtataacgaaacgttagaacagcattactacggtgttctgtattcaaacgtcgaaaccgatgatatgaaccgctctatactgcgcctaaacctttctccggtgcatacggtgtttcgtcgtaagttttcccgttcgttcagtaacaacgccgtacagacgattacagagtgcatgacggcactgtataacgatatgaagttgatcacgccgcatatcgacgcatcaaacgtgcgtattcctccggcttgcctgagcgggacgtatgaaaccgtgtttgattacatccgtgacaacgggcagagcgtagattcgtctgacttctgttatctgtgggaagatggttccggtatctttatgaaaagcaatacggagatcctcgcacaaaccccgttaaaggcttacaagttcaacgtaagtaacccgtttttaggtgacgctttggtattcactaaagcagaatacattacccataaggataacactaccctgttaggggatgcaagtttctttagtttctcgatgacggataaaaaactgtatagtgatatccttgcgagtaccgatattgaaaacgcatggatcaccatgaacaggaacgcggtatatgagaacaacttccagaacccagacaaacagggtcaaccgttccaggctgtgaaatgtcaaacgttatccagttatgaaaaacgtattcggtttgatatcaatcagggtcgaatggatgttaaagtgggggcattgattgaggtgttaggggatgaatattcagggaagtatctgatcgttgaatgtatccgtgacgtatcaaaagatttccacctgcaaacattggaatgtgtacaggtggcagcggctacgaacgacaccagcaaaaccagcgaggcttaggccgtagtttcttcatgatagcccatgaacaggtcgaacacgttgttcttgttctgtttacgggctttcttgatattctcgtagttttcgcgaggcatatcgatcatgaagcacttctgacgcgctgtagcgttctctgtgagcgcaaacagttcatcttcggtgtattccttgtttttatccagatcgagaatgacgcattgccaggtgtcttcatcactggtttgctgcatcatcaccagtgcggcgtttttgaatcccagattatgcgcaagcatttcatggacgaattcacgatcctgatcttcataacggatttcttgtccttcccaacggatcaggcggatagttttacttggttctgatttcataatttattcctgctaataatttcacgcaaacgcttcgtcggttctggtggattcttaatgatttcctgaatctgatcccagacttcttccgaaacttctttcctttccatgataacaatattcgggttatcacagcattttccaaccataacacaacgcccacaattaaggcagattgtatccggtatcgttggagcgttatcaaggaagcgaccgaaatcaatatctttcagcgcttccgcaacccgtgcttcaacggcttctttactcatatcaaccatttttcgcctcgttcatccaatcgcggaatttccacaatttgttctgtgctgcgatgtagctttcttcacggaaattggaagcgcaatagatcagagtcgggatctcaacttcgctagtgcttggcttctcgtcgtacacccacacctgaatgttctgacgagttaaacgcggtgcgttcatgccagcaatcagagccagaaaatccgctttcttagttaagtgagccattgacataatctttttcctctttccgtgttgtttcgatgtgtgtaagataccattaccctacacacaccgcaagcactattttcaattttcttctttgaagcaaagttctacttcaacgttaactaagcagattgcgatatcccatgaatctgcaactgggtcatatactgctttgtcttcgtctgcaacaggcagagcaacaacccaaccatcaacaacacgtttaacccgaagtctttcgaataatgctaccgcttcgcccaaagactcaccaccattcgccagcttttcaaaacgcgcacggtctgccaggttgattactttgccttcgagttctttagtgattttcatgggatgttccttttgtctgtttcgtttcgatgtgtgtaatatacaaaaagcccctcacatatgcaaggggcttctttagcaaaaagtgctatttaaaacagatcagcgaagataacgtgaatgtcatctggttcggtcttatcgcgtcgaatcttcttgatgattggcaggaagaaactgaactcaggttcgcccttcttacgcgttttcgatttctggagtccgtcaacttccatttcgacgatagcgccgatatagtcatctttgttcgccatgatgtattcgcgatccagttcaccacgttcttctaacgggatgtacacgcggttaataccgtcttcatcgtatcggtaatccgtatcagtcagaccggaacctgtgttcgttctggcttctcctgataagtcctcaaccacgaacccgccaaccttatgaggttctttggtgtgttcgtacacgtcgatgattcgcagttcgatcggggttttgttcttcaacttcacctgatccgcaacgcgtgaatccttccatttgaaatcaacgtttttcaggattgaaccctctttaccgtcattgcggtaattgttgtaatcctttttcgcttccgcgtagttctgtaccaggatagaagggatcaacttaaccgatgttacaccagagccagccagcgcaccttccaggatgctaaagcgatcgcaatatggttgaacactcggagcatcgccatagtatacttcatacggtacgatatcccagacaacataaacgatattgcgctgttcttcgtcgctgatagtacctttcagggatttgtttacaatcccgttgccctcttcgcgtttcgcttccgcttgtgtctcgttctcggtagcttcccgcctaacatctgccacaaggtcagaaacagaatcgtcgtcatcgcccataaacccagcaagactaaatggaactctgtttgaaggaacgacagcagttttttcagcagggacataaatcagttctccatcaagtacaacatcataacccagataatcacgaatctttttcagatccttgtccagattcaccaaaccttcgtactcattccccgcgcgggatgctttgcggatcttgtcttccagcagatcggacatacaacgcgcaccatcggctttaagctgcgagtaagcagggaagcgaatacgttttaaggctttctcactaaacggcgtagcgaggcactgaggctgttctggaatgagtttcttccatacgcggtttggtaacgttgtaccagcaccacattccagatcgcggttaatgatacggcgaagcacttcgcggtcattctcgttcaccgatgatacgatatccagcagacgatcacgggctgcattgcctgtatattttcgcgttgccaaatcagacatcaaatccgcgatagcattcgatagcggggttgtgcctggcttgccgtccacctgcggaaacttcttaatgtgaaacataatctgtttcgtgtacgtaatgcggaaaatctctttcagcagttcattacctgcattacgtttaaggatcgcttccttctctgaaattttcagagtcgaagcgagttcatttagaatctgtaagatcatgtaatttctcttcgatttcaaaccatgatttaactgactggtgaggcgaccacggggtttcacgttcaccacgcaacatatggaataacggcaactgactgatgacgttatgacattcgtttaagtttaccgcaagatcatcaacgaagcaaaccagacgattgccatatttggctttcgcttccagatagcggtgtactttagtttcaccatgcccgacaaccatcacttctttaaatgcagaagggaacagcgtgttcaggttcgcaatacggttaaggcttgccgtaggagtggttcccagcgccgtgacagccacgaaatcatattgggctttcagacggttgatcacaatcaacgcatcgtcatacgcgcttagatagcgaataaacgaactgttattgtattcttccatgagaattttcgccagttgatgatcgcacccgaagatttcggtcatatcacggaacttttcatctgtaaccatatccagggcaatatcggtcggcatgttgtgtttagacaaaaagaacgggaggccgctttgccacttcacggcgatcccgtcaatgtcggtaagaataactggtttcaagatttaacctcataacgatcaaagaaaagggtactcttaaacgcttcaatatccgcaaggaatttgtcacgctcaaatgtacgataataatcaaattcgatacacagcatatcatcgttcgtaacactgataccagtgatatcttgatgatatttctttgcctgttgcagaacgaaaggatcaagatccgaacaatcgaaataaattacgtaactcattatcaacccttgtacatataaacagcatcgaagcctggaacatccatttcgactttatcgaacacaatatctttcagcttacatttttcaacgtagctgttgatcacgttaatgttgttcgcgccgatggtgacgtaatacacacccgctttgtagataacacccataatcagggtagaactcaaagctccctgtgcgtggagtaatgccagcggattgatcgcgcctttgaacaggaacgcgcattctactctttcatcataatctttataacctatcataacagatctctcaatcgggttaaatttcggacaaactcacgttcagtgagcacagtttcattcatcttattctttcccattgaatgagtcaaggtactttttccggttgcagccagcgcacggcggaacccatcattcaggaaaagagcattgtacgcgttttcaatcaggatttgatacgcttctgattcacggtgaatcggcatacccttccagtatagggtctgatcgcgataccatttctttttcttgcctttgaacttggcggctttaccaaccagcgtacacacatgcgcttgcatatctggattgctgaatttcagactttgtaaaaagccctccattgatgcacattctaccccgtcaaacgtgaacggatgcggggcgaagttgctcaacgcgcatgatggatactgactacctgatccgatgtccataatcaccccgcgaagttaacgagtaacgcggaaaccatacaacccagagcaaaaccaaaagcaatcaaagccagttcactattctgtttcattttcggcttccttcttcccttcctggcgagcgcgtttgcgtccagcacgtaccagagaatcatagtacggacgtttgcgatcaatgttgtcagtgcggtatgctttaccgtaatgactcgttttgaatccgtaatacttcacgctttaacctcgtaaggcttatggagtccacgcaccggatcataacggtcatatgttgtcccgttggttgatgccatgatagagacatcctggcgacggttccagttcaacagagcaagaacgatacgatctgccgcttcaataaaatactttttcattagaaacctaccttccatactttttcgaatttgtcgaatattgcaccgatacttttcagatacgcggttgcgtcgtcttcggaatttgtgtacatcgcgaaggagtatcccccaaattcacggcacactgatagcggtttgatgctggtaatgttttggttatatacccgcatcttatcgatcattgcttcggtaatttgatgctcatgatattcgagaatatatttcatttgattgtatacccgtatttgttggtttctgcattcaatgcaatagccagcttattcagatccccaatatcaccctcaaggtctaaatcaatgctgtcaatcttcgcatcattataaagatcagtacccgcgtatgcatcaatttctacgattttcacgttgtgttctcgaatgagattcattgatgcttctgggatacgacgcatttcgaactgaaacgttcttacttcgataccttcacgcatcacgctctctccagacgggttgttacttcacggttatagatccgcgcatactggcgaatgtcttcgttatcgctggtgttcttcgcgatatatgcatcatcttcggtttcgaatgatgctgggttgcgatcgtcgttcgacaggtacagtttaccgaagatatctttctttacagtctgtaccccgacaaacatcacaaaatctttttctgtgttaatggaactcattgttaagccctcaaaccaaagctacgttttttgatgacggtgacattatgaacacctctgttattgcaagtgctggttttcagagtttcggctttacgcgcacccagaaccagagttttaacaggagtcacaggagcagcgataaccacaacagcagcccaacgtgcgccaacagctttatcagtacccaggtcgattacagcagaggtatttttaccagcagccagaacatacgcacgggcttcacgacgagtgttgaagcaaaccagttctttcatgttgtaagttttcataatgtcatcctcagtttcgtttcgatggggctatattctcacaacccccagattaggtcaacaactttttagaatttcgcctgaacgtcagagatatcgtcggcgtattctacttcaccgtttttgtgctcgatccggtaagagtagcccattcttttcatttccgcgtctgggtcagagaaagcgatttccttaacttctgcaaccacaacaccattatcaactactacgaaatgttttgctgcgtcgattgggtttaatttaatcattttctcgttcctttctctgtttcgtttcgatgtgtgtactttaccacactcacgattcagtgcaagcattattttgcataaaaacgaaaaaagccgctacctttcggcaacggcttgatttttaatacttttcttctggctggaaaaccgcgcgacacgcccacatagaggcttctttcagtcggtctttcgccagttggatttgatggacacgttcaagcatcgcatcgagttcttcggtagtgaatgaatcggtatcagataccgcgtaatcacttgaatactcttcatccagttctttgaagatttcgcccagggcaacttctgcggccttgatgcggtttactttgtcgatcttttctttcgagtggggcttatagccctgtacgtcttcaatcgccattatatactctctgtaaaggttcgggcgataacgtcgcgctgttgttcaggagtcagtgaattgaaacgaactgcatagccggacacacggatcgttaactgtgggtatttttctggatgcttcacagcatcttccagagtttcgcggcgcaacacgtttacgtttaagtgttgtccaccttccactttaacagtgggttgaaattcaatatcgacttcacgttttgcgaatggagcaacgcgagctttaccgatcactgaatccatttcgagggttttggataccaccacacgaacatcattaccttcttccaggtagattgtgccagtgtgtaaaccttctaaaatctgatatgctttcattgtattacctttctacgacataataacgcaacgggttgatatggaacgccagcattgcacgatccagcccgttagggtcagttacttcctgtttcagtttccacccgcaatacacgcgtaagcagaactgaacctttccgactttaagccacggtttgaagacataaagcccccatgccgaatcattccacatcaacagataaccgtgacgcgaaggatcagaaccaccttctgttttcgggttgcccttccaggcgaagtctgattgtgcttcacgccctaagacgtgataagcgaagttgtacgccttgttacgccacaaccagcctacacgttgcgcatacacacccagatcgcctaagtgataccggatgttagcccaacgccggatatgtccaccatcaccatcgatcgggttatcgaatgtttccatccaacggaaccctttaggtaagtgtccggtttcttcactgtagaacggaaccacaaaaggagccagcagaatagccagaacaccagaaagaatatcaaggggaaccagtacaagccagcttgcgtattttaaaaagcgcatgtgcttctccagaaaaaaggctatccgaagatagcctgttgattaacgaactgctttgatatacttatacgcttctgcgaattcttcttccagagcttcgttgcagaacggaataccttctgctttaaatccaccagtgataaggtactggataaagaatacagaagaatccatagagatcaactgatggttcgtaggttcgatatcagttcgacgaacgatattgacgatcgaccagtcaaagaatcgtcgatgatattcgtgtttgctattcacctgcggtgatgcaaagaaaccatcaacagaatacgcatcgaacgctttacggtattcgttatcgaaatctgggatttcttcggtaaacagtttcatcaatttaccgttgatttctttttcagttgatgcagcgacgatttcgcgaatttttggggttaattcaaacagcttttgaagacctttcatatttttctcttttaaatttcatatgctgcgtctatacaagattgtattagtgcgtcgggcgaattctcgataattggtactgtttcaccacatacatctgctgcataaggatcgtcatcaacataacattcacggaattttaatttatatcggtagtcatttttacataaccccgctttccattcgttgaatgtcatgccgtaccgctctttgaattgcgctggcgtaatctctttgaacgtatggattgttttgcctaacttagagtcatacaccgtcttttcacgaattctcatatagatctcacattgtttagtgggctggaagtttctttacttcaccccgcattccggggaacctattaccggataccaacagagcctatcccgtgggatatggttgcatattccgaaccatttaacggcattgcgctacgcacccgaattggagcaggtgaagggactcgaaccctcaacaatctggatggaaaccagatattctaccaattgaactacacctgcgaatttttttagaactgtttgcgatagatttcgcgaaccagcggatcaacatctttcgcgtacttacatacgtcttcgaactggacgatgtacgccatgacttcatcggcacgggatttaagtttaccctgatgcgcatcaatgatcattgctgtcattacgtcaatacgcgctggggcttccagaatttcgcctttgtcgaacagctttttggatttgctgacggtatcagcgataattgcttgaatagatttagccatttttagatctcgtagattgcctggattgctttgtaatgtgcggaaacgtattttgtttccttctcttttgcttctttttcggaaatgtaacccgcaaccagatcagggtcaggaacattcgccatgtgagcgcttggcagtgggatatatttacccaggattcgttctgccgcttctggtggaacgtctacgcctacagaaacaactttaccataaaaaggttgttccccgtgctggcgtacaccaaccacgataccagattcagatttgatttcggaaccctgcggacgcgcagtagcttcgatgatcacatattcgccggatgcttttactttcagttcagacatttctttactcattgttgttaaacactactttggaaaagtcgataaacgattctaactcttcccgtttaatttgttccacgacacagccatatttctgcaagcgtgaaatccattcatcattaccacgatcgtatttatcgagataatacaccgatgtaatcgccccgctagcaacataccattcgatatgtttcgcgcagttagggcaaggcgatgcagttgtgtaaagtgctgcgtctttgagtataacacctcttgtgtgcgcactcaatagcgctttcatttctgcatgaatttcgttatcgtttgaccatgctgaatgttcaggacgatcaaccgctttcagtttaccgtcatcattcaccatatgattgttgcatgagttgcaacgacaatcaaggtcaaccgtattattttcgccccacgcgacggcacgaccacctatcgcgataatagcacctacacgattcgaaatacattgagaacgttgactccgatcgattgctctcaacatattcattactttgaatttcattaacggtcatccatatatttcagaatgtctttgatgaaatcgttatcagggttgacgatgtgatacgtagtacctgaacgtgtcaccacttcaacaaacgatttgttcgccggaatcgcgtattcaacaaccggacttgttgcaatgtcctgttgaggatcgttatcaaccaacccaaacacacaaccataacgaagcatcgttggttcagtacagaaccatgcctgatggatctttctgattttgtcactcataatactgccgcccatgttacgaatttagttaccggattccactgaatcccgaactgttgttcaacgatgttacgttgactcagaatacccagaaggaaggagaactgaccatcgcggacaatcttcactgtataaccagcaggaattttatcagcaatgcgctggcctaactggttgagtttcagttgaagttcaacaggattctcaactttaacacgatcacccagttcaaccatcacattttcattttcacgaataaccataatattctcctttgtttgtgcgggtatcttatcacacccgcactcactgtcaactgttttttagaagtcgccgtaatcaacctggaaacacgggataccgttcattcgccacatcccgactggtgtatccctgtcgtccactgcaagaacaggataatacttatcgagaatcttttcaacaagtatttgctcttttacgtgaatatcgtgacgatgatcaccttcttcgcgcatgtagataccatcgctcaggtcaacatcgtatccgatcaggcttgcagcggtatcatgtgcgcactgtacagtaccctcacgcccagacacaacaacacaggcataaccagcggccttatacatcctgaacagttcttgaacaggagggttaggcggatcgttgataaccttcgtgaagtcatacgggctacgttgtccaactttggttaatgtcccgtcaacgtcgaagatgacgcatttcggtttgctcggatctgcatagctcatagccggaacccagccacggagtttacggtactgttcgaacatcgcccagacacgggaaacaggtagagcattcacaccgcgtttatggttgcgtttcaggagttctacgatatcggcatcaatccattcgatatggaaatcagcattgaactctttcgcgatctctcgccacacatcatgatctttttggtgtaaatgggtattgtgaacgataacgttcttcccactcgccagggcattacgaactgtatcttcttgcacacggcaaacaaacagttctttctcttcggtgaagcgatagccagtgagatcaccgccagcacagtaaagggttttgcggatatcgtcacgggaaacagtcagagtgttccccagttgacgcgctttttctttcgcccatgtagttttcccgctacctggtacgcctacagtaataaacagattcatttcacaatctcatattcaatcagttctttgttatgctcattcgttagattgagccacatatcacggttccagtcattttcgatccagagaccttctttgtccttcttcgcatcataaacctttccttcggttatgtcacggaaaaatgacttgattattttgacttgcatttctcagggtatcccacggtacacagaatgttatccgtctggtctttctgacgcttaacgtcattcatccagctacggaagattaacgaatcgggatatgaaagggcaacgtatgggtttccgtcataaggcatgacaaggtattttttaccgtcaatctctcggacttctgcaaccactttccatttcacattcaccggattcaccttcgcggggagtgtaggcaaaatcttttctgggggcttctccgcacacccaaccaacagaacgcccagaacaagggctaacgttgcaattttcatttgtcgtactccgccatatactcttcgaaggacttgttgatcttgatttcgatcagtcctggttttttgaacagcaggtctttacgtccggcatccttgaccaactgctgatccttacctttttgttcgacatagatcaccgtattggtgttgtttgtctctttgacttttttgatatcagcctgtaactctttgatatctttagccaattggtcattttcacttttcagcgtgattgtcatgtacaaaagccctgccaaagacagggctacaatgacaggccacaccaaagaagttaactttggaaaggctggtaatgtcatttatattcttccggtataaactgttcgtagttcttcgccattaatgcaacgatgttatcaaccagcttttgcttatcggtatcatcgaaataacgcatcataggcccgaagataatacgaccgtcaggggttaagtcagcgctcagggcgatcgcgtagtctttgcgtgatttgcctttcgtgtcttcgattgcctggaatgcttttgcagtcagacgattgagactatcaaggaataacgtttcgaatgcgtcaattttcttgagtgcgtacatatcatcgaggaacatttgtttcaggtcatcgacggtattttcaacaatatttaagaacagatctttgttattgttgatgctatccttcgtgcggtgaaggtttacataccagttggttttcgctttcacaaaacctttatcagttttgatcacgtaaccctcgaaaccttctttcgtgtaggcttcggtaatgaacgcatccagatcggtgatttcgattttctcgcgctcaaccaggaacggacgtaatacaccatctgcgaagatatcctgataatcgacatattcgcccgtgtcgttattacggatgttcaggatcaccactgctggttcctgatagccaattacaatacggtttgtcggtgcgacgtattccatgttgactgtgaaaccatcgttaaccagttcggtcaggcgatcgaacaatgcgcggttagtctggatcacgctcatagcgtccatagcctgttcagattgaacggatgctttagacttaacgcccagatagccggaatcacagaaggtggagatcagggaaccatcttccttaatcatcacatccactacggtttcaccaatcgtcacaggagaggatttcagtgcttcccatgcctttacctcggcatagttgaaaaacttctccatagggcgactgacgagttttacgggggtatccccatccatcgcaaacatgataccgcgacattccagcgcaccgggttttaaccagtcggaatagctcgccatgcgatagttaaagatgcgcacgttggtttgcatcacagttttttgatcaatgaagtagaagcattcgctttcgttacacagtttcatcaactggtcaaagagggttttctgatttttggttagctttgtcatagtgctgtttgttccattcaggattgatttttcggatcatgtttatttcaaaatcatgatatgtgtcttcatcgtgtgttgtcacgataagatttacacgcttacgttttttgattgccatttccagacgtgcggttttcaaaatattactggggtttgcttccctccagtatttcgaattgcggtatgtgtctaaccgcttccacaaatcacgacattttccaacatacactatccgaccgtcgatttcaataaaatacacacaatgccggaattctccacatttaacaaaactccggtctatccttttgtctgaacccagacgcaaaggaaatattacaccaaatgttacatcgtccattatatatccaacttattcacctttccggtcaacacattgacgcagtgagcaatataatcaccgtggcacggtagaggtttgcatgtacatcctaaccgcttcccgtccaatgctttcagttcgtcgattgtgatcacgccagttcgaatcaagttttggaaatacgggatgaacttcattatgttttcagcccgtgttcccttgtagaagggattgccgaatttcgtacctctctgaatatcgacatcccagctacctttatacttgtttacgacgcgacaatcaagcgtatttttgtcgccattttgcataggcttcgtcgctgatctcggtgttgaggttgccaaccaggtaagaactcacttctacttcttgtggggctacctgtacgttgtcagacttcaaccatttgttcatccacggatacgggttcggcgttggtttaaatggagactgcaagccaaccgcgcgcatacgctgatctgtcaggtgttcgatataagcgatcgtacttttcagggatacgccgtctacatcaccgatagagaacaggtgttcagcccattctttttcctgttcgtacacttccaggaaaatctttgtcgcttcttcttcatactggtaagcgatttccgccatttctgggtcatctttacccatctgccagagtcggatcttgctttgagtgcctttctgatgaagtgcttcatcacgggcaatcagacgcatgatcttcgcgttaccttccatcttaccttgttccgcaaagttgaacgtgaaggtaaacgacacatagaagcggatcgcttccagagcgttgacagcgtgcatacacagatacagagcgattttgcatttacgcatttgctctttgcgtttcttttcgtactctgcgatcgattcgtctgggtatccgtgggacgttaacatttcgattttgagcacaatgtttttcagttcgtgacattctgcgatcaggtcatcgtagtattttgtcatggaagccgaacgtttcatgatcgcttcgttgcgcagaattttatcgaactctttcgacggatcgatgtgtaggttgcgctgaatatgtgtatagctgcggctatggattgtttcactgaacgcccatgtttcgatccacgtttccatagagacatcggaagcgatagggaggaacgccaggttcgggccgcgcccctgaatggtatccagcagggtttgatattgcaggtttgaatcgaaaatgattttttcgtgttccggcattttcgcgtactgcatacggtcgatagacagatccacttcttccggtcgccagaagaatgacagttgtttttcagtcagggtttcgaatacacggtgtttctgttcttcgtatcgtgctacgcccgtatcctcaccaaagaacataggctgttctaagtgtttgtgatctgggtttgtgttcattacagttaacatggatttaccttataaaaagcccccgaaggggcattgaatcaaattttgcaaccttcgcaatcttccgcttcttcctcacctgcaccgtcgcgggtgttgtggtagtacagcgttttgatgccgaaatagtttgcatacagcagatcttcaaggatgatttcagatttcactttaccatctgggaagttagccggatcatagttggtgtttgcagagatagcctgatcaacaaacttctgcataaccgctacgtgcgacagataacctttgtttccacgttttgccattgtccagagataatcatagaagtcaatctgattattctggtttggtactacctgattgaatgaaccttctttcgaagatttcacactcacagggccgcgcggaggttcaatcccgttggttgagttactcacctgcgagctactttcacaaggcattaaagcagaaagtgttgagttacgcaagccgtgttttttaatttcaccgcgcaaccattcccaatcgcagttatacacaggtgatgccagttcatcaacgcttttgcagtaccagtcaataggcaacagcccttgtgcatatttcgtttcgtggaacagtccacatgcaccgcgttcctgtgcgagttccatagaggcaaccagcaggttaaattgaaacgcttccatcaactcatgaacgtttccggcgtatgcttcggagtagtcgcaatagttgcttgccagccatgatgcatagttggtgatacccacacccagagaacgacgctgtttggctttcagagccgccgcaacagggtagttctggtaatccagcaagttatccagtgcgcgtactgcgatgcgtgtaagggctgggaattcgcttatatcggcattatcgagaacgatcgccataagcgtacacagtccaatttcgccagccagtttatcatcgtcgtccagcggtgaagttgggatcgcgatttcacagcacaggttcgacatacgaaccggaacagagaaactaccctgctggtttacgtgatgactgttgaaaatgtatttgcgtccggtctgtgcgcgttcctgaacaagcaactggaacagatctaccgctttaatacgtttcttgcgtaccgttgggtctttttccagactggtatacagttcttcgaactcactctgatccgcttgatagaatgcgtcatagaggcgatcattcgcaacgtcagggctgaacagggtgatgtaatcgttattgattaaacgcttatacatcaaatcgttaagctgtacgccatagtcaaggtgacgaatacggttttcttcaacgccacggttatttttcagaaccagcaggttttcaacttcaagatgccagatcggataatacagggttgctgcaccaccacgaacaccaccctgtgaacaggatttaaccgccgtctgaatgtgtttccagaacgggataacgcctgtatggactgcttcaccaccacggatttttgaacccatagcgcgaatgtgtccggcgttgacaccgatacccgcacgttgagagatatacttcacgatcgcggacgtaacagcgttcagagaacccagagaatcaccggattcgattacaacacaactggagaactgacgcgtaggagtacgcacacccgccataataggcgtaggtaatgacagtttacgatccgaaattgcgttatagaagtcaattacgtgactgattttatcagcgtgtttttcgtcctgatgcagacacatcgcgatcagcatgaatgcgtactgtggtgtttcgtagatgtcgccggacgtgcgatcctgtaacagatatttcccgatcaactgctgaacgccagcatacgagaattcaaaatctttatcgtgattgattttcgattccagataatcaatctccgctggagtccattttgtcaggatttctttatcgtattttccagcctcaaccagcttagtgatgtgttcgtagaacggaatcgggtcaaactgcccgtaaacggttttacgaagggcgaacatttcgaggttagccgctacatactgccagtcaggttcttttgcggagattcgatccgctgcatacttgatcgctacagcctggatctgtttggtagtcataccatcacgaagcaggtcaacgacactttcaaggaatgcgttaacatcaatatttcttccaatactcgcccaattaaggactttgaacagtttttctttttcgaacgtttgacttacgccagaagacttcactactgttttaatatcactcattatcttaccttgttaagaaaggggctttcgccccctttgtttatactgccatagctgcttttagcgagccgtggtgattatagtctttcaaatggatggagtcaaagaattcttgatccaaatcaagtaagctatttaccttcggcatataaagggtcggaagtggaagcggtgcgcgttccggcttcaacaactctttcgcttgttctactgcgtttttgtagatatggacatcaccgccagtccaaaccagatcacccacttcatacccgcaaatatccgcgataatatgcgtcaggagagcgtaggaggcgatattgaacggcaaccctaagaagacatcaactgaacgctgataccactgtagagacagtttaccgttgattacgacgaactggaagaaacagtgacacggacgcaaagccatatcatccagatccatcgggttccaggcagaaacgatgatcccgcgatcgtctggtgtggttttcagttgttcgatgactttcttaatctggtcaacaccataataagaaccttccgcaccaaatgagcgccattgatgcccgtagatcggtcccagataaccatgcgtataacccagcgctttagcctgattttcgtagttatcgtcccagatcgtccgcttatcgctatcttcaccccacgtcattttacgcagtgtttccacgttggtagaaccttcgaggaaccattgtaattcatgcttacacggtttgaagaatagctgtttgctggtagtagctgggaaaccttctgcgaggttccaacgtgcttgcatcccgaagatgcgcagtgtaccaacaccagtacgatcggttgattcagtaccgtgtgttagaacggtgttgacgatatcaagatattgtttcattttatgcctttttcgtatgtcgatcgacgataatttttctgacgcgttcgtttgattcgatctgctgaattttgaaatcagtcagttcatatttcagaaccgcttcacagaattcaggaaccgtgaatgaaacatcacgtttaaaagctggtgcattatatacatgatgtccgtaaatgtgcgtcacaaccacttcatcaaccattgtattattgattgcttgcagaagcaaccacttaccaccaatgagacacacatcacgatctggatgcgtttctttcattacgtcgattgcagcagacaacccgccaccgtggatgacataatcagcggtattcccgttctttgttaccagacgttgaccggatgcagacagaacgcaatgaactcgccctggcaatttaccaggcagagaagtaaaagtgttcgcacccatgatcaggacgctatttgcggtttcttctttgaagttctgcaaatcctctttgcagtggccccacggtaaaccctgttcataaccaaacgcatagtccacttcgtacatatcatgaccaacggcgaaaactgcttttactttgctcatagcgcgatccacattttgttgtcttcaatagtcacgatgtagcccatagcttcaaccatgacgcgcaatttgtctttacaggcttcattgtacccgcgaatcttttcaaattcaacagaaaagatactcaaaccgttaacatgagcgttgatgattttggattccagatcgaacaccatcacatctaacggactccattcaacagaatgaagtttttcgcgggttaacagggttgtgtgttttggtagtttcattggggtacagtttgccatagccattgttccattttacgtaaatcttcctctaacggagtgaaaccaaatgattcttcgatcacaccgtcttcccatacatcaatttccagaatttccgttaccggagggtttgacatcacatgatcacgacatgcagccatagcggtcataatggaatttgttactgtcagggtgttgccctgaaccgatacctgaataatcatactcacctcataaaaaaagggaactgcttttcaacagttcccattatagcataatcagttagtgtttcaagcgccaaagagcgattgcttcatcaactgcttttttaatttcttccggcgtgtctttgcgtccggctttaaccagggcagagagcatagaacgaatggttgcattcatctgtgacttctcacgatccatctgtgcctgatgcgccttatcaaccgctggggcttctttcttcgctgcctgtggtttcgtaggctgtgcgcctaactcgtccttagcttgcgtttcagtgcgtttctgttcggcttctttcttcacatgaggtgctgagaatttaccagccttgaagttatcacgcataccttccaggatcttacgggctgtgtaccagtcagcaacaccacgaagttgtttcagggtatcaaccagcaaaccgatacttgcgcctttgctatcctcgtcaatgtcgatatctttcaaccattcaacatgtttctgaccggagtgcatgaaatcaaagctgctgaaactccagaaacctttacggttgctgatctcgcgtttgaagtggaaagtcaaacccgcgccgttatcaaactcaccgtagttactgcggaatgttgcccccgcttgtttcagtgcgttgaaatagtcatctttattgatgcgattaacggtgcgttttggtttctcttccggcgctggcgctgctgcttgctgtgcggtacgtttaacaaaagatgctgaacgatgccccgctgcaaactctgcgttcatccggtcgattaccgctgcgatgccgcttgcgtctggttttactttctgcatttctttgaaagtgtcgatgatcatatccagacatgcaccgtcttcatcttccagcatagtacctttcagacgttcagcaggtttgaatttgttcacagttgggtcaacaacatactggaacacatacgcgcctttacgcatgaatacgtgacggtagaagtgaactttatagtgtccaacatcaacaataacatcgttaccgctaaccttcgcacccaggatacgggcaaaggatgtcatgtagtccgcgcgtttgaacttgagatccttcttagtcgggctaaagatggattccagtttcttagtagggaacaggctttccggcgtgattttgtctgggttcttgccccattggtaatcacggcttgccattttgtgtttcttcgtaccaaccagaaccagagtattaactgatacgctacccagtgcggacgcgtccggcgctgctaaaccttgaccgttaggcggttgacaagagaaagagaagtcaaagaacgcatcaccagaagtgaaacgataggttgcgtgaacagtatgaccgcgaacttcgctgattgtctgggtataggttgttggttgtccggtgaatttcgtgaaatattccgcaaattcttgcgcgttgaatttagtgctgaaatagtttttcgccagcacgaaatacgctgcaaatttttcttcccacgctttcttgtttgctgcgtgttctgcgcgaacatcactgaaagttttaccagcgctgtttgttttggttacaacgtcatacgcctggttgattttctgcatgagttcagtgctaccaccacggtcggggtgattgcgcagagaagcacgtttaaagagctttgacagttcagctttagattcgtcgccagtagcgcccaaaatcttcaatgcttcgctgtgtgacatttgttcgttaatcattttccgttcctcaaaataaaaacccgtgcaactcagtacacgggcgactttaaggtatttatgttttactgtcaatagattttttcgaggaaccacaccgaagatttattattcttgatgcgggtcaattcaatggggttatctttgaatgcttcctcaacatctgccattgtaactacatgtttttcttccaatagttcattatggagataaaacctctccacttcgggagaggtctttaaatcaaattcacgttctaacatgagatcgccatatctttgattgatggttttgtgaaccgtccaaccttagacatgatgatgtggcggtcgaagtcctgcggatcaagatcctggtgactgattacaataacgttaccatctacagaatccagcagggatttaatcgcgaatgaaccctctttatcaagtggtccatcaaacacttcatcaagtaccagcagagacagatccacgcctgatactttacttgtcacgtcacgccatgtgaacagaatagacaagttgatgcgagcgcgttcgccttgactgaatgacgcataactgaaatcatcgcgccccagtgatttgatcgattcgttgaactcgtcatctaaagtgaactgataatcagcacccaacagatccagataatatgctatctgtttgttgaagtacggaatataacgcttaacgatgctcgctttaacgccggaatctttcaacatatccgtaacaataccacgaatatatttttccttgacgtagccttgtcgtttttcgttcagttctgcttcctgctgttgcaactgcttcacgggttcttcatcaatgactacttccgcgcttgcctgttccatgatcgcctgtgcgcgtttagcgttggcaacttcgttttgcagagtacctttcagggcttcatatttggttttcagggcattgagtgcgcgttgctgttgcagcaagtcattcatgatcccttgtaactcgtcctgtttggttttgatcagggttaaacgttgtgtacccgctttgatgttctctgcgatctccgccatacgctcaggagtgggtttaatcgcttgcttacaggccggacactcaccgcctttctgatacatcacctccagctttttaaactgttctacagtcattgagagccgcgaataaccgtcacggagtttgttgatatcttccgtccggtcttctccagtgatcaccgattccgcaatctccgcttgcaactgcataagctgtgctttgatgttctttgcggtttctacgtggctatcgtagatctctttgtatcgggcgttgttctggtttgctttcgctcgctgttcgtcaatgaagcgctggtgtgttgcgatctgctgctggatgtgattaccctgcattgagagtgtatccaactgctgattaacaccgcgaatgtatgacttgtttaacttgtccatttcactgatgacggacagagacagcaaatcttcaaccagtttccggcgttcgggggttttcagttccatgaatggagtgtagcccgctgtaccaagaacgataacctgtttgaagcccacaaggttgatgttcagcatagattcaagctgtgcctgataatcacctgctgcggagtcttccggcaacttctcgccgttcttccagatctcgaacaccttcggcttttgtccgcgcacaactttgtacgagtctttcccgtattcaatttccagttcaaccaggcatttctttttgttgacgctgttcaccaactgcccgacttttagatcgcggaatgacttaccgaacagggcataggttaaagcctcgatcagtgtcgatttaccgccaccgtttttccccgtgatcagggttttctttgctgtatcaaattccagttcgatcggggtgttcccgaccgacagaatattttgatacttaatttttttgaagtttagtttcatttaaaatccgttcacataattcagtgatcatttgaacaactgatgaatcaatactatatgatagagtatcgtcgtccagtgtatcaagcatgaatattgaccatgttcgtgatgaatgccatgcacccttcatgatggtcaaacaaactgcgctggtttcccctgcttcgtcggatgtggaaatgatgtgtttcattcccaacatacgcaacaggtgagaatatcggggattcgccccgaaatattcatcataacggctatgcacttgacacctccgcgtatagttcgctgatcagcttattcacttcctctttttcatcgtcggtgatctgcatgttggcgatatactcagtgataaggccacgaacggttttgatttcaaagtcggtatcgacatccgaatctgtttgaactttgtctatgatgttgatttcataggcaatttcttcaattttggtttggaactttgcaagcccctgatcaatttcgctaacaataagacgcaccgcacagttgcggaactgttcgagatcaacatctttctgtgctggatacatgatccggcgatggtgacacacagggttagcgatgaaagtcaattcaggcttgcccgtgaacacatagaatccgcgtgtttcgtcttcgtcgtttgcgctcatagtcagaggcgtaccgatataaaacacgttatcaccctcgttagcgtggtgatagtgtccagagtaaacacgatcgtacttcttcaagaaatcaggttccagcccatgatcggctttgctgttcttgtagaaatagtaaccagacagttcgaagtgtcccaaacaaaagttagctttcgattgtttgatgtagtcaaaaatacgctggctgttttcctgacaaatccacgggatcaggtcaatcgaatttccgccacctaaatcaaccgtggtcggttcgtcgatgacattaaagcattcgtattgacttagtatctcgcgtggcgcgttggggcgtattttgtccttaaattggcaatcgtggttgccgacaagaacatccagagtgatccccgcctcaatcagaagaggaaccagcttttcacgaacaaaattcattgtcgtttgtgtggttgcttttcgaacgtcgaagaagtcgccagcatggaagccgcgcgtgatcccgtgttctttgcaatactctacgatctgtttgaataccgcatacaggttttcttcgttccaggggttatcctggcgaagtccggcatgggtatccccaattaaaacatagttcatataaacctcaaaacccccgaaggggtttatttgccgtatttttcagaagccatgatgaacaggtctttcaactgctggttcgaagtgatccacatcgtttcaatcagttcatcgttgtatggttgcttgagcatatcacgcatctttttgatcgcgtatacgtactgctctttgttaccttcgaagagtgcgttctctgcgtgtttatgcagtcgcttccattccgctttgttcttccgcatgaacttttgcgctttgcgtagggcttcctgttcaatgcgtgtacccttgatggagtccagttcttcttcacgaagatccagcgctgatttttggtgtacttcgtcgattacttcatgctgcacgttcatagtaagtgatctccatgatcattgtttcggcgtttattacatagtccagacgaccttctgttatctggaagtctggatctcgtacatctgtagggtcgatgataatcggaatccctaagctctgcaactctaatttcacaaggtaaggaagcagatcaatttcgtcgttagcatctgctaaaattttgttcaggtcaattttaattttcatagaaacatttccaatgttggcgattcgtccacaacctcgattttatctttgggttttttcgcggactcttcatactgattaagtttgtcatggatatcctgaatgaaagtttcatcggctatcgtggtcatatcagtatcatcgctgtcatagacatgttccaggaagtatttgtatttcttcgcgttctctttcttctcgtagagaatacgagttacaaacgcttgccagcaagccttgttgatgtaaccgtagacgtttgtatatttggtttcgtcaaagttatgaaggccggaaatcgttgccgaaattccatcatcgatcatatccattttccagtcttcggaataacggttgaagttgtatcgacgtgccaaaccgtgagcaatgttcataatcgcaataccgagttcatccggcatcttacgatcaccagtttcacggatttgctgtttccacttacacataactggatacagcttatcattatctgcataaatctttgtagtcattatattctccaaattgaatacattcattatagccgattgaatcaggtgtttcaaacctacttccaatctatattatttaataaaatcagcgcgaagcgcttccgtgagcgaagcgaaacggatagttaaactggttaaaaagtatacggaaatgtactgttttctctatatataaaatataaaaatattaaaacgtacattcagtacatagacactcactacgttcgtgtccttcgcttcgctcagatttttgaaatgatctattgactttgaaaaagtgatcactataatcagtttcattcaacaacaacgaggtattgaaatgtcttcatttgcaagtatgttcaacctgaacagcttaatgagcaatgacgatgatcctgttgatgtgatgtgtatagatatttcaaacctttcggtagcaacgttgatgaacaacttcaagccgaaagaccagaatgacatcaaccaacaaattgttcgtcacatagtgcttgacaccattcgtcacaatgtggttaaattcaaaggcgagtaccctgaaattgttctagcctttgatgataacaagtattggcgcagaagtaaagcctggtactacaaaaagaaacgaaaaatggaacaagaagcatcggattgggactgggatcgcctgaatggtttccttcacccgacatacgatgaaatccgtgctaatttaccgtacaaaggtatccgtgttgacttcgcagaagccgatgacgtgatcggtgtggtgacgcgtaaagcggtatccgaaggtaaacgtgtcctgatcgtttctgctgatggtgactttgcagcccttcaaaaatatcagggtgtgcgtcagtggtcgccaacccaaaagaaatgggttacaccgaaatatggttcacctcgtaacgatttgcgcatgaagatcatcaagggcgataaaaaagatagtatcgcttgcattaaaatgcgaaatgactatattgttacgaaggttgaaggagaacgcgccccacaaatcagggctgctgaactcgaagcctggctggaagctgacgatccgaccgtgggtatgcccgaagagtgggcgatccgttacagagaaaacgaagaacttcgcgactttgattttattccgaaagatgttgcaacggcaatcgaagaagcgtacaatgctccaaaaatcgggaacaaagcaaaaatggagaaatacttcatggaatgcaaacttacccgtatgtatgaaaaactaagtgacttttgaggtaacaaaatgagtgtagaattactgcaagaaaacccagacatcgctaaagcggttaaagaactgatcaaagaagcgtcgaacgtgaaaacccagatcgaacacttccagggttctttcaaagacatcaaatccaaagcgaaaacggattatggtatcgacggtaaaaccttcggcaagctgttcaaactgtatcacgaacaggcacgtaccgcgttcgaagaacagaacaacgaacttatcgaactgtacgatgtgatcgataaggcgtaatatgagcgaaatcggaaacaaaaccgaagtcggcttgtatatcgaaaatctggttgcctctgagggggcaacctacatggaagctacgttacaatggatggacgaaaacagcattgattatgctatgctgtccaaaacagtaccgaaagcgatcatcgacaagattagcgacgaagccattaaaaacaatctgctgcgtccttctgtggctaaagaccacgcgacgacgcaaacactggatgatttcatgtgaaatttaaaaccccgtttgacagttcagacgctaattcccgtttgaaaccgatcgcggtatacaaactgtatctggtgatgaaaaatcactttgctgggaagtatgacgcgatcaagtacaaatgggaaataaagatcactgaaaaagcgttcgaaaagagaagagataagtattttttcaaaaagttagccgaaaggtttacattcaaagaaatatatcttatacttctctccaacatggtagctaaccccgacttctgggtcggggatgtagacgaagatacgatcgtgttttatcgtcaatacataggcaagttgaggcgaattgataatattttcgtggacgatgtaaaaaacctgtatgaattttcccgcatgaaaggtattcccctctcaacggtgtttcagtatagcgtcaaatcatcaacctcgtatatcagcaagctcgtactttctggggtgatttcttatgaatcattcttgatcctcgactcgtttttagacatcataaataaacacgatgaaatcgcaacggatttcgtctggaatgaatttagcaaaaaactaaacgcatacagaaaattagttgaaatcagtaacgaagaaatcgtaaaataccgaaacttaatgaaacaaaccttaattaacttaaacgagaaataacatatgtcattctttaaacgtcaagatccaaccaaactgcaagaacaagtcgccgctctgaaaggttcatccggcttccagaaagatgaaaaagagtggaaactcggtgtcgatgcacagaaaaacggttctgcggtgatccgcttcctgcctaaccgatctgatgatgaactggcgttcgtgcgtatcgtcaaccattcattcaaaaagaataaccagtggttcatcgaaaactgcccgtctacccacggcgattacgatgcttgccctgtgtgtcagtatatctctgaaaacgatctgttcgaaaaagcgaaagtgaaaggcagcgaagccgaaaaaacactgggtatgatcggacgtaaacaatcgttctgggcgaacattctggtggttaaagatccaatgcacccagaaaacgaaggtaaggtgtttaagttccgcttcggtaaaaagatcatggataaaatcactgcggctatcgcggggaacccagatctggatgaaccaggtgttgctgtaacctgtccgtttggtggcgctaacttcaccctgaccgcgaagaaagtaggcgactggcctaactacgacgacagcaaatttggtgttcctggcccaatcaaaggcatcgaagacgaagcgcgtcagaaagaaatcttcgaaggtatgagcgatctgcgtccaatcactgctccagaccagttcaaaccaactgcggaactgaccgcgaagttcaccaaagtattcggtggtgctgcaatgggtgctggcgcaagcgctggtgtggatctggattcagaactgaactcatttgacaacgaactgaaaaacttcgataatggcaaccattccaacggtgctaaagaatctggtggcgtaagtcaactgaacgtaggcggaagcgtaccggaagatgataatacacctccgtttgacctggaaggtggttccggtgatgacgacctggataaactgctggatctgtaatgcttacgggggcgaaagcccccaattttgaaagtttgaggtagatatgaatttagaacaaaacgtatatgtagcgcatctgaacaacgttcgcaaatcctgggtaggtaaagtgccggaaaacatcaaagagattttccgtgcgatgcctcaagctgaacgctttgagcattacaaacggatcgacgaagcagtaagcgcagtacataccggactgattcacgacgctcgcgaagcgggtacgaaaatcacagaatccaaaagcaaagaattccttgacaatgcggcggatcgcgttgtagaatccctgattaacggcacttttgcctaattgaaaactataggttgaatatgaaattctctaaacaaacgatcgacatcctgaaaaacttctcccagatcaacccatctgtaatgctgaaaaagggttcgttcattatgacgaaatccattaacagcgtagtttacgcagaagcaacgatttctgacgtaattgacgaagatgtaggtatctacgatctgaactcattcctgaacatgctgaacgttgtaggcactgatgccgaagtaactcacgatctgtccactggcgaaatcgtcattcgtggtgagaaaatgaaaatcgttgagcgttcaagcgatccaaccacaatcgtacagcctaagaagcgtctggaaatgccagttgcggatctgattttccagattagcgcgaacgatttcgaaaaactgatcaaagcgtcacgcatgatgaaactgaccgacctgtctgttgagccaatcaacggtaagctggtaatcaccgcgaaaagtaaagaaagccagtcaaccttctctgtagaagtgggcgattacgaaggtgataacatgttcaacttcgatatgaagattgacaacatgcagttcatcaacagcgattacaaagttgaaatctcttctcgcggcgctgcgaaattctcgtccgaaaacggcgttgcgtatgtagtggtacttgaagcaaccagccagttcaagtaagataaacaaagtagtacacaaggggcgttaagcccctttttgataatcaattgaaggtaatattatggaacttagtgaaaacgtacagttaatcgaaaccaaatacggcaaaatctcccagtctcccgaagaattcgcatgggatcagcgctatcgcccgacgacgatcgatgaatgcattctccctgctgctgataaagcgacgatgcgcggcttcatcaagtctggacgcatcgacaacatgactctggtttctgattccccaggtacgggtaaaacaacgctggcgctggttctggctaacgaagttgatgcggaagtgatgtttgtcaacggttccgattgtggtgtgaacttcatccgtaacgaactggatcgttacgcgtcctctatgacgcagaagaaaggcggtaaaatcattctgattgacgaattcgatcgccctggcatggcagaagcacagaagcacatgcgtagctttatcgaagcgtacagcaagaacgttactgttatcatcaccgcgaacaacatcaacgggattcaccctgcgctgatctcccgttgtccggtagtcaagttcggttccccgtcgaaggaagaacgcgttgaactgatgaagcaaatgatcaaacgttgtttcggtatcctcgaaatcgagaaaatcgaatatgaccagcaggtgatcgccggattcgttaagaagcactacccagacgcgcgatccatcgttaaagctcttgggttctattctaagcgtggcaaaattgatgctggtattctgtctgagattgttggttcggacatcacaccagtgattgaggggcttaaagcgaagaacttcaaagcactgcgagccgaagcaatcaagtacgcgcctgagtatgaaactttcctggctaaacttctggatgcggtatacccgatcgtcaccaacgaatctaaggttgcactcattcaggcagtaggcgaaaacaacgcacagtacgggctggcagtgaacaaagagattcacctgcaatacctgttcatgggcttaatgcttaccctcgcgtgggaggcttaaaatgtcactggctgcttttctcgatgaagaagaactgaacgaacatgaagcggcctggcgttctaaagactgggacaagatcgaagaacttgtgaaagagtacaccaaagacaaggaaaacaccttgtttatggtgctcgaagaactgaacaacgggaagacaccattacggatctctgcccttgattcatacgataagtttttcatcgacaatgcgatgagccagcatatcgaaacgctgatacctgcatacacgatgaatatgatcggttccggtttaccagaccaggcgcactttgattattacctgcatacggtgcgcaaaggtaagcggttcggggcgtgggctaaactcaccgaagataacgaaatgaaagttatccttcatgttctccaaaaacgatacggtgtaaatacacgtatagcaatggaatattacgaagaactcaaacagcttgaaaaactggacgagtggaagcggaaaaatatgaaagttgctttatctgtgttggctgatgttgtgaaaaataaaaccgaccagaaaaaggttgaacaactaataaagaaatggtgatgtatgaacatgctcgaaattaaactgtccagcgatgacagtttcctgaaaattcgcgaaacgctgacccgtatcgggatcgcaaataacaaaaagaaaatgctgtggcagtcttgccacatcctacagaaacaagggcgttattttatcgtacacttcaaagaactgttgaagctggacggtcgccaggttgacatgaccgaagatgacgaactgcgccgcaataacattgcgcgacttctggaagagtggggtatggtttccatccttacgccggatctgaaattctccgaagagaacaacttccgcgtattgactcacgcacaaaaagctgaatggactttgaaatacaagtaccggatcggacattaatcaaaagcccttgcagaaatgcaggggctttgttatattggttgtacaccacttgtgaggactaaattatgaaaattcgtattgaagaaatcatcaaagctattgaatccggtgatcacttgatcaaccgtctgcatagcgaagacatcaaactgtctcttacttgcaatctctctgatctgcgcacctacgcatacgcgcgggatcacttccctaagttctatacccgcatcatggaagaatataccgtgctggttgaacaactaaatcggcctgacacccaacgctatcacaaattagcgcaacgctcgcttgatctgatcaagctggctggggtatcattcctgtcacgattaaacacggagaaagaaaaccgtaatgaatgaattttatctatccgttgagcaaatgggcgatcacatctacgagcgcttcattgactctgagggacgcgaacaggttcgcaaaacaaaatatgcgcctacaatgtttcaacacgctatggcgggtgtagactcgccatatcgcgacatttacggcaagacctgcatcaaaaagaacttcgaaagcatcaaggaagcaaaaaactggatgcagcgaatgaaagatgtaggcatggaagcgctaggcatggatgatttcaggctggcgtatatctccgattcctacagaaaggaaatcgaatacgatcgcgacaagatccgcattgcttcacttgatatcgaagttaccgcgcctgaattccctgatccacgcgaagcaaaatacgctatcgacgcaatcacccactatgacagcgttgaagataaattctttgtgtacgatcttgtcgagggtggtttagatgaatgggtagcgtcaaaagttgataccgaaaacgagatcagcgaagaagacttgaagaaaattgtttaccgttcattccagaccgaaaagtcgctgatgtcggcttatatcaaagactggaaagagcggacacctgttattgttacgggatggaactcaaacaagttcgatatcgcgtatatcatcacccgttacctgaatatcttcgggcaaaacgttgttcgtcatttcagcccgttcgggaaagtgactgcgaagacaacaaccgaccattacgggaacgaacaactgggctatgagatttacggcgttgctcaaatggatggaatggatctctataagaaattcagtttcaccccgcaaccaacttacgctctgggcgcgatcgctgagttcgaaacaggtaaaagcaaagttgattacgaaggttcgctgtctgaactgcgtcaagcggatcaccagaaatacatcacgtataacatcgttgacgttatccgcgtgttggatatcgacggtaaacgcaactttatcgaactggttctgtctgtagcatactacgcgaaaatcaatttccctggggttatgtcaccgcttaaaacgtgggacgcaatcatttacaactctctgcgtgaagagaagaaagtaatcccagaaaacaaacgccatactaaaacgccgtatgatggtgcatacgttaaagatcctgttgtcgctccataccgttacattgtatcgttcgacttgaccagtctgtatccatctatcatccgacaggtgaatataagccctgagacaatcgctaacagctttgcagtgcgtccgatgcatgaatacatcaataagactgcgccgcgtcctagcgacgaatttagctgctctcctaacgggtggatgttccgacgcgatgttaaaggcgtgattccggtcgagatcaagaaagtatttgatcagcgtaagacgtggaaaaaacgaatgatggcgggtgagcgaaatctcgaactgattaagcacgaactcgaacacctgacagacgcgcacaaccaaatgatcaaccctgatttcgagttctacgaagatttcggtgatgaatcaaaagctgtactgaaaacgctgtctaagcaaatgcttaaagccgtgaagaaagtgtgtgagaagaaaatcgcacaggcgaacaccgcacagcttaaccgtaaaatcagtatcaactccctttatggtgcgttgggtaacgaacatttccgttacttcgatattcgaaacgccagtgcgatcaccatgttcgggcagttggctattcagtggattgagcgtaaggttaacgaataccttaacgaactgtgcaacaccacggattacgcatacgtgcgttactgtgacaccgactccatttatgtttgtatggacaacgtgatcgcgaaagtcggcggtgaaaataagttcagggataacaaccattgggttgacttcctggataagttcagtaaagaacgcatggaacctatcattgataagggctaccgcgaactgtgcgagtacatgaacaacgtcgaacacctgatgtttatggatcgcgaaatcatttctggaccacctctgggatcgaaaggtctgggtagtttctggacggctaagaaacgatatgcggctaacgtatgggactccgaaggaacccgctacgagaaacctaaattaaagatcatgggaatggaaacccagcgaagtagtacaccgacagcggttaaaaagttcttgaaagaagcgatccgtcgcatcctgcaagaaggtgaagaatccttacacgaacacttcaaagtatttgaagaagagtataaggcgcttgactaccgcgaaatagctggtgtatcatctgctaataatatctcaaaatataatgatggtgctggcttcccaatcaaagggacaccaaaccacatcaaaggcgttctgttctttaaccgccatacgaagggtattcaaggaatcaccccgatcatggaaggtgaaaaggtgatggttctgccgttgcgagataaaaacccgtggcaagctgattgcatcgcatggcaatccggtacacgtttaccaactgagatcgaagaagatattttgaagtgggtagactacggcggattgtttgaaaaacatgtgattagtccgttgcaaaacatcacggaagcatgtaaaattgattacgaaaaacgcgcatccctgaacactctgtttggtgatgactggtaagacctgacggggcagaaatgccccatttatataaatttgtgaggaagatattatgcgtgtatataaaccggaaaaataaatgtctaataaagcactcctgaaaaaactgatcaaaaactcgaatagtcaatctgcgtcaattctgtctgaaagcgatgttttcaataacatcaccaaaactcgaacccgtgtaccgatcctgaacctggcgctgtccggcgctttcgatggtggtctgacttccggcttaactctgtttgctggtccgtcaaaacactttaaatcgaatctggggctggtgacggttgcggcgtacctcaaagcgaatgaggatgctgtgtgtctgttctacgattcagagaaaggcgtaactaagtcttacctgaaatcaatgggcgttgaccccgatcgtgtggtgtatactcgtatcacgacagttgagcaacttcgaaatgacgttgtgagccagcttaacgcgctggaacgtggcgacaaagtgatcattttcgtggactctgtaggcaacaccgcgagtaaaaaagaactggctgatgccctgtctgacaacgacaaacaggacatgacccgcgctaaagcacttaaaggtatgttccgtatggttacgccttacctggcggatctggatattccaatggtgtgtatctgtcacacatacgacacacaagaaatgtacagtaagaaagtcatttccggtggtactggtctgatgtattccgcagataccgcgatcatcctgggcaaacagcaggtgaaagaaggtacggaagttgtcggttatgacttcatcatgaatatcgagaaatctcgcttcgtgaaagagaaatccaaattcccgcttcatgttacctatgagggcggtatcagtatgttctctggtcttctggatctggctatggaaatgaacttcgttcagactccaacgaaaggctggcgcggtcgtgcgttcctgaacacggaaacgggcgaacttgaactggaagaaaagaaatggcgtgaatcggaaaccaactcgatcgagttctggaaacctctgttcactcaccagccattccttgatgccattcaggataagtaccgtattcctgacaaagagatcactgacggggcagcactcgaagatctttattccgacgatgtagtagaaccgtcaaataaatttgatctcgatgacgatatccctgatgatgtggatatgtcagaagagtaataaacaactgggggctttgcccccttttaataggtgaatcatggacattgaacaaaaaacaaaaaacattcttgatgaagcaatgcaggacgttattcaagaactgttgatcaacgatgaaaacgatgttgcacacttagtgtacatccataaggtgtattgggataacggcctgaaagtcgaatttagtacgccggacgaagacaaagaaaaactgattccgctggttcacgatgcaatctacgcgcagatcaagcccaatctcccaaagcctgaaaagaccttatgggcggcgttgaaagtaaagctgtataatttctttcagatgttcgctaatctggtttaagaggtaataatgatcgtcgaaacaatattttcaaatctggtttttaatggtacgtattttgttcaggcgtggccccatttacgccgtgaatatttcgaagggaacgcgcagattctctttgatttgatggataagcacgtacaggaattcaacagcattccttcacaaactgctttagaagtagctctggacaaaaagagcctgagtgatgtagtctacgaagataccaaaaagatgatccgcagcatgaaaaatgcgccggaagatctggaatggttgatgaaagaaacggaaacctattgtcgtgacaaggcaatgtatcgcgctctgtcccgtgcaattgagatccaggcgaatgctgaaaaacctgctggcgaacgcaacaacaaaatccctgacgttggggcaatccctgacatcatgacggaagcgttagcgattagcttcgatagttcggtcggtcatgattacttcgaagactatgaaaaacgctggatgctttaccagtccaaagcgatgaagattgctttcaatatcccgatcctgaacgccattaccaaaggcggcgcagaacgtggaacattgaacatcttaatggctggtgttaacgttggtaaatctctggggctttgttctctcgctgctgattacctgcaatcaggtaaaaacgtcctgtatatcagtatggaaatggctgaacacgtttgttctaaacgtattgacgctaacctgcttgatgtgccactggacgatatcgacaacgggaacatcacctatgcggactataagaaccgtatggaacgcctcaaacagtcgaaggtcgggcgtttaatcgttaagcaatacccaacagcaggggcgaacgctaaccacttcaaagcgctgattaaagagcttaaattgaagaagggtttcgtacctgatgtgattattgttgactacctggggatctgtgcttctacccgtgtacgcggggcggaaaacacatacatcctggttaaagcgattgccgaagaacttcgcggtttggctgttgaaacaaataccgtaatgtggactggtgcgcagactacccgcgccgcgtgggatgcttctgatatcagcatgggcgacgttgccgaatctgctggtcttccggctactgctgactttatgttagctgtgattgagaccgacgagttagctgatcagggcttgcagttgttcaagcagatcaaatcccgttacggcgataagaaccactttaaccacttcaaactcgaagtgcgtaagggtaatcaacgctggatggataccgacaacagcgatatcgggttcaaatctgattataaaggtcgtcagatgccgaaaactgttgaagaagcacaaggtgctatggtaaaacaagctgagactaaccgaagcaataagttagccgaaattgcaaatagtacagacattcaattttaacggggcttcggccccaatcaaaggtatagtgaaatgaaaaagattctcgttattgtattcctgatcctcctgtctctgaaactggcagcaatcggggttatggcaaatgcttcatggtggcttgtgtttgcacctctaatcgtgatcggtgtgattaagctggctttctgggtgctgtttgtggtggcaatggcaaacgtattccctaaactgactctctggattgcaaaaaacgcaaaataatcctgattaggggttgacgggagttatgattgtgataatatgactcccgtagacaacaaaaactgattaggagataccaaatgaacgtactgaacaacccatacgacgaagtgatgaacccagaactggatttcagcgcgggttatttcgatgcagtagtgaacagcgtagtaaacagaggtttactggttgaaatgctgaaaagtgggaaagtagatgttgaaggtagtgttgatttcctctggggcttcctcccaatcgacccagaattcaaactctgctgtaacgaagttcaggccaaaaacgttcttcggtatttaatcaacaaagcataaaaattaagccccgaaaggggcttttttgtatctgtaggtattgcaatccttctcgaaaggtgataccttattctaaacaaacaaaggaggacatcatgaaactcgcaatcgcttttatcttactggttctaaacgcacttatgggctttccgttcccgtggttagtgcttctggctatcccgtttgcctggaacctgttcagaatcggtttagcgggttgtgttggtgtcctgatgcttatcatcggcgctatcggtggcaaagacgcttttatcggtgttctgaaagccatgaaagagggcgttaaagaaggtttagtgaaatgagtgatttattagatatgattcttccagacgaagaacaggagttcgaaagcccgtatcgttcagaatggatcgtatcggttgacgataaaggctatgtcgatatcatgcgctggcctaatattcatcctggctacctggacgaaggtatcaatgcggaaatgctgggtatgcctgaacaggttgaagatcctgctggggtgtataagtggatttgtagcccgtgggaaacccgcgactgggaaagcaatattgttgatgactggggctttgatgtggtagaatctacccctctgttcttattaccggaaaaggtcaatggcgaagttaacgaaagcggaaaccaaacaacacaacaagataatggatctggtggagtctgacaaggcgctaacctacgacgaaaaattattcattatcgaaaacttccatgaaggtgcatttacgaataactctgaactgggtgcattctttaccccgatcggacttgctcgcgatttcaccattgatgcttgtaccagtggaagcgttgttgacctgtgcgcgggtatcggtgggctatccttcgcgatgcttcatatgatgatgtacgccaaaccgcgtgaaatcgtctgtgttgagttaaaccatacatactataagttgggtaagcgtatcgtaccggaagcgacctggattaacgcagacgcgttaacgacggagtttgatactctgtttgatatggcgatcagcaatccacctttcggcaagataaagacatccgattttaagggtaagtatacgggcgcggaatttgaatataaagtgattgaacgtgcttcacagattgcccgtgcgggtacgttcattctcccgcagatgtccgcgaattttcgttactctggagaacgatatttccaacaggacgaatcaacgacaacatcgaaatgcaaaaagtttcttgatgaaactggccttgaaatgcaaccaggttgcggcattgataccggatattatctggaagaatggaaaggcgtgaaaccgatgtgtgaagttgtctgtatggaattccctgaaccagaaaccaaacccgcgcaaaaccttttcactttcacaatagagtaaagactatgagcgatcaattaatcaaaaacatggatttaacctacagtgtgcgaatgattcgcctactgaaaaagccctggactgaatggacggcttacaagctgggtatcatcgacggtcaaggggaagtaatcaagaacccgaagacgaaggaagaactggaagcatattccccattccatcgctctgtgagacacatcaagcgccgtttaaacgcggttccttatatgtctgggttcatgaaccttacgagcgcgtatgactcgttacggaaccgctggaacctgaccgagcaagagcacgaagagatcatgatgaacctcccagaacttcgcgaaagactcaacgaagaaatggttgcaggtgattcaggcggaagcgtggataatattgcttcgggtgtgactacaggcgcgatcacgaacaaagggccgaaggttctgggttctacgcgtccgcataaacgcaaacgtaaaatcatgaagagtgaagaatgaaaccattaccgcctctgaattatcggatctgggttactgcgaacaattacacctggtttcctatccgtatcaagtacatgagcgacacagcgatcgtgtacacgaacgaaagaaaaacatcatcgggtgtcgatattcctagaccttatccgttttataagatattctatgaatggaaaatcactttagacggcacagagaaagaagttagccgatagaggtaaacatgtatcttgatatagagttcgcaactcgtatcatgggatcattaccacaaagcgaaatcgttcgacggggtggggaattcagtatccattcccgttgtccgatttgtggcgactccatgaaggataagcacaaaaaacgtttctggatattcccgtcaaaacgaggcacacacatgatgtgtggttgttttaactgcaactacagcaagccgttttctgtgtttctgaaagactattacccggatgattacacggcgtatttgatggaatctttcaaggatcgtaaagatttaaaacagacgcacgaagaaccgccgaaggaagaaaagaaatatattcctgaattgcagttctgcgaacgtctggacacgttgccagaaaatcaccctatcgttaagtatgttgcaggtcgtcacatacctaaagacaaatatgatcgcctctggtttacgcgtcaatggcaacacctggttaactctgtgaatgcggacgcataccctttaccgaaggatgaaccgcgtttggtgatccctatctttgatgaaaagggtaaaatcgagtcattccagggacgcgccttgcgtgacaatgccaacgcaaaatacatgacaatcaaagcatgtgaacactcaacgaaagtgtatggtcaagataccatcgatccgttgaaacctgtctacctgcttgaagggccgctggatagcctgtttgtagataatgctggtgcgattacgggcggacaaatggcgctgtccgatgttccgtataaaaatatgcgtgtctgggttcttgacaatgaagcgagacaccctgatactactcaccgccttttaaaattgattgaggctggcgaaaaggttgtgttgtgggacaaatgcccgtggccgtcaaaagatatcaacgaaatgataaaaacggacggcgcaactaaacttgaaatcatgcagtatttgaaagataatactgtttctggactcacggcgaaacttcggtttaagtcgtggaacaaatcaccgaaaaaatgagattgatatgactgataaaactcctgtgtttaatagctgtgcgcacctggttaaagccgatgatctggaaatggtagaaggtttctaccgcaatgcattacagaacggaattgacccgctgcaaaagatgctggacttgcaaaaccatgcacaacaaagcctgtctgataccctgaattgggttccacgtccgaacgaactgaaaacgtgcggtgagatcctggactggctgaaactgcaagatgatgcgatcgcagacgaaacccgcgaactttacaccgctctgggcggtatgtctcgcggtgcaaaagcggcttccggtgtctggaaaccgtggaaagcaaatcaccaggaactgcgtagccaggtattcgcagaaatgaaagaagaagacaagctggaaatcctgtttgaactgattgaccagtggcacttcttcatgtgtaagttcctcgcgctgggactggatgcggaaaccatctacaagctgtatgctctgaaacaggcggaaaacctgcgtcgttgggctaacaactactaatggaactcaccgcgctacatgccgtatttgctttgtcttatatcgtttgcgcggtgataacgtatctctttggatggtgcgttttccacgttaacggtgttgacagaaaagccgctttgatagtattatcattgctatgggttataggttttttctacgtcatctatgaggggcgaaaatgattgacaaatactatatcattgttacgaaagacaaagacggctttactattccatacgttgaaaacgggaaaacgccggaactgtttgcatcaccgcaacttgcaaaagataaattagattttatccgcaagtgctacgaaaccaaactgaactacacgccggacgaaccgcgtttcagtttcttccgcaaaaccgagcaactaccagcaaccgaagaacagaaaaaagagatgcgttggtttattgagaattcgaaaattcaaggggtattactcaaattatgagcgagttaacatttgatgatctgagcgacgatcagaagtccgcgcatgatcgcgtgatccacaacatccagaacgccattcatacaactattacgggtggccctggtgttggtaaaacaacactggttaagtttgtctttaacactctgaaagggttggggattagcggtatttggttaactgccccaacacaccaggctaaaaacgtgttagcagcggctaccggaatggacgcaacaacgattcattctgcattgaagattagccctgtgactaacgaagaacttcgtgtgttcgaacagcagaaaggcaagaaagcgcctgatctgtctacctgtcgcgtgttcgttgttgaagaagtctcgatggttgatatggatctgttccgaatcatccggcgcagtattccaagcaacgctgttattctgggactgggtgataaagatcagatccgtccggtaaacgccgatggacgtgttgaactctccccgttctttgatgaagaaatctttgatgttatccgtatggataaaatcatgcgtcaggcagaagggaacccgattattcaggtttcaagggctgtacgtgatggtaagatgctgaaaccgatgtctgtcggtgatctgggtgtgttccaacatgctaacgctgttgacttcctccgtcagtatttccgccgtgtcaaaacgccggatgacttgatcgagaaccgcatgttcgcttacactaacgacaacgtggacaagctgaacgcaacgatccgtaaacacctgtacaaaacaacagaacctttcattctcgatgaagtgatcgtgatgcaggaaccgttagttcaggaaatgcggttgaacgggcaaatcttcaccgagattgtttataacaacaacgaaaaaatccgagtcttagaaatcatcccgcgtcgggaagttatcaaggcggagaagtgcgacgagaagatcgaacttgaattctatcttctgaaaacggtatcgctcgaagaggaaaccgaagcacagattcaggttgttgttgatccggtgatgaaagaccgtctgggtaactatctggcctacgttgcgagcacttataagcgcatcaagcagcaaacaggctataaagccccgtggcattcgttctgggcgattaaaaacaagttccaggatgttaagcctcttccggtttgcacgtaccacaaatcgcaggggagcacgtatgaccatgcgtacatgtacacgcgcgatgcgtatgcgttcgcagattacgatctgtgtaagcagttaatctatgtgggcgtaacccgcgcacgttacaccgttgattatgtataaggggctttgccccttttgaggttattatgaaattgactatccttgtaaaagacattccccgaattcttgaagcactcgataaaattcgagaaaaagatccacatgcggtcaatgtgttcgggatgtatagcgcagcagatccgcaagaagttattcaccgtttgcgcttcattgaaaaatctaacgatattctgtattctccgaacggaccaagttattcatggagtcctattgcaaaagaagtcgaactgacttatgatgaatatggcgttatcgtgctgatccttcgaatggcacgaaacattcgtgaagataaagacatatggacattaatatcatgaaaaaagatatatctatccagatcccacgcctccacgcggaagcgattgcagatctaattttcaaaacccctgttcaagaacttccgcatttcatcgatcgcgatgtgttggacgaattcacagaagctgttgaaaacgcgaaccgtctggaaaaggcaatttatcattccggtctgcgtcagttcggtatgatgactttgcaaagcaaagagtttgaaacttttgatatcaacccagaagttgcgcttacgctggcgtacttcatggaagagtataagcggagaacttcatgagtcatttacccgtagattacgtatgggattatgaaacggttggtccttccccgaatgggaaggtgatcgaactctcatacgttccatttgttgacgatccccacaacccgccaacgttcgcggaactggttgcacgggggcgcaagtacaaatttgatttgcgcaaccagcctgatcgtattgctgatcagggaacaattgcctggtggaaacaacaaagcgaagaagcccgtcaaatcctgaaaccgtcgccggaagatctggaactgtatgcaggacacagacaattctttgaagacctgaaagcggacggtgtgagccgttggcaatcactcgattatgttcgtggtcctgaattcgatcgcggtatcctggttgatatcgtgcgtaagatggttggtaagatcgacatcttcgaagatatgccgaccgtgttctggaatagtcgcgatgtgcgtacatgtatcgaaaaccgcctgttaacgcgtgatgcttcgacctgtcctcttcggaaagggttgcttgatggttttgtgatgcataattcaattcacgattgcgcgaaagatgttttgatgatagtctattcattgagatatgcgctggggctggaagaacccccaagtgaagaagaaaccgatccattgagtctgccgaggaaaagatgattaaattatcatttgtaggtaaaactgtacatgcaaaaacactgaacgaagcgaaagcgcagatgtttgacattctcatgaaccccgcgttcgttaaagtcgaatacgatgaatatgttgttcagcctggcgatagcatgtattcaatcgctgaaaaattatacggttgtggtgagcgctggcagtctatcgctaagttgaaccgcaaaaccgttagcaatgcaagctatatccttccggggatggttctgaaattgcctcagttagtcgaattatgataaaaagcccttgcattcgtgcaagggctttgttattttgtagggactgaaacaaaagaggataaaacatgtttggtgatttgaaagaaggtttgaacattttaatcggattcgcgatcattggtgtgattgcttgtgtgtccggtgcggtgtggttgtcttatcaggcgatcgtgtggttgggcgaatggcttcacattctggcacagtaaggggatattatgcgtttatgtttagttggtgtaggtttcggtcgtgcgttaactcaagggttaatcgactcaatccgctggattcaaccaagcgttgaactgtattcattacctaaccggatcgaatactctgatccaacaccgtacaaaatgaaaccttatcaagcgccacgcgttaaccgtgcgttacaccgtcaatctgtgaacaggggcaaataatgagcacagcaattccacttatagtaatttttgtgttggttgtgctgtttgtcatcttcaaagcaatcgaccaatccatagcaagagaatggtttagcgactactacacgaagaaagcgtttataaaacattttcgaatggaagcagtgtgtacccacgtatacacggagctaaaccaggttagattctcattctcacagaagggaaccgattatgacatcacggtatctctttccaaagcaaaagagctttacgatatcacccaaaacgggggaatccgtagaacacttaaatcattaaaatagcactttttgttaaactagcctcttgcaatgcaggaggcttttttgtatattacacacatcgaaacgaaacagacaaaaggaacgcatcatgaaaaacttagaagccaaagtagttaaagtcctggttaagaacgggttcaatgaaaaagacgcagtagcgatggttgaaaagaatctgaatgatgcgttgaaagttagaccagaagcaaaacctgctaaactcgcagaggtgattgtatgcatcatgtaaaagtaagcatcaaggatatcacggttggtgacaccgtgatccacgaagggaaaatgaagactgtcgggaaaaacgatatcaagcgcgatcctttgtttggtgtcctcctgtttggtgatagtttcaacctggggagaacttttatcgagagggttattttcccgaaatggtatcaagggaaacgggtttaacaaatagcactttttgctaaagacttcacgggatagctttgatatagttatcccatcgaaacaaaacggaaggagagttatcatgatgcagaacggttctttaatcaaaggtcacggcaaattcctgattcagcagatcaacgacaacaaaggcatcatcgcctattgcgacgagaagatgaacagcgatatcgcagcatgggaaaagaaagagtatgcagcagtgaaaaaagccgcagaaaaatcccttgctaaagcagaagaaaatctggctaacctggagaactacgcatgaactacaaaactttcgtgattaccgtcaaaactaaaaatggtgaagactgcttcttgtatcaggcaaaagacgagaaagaagctaaagcaggtgtattgaagttcattaaacgcgatgcattgagcaatatttgcgaacaaccaaaataatgcttgcaatcctgaacgcataatagtatattacacacatcgaaacgaaacacacttaggagattttaccatgtatacttttgacgaactgaaagccgcagcacagcctttactggacgcgatgcacaaaggtcgtaacactggcatgtggttcagcgattacactgaaactgtgttcgttctggaaaaaggccgtaagtatcaccgtatcgtgcaggatacccgcaacaaagaaacgggtgaaatgttcaatcagcgttcagttgctggcttcatcgacaatgacggaaatatcttgaaagccgctggctggaaagcacctgctaagggtattcgtggtaacatcttcaacaacccagagaacgcgatcgaccggagtggatacgttcgctatcttcgctaaaatcggggcttcgtcccctttggaaattaaaatgaaactatcagcaaccgccagttggtcaatcttcggactgatagccgcaggggttttattcttcgcatggcaatcaagagatccgaacaaagcggcgtatgaagccgcacaacgagtagtagaacaggatgcagaagcacaacacgaagcaatgctacaacagcgtcgtgatatgggctttgtggagactgtgagttacacaaacgcttttggtgatgtcactacgcgctctgtaaacgtcttagggcgcacgaaagggacaatgctcaccatcagacgggaaggaaccggaaagctcgtagacgtgtgtttcagtgcgattacggacgattccaaacgcgaactattcgccccgtatttttctacgcctgtatatgctaaatttgacggcggagaaacaaaagagtttagcgcaagcagaggaagtaccgaagatttcctgtgtattacttccccgcaacgcttccttttcaatatggatcgtgctagtgttatgcaagtccagttagtattcctggatcattactccaaagtgccagaagtgcatgaatggaacctgaaaacatataatgaggttgtgaataaatgagcagacgcccaaagaacagcaaaaccgaaatgtttgcaacgtttgatgtaaacggaaagagcattgagggtaaaccatgcacgaactcaaagtttatgcatatcgccggattgcctggtatgagtgttaaaacttcttactgttgtcactacaacgaagaaaccacctctgtttatttgggcgaagaactcatggctgaacgcgtcatgcaatgtgtgcatttccctggcgaacgtccagaagtgaactgttttattgttggttatcataaaggtattgtaaatgagcaagtataaaattggtgatatgtacgccccgaaatctattttaatggctgtgtgtcaaatggcatcagaagccgatccgattcgtcgtatgtatgatgcgttgcgtaagaacccgatggacttcaattcaccacgccggatcagtatggtgtatgaagaaacagggattctttatcttgaaggtattcccgttcctatcaagttcaacgatatgaaagggcttttcaatccggtatgggttgcaccagaaccggaaactgaaatcaaccacgtcaataaaggtgaggaagtaccgcgcgaaaattccgctgtagttctggataagtttttcaagaccgctcatagcgtcaaaaaacgaaccgttagcgacgtggttcaccacctgtccgcagaggttggggagatctccgaatgtctcgttcagcctcaacgcggcggtgatatcgtcgaagaaagcgttgatgcgatcgtgtgtgcgttggatgtgatttacctgaaactgggtactacccacgggacaacagaaatcgcgcaagtgatcaataaactgcttgataagaaattagataagtggtactctacttgtagttaatcaattacgaggatcggatcatgttggtttatcgcgttgaattgaaagcgtctatattatccaaatatgatggatggtgtaagcaattaggcccgtacacgggttgtgttggtgatgaagacgatctctatgagtatcttgatattcatggaatcgagttcggtttaaacttcggtatctccgagactcgtcaccccgcaccatgcgaagaccttcgtttaatgcgtaacctcaaaaaacatggtaaaaattatcgtagctatattttcggcttctcttcattgcagaagttgtctaaatggttcgatagctgggagcggcaaattttggagaatcagggatatatctgtatggtgtacgaaactgatctcatgtttgcagggaacaaacaatgtgttttcagcaaagccgcaaccccgatccgttttattccattgtcagagatttattaatgccaacatatacctataaatgcaccaagtgcgaaaaagaattcccgaagatgtccagcatcgcgagccgtgacgaaccgaaagattgtgattgcgggggcgaggcgaaacgaacggttgataagccgcagatggtgaaagacggtttcccgtacaacaagtaaaccccgaaaggggttttctttttcatagaaccctatataatgcctgagaactaataaagaggtgaatatgagtttagatttcttaatggacgataacgagccgcagaaagcaccagaagccccgacaaagggcgctaaggtggatgaatcattctgcttgagcgatcgcgatcacattcgcaaacgtccgaacatgtacgtgggttcagtgaacaaagaagcccatgaacgttttatcatgggtaaattccgcaaagtggaatacgttgaagggttggtgaaaatcatcaacgaaatcctggataactccatcgacgaagcgatccgaactgatttcaaatttgcgaacaaaatcgaagtcaagattgatcacaatctggttactatttcggacaacgggcgcggtattccacaagatgacgtgagaacgccagaagggaagattgttcctaaacctgttgcagcctggacaatggctaaatccggttctaacttcgatgacgaaaaccgtgtaacaatggggatgaacggtgttggttctttcctgacaaactgttacagcgcaatctttatcggtgagacatccaacggtaaacgcaaagtcacgatcaactgtacggacggagcgcagaacatggattaccgcaccagcccgacgaaggagcaagggacaaccgttaagtttacccctgacttctctattttcggtgtggacggtatcgacgaagagacaaaggaagtcatcaaagatcgccttatggcgcttgcagtggctttccctgccgttaaattcacatataacggtgatatcctcccgaacaaattcgcgatgtatggcgcgatgtacggtgataaaacgattacccagacaaacaacaaaatcagtttcatcctggcgagcacagaagacggtttcaaacagaaatccttcgttaacggattggatacgaaaaacggcggtgttcatgttgacaccatgatcgacggtatctattccgaactcgaaccgatgatcaagaaaacacacgctatcgagatcccgaaagcccgtgtaaaagaatgcttgactttggttgtgtttttgcataacttcaatgcaccagcttttgatagtcagacgaaagaaaaactgactaacaccgctggggagttcaacaaccacgccggactgaactacaaaaagatcgcgaaacagattatggatacttctgaaataatcactccgatcattgagtccgctctgattcgcaaacaggcagcagaagccgcagccattaccaaagcgaagaagaaagcgaaaaaggcgaaggttgcaaaacatgttccggcatcagggatcgacactgacggggtagaaaccactttgtttctgaccgagggcgattccgctgtagggcagtttatcgagtgcagaaacgaagagacacaaggcgcatttccgctacgtggcaaaccgttgaacacctggggaatgagtaacttagaagtgctcaaaaacaaagaattgtctgaactcatggcgatcctgaatctccatccaggcgactcttccgaaatgacttacgacaacatcgggatcatggtcgatgcggacgttgacgggggcgatattctcaccctactgattgcgttctttagtcgctggcctgagttgttcgagaagaaaaagatccgttatatccgcacaccgattatcattgcgaaagtcggtaaagatgaaaaatggttctactcccttgaagatttcgcaccgttccgcgataaagcgaaagaggtgcgatatatcaaagggctgggttctttacgcaaagaagattacgatcgggtgttgggcgaccagttaaaatacgatacaatcgtactgggcgacgaatacaaagacgttctggaactgtgtttcggtgatgaatccgatccgcgtaaagactgggtgaacggaaaacataaattttcggtgaaatgatggaaagaagtattaaagacgttgtacaggtagaagggcttacgtttgccctttacacaatttattctcgtgcgatcccgcacctggtagacgggttcaaacccgttcaccgtttcttcgtgcattccgcagcgaaaggcggtacaggcttccagaaagtagcctctatcgctggcggtgttgcaatgtatggttatcaccacggggaaacatccgttgaagaggcattgtctcttatggcggcgcactggtgcaataacatcccgctttttgaccgcgatgggttctttggttcccgtctggttaaaaagccaggcgcaccgcgttacattaaatgtaagctgtctccgctgttcaaggctatctacatggatgaagatttgacaatcccgcatgaagatcctgaacacgtaccgccagcctattacctgccaatcattccgatggtactggttaacgggttcagcgggatcgcgaaagcatacgctaccaacattccaccacacgatccgatttcggttctgaatggatgtgttagttacctgaacgggaaagatttcacactggatctgaaatacccgcatttcaaaggtgacattgaaaacggtacgatgtatggcaagtatgaactccagggtaaaactaaactggtgatcacagagattccggtcaagtatgatcgcgtgaaatatatttctattctggataagctggaagagaaagggtatatcgtaagctataaggatctatcgaaagaagatttccgctacgagatcaccctcaaacgcgagtatgcaaacgggcttacccctgagaagatcctgaaagatttcggattgattgagaactcaaacccaaacatcaacgttatctttaacgggaaactgcattcatacgagcgtcctgaaacgttgctgaaagacttcgttgatatccgtattggtgtttaccaacagcgtattgataaacgcatccaggagactaaggaagcgttagataaagcgctggcgaaggttgacttcatcgaccagatgatcgcacagcctgacgcattgaaggggcttagtcgcagcgaagcggttaaacttgtctctacgtggacgggttgcgagaaccacgccgaaatcctggttgcgatgaacatctatcatctaaccacggatgaacgtcaaaagctggaagacgaagcgaacgaactgcgtaagcaactgaaatactgggaagaaacgaccccgaaaactgaatatctcaatgatttgaaagaactttcgaagaaattgaaataatttacaaaaagcctcttgcattgcgggaggcttttttgttatagtgtcctcactgattggggaggatataaaatgttcaaaactcgtagcgatatggaaataaccatctgggccaaaagcatcatggcgaagcatggcttatctcattggtctttcaaaatcaacggacgtttcaagcgtactctgggacaatgcaattacagtcgcaagtcaattgaattgagccgttctcacgttaaggaagatatctacgagaacgttttagatactctcatgcacgaaattgcacatgctctgaccgaaggggctggacacgggatcgtatggcagcgtaaagctatcgagttgggcgcacagcctacaccatgcaaaagccgtatccgtgagaaatcagtaattcaggaaagcgaaaaagacatatacgcgtttttcctgaaaactccgaacggtgaagtttatcagtgcaatatgaccgaaaagatgtacaatgagatccaggaaggtaaacgcaacattgcaaacatctacatttcaagaaacaaacgagcaaccaaagggcgcttagtagcgcgtaaattgacaccagaacaatatgcagaggcgattcaatgaaaccatatgatgcaccaaaaacgggaaaatatattacaatagctgtgctgtgtactattgcaatatgttttgtaactgctatcgtggtcggtatcatggatatgaaagaccgcgaacgtcagaagcaacaggtttacgaataccttgaccggatgtgtacacctgttgagtatgggcttgatcaaaagcctatgaaatattcatgtgataacatcatcttcaacaccaagtgagatataaacaatgaaattgcgtcagttagcaccacaaaccattcacactacgggcttcgataaaggcgaacgcacgaagtttaaaatggctaccagtgcgaaaacatacaaaatcatgtcatcaaccatctacaaatacaagatccgcgcaatcattcgcgaaatctccagtaacgccattgatggtcatatggtagcgggtaacatgaacccgttcgatgttcagttaccaactgttctcgatccgcgtttcatcgtccgtgattacggcacagggttaagtgactggatggttaaagaggtgtttgcaacctatttcgaatccaccaaaaccgacaccgacgaactgatcggggcgctgggactgggtagtaaatccccgttctgctacaccgaaacattcactatcgaatccatccaggacggcgttaaacgtgcgtacacggcttatatggataatggtgaacctttcgttgaccaaatctacgaaaccgaaacagacgaacctaacggcgttcaaatcaccgttccggttaaagtcgaagatatcgcagaatgggaacgtgaagcggcgcgtgtttatgaaccgtttacgggtatccgtccgcgctttatcggtgttcaggttgatgtaaactggcaaccgaaagaagcagacgatcgcgggatcatccgttataagtccatcaactattcaggcgtatacgcgcgtatgggtaacatttgttatccaatcgatctggatatgttcgaaaactcgctgttctactgctaccgtaacagcaattacgcatatattctggatttccctctgggatcgctggacttcatgccgtcgcgtgaagagttgagccttgataaagtcacgaagaaagtgattacggatcgactggataaaatcaacaaacgctttgatgaagagttgatggaacagtataaaaagcagaagacaacccgcgataaactcgtatggttcaataatctgcctagcttgttacagacattcgtaacccgtgataaccgtttccgtgtgggtaaagaatcgctggctgaaattctgacgcgtatcaaaagccctgatacagcaaccggaaaatatgtgtggggcttctgggctaacccatatgacgggaaagattgcgtattcgaacgtgtgggttctggtcgccgttatgagaagtataaagcggaaaccaccaaacgccaggacgttatgcgcatgatccaaccgtggcgacagaagaaactgttcatcgttgaaaatgataacgaagcgcgttcactccgcccgtatctgatcggttactgcatgatgaacggttcggatcgtatcagtttcgtaactgccgatcgtaaaagtgactctgtgcgtcagttgattgaaactggctatttcgatgaatctgagatcgttacactgaaaaccagtgaattgaccaaagaattcgaaacgtacaccgaagatcgcaagcgctggaaagcaacgcgtgaatcatcttctggtgattctgaaccacgtccgaaaacgcctacggcatatcattacttccttgatgatcagggtaacttacagaaaaacgatctgttcctgacaaaagcacagttcgtgaaactggatgaaatgtacgctatgcgcctctacgggattgatgaatatagccgactggacggagaagcaccgaactatacactgggtagcatcgccagcagtatgatgaccctgttgaaagttaccggactgaaaggcgtgatggttctgcgaaactccctgtggagccgcattcctgatagcaacatgaaatgtcttgatgactatctggtacagcgttttgccgacgcggtgaaaaagatgaagcctaactggtatccagcctggatttcgtctaaacatggtagcgaggttcgaacccttcgcgattatctggaggtgactcttgatcgcatggtgaaaaaccgctataatccagaattgtatttgttgcttgattatcttgatggtaagtttacctacgatactatcgagaacaaaaacaaatcgaaaaatgtggtgcgcaatccgttacttcgtgaaatgtcggtgaagcattacaaaatgctgaaagatatgaaagaacgtgttgataccgcctttgatttgtttgaagaacgcaaccctgcattggtgtatgtgttgcgcaattcgtcttactctttaggccgtaccatgattacggacgataagatcaagacgaacctgattaaccttatacggtggaaataatgagaaacgttaagatccttgatgatgtacaaaagaaagcagtttatgagggctttctgaccagcgcgaacaaaaccgcactggctaaacaatttggtgtaagcgtccgaaccatcgggcgcgttattaccgaacagcattctaagtataatacggaagcgtcgaaaccacttccgcaaacagatgtcaaatctaaaatgattggttctgaatcgttcattactctggtactggacggcaagatcatcacagcggattcgtcacaccctaacttcgaaaaagcacatgctttaatggttaagggcgacatcgagggagttgctaccctgttggacacaacgcaagcgttgaagatttacagcaaaggcaacattaaaatcatcgggcataaagtcctgtacaaagatatcgtgtttgacagcggtatcacacaacgtatcgttcgcgaaatgtacaacgatcgcccttacgagcacctggtgaacttcttcgagaagttgatggaaaacccttcacgcgatgctgtgtatcagctttacgggttcatggtgcataacgatatcgaactggcagatgatggagatttctacgcgtggaaacgtgttcgtgaagacttccgcgatctggcttccggtaagttcgataattcccctggtgttgtggttgaaatgccacgtaaccaggtagacgagaataaaaaccgaacctgttcatgcggtttgcatgttgccgcaaaatcgtacctgcctcactatggcggaggacgcgggaaagttattcaggtcaaggttaatcctcgcgatgttgtagcaatcccgacagattacgacaacgctaagatgcgtgtatgccgttatcaggtgatgcgtgatgtaactgtgggattcagtcactactaaccccaaaacagcgcctggagcgattcaggcgcggaggattcgattatgaaattcctacagagcattcctgactactggcagaacttgagcggggcagaaacagccattaaaaccgccaaagaactctggaacggaggcaacgttaccgctggacgtacagaagacggagaacagacatacttcaaaaaaccttacggtattatcgcaacagcccttgcatttaatctgggttatgttatgctggtactcgcaacggttcagaagtgggtagagataccgatgaaatggatcgggacgttgttgattcgcttagttcgcttagtgttcggcgcaacgatcttgattttgtcatgccctatcttcttgctggtactgacaatgaatatgaaaactggtgtaaacaccaaattaggaaataaactggtgaagaaaaatgaaaagaattctgacaaggcttgacatccacaaatatgctgttaagataggtgacatgaagcgcggtgacttcaccaagttcgaaggggttgacctgaaagaacacggcttctacctggtagttgatgataaaacgggtaaggtagtatttcgattctacgtagccccaaatcaacgccgtaagactggcgcaaaccgtactctgttacgcatcaaacgccgcgaacatgaaccatcagcgatggtgtccttgctggatagtgcttctctgtacttcgttgcacacgataagattaaaaacctctttggtttctcgaatcttactggtacaatagcggaaagcgcgattcagatgcggttcggggatggtgagaactatactgaatacaaccgcgcactaaatgatctgtttgactttgaattccaaccatactaattgagataatgaatatgaaactgttttccaaaatccgttctgtagacgaaatcgtagcaacttttgacaaaaccctgaccgaactggaagcgcgtattgcgcatgatcagaagcaggtcgaacaggtagcagcagaccgcaaagcagcggaagaagaacatcagcgtaagctggctgaactggctaccaaagaaagcgatcataccgcaagcgcaacacgagccggacgtatcgcggataaaatccgcaaactgctggattaattatctaaaatggggctgaaaagccccaataaggaaaataatatatgtttgtaatttcttcgtactatgattcacgtcaacgagtatcgttgtcttctatttccaaagcaccaaaagatatagatgacttcggattgcttaactttgtcaaaaaagaaatcgaccgcgttgttccagaaaaatacagaattgttaaaggatctgatagcttaactatcgtaaaactgtatggcgaagtcagtattcaacatcatgtgccattatatcctcgatgaacaacctggtagcgaaacatgatttcaaccgcgcttctactcaccgcgatcgcaagcgagcacttaaagaagcaaaacgtaagcagaaacataaaggtaagtgtgatgaaaaccgctttgattattcttgaggaaatcccagaaaacacggggctgtatctcgttgaagccgacgaagatatcattgaaatcctcaaaaccgctcacggacattatgtgaacggatgcaacaataccccagaacaggatcacgttgtcaatatcgttaacctcatgttagggccgcgtacagatgacaacctgaaatgggcgagcgaatccaacgttcctcatgagtatgtcgggatgtattatcagtgcaacgttgacgataaagcgccactgataccggaaaaacagatcgatttagtagttcgaacaggtttcttcttatgagttcacaaattctgttcagcaaagaagatccattaggcacagattcatcggtacagcgcttattctggcacatggattatgcaaaaaatcgttgtcgtaacccaaacaatacatggggaagcaacgaagacattgataaagcaaaaatttatcctcgcggaaaagcatactggaaaatttttgatatccatcttcataaagttatgaaagattcgaacgcatgataaaaaagcccttgacttcggttgagggcttttgttatattggccttatcgaaacgaaaccactaaggagattcaccatgactaacctgactaaagttaccgcgacatacttcatttcttctggcgctaaaaacgctatgtacactctgcgtgtagagcgtcgtggaggtggattcacttctgataactatatctgcaacctgtctactgacccagataaagcggaagcgaaagcgcgtgaatacttcgatcgcatggtggatcgtctgaaccagaccgatactttccagatggtgttccagggcttcgcagatttcgatctgtttgaacgtcgcggcaaactgtctgtacaggataccgaaaacctggaactgctggaacagggcatcatgccaatcggtaagcgtaaaggcgaagtgattgctgatatgccgatgtatactattctgtggtgggctgatcagtgcaaagaaaacggcaatgatagcccagtatttcaggctatttgctcttactgcatgggcgtagcgctggagaaggattacatcgctaaacgtgaagaaatccgcgcagaatgggaagcagagcgccaggcgaagatcgcagcagcgcagcacatcggggaaatcggtaagcgtatggaaatgagcggggttgttgagaaagtgatttctctcggatatacccaagtttcttattacaccgaagtggaacgtttcatgaccaaaatcaacgtagatggtaacgtggttatctactacggaaacaaaattgttgaagagggtgatgtgattcgcttcaaagcgacacctaaacttcacaacgaatacaaagaagttaaacagacaatcgttcagcgagtaaaggtattagaatgacatacgaagaaatgttaaacgaagtgtgcgcgggtaaaaccgcgtaccgcccgattaacccagatatgatcgtgttccgcgaaggggatacgatcattcgccgttctcaccgtaaggttgagattaaccaggtattcattgccagtgttgaagaacagaaagcgaccgactgggatatagttgcagaagatgataaccacgacgaacttgacctgatcttagtcatagataatcacccgctgggtgttcgtccatacatctaccacaatcaatacagaggcgaagtgattctatcatgacacacgacgaagccatgaaagccgctacacgcggttttaaagtcgcccctgtgggtaaggctgggttctttgtatatcacagcgtagaggctggtttccggcgcattacgatagggaacattggatactggaacgatgaatatgtacctacaccatatgaacttatgcgggtatgggacatatacgataaaagcccgatgacgaaagtaaaagatttcatcaatcgggctttgaataatatgaaactgaaattatcatcgaatcctgcctaaaattcttgcggcctgattgcacacgatcattaacttcgtatcggtgacttcgggcttctgtatataccattccatcagaattgatcctgaatagtagttttcgagattgaagtaaggacaactaaaggtatatgctaccggaacaaggtctttagtcggaagatacgggcttgcaatatctgagatatagtacagcccgtttatatgtctgttgtattcttccgatgtcttgtctataggatagccacccagatttttcgggttaatctgttgcggtaacttcccttcatacgcaattatatcaacaaaataattgacattcttaggtctgaacccaaagattgccgaaaaatccgcacccgtagttaaatgcactatgtttaactgttcaatggatgcggattcaaacttttttgccttttcaatctccatcgtcggtacgtctataacgcttgaagatgttttccagactgaaaataagtcatcccacttataccatgttacgaacataatgaaaatagtgacgataagaaccaatttaatgaataactgtttccatgttttgaccgccatgatgaacgatattattcgttcaagcaccgccaatttatcttgtaatagcgccatgtttaatcctcaagttcggggatgccgacccccgaacatatttaggaatttacttaacgttgagtgaccagaccggatcgtgtttggcctacacgggcgttcaaatagtcataccacgcgttatgttgggcagaagcaatctgatattggcgatatccatcctgtatacgaccgttattgtcaaagtcaaacacaccgccgtcatccatcgtaagtcttaggttaacagcagggccattttgaatagtaattacactaatctcattgctgaattgtgcagaaacacaagtaccgaacgcattaccattaaaactaccactaaccgctccatgaccggaaggttttgaatgtggcgaataccagccaaccccccactgaccacgataacgggcgttgttatagtaacgctcatacaccgtaaaggtgatgttatataccgattgtcccgccattcgagacatataaaacggtgttccgattcgaaccgcgttacccgcagcagacatccaccgttgccctgtttcagtgaccgcagacgaaccgatccagccaggaactcctacaatagccataaaatacctcatgaaagaggggcaattaagcccctaatttgttttcgattgcttccagacgttcacgcagttcgttgattgcgttaaccagaagcgcgttaattcccgaaggtgaaatggttaacataccagtgtcgatgtcttcgcgcactgcttccggcaataccttctcaacatcctgagcgatcagaccggattcgcgatggtatacgatatcatcagcatcttttgattgcttatcgtagatataacctttaagctgttcaatcttgcttaatgaatctttcagttcaactaaattcgatttcagtcgaatatcggaacgaatatacacatcgttggcgtttacgttaccttcaacatacagaccacggttcatatacagatccgaagcacgcaactgtaaggtcgtattcagtcggtagttgtgtaccgatacgttatcatcagcaccaccaaacccgaagtatgcgccgttgttacctgccaaagtaatcagcaaataacatgattggttagtcgctgtgttattcagaagtaatgctggtccgttaacaccctgaacctgtaaactgtttatagttagcagttgcgccagtagtccatcgcataatacgctggctatttgcataggcgttgagaataccgtcaccttcctgtttgaaacctgtatcgttatcacccagagaaataccagtcgtacccaatccgtttgcagtaccacaacccagaccgtttgtttcgaccgtgccgttgaagtttaccgcgttaccaaagttaacagaaccgttgatgtttgcaccgtttgctatagaaacaacgccattcgagttactgatagtaaacggacgtagaccactccatgttccatactgatcgccggatgcagtaagtaagaaatatgtacttccaccatcatttcgaatgatgaaaccatagtttcctcctacggcgcggaattgtccgccagtaccataagtattactctgtatctcttgacggaatcgagcataacccgcagtagaaattgctaattcttcctgtccgtcagttgaacctgttgccagtcgatatacgccaccctgaacagtttcatgccagatcgtatccgcattaccgcctcggaactggcgcaaatagtttttcccgccctgtccaacagtaggtaagaaatattgcgctggtgtgccctgtggaacttcgttataatacgatggtacgtttacgttaagacctgatttggtgttaatatacgttgcgccagtaccacggaaataatggttatatcttccgttaccatctttatagcctaagtgggtaacaccatcaccaaccccgtttccatccccgtttgtagttactcgaagtattgctgtgtttattccttgagtagcataatcagtttcaacggaagcacggttattgaatacacccagaccattaaacgtagcctgtccaggaacggttagatggttagcgagaactaaagttccatcagaagcaaaacgagttgcatacgcaccaccaccagtacgaacataaacgttcttccctgtatcaacgtagaccaaacccaattcattacctccagcatcctggaaatataagtttctgtttccatcgcctttgatagacatttgcgtaccaaagatcgtaccgcttacaacagtttgcatcccgatgttgaattgcgtccctgttaaactaacaagaccattatcacccagcatttgcaattcagcgcgaatggtcccagcagcaccagttgttgtgtttggtgcgccaaaagcacggatataataagcaccaccacccgcagggcgttgggtacaaatcagatcaacaaggtttgccccagcgttaggatctgacgttggtgaagttgtttttgaatgtataacaaaagtgcgtgtttctgcgctagggaaaccgttagttactgggttgttgtcggtacgagtagcaacgagataaggttctgttgctcgaaccattgcgatcctgaacggtaatttcaattcagttgccgaaccttgtaactctaaacttccttgcatggtatcgccagctttcttcacctgtgcgtcgttcgttacgttgcctaatccgatttcggcttttgttggtttgtcgttttctgtgtataccttaaagcctttgtatgttaaagtatttccagaagggagtaaaggcaaattagcctgactccagatagtattaccgccaacggtagtacccgcttttaaatctgccattattagatcctcaaatgcttttatgatatttataaaaagaaaaagccccgaagggcttttaattagcgggatttaagttccctgacttcctcacggagttcttttactgcgttaaccagcaacgcaataacagcagaagaagaaacagttaatatctcgttctgttcaccatcaacacctttcttaacggcttccggtaatacttcttgcagttgttgtgcgactaatccagcctcacgggtagtttcttcacccccgatatgatttgctttgtcgtacaccataccatcaagcaaatcaactttatccaatgcattttcaatcttactgaaattgcttttcagtctttcatcagaacgaatatacacatcgttaaagctaccgttaccgttcattaccaactgaatgccggatgaagggttgcgttcaaaataaaccagatatgatgcactatcagagatttcaatacggtttccacgagaagcatcaccagcatggaacatatacatatcgcgagggtttgcaccactgcgaataaaatctatacgtccgctaccactaccatttaacaataattgtccattgtcgatataactactagattgactaatacgaccattaacggataacgtatgtcccattgtaacagcacccgtggtgttgctgtaatagatcggacgcaaattgttatatccaccataaacatcaccgctatttgtcagtaggaaatacgtgttgtttccgtcactgcgaataaatgatccggtgttaccatatgcaattcgaaatccgtttgccgaggtggtaataatatcaccatatgatacaaattcacctgaattgtcaaaataccactgccgatctaccgaactcgtgcggtaatgaacggtaaatcggttagtgtttaccaacgtacccatagaccaagcaccaccagcttgtgtgtaatactgtttaacaataggccagtattcggaagttgctgttgtgttaatggtttggaaaattggagcttttgcggtgttttgtgaagcccaagaacctctaccttcccccgatgcatcaaaataaccgcctgtttggttgatggttcctgttaccgtgcctcctgtatttttcaagaacagtgcatcgatccatcctgcaaacccgcttttgttgatatacacgttcccgtcattacccagaataccaccgccgggtgttttaagtggttgagatatgtttgccagtgttagaacaccagtcatcgcatcaccggatttattgactgcccctacttccgccggagtcggaggaagcgaagtatcataaattcttctccatccattagcatcacccgcactataagaccatgcaccaggagaacccgtcgcagcacgaatccatgttgatgttatatcatagtaagtctgaaccagagaaacaccactattcagagtacggcgatatgtggcaacctgaccgtaatatgttgtgtttccatatggaccgtccgttacgttaccaccgaccgacagaacatcgttcttttcagtaaccgcagcagccccgaaactgtttccagacataccgcgaggaatacccgtgatataacgttcatcatggttagcccagtttgacggagttactgtattcgcagtaatcgcgccactaactgccattgatgtagcattcgttaagccgaggttagaagtcccgattacacggaaagatccttgctcaactgttacctgttgggtttgtgaatccagactcaacagcgtattttgagtaccatttttaaaggcacggatgtatattttattacctccgtctgtgcgagcgttcacgttaattgcacccgctaactgtccgccagaaataccgttgtatgcgttaatgtccatcaacccagattccgcaccaggaaccgaagtaatatcagggcgacggaaaacaaccaccggagcagcagcacttcgagtgatcccgaccgactggttagattgaatagtgtttgcggtcaacagaacgcctactgtcacgttttgactaaacgtagtattcttcgcaacagtaccgccgttaatcgtcgatagtgcgtttatatcctccgctgttggacgatcgttttcggtgtatactctccagcctttatacgttaattgtccaccagagggcaatagaggaaggttagaagcactccagatacccgcaccacccagcgttgtacctaatttcaaatcagccataaaaatttctcctgtaatgactgtatttatgaaaaaggggctttcgcccctttaacgcacaattgacagattaacgtctttagcggacatcgaacctgtgcttgtgttgtttggataacgatataaaccgaaatcaaacataacagcaccagcaggaataaccccttcgtttttgtagaatgaatatacgttcgggatcgtgccaacatcacgcatgttaattccagagatatacgtattgtttgcatcccagaactgcattacgatgtacgcgcccttactatttgcgattgctgttgcatcacgtttcatttggcattgcatacggatcgtatcaccaggttttattccataactgcttagtgatgctttcgttaccgccgcttgctgggtagcagtccattctttgaactggtactccgctgtattggtagaagtatattcagtcggatcagaaacaatataatcaagttcagcaaagttatgcgaactaattttcttgtcactgataaccccaacaggcgaaacaggcagagaaagcaattgttcaatcgggtttacggttccagcatcagtgacttcggaaagtgtttgcatcctaataccgttgacaccgatagccgccccgtttctgttcacctcttcgcgagggactttacagaattggatatttcggcatcgggcctgacctgtggtaactgttgacggataatgataagcagaaacacccaaacgagttatatcagcattatctggaatagtgtaatatcccgataccgaatgccatgtatccgcagcaagtccagttgttctaagaactgttgatgatatccactgtccagacgcaatatgagtaaaggcatacagataacattctgcccccgcattacgtgcagcctgatcgatatagatgtccgcagtgattttgaaaatatcattacgagaaacatcactcccaacgttccaaaccccgtatgctttgaatggataaccattaccgctatacgtttgaggatcatccagcattctttcaggaataccagttaccccgatatcactaaattcatcaaacacaacttcaacaaaactcgttgtattgtctttcaaccccgtaccagaaccaccgacaaagttttccatgcaaatctttttcatcgttgatgaatagatagctgaataggatgaacggtgagaatagttggttgtggtgatcgggatattaaagaaccgagtttcgggccacgcaacagaaccaattttcctcattgtcgctaaaaagttatcatcacttctgatcgcatcgaaagtataaaaacacacaattctgttcgctggaagtgaattcaggtagtctttaatcgcattcccgttcgtagcaggatcaccatacatatcaaatgatttgtaatccaataatgctaaagttgttccatcaatgactgccaggttaattccgcgagcaacttgtgtccgtctgttaataatatcagccccgttaatagatacctcaaccgagttgaccgcagaatcgttattcgttccacggacaacaaggcgatatttcacggcgtttgcttctgaaaacacattcgccgtgaaactatcagggccgaataacgccataaattcgttattcgccatttaaattattcctcccacacaaattcacaagtcttagttgctgggtttgcgaagattttcacgttaccgattttgatatagttacgtacaaccagagtatcgacggttgaacccgctaccgctaccgccccgatttctgccggagtcggtttacgacccgcatgatagatcaggtttccgttgatcatcgctttgttgtaatcggtgatattgatgttgaactcagtcaataccttatcgtcaatgccagttaagcgcattttctggacgttcccagagaaatcacctgcctgaacatgtgccgtaccgctcacactggtaaagcgtccacccgtaccgtttacgctaactgacagcgcaccagtcatagtatcacccgctacgttgacataggtactgtcaagatgctgggtaaagtttcgggtgttgatcacggttgcagtggttgtgccgccgtcattactgattgttacaccgttccaaccattagttgcagcggttcgtaattgtaccgtaggcgttgctgtacttgcaacaaacaaatcacccgccgtgttgatgttagccagggctttaccattcagacgaatgttcgtaccggaatacgccattgtgccgttaccgacatcacctactgtcagaacgtcaaccagatccgttgtacccgtcgccaggcgatacgtgcttgcctgaacagtttcatgccagatcgtatccgccacaccaccacggaaggtacgaagcaagtttttggttcccgcagcctcaccactcagaacagtatttgcataaacagtgtttgctttcgcagactgattaatgttattgttcgtggttacggtgttgttaaccgttaccgcagcgttagccgtcagtgttccgttagtggttacgttaccaacgaagttgcttgtaccgttaaacgtgttatttccagttaccgtctggtttgcatcacgacgcatccagcttgcagcaaccacaccgcccagactcaaactattctgtgccgttgccattttcggtaagaagttttgcagagcaaagttcagaccgcgaggcgatacagcatagaaatcttcgagataatcgtcaacggcctgagtagaaccaaccagattatcaccgatgaaagtgtttgattgggtagtgataaacaccgcaccgcgtcgagttgtcgtcgcaccccacgccggatcagtaccgttcaagaactgcatggtagccggagtaattgctaggttagtagcagtacccgcacccgcttccgcgttagtcgcacaacgaataataccttcggcggtatccgtcgctttcttcgcttgcagtttcttaggcgtaatgaacacggtatccagaagacccgcatcagtttcaccctgagtcgcaacacgtaaagtaccgcgctgtgtttcagtagcagacgcaatccccaggttaatcgttgtccagatagtgccggactgagttaaaccgtcatcggtagcaaccgcaacatgacttgtaacgtcgaagaactctttcagcttaaccggaacaaccgccttattcgttaccgtacctgctgcaacttccgcagtggtagcgagggcaataataccatcaagtgattcagtcgctttacgatcgttcagcttcttaggcgttacagcacggagatcatcagttcccgtgtttgtttctgtctgggttgcgatctcaatcaatccgatacgcgtttcagtagacgttttacgatgcagcatttcaggagttactacgatcggcattgaagcagatcccgcagcagcaccagttaccacttcgttttcagtcgccagaacaaccagaccttttgacttttcggtcgccgtcttctcgttcaatgatttcggggtgatcagatcaacaccgttattgaagttgtagacgttcgtaccagcatccccacgtaaagccccctccgctgtcgtagcgcccgttgtaacgagtttcccgatacctgctagggtttcggtcgcgcggcgtgtgtcgagctttttaggcgtgattgcggtagtgtcatcagtaccagcgtttgtttctgcctgagttgcgatttccagcaccccacgacgatcttctgttgctgatcgttcgttcagctttttaggcgtcacgatcacgtcatcaaggaaggttgctgtcgtgttctggttaacttccgcagttgttgccaggcgagcgataccacgacgcgtttcagtagcggttttattcgccagtgtacgcggggttactgccagttcatcagacggcgtatcttcatgattcttgtttacttctgcctgtgtagccagcgcaatcacacccagacgagaacgatttgttggatcgacacgttcaatgatcgggcgatactgtgcaactacccattctttcgttgctttcagatatgacagttccatatatggaagatagtcagtatcggcgttgaaagtcagagtgtcaacactgaaccagtcatcaggcggataatccttacgctgtgggaactgcatcatgtttttgttggtgcggatcttttcaccggaaccatctttaactttgatcgtacagttctgcgttttccccatcatgtacatactgatatatacgcgatcaccttctgcaacatcttgcggaagagtcagcgttacattacgtacagttggtgggttgccagcaatcggagtgatgaacacgtaatcgttcggcaacatgttcaggtcatcactgatacgacgcagacgaacgcgctgatcaccgtcataaacaacccaacggttattagcctgatcgaacatgaagataccataaccggaacgctgtgaagtcacagaggttacgttattgataccgtcatagctgatcgtgtgtccgctaccaggataaacttgcagagtcgcaacgttcaccgaagcaaggcgatccagatcgtaagttgtgattgagtcaccatcatttgcgtaacgaggcaactgcaacgtaattttacccgttccactgttacggaatgttaccatacccgcttgcatttggaaagcggttaaaccagtcgcattaacaaactgcgaatcacggttatcacgcatttcagcaacacgccataagttgccgttaaaaataaacgcaacggttatatatgggtgagtcagtcgataagagcttgactgaatatcacgtaaacggatctgacgggtgtttgaacgtactaacaggttgttaacccctgcaagaccgccaccgtctttaatggtgataatatcaccctcaacaggggcatctggcagaatataggtcagttcagagaaacgaccatcagccattaagtacgtaccggattcaagagggagaccgtcagtgctcgttacgttgttatatacccattttggatcgttacgggttgagatccattttgtttcatcgaaagcacccgctggcgatggaatatctgcgcgagcgtaccaaatacgacgcgcgtacatgatagccataaacgcagcataaccacgggtagaatcgtattgttggatcgtgttaaattcgttaaaaaagtcaacgttcacgccgtcgctcaacacagagcgtgatgctttaccaacgttgataactttttcgccagcagcatcaaggccacttgtggcgcggaatgatttagctaccattatcgttttcctttatcttattcaatactgatatttataaacaaaaaaggcgaccatcaagtcgcctttttctcacggtaattgttcagccaatctttaacaatcgcgtgatgaagaggattcgcataatctaatttgtttcttttcttgtatggcgtaaaagcgtttttctctttgtccgtcatttggaaaagggtttgaaatgatttgcgttgccttttcgtttgaactgcttctgtggtttcgataatggcatcaggaaaatatttttccttcatgtatttcgctaaccgcatatcaggcacaaataaattaatctttcgtttgctgttgttgtgtcggatatcagaacgagcgcataactgaaaggctggttcgtaatatttactgacaacataagcatcaactaattcttcctcttcgagtccagaggacaccgcaaccgctcgcaacatttgacgaagccagggtaacgggttgtaactgaataatgcaaccacgttagtatagcttgaatagaagttcaatccatgcgagttatacggaatttcctgcccctcgctaaacttcgatctgtatgtgttggtgcaatagatgaactgttcgccccctaaaagcgcctccacgcgttttttaatctgagtgtatactgtcgtcccagattgagagagatcgcccgtataacgcgaataatccccctctgcgagcacatgtatatgtatgcgcccagtgtttttgtattgcttaaagtcaaccagcttttgaagcggtgaatctttgaactccacatcatgaaacgtttgcaggatcttccctgtaatcgtgtctttgatgttggatgaagcaatggttacatttttgaacttccactggcttacgtcatgatcctctacgaagtaacagacatatcccgaatcgctacattgcatcttcaccggaatagcccctaacagagcacggtaaagcgggaacatcttcattgcgatatcatcacgtttacgaagcccatcataggctaatcgtgtaaccagttctcgtttttcttcgtcaagttttaaatcaacgatatcatcggcattgcaactaaacggcaagcaaatctcgcgtatgtgcttgatattgctattaaatcgcagactttcgaacgcaaccaaatcaggaacttcgtcaatgtacagggaaaaatccttatacaaatcaaagtcatcaatgtttttgagtgctgcatgagtgataaagatcacatcataatctttgacaacctcacgcagcgcgtcattgttggttcttttggttcggtgatccgtgtccacaatcaccgctcgttttccttttacctggttgatgtagtagtcataagactgttttgataacatcatggaaatcgatgcgatgattgctttttcgcccgtttgattgatatggttcagaatcgcctttgttttaccacttgacggaacacattcaatcgtattaaagatcatttattcttagcgtatttcttctggtatttcttgattgcttcgtcggtgatctgtttaggcatttgacgcggtttcttcggtttcagtggttcgacaccgaagatttcaacgccataatgtttcagcatcattgcaacgatttcctgacgaatgaagttgcggctaaccttttcaggaaattgatctttaatctgcttatgaagacgatcttcgagcgcgtccaggtgagtaggagtgatgatcgcggtgttatcgcgttcaacgaatttctccatgtattccattgtttcagcatgaacagcatttgcagcagggagtaaaatttcacggctcatttaatcaccaataagttgtttcaattgcagataaccgccgataagtttgttatcgacaaaaatacgcgggtattgaaacgctaaactacgttgccttacccgttttgctaactcttcgatacgtgggcgatcgtattcaaagcccagatcgtttttcgcttctttcagaacgggataaaatgtatattctatccctttttctgtcaacagcttttgtgcttgtatacacccgtaacagttatgaagactttcggggattccgtatatttcgactttcattcttcttcccgtatggtttgagatcctgcaaaatacgctttttctctttgcctaacagtttttcgatattttcaacagcggttaactgagtgtgcagatcgaacaggtttgcaatctggtcttcctgcattttcagttcagattccatgttgatttgatagatgctaccaccactgaaaacatgttgcaaggcgaaacgaagcattgcatcagatttacgtactggcatcggtgcgatgctcaacgtttccaggttagccccaaatgatggatcgatgcggagatcacgcaaaggattttcctgtacagggcgatacgtgaatttagggatatccatcaggcacagatccgaaccagtgacaccagcggaaacctcttccggtgtagcgatacgcataacgttttcagcctctacacctttacccagattaacttcttctggttcttctggggtgaattcaccatcttccggcgttacttccttgaaccatttccatagtgatgcagggagttcatattcgtagccaccgtccatgataaatgcgcggtcttcgaactcaccgatcgaggtgcgatcaattgtaacataacctttttcacgaacgatgtttgcgatacctgttttccaggtcttttctgcaaagacttctggggatacggttaaaccgtaagtttttccagcgaataattccatgattacctcaaataaaaaggggatgcccgtaagcacccccgaattatattacttacgtgccagcagtgcaagttttgcagcggcttcgcgaactgcgcgagctttctgtgtgacaacttcgatcgctttctggtgttctgccagtgcatcttctactgcctgtgcagcttcgatgatctctttatcgcgttgctgtttggcaatgtcaacagtctgaaccgctggggtatctgcctgaactgtgccagtaccgagttcacggaagaacttacgctcacgatgcattacaaacgggaggctacgatctttataaatcaccgcgtcgccgtcaccatcaacggattcaaacaccagaactccgttgttatttttgatgtgttgcacaatgcgtttattcgcggtatgagagcgcaggaaaccatctacatctaccagaacatacggacggtttgcaacaaagttaccaggcatcgcttcaaccgttgctggctgtggtgcaacaggtttcgcaactggttcgattgtcggagcgaggttaacgccaccgtcgagttctgaatccagatctggtttagctggtgcaggagcaacggacggtttgcctactggttttggctttttagcgcgttttggcgctggggctttagccggagcaacttctgtgaagtatttcgcttcccatgcacgaagggtgttcatagcaacacctgccggagcatcgaaggtatagcgatcaccgttacggcttgcgatatgtacaacaccgttcagcaattggtggatctgttttgactgaacactgttagcaatgtttttgccgttgtcagtgaaaccttcggcatcaaccagcttgtaatctttgccagtttcgaagcgggtttcttttgttctcaccgtccacggatgtgaaccgcttcctttggtgatgtttttcagcgggatcgaccacttccagcaatagtcacgggcttctttacgggttttgaaattcaggatcatgatattatctctcatagagggcttgcaatttagtaacaaattcatctttgctacgggctttgattacaacttccagacgagatttggcttctgcttttgcagcgcccaaactccaaccatacacatcaaccagttcacagatttctttgatgattgcgtttttcattttctcgtcctcaagtttgtttcgatgtggatatcttaacagaactaccaaccaggtcaagcgatatttttaatttcgatggaattctttttgaactcaatcattcgctgattatccgaaccgcgaaacggtttcttagtcggtagatccttttcgtaccgtccatcgatcagaacatcaatgaatggtaacagcttagagcgttctgtatcgccctgtaaggcttcgagggtgtaacccgtccaaacccacacatctttatcagggaacgtcgcacggacgcgctggagcagttttaagagcgtcggatgattggtgcggtaaaacggatcgccgcctgtaagcgtcaacccgtccacatggggatttgaaaggagtttaatcaactcgttttcagtctcttcggtgtatggtgtaccgttgcggggattccatgttgatttgttgtagcaaccttcgcatttatgattgcagccagtcacgaacaacactacacggattcctttaccgttaaccacatccatgttatagatgcggtcaaagttcatcagcctttcgcctctgggaacagacgggctttgatcgcttcgtcgataatttgcgggaattcattattcacgcgcttaacgatttcctgacgaaccgttacttcgaggtttttggttacgcgagcaataaacgcttcttcgtccgctttgaggtttccggttgcatcgttgattgcttccagcttgattgaatccagcaggtcggcgcactgttttttaacgtttgtcgtgatcagttctttgatctggcggataccgcctgaattgatatcgaaaacattgctgtatgcgtaacgtttctgaatgtaatcagcaaactctttatgcacaatcttttcgatttcgtgattggctggcatcatcaaattgacgtgcttgatcaccatgttttcgatttcttcggttacgcgcttaccgataacgctgtcaacaacgttcttgatgacagcggcttgcagatccatacgcgcttgtgtcccttctgggaacaggttgttcagcgcctgtgtgtctaatttcagttgaatcattttatagtgcctttcttctcaaggatcagttctttgatccgttccacgattacggcgtattcccagttggctaacttctgggtatcacaccactgttgaaaatccttcattgcttttacgtgaccttctttccagtaagtcaccgcgatttcgttacaaagattttcagtagcagtatttttgattttcatgatttagcccctatagtttgttgtctacaggggcatattataacatcattcgtcgtccgtcaactcttttttgaatccgacataataagcatcagatccattccatgtggaggcgttaacgctacccaacagaacacgacaaggcatatgtttaagtgcagactctacaacctgggagactgaatccagaggattgctaccagacacccagcggagcagatgacgatcatcaccgttaatcggatcaacgaattcaaatctgataccgttttcaatcagttcgtgtagcagaaaattaatcgctttgcactgcgctttgttaatcagcataaatcacctaccagatctttatcaattttggtgtatgtgagcgccggatcatacttctccagcacgttctttttgcacgaatggatgaacttttccatcgcacgggctttcatcaatactttgaaatcttcaccaaagcattgtttgattgtgggaattgcacgagccgctttgtcacaatcaatgatcagtttgtactcgccttgtgtcgtgacaaccaccattgagatcagaacacaaccatcaaatcctttttcattgattttatggaagttcagcttatccgtagtgcttgccaggttcgcataacgatccccgcggatgttaccaggagaactataccgagaaacgttgattgaaggaatacgaatatcttcaacgatatcacatgacgcaacagcttcaacgaaatcaagaattctggtcgctttgatgacgtgcgccttaaacgaaccgacctctaactcatattcatctttccagcctgaatagtagtcaaccgcagggctaatcgctttcatgagcgcttcgggaatgtcaatgtgccataactgttctgcgtactgtttgcgccagtctggatacgttttacgtgctggtttaaatgcaccatcttcgaacatcatttcacctttcctctctttttcgtaaatctcgctaagaacttccgttgcacttctttcatatgattctttaagatgaaaattaaccataccatcaaacgtgagttcagcacaatacttttcttgtgaccgcgatgctgcatggtctaccattccttgaaaaacttgctggctaatcgccccatcatgcaacatccgtatcaatcggtcgcattcatcactaggaagacaccaccaatcagacggaagttttacccgaaaattacgagcatggttgattatccaatggtcgttaccatatttttgaatagtataactcatagcaaaaaaggggcttgcgccccttcctcttatttcgcgttcagggagtcgatgtaagcgctaacgtcagcggaggttacagaagcggcatttttgccacccagcaacacatcaatcttcgtcacgatggtatcgacgcttacggaggtgtggcctacagcggcgatcacgtcttccggtacagtcagacccagactttcggtttgcttgttcagttcgatgatctccaggttgattttgacatcagccagtttgcgatccagttcgacgacagagagatcaatctctttgttcatcccttccagttcttcgatcttcgtctgtaagccctgccagatgttacgatgttgcagcgccagcacgtaatgactgtttgacacttcctgccctgccgccagaagttttttgatctccgactctttgccagtgtgaaggtctttgtgttctttgactttctttttcaacttcacgatttcctgaacagcagaaacacgagtatgttgcagacggtcgatctctttgatcaggatacgtgcagcactgcgccaggcttcttctggggaagtgttttgttcgattgcagtttcaactttaccagtcacgaaagatacaagtttcttgaacataattttgccttatttgatttcaaattgattggtgaaccattcaggggctttaacaactttcccctctctgatatagcccattttacacagttcgttggtcaagtcaagcctttttccacccgccatgtaaaattttaatctgcttactgggatcaccggacggataacgtcacgatagccgaaatgcgcactacgcaccactatagagagcatacgcaagcggttgatgcaaccagtatacgaacgcccagtagcgcgggagaagtcctccagcgtaacgccgggggcaatagcacctatcagatcaagataatccttttcaacccagaaccgcccgacagaacatttcgatacaccctcagccatttttgcgtttgggtgtttctcgtcttcgcacttcttcttgtcctcaaggaacttattgaagcggatctcttccagtctgttttctctttctacccgtgcgcgtacacgggagggaaacagagtatcaaggattttcccgatcatatcgttggctttccgtttggtagtttcagatcgaaaggaacattcacaggccggacggtttctaattggagatattgttccatccccacacgcttaccacctactttgttataacggatgttctttccgtcatagcctacagcctgtgaaatgtagtagtgtttagtttcgcgtaaacactccatccattcttgtgttccggttttgttgcgtacccgcgcctttaatggaaacatcattcaccccgtagaactttcagttcatcagacaaacgatgtagattggcggttgcagtatcgtaacgcttttcggtgtctttcagggtagtttcccgcgccttacgcaagaatttttccagatcgccaggtttcgtcaccagcttaccatctacgtaaatccgtcccagcaggtgagaacaatccagcagttgttgcgcgtcggctttttcaacagcaggtttaagcgcgacaaactttttaaagaaaccgcgatcctcattatcaaacagataagaatcttcggaataccatgttgtgccattggcatcaacgatcccactaacacctttccggttgcagtgcgttaccttgataggaaacacgacagatgatagttgattaggcgacagaggactaccacgcaaagctaaattgcggtacaccgtcccaaaactttcttcgtcacgaaattcaaaataatcttttgtccagtacatcattttcaatacctcatagtttcggtatgtgcaatataacaaaagcccctcactttcgcaaggggctttttgattaattttgatgcttagttcggtgcatcatttctttgttcttaccgtcgttgaaaccacggacagcaggagcacccaaataaccacatgtacggcgcgtgacgctcattttagccggatcgtgattaccgcagtgcttacagtggaaaccttcttctgtaggcgtgaactcgtcatcagagccacatacaaagcacttatcgaccggaaggttagttccgaagtagtccagtttttccatcgcataatcccagactttttcaagggcttgcaggttgtttttcatatcagggaattcaacataactgatatgaccagcagtagcgatgtaatgataatcggcttcatagtcgattttctcgaacggtgttaccttgcggtcaacgtccagatggaaactgtttgtgtaccagcctttatccgtgacacctttgacgcttccgaacttctcaaagtccagcttacagaagcgatggcagagagattccgctggggttgaatacaggctgaaaccatatcctgttttcttcttccatgcttcggttgcagcgcggaggtactcaatgatcaatctgccgatattctgggagccgatacgatcgaatggatgctggcctgagccaaacatcaacagcgtttcatgcagtccgatataacccagactgatagagctacgcccgtttttgaacagttccagaatttcatcatccggtttgagtcgaacaccaaaagcaccttctgtgtacaggatcggcgcaacactggctttaacaccgcgtaggctttcgatacgagtcatcagggcttcaaaacacagttccagacgttcatcaaggatgcgccagaatgcgtcgtgcgcgtcttcttcttcctgtgcttccgcttcaatagcgatgcgtgggaggttgattgtcaccacacccaggttattacgtccatcaagaacttcattaccgttatcatcatgccacacgctaaggaaactgcgacaacccataggagatacaggaacactagaaccagtaataacacggttgttagctgaactaatgatatctgggtacatgcgtttagaagcacattccagggcaagttgtttgatgtcatagttttgatcctctggatcaaggttaattcctttttccatgaacataaccagtttcgggaataccggagtaataccctctttacccaggccgcgaatacggtttttcagaatcgctttctggatcatgcgttcataatcgctcgtaccagtaccgaaagtgatggtaacaaacggggtttgtccgttggcagtatgtagggtgtttacttcatactcataggactggaacgcatcatacacatctttttcagtcttttcaatcgcatacacatattcattatagtgttcgatgccgtaatgttcagcatcgcgcagatgtttgaagaatgtcatttcgacgtatggagccagcactttatccacgttcgcaaaggttgtccctccgtactggtgagaggcaatctgtgcggtgatctgcgccatgagagcggtagcaacaccgatcgatttaggcggttcaatatcagcgttacccatcttgaaaccgttctccagcatacctttcaggtcaaccagacagcagttagtgtaaggggtgaacgggctatagtccagatcgtgataatggatgtcgccggagtcatgcgcttctacgatatgtttcggaaggatatgattacgggcgaaatgcttcgctacaatacccgccagcaaatcacgctgtgtcgggaatacccgtgc

SEQ ID NO: 3 - DNA, 174256 bp, Unknown
  source: /note="Description of Unknown: colon-11 Bacteriophage Sequence"
ggatctcagcatcacaaggatgctgataattttgcataattccatcaattattgattcataatccataatcatgttagcctacctgtactgtgccgccagtgatttttgttaatgcgccagaatcaataaacgtgttattcgttgctttgatattgatatctttagcaccgatatccatcgtttcttcaatctcaattttcgcattttttgcagtgaccgttgcgtcttctgttacagcaacggttgcattctgtttcacatttgcggtaagattctgatcaacgttaactgttgcatctttgtttacagttagttcagcattgcctttaatcaggccaacgtactcaccttcaaccgtttgttgaacgtttccacgaacaaattcagttacgttaccatcaaccgtttgttgaacgttacccatgttgtaaatgaacgcatcgccttcaataactacctgtaagttgcctttaacgttgagtttccggccctgcatcacgatctgataatcatcccctacgattttaacaacgcgggttccatccgggcgaatttcttcgtaactccctgctgggtgaacacggttatatcgttcgtatcctggggtatcatcgaattcctgaatgtgtccggatctcgattcaaacaccatgttatacggatattccgcattataagatgatgctggttcttcaaacatcacacgggtatcaccaggagtaaacggatcttccggactagtagccgacaatgtagcaccgttatacgcagcgtaagcagcactcagagagcgcccttccggatctggtacttgcaccccatatgattcaaggttgcccgtgaggacgattttagacacacgagaagaacggcctggagtttgactagcccacagtgaatttcgaagaccattataagccgcttgccaatcttcatttttcatcgcttttagggtattggtgaatttagcaacaccaccgacgcccatttgaaacgacatgttttcgatcgccatttgacgaggacggtttaggttcacatacacttcacggacgttagcggttctctgaatatcagatcttactttggctaaatcttgagcaaataaggttgatacctcttctgccgtgattgtcccgtttgttacttctcgacctaccgctttactgatcgcagcgttaatttttgcagtgttgcgagtcttttcgcggataagcaaatgcccgatcccgattgtcggatatccttcactgtctgtataccagcgtgtacggatcccctcatcctgcttgagcatcttttcgatcgtaaatccacccgtatcagggcggttatcttctggtatctcatccagtgggcgatcgtctgggtttactgctatgcttgtgtttgaatcacgaatgatgacacttgatgatcctttgcctttcaaaccacctaatgcaagggagttaacatcgttaccaacatagcgagggtattcacccataggatcgcaaaaacctttctgtgtgtctggttgttcgacatattcaccagcgacagtaccgattatcataccatcttggtgccatttgtcacgccaataaccaacaacaaaggatccgcgagtgataccagttggagagaagcccacaccagagatcgcagcgcttctaatatcctgaataggcatcatccagggtaaatcttcaacaggaacaccgattgcatcggatttttgtttttgggctgggtgttgtccaaatacacggacttgaacacggcccaacccgcgcggatcatcaacgttttcaaccaccccatcaaagaaaggtgagtgtaaatttccgcctaatttcatgagttagccttttccatttctttaataaaatcattcagaaacgcctggatgtcagacggactaatgatttttattgttcgttttgcttcattttgcaacactgcatcttcataaatatctacaggagctaatacaccttgatactgtaaatacagcattggtttgtcacctttgtcataccaatgaccagggttattggggtcttcgacaaggttataatacttgttgttgttttcatctacgtgatacagaacctgttcaccgccaacctcagaataacgctgtatagcgcactgatacgcggcttcctgatcggagatccaaccatagaaagggtcataaacagagttaagcatcaataggatccagtagtattgctggtttccatataatgattctgcaagttgttcaggtcgtagtgtgcctgttatctggtaactacgggttttatattttccaatcacacgattaaaataaaatcgatagtctcggaaaatatcagttgtctgggtgcctttgtaatcaacaggcgggaagtatgaaaatagcacgataagttcccctatctaaacgttatattattctatttaggatttacgcaatggctggaagacagacgtataaagggtcgtttgtacccgaaaacatacagaagtataaaggcgatccgcgaaagattacgtataggtcatcgtgggagcgctacgttatgaagtggctggataaaaacccacacgtaaaacgttggaattctgaatgtatagtgatcccgtatttctgcaatgcagacggtaagagaagacgctattacatggatttctatgtggaaatggaaaatggtactacatatctttgggaggttaagccccttaaagaaaccatgcctccaccgaagccagtaaacaacaacgtacacaataaaaagaaatttattgatgctctttacacctatacagttaatattgataagtggaaagccgcaaatgagctatgccgtcaaaaaggctggcagttcaaaatcgtaacagaagaatcactcaaaaaagtttttgggtggcgaggtcagtaatccctggagggaaacatgagttttatttttgagtttgagatcatcgcggaagaggataaacccaaagcaccacccaaacgcaaattgagtgattgggttgaactggggatcaaattccgtaaggcaagaacgaaaggtgtttctgctaaacgttttgccgattctgagggattaaactacgcaacgttcacaaagtcaatgcatcgttacaaaaaacagattgatgatgagattgaacgacgtaccgcagaaacagaagcccgtaaaaaacgtaatgactaccgtaaaaaacacgggatcgagatcatcaacgatttccgtaatagtctgaaaaagatcactgttggtgtatcagcggcaaagcgacagaaagattcaacagaatggtttggtaatttcatcaaaaccagtatcaaaacacaccgtgtggcaaaaccagcaacgggtcgcctgtacacgtttgcatatgatgcgaaatataaagacactctgccgtactgggatagatttccactgattattttcttaggatccggaagatcgaaagcgggtaacttggtgttctatggtttgaacttgcactatgcgccacccagagcacgacaggagtttttagaagagttattgaagcgagggtacggatccactaaacgcctctctaacaagactgtactcaaaattaactggggtaacgtgaaaggtatgcgaggcgcaacagaaatgatcaaagcatatctaccatcacacctcaaatcaccattagcagagattgcccctaaagattgggcgaaagctgtttggctaccgactcagcaatttatgtccaaagggaaaccttacggcgcgaaaaaagtctggagcaaatactaatcaaaaagccccaaccgaaaggaaggggctttatttttacaggatgctaactatttctgcaagtttgccaggggtcgcaccaggtctaactttcatagcatctttcaggtttttgtcaaccatcttttctgcatctttttcgttaaacccgcgtttcaccatcacagcaataactttttcgcgaatgcctttagacgcttcattcagatcttcggattcagccagaaccagtttagaaaccatatcgcctttatattcctgggtgaattttttaccagatactaggcgaggtttgccggaagcatcaactacggtaaacactgcatattcaccgcttgctttagttttagaacgcccagtgtacagaagacgcatatcgttgcttgggagtttgtaaactttacctttcaccagagcttcatccatagggatctcgatttcgaaatcttctgctaactggttatacagatccagattttcttccgcctcttcatacagagtagcagctttgaatttttctggtttgtcgaaatccagatcatcatccggattgccactgtagaaagaaacagtacctttagcccaatcgacataagccgcttgaactttaccagtagtcatacctttcaaacgtacaatgtttttaccgaagtatgccagatcgtgagaatccggtgctaaaacttcgaaatcagaaccatgtttgaagtgaagaaaaccgattgaatgtttatcggaagttttagcgcgttgaccacgtgctacggtacgagcgagggttttaccttcggtcagaaattctttgaattttttcaagtgagtcattttgtttttcctgatttccaatatgggaacatagtaccagtatttagtgacggggtaaaggaaaagttttcagaaaaagcataaaatttattagatctaagtattgatcttcataaaaatttatgataaaataaaatattaatatattatagatcataaaatttatgaattcaagatcagatctaaaattttttgataaattatttattaaattttacttgatcttgttagatctttttgataaaattttaattaataattattatagatcaaagattttaaaaggtcaagcattttcttcaaatttttatattaccccgtcaggccgctttgatcccgttccccgctaaatagaggaaaggagatcctatgtctacagaaatgattttaaaccaaatctcacctacaaactttcgggttgatattcctgataacagttacatgaaaggtttgactttacaagttcaaggggttacactaccatcaatgaacctcccagcagttgatattcctgcaaatatgatggttcgaggtaaagtacctggttcggcttttgagtttgatcctttgatgatccgctttgtagtcgatgaggaaatgagatcgtatcttgggatttacatatggatgttgagcacaaacgattacaatgagtttaactctgttgcgtgggatgatcctaagcaatcattcgctgtgcatatcctggataactcccagatgaaaacgatcgccacatttagattttatggtgccttcccaacaaacttgggtgaggttgaattgggttatactaacgatagtgatgaagcggttacgtgtatggcaacttttggcttccttcatatggaagttgaaattgacggaaaagtagtcacttctcaaaagagaatgagctaatgatttatgtgattagtggaaaaaagcgaactggtaaagatacggttgctaaatttattcaagaggcgtacaatgatgttcagtgtgaagcactggcatttggtatcaaaagaacgctaagaatagcaatgcagcgatatggttacgataaaccatacattcgcaatatgattgaaggacaatattctgatccggatgctattttttacaaaggcgatcgagagaaacctcttgtgatgtctaatgaagatgttctaaatattttcaaaatcgggcttgaaatcctcaaagaacgtggatacaatattgtttatagtcctgatgatattgataacctgattatgagtaacgatactccctggagtatcagacgcttgatgcaagtgtttggaactgatatcgtatgcaagtatgataacacggtttgggttcgttacacgttggaaagattcgtcaataaatatactggtgacgaatacaaccatcttctggtcactgactgtcgtcaagaacacgaatacaaatacctaaaacgcttaggtgctaagtttgtgtttattgtaaaggataccggaattgttgatgaacattccacggaaaaaggtttgacacctcaacctggagatagtatcatcactaacgaaggtactttgaaacaactaaagagcaaagtgctcgatacttttaaattttaacaatgggtaataaaatgtctgatattcaaaaactgcaaaatgaagtactggtactgaaaggccgcgcattcgatctgaacgaagttatcgcgcaaaaagaaagtgaactctctgttcatcgtcaacttctgtccgacctgtgttcggtactgggtattgacgcaagccagccagtaaccccagaagcggtaattggcgcggtatccgctctgatcccttccgttgaagtcgaaaaagtcgcggaagatgaagccgcctttggcgaagaagcgtaaaaacaaatttattacaaaggggctacggccccttttttattggggtgttttatgaaatcatttcttgaaatcacaaaacctgttgtagatcctggtatctacatgtgtgctaaattcgatcaggcttcatgtgaggctttgaaaaatgttcaaaagacattaggtatcacaaagaatgctgtttcagccgaaaagatgcatacaacgatcgtatacagccggaaaacggttgatttgttcccgcaacaggacatcacagaacctgctaaactggttgatgttgaaaagtgggacacaaaatacggtagcactattgtagggatcctggaatctgaatacctgcatagccgtttcaaagattctattgatgctggcgcaacatacgattatccggattacaagccgcacgtaacccttgcatacgattcgatgcttgatgatatcagcggagtgaaaaggttgttgacactgcccgtggatttgactattatctgtgaagaggctgaatcactggatctggataagtcgttaaaagatattacagaacacattgaacagcgtggcgataagtgggttgttttgaatcacgatcgcacaaaagaacttggtgaatacaattcgaaagccgccgctgaaaagcgtttgcgtcagatcgaatacttcaaaaatcagtgaggattatatgaacagaacacgtttaatgtatcttgttaacagtgtacgaaaagaagttagcgaggcgtttactagcgcgttaggtgactggtatacaatcaaggtagcggctactgctgaccacatttcagatcgctttaaagaccgttcagtatcgattaaaaaagatattgaaacttatcgcgatatcatgatgagtctagcaaatcattattcgtgttatgttctaacctacgctgtgaaggccaaaacagaagggacacaggaagttattgtttatcgtcgggtaaatggtaaaatctttgcttgtcctataactgttcaaatgttctttaacgaaggcgaagagaagccagtgatcgctatacggttacgaacggtgatccctgagtatgtttctttagctaacagaaaaacaatccaggtcaactacgttccaccaaaaattaattttgaatacgacggttatcgtcgggttatgtcccgcctggatcgtctaatcgcttctaaagattgtcctccgcaactttggatgctgaaaaattgaaaaaagcccttgcattcgtgcaggggctttgttatattggccttgtcgaaacaaaggaggctatcatgaaactttactggttaattttctcaaacgggtttgttatgaaaggaagtgttcactgtgcaaaaacgtattgtgagtggaacaattgcactttcaagatcctgagtgttgcggcgtctcaacctgtaggggattactaatgactggtgataagtgggttgataaaactttgttgttgactttggtttatattatggtaagatacttaatatagaaaaaggaggatatcatgagaaacttaatgaacatcgcagaactcatcgcatacggcagctcactctatgttttggcgcacggtgacggaaaaggttacttaattttctttggtatcggccttgctatctctttcatcaaaaaattctttaagtgagaaatatattatggctaaaccatccggcaaaaaatataacgtcattgatgtttatagaatgactttaaaagactttgaaaacatgtgtcgggcttatggtagttctaccacccttcgcgaactggcagagtctgctaaaaaagaacgtcctcatgtttgcccgaaatgcaacggaaaaggttatgaaaccattcgttataacgcatatccgtctgggttgccagattctggatgggtcgaagatatgaaagatttcaacaaagaatgtgacctgtgtaatggtcatgggcgcaccaaagataaatttgttgcaaaacctgttaaagtggaatatgtaaaatcatgaaaatcgtcgatttgattaaaatggctaatggccttgtaacaagcgatcattatgccgactattgcgaacagtacgaggtgccactgcaacgcgcgatcaatcaatccgggtatgatggtgttagcgaaattaccaccgaaaacctgaaaacattcatcgtgtttgctaacaccttctggatgtatctaccggataatcctggtattcgtcaacctgcattctttacgctttgcaccttctgtgaaacgtatttgcctgattgtgaggatttcgaagaaatctatggctaaagtagagttgatgtatcttgataaaccaactggatctgttttcccttgtgggtttgctgatagcgcagaacaaatgatgtctatcgcgttttctcccagcatgaagccgatccctggtttagatgaaaatgtaatgaatgagtgtaaccagaacggaaaagtatggtatactcgacacgaagggagtgttgtttatcactccaccctcgaaaaccttaaatctgaaataggctatacgaaatgaatattgaacatgtatttgcacaggcattagaacagaaattaaacgcagaactcgatctgtaccgctacaacatggaagaacagattcgcagtgatcacaaaaacagtctggaacatgaatctattcgccgcgaagtgtggaaacgtactttctttgaaaatctccaggctggtgtgacaaaagccagtgctcgcgctaacaacgcacttgaagcatttgataacgcttttgcaggtgaataaatggaactatcagcgggtattatctttgttaaagatggtgccgtgttgatgggccatgccactgaaacgccccattgggatattccgaaggggcatgttgaaaagggcgaaactcatattgacgcggcgatccgcgaatgcttcgaagaaacaggatttgaagtgttcgcggaggaattggttagcctgggtgttctcgattacacgaaaacaaaaaaccttgctttattcctctatgtagggcaagattacccagtagcggaagaatgctattgtgcatcaactttcgttaagaacggacggactatacgtgaaatggatgattttaaatatgtcccgatctcacagattccgtcacatgcacgtaaaacgatggggcaactactgcctaaaattttagcaagatgagaaatatatcatggaaaatcaactgactttaatcgatatctgcaaatcaattcgcgatgctgttttaaccaaagcatccgaagtcactatttactcttcatggagtgctgaattcggctatgaagaaattgtaaacttccccgaccgcctcaaaaataccaaatggttccgttatatcgatcctaatgagctttcccttgatgaactggaagaactcaatttcagtcgctgggatgaacatagcggcctacgcctgatccctttgtggttgcttccatacatcgatccggaagcaaaggtcatctgcattgatggtaacgaagttctgtttaaagatgcagataatgatcatcgttttggtatgttggcctacggtgtgaaaccaaaggcataatatgaaatacgtcgattttaatactctatctgaaatgggccttgtttggcgcattaaccgcgaaatcttacaccctctggggcttgcgctttcccgtgatgtagaaacaggttcatcacctggcgcgttaatagctgatgatggtgtatggcatttcgacgaactcacaaacgaaagaaacgcagagaagttttctaaagttttggatttacatcaaagcggaaatctgttagattatctacagaagaacgcaaaataggggcttcggcccctttgaggatcatattatgaatggtaagcgggttattgtcgttggtgaatcaaagcataacgaaaaaggcgatcatctgatcattaacaacgatcggggtggatggtacggggcgacacaaataaaaagcggttatgcaacgctggttgaaaaagatgcggttagattggcaactgctaacgatcctgggtattatggtactcgcgaagagtttgaaagcgaaaaggatcaagagatcgcagaattgaaaacacaggttcataatgcgcgggtgtacgctgcaatgtgtttcactgtagcggttatgattacgattatatactggatggtgattttataatgacagacgaaattgtaagaaaccgtattcgtgagttaaaaactttccaaagtcgcgatcatgcgatcatggttggtagttacattcactggttcaagaacaacgatctggatctgaatccgtcctatcagcggccctacgtgtggaagcagaaagagcaagatgctttcatgaagactttgattactgggtttccttgcggtatcatcgcgatcgcggttgatagtgaattcaacgaatctcgatgggtagaagtcatcgacggaaaacaacgcttgacaactatcatgaaattctggaacaatgaaattggaataccgatgcctaacggttcccgtttgttttggggtgaaatggaaagacatgaacaacgtgcttttgaaaacatttcattaccagcgcttggactcgatgagtgcaacataaaagatcggttgaatttctttttgaaagtgaactttgcaggggttccacaatcaccggaacatatgcaagcaattttaactatgtatgagaatgcaaaatgaattttacaacagcgccttttgaaactggtaaatggtacttcaaaaaacggcagagtcgtatccatagctatacttgcaagaaagaccatctttactatccgcaagtaatgcaagctatgtgtgacgcagaaggaaacattcacgctgttattgttccttctaataattgtaaactgagcttggttcagcgcaaaattcctaaagaattctatgttctttatgaagagtttacccctactcacctggaagaatcgttatttttcaaacagggtaagcgttacaaggtttctaaccgtgggatcattgattgcctggctgaaatcgatttagggaagtatggtcataacacatcgttacgtcgcttcctttcttatggtagcaaccgacaggaacagcagaacgttatctatatcaataaagttgatatgcatggcaacgcgatccacattctgggaaattcatgcaccagtgaagtacaaagttctttccggactaaaattcctggatggatgttgatgtttttggaagaagtaggtgaaaacaaaccagccgtggcaaaggatccggtcgaaacgatgatccagaatcatgaaacactggaagaaacaacccgtcgtgaactcattcaggatgaagttgtggatcttccaaaggcagaaggaatcatggtaagtcatgaagatttagccctgcttgatgcggttaagtttctcattgaacaaagttctgttgattatggttcccgtgctcgtattcaactgagtgcagaaggttacacgtatggtgtagattctcatgaattcctgatcaagtgggccgaaaaacgccgtagtgagttgatgaaatatagcgatgaactctttaataaaatcaatgagttgaaagcaacaatcgaaaaattaccaaaataatcaaaaagcccttgcattagtgcaggggctttgttatattacacacatcgaaacgaaacagagaaaggaaaatatcatgaacatgaataaaaacattgccgctgtagttggttgtgaagtttctaacgcagaacgctatgataacggtttctctttctgtgttccgactgaactcgatgcgtacaaagccgcttacaaataccgcactatgcataaggtaaacgttacttacgcgcctaacatcgaaatgtggttggttcaggtttacaaagcatgaatttccatgaacgcaaggccgcacgaaccgattattacatgaggttcgtgtatggctggaaattaaggaaatgtgttgcatgtaacggttcggggcggtatgataacaaccgttcccccaaatgcagtagctgtaatgggtctggtaaagaattttataaaagtgaggtttctaatgagcgtatcaaatgaactgactaactacttcaatattcgttatacctctggtattgatgactgggctagggatgacgaaatgactattaatcatgcatgtgcagttcatatgaaacgcttgcatgagcaagggaaattgaaagaccttaacctttacggcgacatcggatccggttatcgctattcattctctatcaatgataaagagcgcatgaccgttactctcactaacttagttattcatgaacctggtaatgtcgttgcctgggggatccataacgggcgatatactgaaaatcacagcatgaaattagcgctgatgaatcataagttgtttggtggttgtgttcctgatatctttactaacgcacttctgcgtattttgaaatctatgtgaggcatacatgagtgatgaaattgtgtttgatgacgcaacattaaacaagttgcatagtgtcgccagcggaacctgtacagccatgagggagaaatgggcggctacaatcaccgatgataacaagatcggggttgttgatgaaatgggccgcacgtttacggttacgtataattcgtcttggtctgttgctgacaaccaaacaaaatccaattgcttgatgaaattcatcgacatgatggatccacacatgatcaaaaagctggttgaagagatccgccgccttaataaatttgaagcggaatcgaaccactggaaagcaaatcatgcttgtgaggttgaacgtgctcgcgtactcaaagagcgtcctgatatgcccttagagcgcatcaaagcatatgaccgtatggttgagttggaagaagaaaataaacgcttacgtgcgcgtatggaagttctcatgagcgcggaaatgatgcaaaataacctaaacatgatcagcgctatgttgcattctatccaaagcgatactaaccaaacaagaaaattgttatgtgatcgcttcaacgtacaaggatattattaatgtcatggttcaaacgagagtgtaagcatcaagcaactggctatcgaggtgcagatccttacatattccagaaatatagtcaggtagatgggatcgggcgcatccatttacatttatacgctcgatgtgacaaatgcggaaaagagttttcttacgctatgatgcacctggatcgggcgcttaccgaattgtgtcagtattctacgatgcgttcggaaattcaaagggttatagataataccccaatcaaacgatgatttttgcaaaaaccccttgcctatggtgaggggttttgttatattgcattcatcgaaacaaaacagaggaatcatgaaatgactattaaaacgagaagtgttgaggttcagaatttatatgcagttcgcacaatcctggctgttttgatgggtatctctaccggaaaatcttcttatattgatagtttcatattctctctgtacaacgggaaaactcgttgggatggtgatgttagttggactgaacatttttgcgaccagttgaatgagatcgcaaacgaaatcagaaacgggaaatactggaaaactgggatcttctttactctgattgcagcggaagatgttaagttttgggatgcgataggggttccgatgaaaacatggaaaaatattgaactcgaagcaaaataaatgttgcattaaatcctggttgtggtatattacacacatagaaacgaaacagacaaaaggaaatcatcatgaaacttgttcgcgaatcaatcaaactgggtaacgaatacaacggtaaatggtactttgtcatttacgacgacaacgccgaaaaactggaaaaagttgaagatgcattacgtgctatggaaactggtgcttctgttggtggtgaagtgatgacctgggaaaactactgcgacggttgcccttgctatagtgatggtttcggatctggtttctggattgatattgaagacgttccggcgttcaaagcctcctggaaaatcgctaagaaaatggcataattagcacgaattgctaaaactcgataaccctgttctgttatattacacacatcgaaacgaaggaggatatcatggaaatcatctacaaaagccggaactacaaaaaagaagatgttgcagcagtttacatcaagtaccggaacgtgaaatgtgagtacagcgggatctggggttacgaaatcgttgttgaagaagtcaacgccgacaacaaaaccatttgcagtttcacggtaaactcggatagttctctgttcactacagaacagcttgaaaaagcgtatgatctccggaaccaggcttttaacgcggtacgtataaaatgaacaaattcgaaccctatatgaaatggctacgtaatgttagcgcccacttagggcgcgatattaaacccagcgcactagctcgcgaactgtacgaacttgatgcggatccggaagatgctgcaaccgactacgggagatttctatgaacatgtacgaaatgcttaaatcagaaaacagcgaaacccagggcgaaaaagattacaacaaatggaaacgctctgttcaacatatgctgggttcttctgattatgacgaagatctgatgtatgctctttactcggacggttgcaccccagaagatgcagtgtgtgaatactacgcgcaaggggacgaagaatgagagatcaaccattcagcaaaaaatatcgtttgtgggctgaacatgttcgaagtttactatctcctttgaatatttcatacaacgaccatcactgtactttctttggatttttctctgacggtatgacgccagaagaagcaataaaattcttcatggaatacaaataactcttgcgctgggtgtaggatgatgttatcttacacccataccgaaacgaaacggggataaaaaatggacatgttgacttttgaacagtacaaagcacagcgcgatcagtaccaaaaatggattgatgagatcggcgcagagttaagagcgtatcctaaaaatgaaatgggtatgactattgaatcgatccgtatgtctccggcatacaaagaaaagaaaaatcttttcaatcgtgtattttcaaatctccgtgccttgaacggcgaatacatcaaggtgtacaaaaaagaactggctgacgaacgcaaacaacggtgggtaaaatgatggaacacgtaatcaaaacagagattgacaaacgcgtatttttggaaaagaataaaacggtaacgctgttgaactactccactgaaaattgttctagtgaattttggcgcgttaacattgatagcaaagggcaacaccaatcaataccgtttgataatgaaagtcttgctcgcgctgtcttccaatcccatgttagattttgagaattatattatgaataacgcacaaactgttctgaaagctcctaccctgttcatctatcaagatggtgatatccgttacgctcgatctaagtggtataactacaatttcaacgttaaaactggtgagtttgctcgctggggaacatcgttcgaaactgatcctacctatgccccattcccagaaattctcgatatcgagatcacaactaaatgcaatggccctgctggtaaactttgcggtttctgctacaagtctaataaccctaacggcttcaatatggatcttgatacattcaaatctatcattgataaaatgccctggttaacacaatgcgccctcggtgctgatgcacagggacaaacaaaccctgatatgtttgatatgatggcctatgcgcgttctaaaggcattgtaccaaaccttaccattgctgatgtatcagaagacgttgcagcgcgtttagcggctgttgctggggctgttgcggtatcagtatacaaacatgctggattcgatgtagcgtttaattcagtggctaatcttgcagaagccggacaacagcaaatcaaccttcatttcatggttagctctaaaacctatgatgacgcgtttaacgtggttgatgctgtaaagaatgatccgcgcttgaaacaagttaacgcgatcgtattcctgggtctgaaacaaaagggacgaggcaagaactgggacacagttacccgcgaacaatataaaaaacttgttgaatattgcctcgattctggtgtaggatttggtttcgatagctgttcagcccctgcttttgttgaagcgatggaaggacacccaaacttcgaacagtacaagcaatatgccgaagattgcgaagcaactatgtttagctcgtacattaacgagaaaggcgagttcttcccttgttcgtttaccgaacgctgggttgaaggtggttgggaagaaggtttgaatgtcctggaagcgaacgatttcattaaggatatctgggaacatccgaaaaccaaacagttccgtaatgaactgatcggtaataaggatcataacggttgtcgtaactgtccggcttatgcggtatgcggtaaagatatgcgcgtacacaaagcccctgaacctgatgtttacgcggtggaattgaaatgaaaatattatcgtacaacacgcgacataatcgcttagttgctctggtatcagatcgggaagcgtcactccttcagcgtttcccgactgaagaaatggtactccatgatattgacggatatggaaatgatgatacaatgatcgcatcaagcatcaaagttgaatcggtcgatatgtgtcacgtatcaactttgcttgcataccgtcattatgttgaagatggttcacaacacattttcgactttatcgctaaactgacatctagacttgatgaagaggaatactatgatttattcggataaacctactcttcgtcctgttcctgtaacagttggtattgtgaaaccgcgaacgttggatagtttgatcgacaagtacagtatgatgccaatcaacgcgcaatccgcgcaactggcactatcggaaagagacgctatttgctgcgagtgtgacattaaaggttttcatacagaagaagatcttgtaatgatggattacctatggcacattcgtaatgaagttgttacttatatactggcgtcggaacgagcaggacgcgctgtagcagatgcgcatagagaatcacagaactacattcgcgggttatcagcagtagaacgggaggcgttatatgcaagaaataatcgatgaacttatgtatgtgtacaaagagcgatgcaaaaatggacgcatcaccgaaccaaaggcaaaagcgattattgaaaattattgtgcaaaagtacaagcacaagacgctagttcaaaacttctgaacagtctgatgatccttaaacttttgattgcatccggtgatgatatgccgtatgatgtagatagtgcagaagcattccagaaaagttatcgttcatggggagtgatttactcccgctcactgggttcttatgattcggttatgtggaacctgatgcaccttgataaactgatctgggaagtgctgaaagaagagggtatatcatgacatttactcataccggaatggttgaaacgataacagcaggtaagaagcgtgttcccctgatgaaatcggggaaatactggaagagtgaaaactataaatttgatcataatggtaactcatttggttctttttatgctaaactacacctgaaaaccattaaaccgatttaaaggaaactctatgttaactaatgaacttagtggggccattcgtaccattgaagggatccttcatgatttgcgtatgggtaacgaaatttgtgtaagcgacattgaagcaaatctggttgaatggcgcggcgctctgtatggggcaacacaaggaaaagatccgttgtttacggaatatgatatgtatacagtaaccattgacaataaaacttatcgttttcagtggcctgatgatgcatacgatcatatcaaaacattttacagtactggaggtgctctttttgctaccagtattggtgttaacgaattgccttttcatcctgatggattgagaccttccgatcatttaggatgtacaactgtgttactgggtatgtgcggtaactattctgatcccgtgtactggattgaagccagtaaaaccaacttaaaaagagtttaacatgaaatatattattgctttggtgttagtagttattgtcgttttagcacaatccggatgcaccgatgagaaagaagccgaacgtattctgactgctaacgggtttagcgatatcacgtacacaggccacgcctggttcgcatgtgatgagaaagacacctatgcaacagggttcgttgctaaaagccctacaggggtgaaaattgaaggtgctgtgtgctctggattatttttcaaaaatagcacaattcgcttcaaataagtgttgacgtagatacggggttatgagactatagccctgtagaaacgaaacgcactttaggagagaaaaatggacatcatgaacgaaatcttagctcacatcgaagccaacaaagaagcaatgaaagctaaagaaggttgggttgttgttgacgattgcttcaatcctaatatctggactccggttttcatcgatgagaacggtaacgaagcccacgggttctatgatgctgcaatcttcgatactgccgaagaagcatgtgatttctgggcctacgttagcggtgatgctccatttacaaaatacggtgtgtgccgttgctgtgaactttaattaactagccccgaaaggggcttttttgtaggtaaaattatgattacgaaagcacaaaggatcattaatcatttagaaacagggttcccgtaccagggagatttaacccgcgatattattgatatcctttctgaacacgacggcatgaaggccgaaatagaagaactgttacatcctgatgctaacgtgtttgcttcattgatgagcgatgtagtgaacattgacgccgatgaacttggatgcattgaaacaacaaatgatggtgataaagccatactgaaacaggcttgtgaacggatagacaaccttcacgatcgtttgttcactctaacttttccgtcaaaaaacgataaaccttgttgacatccagaaaataaaccagtagtctgtagttacaccaattgagaggaatatattatgaaaagtgcttttgaaaaacgtgctgttaagaaagatgttaaaccaggcgcgatcatgtatgaagtattttgtgtgaatggcgaaaaggctgaaatgggtagcaagatgattgttactggattcccgtatatgcatcgcggtatcgggctgtttgctaaatgcatcaccatgtacaaagactgggactgtcacacagagttctctcttgaagaccgtagtatgaatgggcgcaacggatataacttccatgctttcttcctgaccaaagaggatgcacaggcttacattgatgaagtcaatgaagaccgtcttcctcctgatatgaaagagcgaaaagaagaacagatgaaacgtaaacgtgaatttgaagaatgcttcggtgatctttacgattattaattatcgaacctcttaaaccataaataccctgtgtacccaaacagggtatttttacaagaggtgatttatgtttaaattcagtcaaaaaagccttaacaaccttaaaggtgttaaacctcaactggtgaaagttgtagaacgcgctctgcaactgtctcctgttgattttggtgtacgtgaaggtctgcgtactgtagaacaacagcgcgagaacgtccgtaagggtgtatctcaaacaatgaactcaaaacacatcacgggtgatgctgtggatctgtatcctagcgtgttgcctcaaggctggcaaacaaaccctaaagtgtggttgcctgtcctgaatgctgttaaacaagcaggtgatgaactgggtgttaaactgcgttttggtatcaactggaaaaatgatccgaaccttccgatcgaaacaaaattcattgatgccccgcatgtggaattagcgtaacaaaggggctttggccccttaaaggtaaaacatgaatagtgaattttatgtaaagacaattgaagaatgtcgtaagatgcatcttatgcgagagttggaagaaccaacgcataattacggccctaacgattttatggtattcgaaaccaggctggatctgggcagagaaacgcaaaagactaaaggcgcgtttgattttatgaaacgttcccatagttcccttaacatttacgtagcgcatacgttaaatgcagcacaagacgccaaacagctaaatggtgctaccggatgtgatgtattgaccagtaaaggggcaattcttaatcatttccgtggacgtcgaatagagcaccaggcaataaaccttatttttgatgagtgtgatcttacgcgcaatgaacgcatggacattgtgtataatacactcatgcattgtgtacaaaagaaacatccattagcatatattcacgtaatttcgctgggtatgtaatgaaaagtcatggctattcatcaagaaccatacatgaagagattcaagggatcgaatctcttctgaattttgtagatgttgatacatctacaggtaaagtgtattggaaagttcagcgcggccctatgtctcctggaagtgaagccggaagcaaaaacgagtattcccaaattcattttaaaggttctatgtatttgcgacaccgaatagtgttttacgttgagaatggttatcttcctcctatcgtagatcatgtatatggtgttgagaatggagatacagcaagaaatttacagaaagcgacgaaccagcaaaatgcgatgaaaaagaaatgtaactcaaacagtagtacagggttgaaaaggtgtttcttatcataaagccaatgggaagtacaaagcgcagataaacatagatggaaaaagaaaatttttggggtactataacactccagaagaagcaaaatccgtttataaccggaaagcaaaagaggttttcggtgcattttttaacgaaaccacataaggttaatgtatgtcaaaatacgtattagacaccaatgttttgattagtaacccctattcaatctattcattcactcaacctggtacagaaatcattattacctctgctactatgggtgaattagatcacctgaaaacgaaagaacgaacagcgcacgaagcacgattggcgatccggcttctgtcaaaagttattttcggtcagtcatatgatgcgattacgaaatcaggtattcctttaaacctgacaaacccagcactgtctgacactatcacccttaaagtggttgattatgtcggaaacaaaacgtttgctcttgacaagcaagacgaacgaatcattgaaacttgtatgcaacaggatgcaaccttagttactcgcgatattatgatgttgctgatcgcaatgtcccgtgggtgtaaggtagaacagtatactggcgacgatacgttaaaagatagcgatgtattgtattccggttatgtagagatccctgatttctgggatactgtggaagtgttgggatatacagataatgtagcccaaatcacttacagttcgcttcctgacgaagatttttatcctaaccagtacattacctcaaatggtgagttagtcgggcgtgtggtgactgctgatgagatttgcttgaatgtcttacctgttaagcacgaacaggctatgaaacgcaaactcatgaaagctatccagccccgtgattctctgcaagcggctttcgttgaatccattatgagcaatgaaatcgatgttgctaccattatgggcggcgctggttctggtaaaacaatgcttgctgtttccggtgctatgcacctggttaatagtggacattacgctaacttgatgtatgtgaagtcagatagcccgttatcaagtgaaatcggcttccttcctggtacattgggcgaaaaactccggccttctatcgaaccttgtattactagcctgaacattctgtttaaggataatccggaatctgaaaaatacattgaaggtttgattgaaaaaggggtggttcaattccctagcctgtattacttccgtggtcgcagtatcggacatccggatccgggcaaaggttctgtgctgattgttgatgaatgtcaaaaccttagcaaccacgaaattaaatctatcatttctcgttgcggagagaacacacttctgatactatgcgggaacattaagcagatcgacaaccctagaaacactgccgttaacaacgggtttgtatgggctgttgaaaagctgaaagaatacgaacactcaagccatatcattcttgatacagtgtatcgttcccgtctcgcggcgtttgtcgaagacaatttctaatgatgggggcgaaagccccctttttgtgaggtgtatatgattactgttatccatagcccaaaactgattactgtttgcagttgctgtaaaagtgggttagaatatgaactatctgatatacagcaaaagagagaagcgatttacaatggatttttctctgctgctgattatgtcgtgaaaaaatttatcacatgtcccaaatgtggtaactctgtgaaattatttttgaattgaggtttccataaatgaaactagaaaaacgttattatgtagcaaaattgagcgatcttaaagaactgacgccagaagatttgaaaacgttcaacgaaatttgcacgaaaatcgaaatcgggcgcgggatcaatggtaagaaaccatttgatgcgatcgtgatcgagaatgattggcccgaatacgataaagtgttggaaatgctgacttctcgtattgttcgcgaagaaaccgatcgcaagtttgaaaagatgctggacaacaaagaacgcctcggatactttttcgtcgtggaaactcaccaggggacttttctgatcaccagtgatgcgcacagcacaaatcgtctgacgaaatacagtgggtacaaataccgcgcattgttcagccctgattgtggatttgacaaaagtgagatccttactactagctggagcgtctactttaaacatgccgttatggtatcgttagatgaaatcattgcactatacgatcctaacgaggctatttcaaattataacattgctgagtttatcaacgataaactacgtgacgcgaaaactatctaaaatagttgcataaatataaagtggggtgtattattgccactctttttgcaacataggtattaaaatgaagaaaattattattgctgccagcattttcttgtgctctttttctggcaacgctgcgacggatccgctaggggatttcattgcggatttgcctactcatcaattgcctttacaaaaggctactgtgaagcctccggcaaacaaaaattctccatcctacatcaaggatttggataatatcacaccgaagcagaaagaggttttggagtatgcttatcgagttggacacaactatgatttgaagactgcaaaacctgtagaaaaagataaggctaaacgtttaggctatcatttagcggctattgtctggatcgagtctcgcgcatgtgagaatgtcggtaaaggtaaaaaaggccatcacgcttatggatgctggcaagttaccgcaaggagcgccagcgcacgaatggataagtcatatcctaaacgcgtagtaatcaaaaagctcgaaactcttcaaggtggatcgaagtatgcgatctatgaactggagtactggcttgattaccacaaaggcgacttgaaaaaggcgcttgcgagctataacgctggtttcaagtatacaaagaaagaagcccgtgattatgctcgtatggttaatacaaccgcgaagctgttagaagaaaaacaaatcatttgacaaaaagcccttgacttcggtcgggggcttttttattatgagtgcatctaattgagaggaatacattatgagcgtttcacatcaagtcattgtttcacaaaaatatgattaccctaacctgttgcgttgtgtgcaagcaatccgcgatcattttagcaaacaagacaacatcgttatcaaagagattactttgagtaaatctctcgattgttttaacatttatttcacatatgataacgaacagcgccgcctgttcatttgtgaactcatggatatgtattatgatatggaatacaatcctattcctaaaaatgggatttattttagtatcaatgtctggggagaatcacagaaaatcatggatcttgtgaaagaaaccgtgtacactgtcattacaagttcggatactgtgtatgagcgcccgaacgatgcttatgaatcacgattcactttggttaaatgaggaatacattatgagcgacctgatcctgaacgaaactaaacgcgtactgtttaaagctggttcctacatcgtggcgactccgaaaggcaatacttcccattgggcggttgctgattggatcatgtacattgacaaaaacggggaatgggtacaatgagaaacttagcgttcgaagtgaccgtaattgatcaacggataaaagaacttcatgcacagatagccccactgcaagaagaaatttccacgttgattaaagagaaaagagacctgattgaactcatcgatcaggatatcattaacaacgtcaaggacggggaaaagatccccgtgatgttggaatatcgttcttccagtgtgtcttatcacgcggcaacaaaatttttcgaatctatcggtctgggtatcgatggtatggatccggacattaaccaatactgtttgcggatcgcgatggatgaagacggttcaaaccttaatcgagttttaaccgctttagaaatggttgaaccttttgtcaggccgcaagcaaatgggcgtaagcgtttcgatctgttcgaacatactctgtctgaatgggattgttactggctgacatacaatccagctaacaaacgttgggctgttgaaactggtagtgggatgagacgaaaccaggatccgacattctcggatatgtctctgaaaaaagttcttgcgtatatctgtaatgcgcattattatactcctatcgaagaggatgaataaggaatcatcatgaaaaagttagcactgcttttaactctggttgctggatttgctcacgcgggtgatgctcgcctggatgagttatgcaacaatcgtgatatcaaagatgtcgcagtatgtaagcaagtgatcgcagaacagttagatgttgcttatatgtggggagaggaaaatgctcacctgtataaacgcggtaagttgctgaaacaaaaagagtttttgcagtctgaaccaatgatgaatctatgcaaacaagcgccaaataaggaacggtgcgaaaagttccgtacttatttggttgacgaattcaatgctggcataggactttactaatggctatctggatttttattattatggcggcggttgtggtgttcttggcgtacaatgctggtaagcatgagagcactgggccttgttactattgcggggatgatgactatgtttagtgctggatactttataggcgttgttatcggttttataatttttggtggtgttttatatatgtgtcatcaagaagatcgccgccgtgaacggaaagcgagaaaatgagcgtaggggttcaattcactgtattgtggatccttgtgattttgatgggccttgttgtggccctactatatcggaaaaataaaaatgatcattaaagaagtgaaaggtaatgctgtcaatatgtatctgaacggtgaaggccatttgatccacggatgcaactgctattgcaatatgggcgctggtattgctcgcgaaatccgcgatcgtattcctggtgcatttcaagttgatgccaatacgttaaaaggttcccgtgataagctcggaacttgttctgtttacattggcgaaaaaggcaacattgttttcaatgcatatactcaatatgatttctggacacctgggccgcgtgtcgattatgacgcaatcggcaatgcttttaaacaggctgtagggcttgctgacgccgttaagactggaaagcctatcatcacacctttaatcggtgctggcctcgctgggggcgactgggaactcattaagcgcattattaatgaggtgactggtgattacccgatcattgtcgttcatttcgatcctcgtaaggcgaattaatcatgatggatcctatcaaagcaggtcgggagattaagaaagcaaacaagcggatcgccgtaatcaaaggacaacgcgccgcactggttaaaacctgtaatgcattggcgcaagcgatgaaagcgaataacatcaacattatgcagcgtaaagaaactgttaatgttctatgtatcgttgacaattgtctgagtaaggaaatggacgaactgaaaagtaaaatcaatatgtggtatcttgatatacatcaagcacaagataacgaaatgagtggttataatcatgactgacaaaatcaaagctaaagcaatgaaggtgattgcgacatatggaacactccgttggtgtaacgcgcaggtgtgcgggtgtatgggttgcgcaaatcataccatgacgaaagaagaatatgacactgcgatccggatgccagaaatcaaagagtatcttgcgcgacataatgaaaaactcatgggtaaaggatggttttcaattggctaacgcacacattatagaaaaagttcgttgtcgggattgtcatttccctttaatttgcgtaatgaacattaccaaacccccttatgatgagtgggattggtggatctactgttcaaacaaaacatgcaaaaaccatgaaggggaaggaaaattccagaataccccagattttgttgagaggataaatggctaaactgtattttcattatgcatcaatgaatgctggcaagagtgctcgtttactcactgatgcatacaactaccaggaacgcggtatgcggatcctgatgtacaaaccagcaattgatacgcgagaaggtaaacagagtatctcttcgcgcattgggttggaagcaacatgcactatgatcacgcctgatatggacttgtattatgatgttcacaacaatcatttttatagagacagcccgaatctggtttcttgcgtgtttgtggatgaagcgcaattcctttccaggaaaaatgtcatggatctgtgtcgggttgttgacgaattagatatacccgtaatgacttatggactaagaaccgattttcagttgaacttgttcgaaggttcttatatgttgctggcgctggctgatgagatcagggagttgcgaggggtttgtcattgtggaaagaaagcaactaccgttgcccgtattgatgcaaatggcaaatttgttgctaatggcgaccagattgagatcggggcagaagacaaatatgtttcactttgtcgaaaacactacttgcaactaaagaacaaccctgatacagtggaagcataaacaaaaggagatcattatgagtcgcacttaccgtaagaaatacaatcctcttcgtgaccgttcatctaacgaaaagatcgaagaagtaaaagagtattctcgttattatgctcaacatggtattgatccggatgggttacgttggtactcaaccaactggaaacacaaatcaggatgtgcgtacattcgatttgataataatttgtgtcgcgacggtaacaaagctcatggcgatctgaacgcaatgctttctattgcagtaaagaaaattgattcaaaagtacgtacccgtttacgtcaggaactgaaacgtatgaaagctggtgtgatcggttgggatgaaaacgtagaaaacgtgaacaaaatacgcgctttcgaaagaagtttgtgttggtatgacattacttgattgactttacagcaaaaatattataacgaggcttcggcctcgtttttgctataaatatatacaggagtagacctatagtgggtctatgagtaaaagagtaattgttatgaacattaaacgcatatcaatggctgtgctgttcggattgttgatgatgacacccacaacacacgccgccgaccgtccggttcagaaagaatttgacgattatatcaatgcggcccttcaagtatacatcacaacgatccctcccagcgtaaatacaagcgaactattctacaactacatggaacgaaaatggcgccaaaaacaatgccgatctgaatccgaatgcgcaaagctagggattagggtcgcgtatgagtttgcaagtatccatcgttcataaagggatcatcatgcaatcatttaaacaaattacagaatctgagaactcaagcaagatagatgcctttattggcatgtgccttatgtccgttacctatatgcatagcgcacattttgcaacaggttcatactcacaacataaagcatatgagggtttttacgaagatatgcaggatttggttgataaattcaccgaaatccacataggaatcacgggaagatacaaacctgtgctaaaaaccgaaaatgtgcttgacacggtggcgtatctccgtaaaatagccaacgaagcaaacgagatctacgaatcagtagatagttctttgaagaacatcctggacgagattaagggcttgtgctatcaaacaatctacaagctgacaaaactttcttaaaaatagtttgacagcgtgaaatgtgatgatagaataactatcgaattgaacaacaacttatggaaattatgatgaacttaaacactatcgtgaacaacccgaagaaaacctctctgatcgctctgggcgtagtcgcagcactgtggttagtgcctaacatgtataccattgtgcaagacggtacggttaaaactgaaaccttcatgggtaaagtatcaccgaaacccgtactgcctggtttccacattgtaaacccgctggcgacgtttgacacgttcagcaccaaagacatcgcgatgaagttcgacaaattacaggttccgtcccaggataaatttaaatccactgtggatatgaccgtaatgctgcaattcgacggtagcaaagcaccgatcaaccgtatcaacgcgggtaatcaggatcaggcactggataagtatgtaaccgaaaaactgctttccactgttcgcgaatttggtaaatccgtaccaaaagcgcaagacctgtttgatgcgaagatccaaaaccaactgcaaattgcgattcagcaggaagtagaagattatgcacggccttacggttacactgtgaaacaggtattcttgcaggatatcaccctgccggaagttatcatggaacaggtaactaacacgaagatccgcgaagaacaggttaacgctgctaaagctgaactgcaaaaagtagaacagacttcattacaagcagtaaaacaagcggaagccgatcgccaggcgcgtgaaaacgctgcaatcgctaacgaacgtgatgctgatgcccgtctgtatgcagcgaagaaagaagcagaagccaacgccgccctgcaacgcaccattacaccggaaatgatccgctggaaagaactggatgtacagatgaactactctacccgctataaaggtggcgtacctcaaactgtaatgggttcggattatgcgggtaaagtgattttcgattctcgtaaataatgttttaaagccccctctttgggggcttgacatctaaaacgagaatactataatgaacataaaacagatcgtactgacaatactcatttcactattctttggtttcattggtggattgtttggtgttttaataattgcgtctgttttatgattaacctttaaacgtggagcacgttatgaaacacaaatatgataaagctgtagtaattggacgttttcaaccttttcactatggtcatgagaaaatggtaagggaagcccttgctgttgctgatacggtttacattctgatcggttctgcttatgcatatccgaacacattaaacccattgaccgctaaacagcgtcaagcaatgatcactcgctggtctatctgcaaacttgatgttgaagatgcagccagaatcaaattcgctcacattccggattatctctataacgaggaaaaatggaaatcccgtgttcgtatggcaatcgatgaaactcgaaatgaccgaattgcgatcgtcgggtacgaaaaagacaaagattcttactggcttaaagcattcggatggaatcatattccggttgaatctgtgaaggttggagaccaggatctgtcctcgaccaatttacgcaaaattatctgggaacaccatgaaggctgggacgaagatttgttaaaatatgcgcctagcactacggtttcctttatcgatgaatggacacaaacaaaagaattccagcgtttgtcccatgaagatgcacactggcaacgagagattgacaagttcaaaaaatatccgtatccggattctctgaactgttgcacggctgattcagtggtcgtatgtaataaccacgtgttagtaatccgtcgtaagtttgcgcctggtaaagatgcgttagcgcttccgggtggacacaaaaacggtaacgaaacgttccttgattgtgcgatccgtgaattactggaagaagtacgaattaaagtacctgaaaaggttattcgtggttctatccgtaattcgatgctgttcgatcatccgaaacgttcggtgtacttctcaaaaccgactgtagcacagtatatcaagctagaacctaataacgatggttcattgcctcgtatcatgggcggtgctgatgatgcagcagacgcgttctggctacctatgcatgaggtcgtacaacgacaaggggaattcttcgatgatcatttccagatagtaaacgcctttacgggggttgcttgaaagcacattcatctaagcaaaccttagaacaagaagccacacatatagatgatcttttatgtgcggttattgtgaatccagatttatacgaaatttaataaaaagcccttgcgttctcgtgagggcttttgtattatacacacataccaagtgattaatgaaaaggaagaaaaaatgaatacaatcaacgtttctaaagctgatgttatgaaagcaacgattattgctaccgaagccctttcattcatggctaagaaagcaggagttgatagtgctgttatcctgatggagattacaaacaacccagaaggcaacaccgcaaggtatttcaaagatcttacttcctatgcaatggaagaatttaaatgattaaacatccctattgtcttgttacccgcccggttagtccgggtggtttgcctgttacctgttggcagttgattgaaaagggtgatgcgtttttaaacaaacgtggtgagaatgttttcgtttacggtgttaactcgatcgagaatgaaactatggttatcactgacgaaaaaacaaatgaaaaatacacgttgacatccgaacacgattgtcgtaattttaacgtatattggaaatctgatgaagaatttgaaactgtgaggaaatgattatgatccctgttattagtgctcgtgaacaagtagcaaaaccccgtgctgttaaagttggtgattttctggacgtgagttttacctgtggagaaactcagaagcaacacaaagaatctttcagcgtgatccttgtatctaaagattctgatggttcaatggtttacattctgcataaagtaggaaccgcccgtgttcagggtcatgtaatgattatctcagtatatcctggcggagataaagtatcttctcagtgtttagataaagtgactgctcgatatctgagagatagtgttttcatggcggagattagcaaaatttatgttaattctcgttctgctgttgatggtattgttacccatgtaggcgatgaattaatgtttaccgaaaaatctcatgaatcggttagacgtgctgttaaagttggtgataaactcggaagccctcgccgtgattatgtggttgaatacattacctcttctggtgatatcatcgtgaaggcagaaaaaggttctaccgttgttatttcccgacgcgataaaaaactgattgaatcactcaatcagaatctggaatggattgatgaatcagaggtgtatgcagcatgaaacctcgcttgattatgtcggatatagtgattgtcaacaacgaagaatactatgttgcagacatgaacacgaagggaacccgcgagattttggatctggagtgtgttaagggtggcgaaaatcgattcattgtgataacatacaacagaagcagtaaagaaacattgggagtgtctgttcccgttcattactgcgaaaaaactaattgctggagacgtaaatgattgatttaagtgatgtgaaagttggcgatacgttgtatgatgctgggatccgtagtgatcatcgacaaaatcgcaaccccaaaaccctttatgtacaaaaagttgcgcgtcagtacctgtatgcatcttttcgaccggaagatgggcctgattgctgttccaatattaaaatcaagcgcaataacgggtgggctgatggttggatgggttatcaactatatcgcagcgaagaagaatataaagaaatggtgtaccgccgcgatttgtgtgataagattaaaaaagtatttgggaacagctacggaacaaacatccctgatattactaccgctgaattgtgcgggattgcaaaaacattaaaggttgaattctgatgaaaatgattatggaaaccgtatttggttctcacctgtacggactggaaacaccaacaagcgataaagactacaaagggatctatctccctcatcctcgcgaaatcctgttaggcactgcgaagaagtctattgatacatcaactggcgataaaaactcaaagaacggtgttaatgacgtagatcgtcagatttacagtctgcaaaagtttatcagcctcgcatgtgatggtgacaccgtggcgattgatatgcttcatgcagatgatagcaaactgatcgctaactctgatatctggcaatatctccgcgctaaccgttcacgcttctacactacggaactaactggcctgtttggttatgttcgtaagcaagcggcgaagtatggcgttaaaggttctcgcctggctgcattacgtgaagttgtcgatgtgttgcagatgattcctgattactggtatggcacatcattgctgggtaacgtagatgaatctaactacggcaagcgcatcaaagttggtgaggtttctaacagattcccgaccaacgagttttgtcgattcgttacagacaaaacactgaaatcaggttgtcaggaattttatgaagttctggggcgtaaattccagtctacaatcaccgtagcggaaatgaagaaatccgtgtataaactctgggatgaatacggggaacgcgcacggcaagcagaagccaacaacgggatcgactggaaagctctttctcatgcattgcgcggtggtatgcaattgatccagattttcaaagaaggtgatattgtgtatcctcttccggatagcgcatttttgaaaatggttaaagctggcggtgttcctttcgcaaccgtacaagaggcgctagaatcaacgatgtgtgaagttgaaaagctggcggctgtatctggttatccgaaagaagttgatcgcgatttctggaatgatttcattgaacgtgtgtattctgaacatgttgtgaggtactacaaatgacatatccgaaattatccggcgctgaaattgatgttctgtgtaaacttcacaaatactcgtcaaaaatgttggatttagatttcaacgatgttcccagtaaatcggggcgtgatgccctgattcaaaaaggttatgcatctatggcgtttagttcaccaacgaaaaatactgatatgtgtttagtgatcacccctctgggcgttgacgcatacaaacacggaattgaaacggagtggcgataatgagtgatgttattttgaacgttaaagatgtagtattgggtgatactaaaaccctagattcggcaatggaaaaggctgttgttaaaattatgcgcaatagcctccgcctggaagttaacgagattacagaaacttgttatacaggtgggctttgtggtcaatctctttatcgtgatgcaaaaagtgtgaatattcagctatgggctgatattggcgaagaatcatacaaaatcgatgaggttgatttcgacgtatgaaaataattgacctttgcgctggtgttggtggcgtgaggctcggtttcgataaggcattcggcggggtcgaatgccttttaacgtctgaaatcgataaacatgcacaacaaacatatgctgataactggggtgatgaaaatattcagggtgatatattcaccattgatgaaaacgatgtacccgatcacgatatcctgttggcggggtttccttgtcaggcgttcagtaaagcagggttaaaacagggcatgttagatcctcgcggtactatcatctttgaaatactccgcattatacgggctaaaaagccctctgtgctgttctttgagaatgttccccagctattaacccatgacaagggcaacacgtttaaaaccatctacaggctgttacaggacgaaggatacgatatccattatcaggtaatgaatacaaaagattttggattgcctcaacgaagagagcgtgtgtttattgtctgctttcgcgatccggtgttctttagctttcctgttcctccacgtaccccaacaagggtcggtgacattctcgaatcggataatgatcaatacaccatatcagatcgtgcctggaagggctttagagagcgtaaagaacgaaacaaggcaaacggcaaggggtttggctatcaggccgttacagttgattctgtgtgtactgggacgataacagcccaatactataaggatggtgttcaatgtctggtattgcaggaaggtaagaaccctcgaatgttatcacctcgcgagtgtttccggttgcaaggatttcctgattcattcaagatgcataagagcaaaacacaggcgtacaaacaagcgggtaactctgtatctgttccggtgatcgaagcaattgcaaaacaaatcaaaaaagcgcttgcataggataacaaagaatagtatagtgaccttgttgaaacgaaactgacaaaaggaacataccatgacttttaatgacctgtttaacggatgtactggtgctggcgcgaaattcaatcttctgaaagattacccgctgggttctaatcctggttatgtgatggttgaagttcgcaacggtgaatactataacgtgttcatgtgggatcgctctttctcttactgctggttcggtgcgaaatataaaccagattacattctggagcaaatcgaaacagtgaaagctaaaaatcctgaactgtatgcattcgcagagtctattcgtggtgtgtttgggcattaattaaacaagccccgaaaggggctttttcgtgaggtttatatgattaccgaagttattgaaatggttttatacgcgttaacttttgtcctcttgtttcttagtgcggagtggactagtcgcggaaatgtagtaatggcccgtatttgtgcggttgctgtggtctggatcctgggtttactgctggttagcatcgttagggggtggtgatgatttacgtagcttcttatagtgctgattatgaattcactgaaattgcccatgtttctgaatcattgcaaaactgcgttgatgcgctgaacaaagttcctaatttcccttatcttggtgatcatgttactattgatgtatgggaaaatgaaaaaatcattgcaaaaagttcaacattcgggcatcgcgatgtatgggatgatgaatcactacagtacaacgaaatccccgtaacttttgaagaggttatgaaaaacatgaaggaagtgaaagatgaacatctatagcattgagttgatttttgatgaccgttttgagcaaacgtctgattgtgtatgttctactgttgacctgaacgtcgcgatcaaatacattaaacatacaccgcttccgtcgttgcattactattgtgtaactgtgtttgacgggtttaccggaaagcaaacgcatcgttgtactgttgggtatgacgaaagaaaacatttcaccgcttttgaatttgaggaaatcaaatgaaaatccgttctggttttgtgagcaatagttcatcaagtagctttattgtacggttcccgaaggatccgactgatatcaacaatctccgcgaaatgatgggtgattgtgttcctaactgtggttatagctggatgacttgcccgacagcggaagaagttgtacagcaagtacaccgcgacctgggtggtcatatgggtgatggtttcgaatcatactatgatgataagcgttatgaatgggaaaccgaagatagcgcagaaactcgatatcggtctaatcctcaaattgcgcttgcttatgatgggcgtgactggtatgatctggaaaaagaagagaaagacgctctgatcaagatgtggttgtatgaagagtacaacgctaaatttggcaatcagaacggtgtattcatttatgaatttacttactctgatgaatgcggagaattccaatcacagcttgaacacgggcaaattttccgtaatctggaacacactatgaagagtcatcactgatggaatacgaaatctgtgtaaaaatgcccccctatcaactgggggaagaaataacgtttagtcaaactctaccagtaccgattgatttattttctttgcgaaaatatcttgaacggttcgatctgaatgagtatactattcaaatcgtaaggattaaaaatcctgttgcctacgctctgtcttttgacgttggcgagtctcaaacaacaacgatggatgattttgtttcattgttgagtagtaagtttggatgcgatgatgcattagatactattagcaaaaaagtaaacgaaattttaataaaatttacctataaatgagaaaattatgatcactaacattgaattcaaaaacgccgtagccaaaccaaccccgactaaccacgtttttgtttgtgacgtatccggatcgatgtataacgaactcccgcgcattcgtcagcacctgaaaaacaacctggcaacgctggttaagcaggatgataccgtatctattctgtatttctccagccgtggtcagttcggttctgtattcgtgggcgaaaaggttagctctgtatccgacctgagcaaaatcaatgatgctatcgatcgttatctgcgtccgaccggatgtactggcttcgttgaacctctgcaactggcggttgaagtcgctaccgatctgcaagcggataatggcaatctgaacagtctgatcttcctgactgatggttatgataactgctggcgtactgatgacatcctgaaagcgtgttctactctgccgttgacgtttaacaacattgctttcctggaatatggttattatgtaaaccgtcctctgctggaaaaaatggcggaagcaaccaacgcattacacaaattcgttgaagggtttgatgcgtatgtacctgcatttgatgaaatcattaccgcgcaaacctccgcacgtgttgaagtcaaagttggcgatgcaactcatgcgatctacctggatgaaggccgtgtgtatgtcctgaatgctgcaaatggtgttgttctggttccggaacatatcaaaaacatttgggcgctgggtgaaaacgcgatcaatgacgttgacggcttcgatccggcaacagcagaaggtgaacaggttctgtatgtggttctgtatcatgcgcttcataccatgaatccagatctggcatggaaagttctgaaaaagctgggtgatgtgcgtctgattaaagcatacgataactgctttaccaaacaggattattccaacgctaaagatatgatctccgaagcggttgttgatccggctaaacgtctgatggatggtgttgattacaacatggttcctgatgaaaacgcgtttactctggttgatgctctcgaactgctggcagaaaccgacacagtgatcgacctgtcttctgaacactgggcgtacaatcgtacaggccgtcagactgtccagaaagatgatgatacactggataaactgtcagaacagattgcaaacgcttctactccggaagaacgtaaagcactggcggcgcaactggtagcgcatgaagtatggaaaccggaatttacccaaaccacaacgaaagttgcagtgaaacacctggttggtaacagttcccgtccgaacatttctatcaatacggatctacaaggttacgtaaccattccggaaagcaaacaaaaagagtttggattgccggaaaaagtagaaaccaaacaagtgcgtaactttaccattgttaaagatggtatcgttaacgttaaggtacttccgctggaaaccgatatcccgactctgaaaaacttacgtgcttctggtctgactatcaaaccgctggctaaaattggtgaagaccgtatgtctgtactggttgactttacctctctgcctctggttaaccgttcgatgactcgcggtatttctggtaaggaatttgttgctgataacgtccgtctggaaatcctgaaaggccgtcagaaggtaatgaagttcttccgtgataacgcgattggtttacgcaacgcagaagggcttaaacagcgctttggtgaggcggctggtgaatggttgtctgagcaagggatccgtgattacggcttttctccgaaggttgagcgcacagaatcgactgatgtttacatgtcgaaagaactgaacgtgaaaatcaaaggcgtttcatcacttccggctgttgctgctaccgttgcaaaacgcgccgaaggtaagaagaaactcaacaatggcgacctgatcattctgtgggcttatgatactgtatctaaagagatcgaagcgcttgacaagaatgacctgatcgagtatcttgataagcagacaaaggaaactattaaagaggttcgcgcccttaataatcgcctgagtcgtgtaatgtacggtattgtcgtcggacacgcatggtttgcggatctggattttgaagaaaccagcgtaagcgttaccgcaacagatatcgttgcagcggaattctggaaagatgtgaaatttgattgcacaatcgttctggaagaaaaagaagttaaactctaatgagatctcgcccccgaaagggggctttgaggtgacttgtggaattacttgaattggactttaaaaatcttatgaatatatgcaaactgaatcaaggcgacatcctttatttctccaatcgtgatgggtttcgtaattcccgtcctgaaaacatcggctttcattcacagctacctgatttcatcgtcgttgatgatgtccggttaacagataacggctggcaggttgatgtagtcggattcaaaaataacaacggtgctatcttatggcgtcctggttctattgatgaatcggtgtattttaacaacattcgtgtaaacatcgatgaaatcggaaccgatttgagcgaagtgcgggaatctccgtatgtgttcagcaactggtttaaagttggtggcgcgtatcgttctgataacacaaccgttgtgtatgttgatagtttgatgtccggtatggttaacttcaacccgtcattacctggcaacaacggcacgatgatggacattttcagagattataatcgttctgggacaatgttaccttccgaaaaagcatatgttatcaatcgttgcttgaaagggctgtaccaggatatgcttacctataatgaaggtaacgtaaaagatgcgcttcacgatctgaataagatcctgaaagaagtttctatgagaatggatacccgcaaatgatttctttattcgcgttcgtttcagttgttgtattgattttcgctggaggtgttatctatcatgggtgcgaccgtcgtgaagataaggtcattctatggggtattgtcttcgcgttaatccctctattcatgattggtaatatggtgatgcgatgaaaattcgttctgggtttgtgagcaatagctcaagcagtagctttattatcgggatcgggcttgttcgtcctggtaaagaaaaggaagttgctgatatctacggtgagaataatattgagtcattaatagatatgatcaccgatgatactcgttcgaagtggggtgttcctcaagtcgatagcgacggtacgatctcactggaagcgttcggttcccatagcgttgagatttcgtatatctgggataagctgaaagaactggggatggacgatattaaaattgttcacttcaacgagcgcggtgatgaaccagaatacgacgatgaaaccggatgctataactatgactggtatgacgacgccgacgcgttcgggcctgaactcgaaagaaagtataatttattacgtgataaccgcgaactgttcattgaaggcgatgtgaattgtggcggggattacgacggttaaccactggggtaatgcatgataacgatagtatactgggaagaagtcgaaagcgaaatgatcgatggggaactggcggaggttgacggggaatccgaaatgcttactgctactgaaacaatcgaaaacgctttcgatcgaatcaaagcgcatcaaaaagaaatggaaggtcgtgatattcagtacatgatgagtttctgggtcggaggcgaggcgttatgtcatgccgtaattgcggaaagcacctcagttgatacatgtcgtgaaaagatcgaacagtacgtgaaatctttcttgcattgatgaaaaagcccttgacttcggtcggggctttttgctatattggttctatcgaaaacaatgaggaatacattatgaaatatctactacttgcacttagtcttatgaccacaaccgcaattgcttcggaacctccaaccgattaccaatcatttaaagcgttatcaaaagaagaacaatgtacgtatcttccatcataccaaacgatgtatgattggattacgttatcttctgattacgatcaggtaaagtcaaaaatcgttagtgactacttgtataacatatcgaaaggttgtattcttaaacttcaactgcaagtggatacgatgaaacttgaaaaaatggaaagaggacaataggatgaactgcgtatatatcatcattgaaaaatttacttctcctgctggtaacgttgaacaaacaacagtctgtgctgctctgaatgaagaagaagcaaagcataaagtaaaatatctcaatgaaaatgcaattattcctttcggtttcaaaggttatactgtaaaatacgaatatactgcgatttctcttgaaactaacccttcatggctacttgatatgaaatgaggttaaaatgaatccttatacaaaatgcggggtcatgtccctgttattaaaagaagttgtgcggttctatagccctattggtaaagtgtggtgtgtatctatcgggggtagacaaatcggatggatccgccgtggagatacaatcaaaggctggcaccaatacactgcaatttctattatgggctgtgaatatggtgagtttgataacttcatgcaagcattgtcactgttcatagataacgctattcacgagatcagttcacagggttccaaagttacaaagtacatggatactctttatgtgaacgtggaaaccgatcgatattgcatcatcaaagaagcactatacgatgataatgatgaggtgtattattacatcgtatccgatcaaaaccagatgcaaagttatatctccccgtttgaattgcgatatcaaacactaatgggattcattgaattctaagagaaagccccaaccgaaaggaaggggctttttgttatgatgcggaaagctgtagtttgatttgctctacgtcatccgggtcatcaatgatgctgtaatagatggttactgttactgagttatcatcatactgtggaataacttcaacagaaagattatatactctaggctcatatgtccggatcgcagatacgatagaagttctaattgattccgctgtcagagggttcatgttctcaaacagcatatcactaatagcacaaccaaagttactatcaaatggacgtgtacccttgatcgtggttacgataccaatcaaactatttcttactgctgcggccccttttgaagccgctacgtcattattccaatctcgttgcatgttaggttctatatcgctatatagcaacctcagatttacacccatttagaccacctttaaaaattgctgtaagcctctcagagagacgatatggctatgtccacacgaacaccttaccggaatgtttgcgaccactgctggcttatccagggcggtagaaatcgatttataggttgcatagtcgattgcatccaacaccatttctttatctttgtcgctacaatcactccacatgatctgttcgccgtctatcattacgtaatcgataagatcggggatctcttcatcaccagtcttacgagggtgaacagatagcgcgattccgtcattgccgtatagcttatcgtcgaaatcttcaaccatgatttgattgcgtttaagctggaattctattctttcctgacattcttcacagttgatgaacagttgacgggtatcaatatttttactttccagaagtgccagaatgaaaagatattctctttgatacaggtaaacatcccctttgataaaatctgcattgggggtaaactctgtatgtgtcagaggacgataatcaacattatatttctcaacgtgtttatattcatgctttctcatttaacagcaccttgttttttcaagtcttctgcaagcaatgcagtataaatttgcctttccattgggctactattcatgataggttccaggttcaggccgtttttatttagcagatagttggtcttcacaaattcatccagatccccgcgactaaacaggatcttgaacagggttaacataccactaaatgatttaccgcgcatagacacatcaaccgatttcgttagcatagtaactattttttcgacatcatcaagttcgactatatcaagaatattctctttcgtttcttcggttagtgatgtccattcatagcgctgttcgttgtatattacataactgatacattcaagaaacaactcttcgcttgtattgcgtgtacgggggaagttaaaccctaatgtgatttcatcattcagcttgtattcgttttccagttgaatatcattaatcaccatgaaggcttcggagtggcccccacctttaccgcctatcacaaccttgataacgtttttaccgaacgaaccacaatacacccggctgaaaatgtattcctgttctgttttggaatacccaggataaagcagatccagcacttcatccagtatttcctgttgctctttaaggggccgaccttccatatcaatacgggtcagcattaatttaaactgatctttaactgtaaacatagggaatcgtttgatccctgatggtaatgttactcgaataatatcaaacataagatcctcaaaaggggccgtagcccctttattgtcctgtaattgcggtacgtgctgcaatggctaaaccttcctctacggattgtttgaacccttcccagccttctttatcagcctcaacaacccatgatgttttataggcaaaatcaacagtaaatgtccagatttcgttgttgttctcatagctcaattcactgttactgattttgacgggcaagcacttctgaaatacgtatgttgtatgcggtgaaccatcacgatcgtgtaagttaacctgaatagtacttgtcacttcatcaatgaaggcgtattgtcctgttacatcatcgcgaatagcggaaatccattcgttaaagattttcaggttacgggcttctgaatcggtgcggaacgtcaatgacaattccccattctcagggcgagtgaatctgatttgaggtacgccaccattataaacgtattcgtacccaatggatttaccagggaggttaactcccataatgcttaaacccatattatacatcatttcatcacggaattcagatagcagttgtccatacatgctatcaccaaacagggaagtaatcaaacgggggctaattgccccgatgattttgctaaatcctgttttgttcagcgacataatcgccttatcgacggtgtaactaaacaatttactcacaccgccagtgatagcattaatgaattcgttcgggttgtttgcgttgatagaactaatagatccatcaatcaaagtatctcgaatactaccgatcgtgttgtcaaggatacgtgatgcagggctggttgcaaatacaacgctaaacaggttgctacgctgaaaatcgcgattagccatacctgataaaaattcatctacgttgtaaaacatcatatctccttagtaatttgtatcaaaaatagaatcctgacgcatatcgatcagttccataaattgaatttcgacctcaagtgagatcggggtatttggtgattctcttaatgtatttacaatattatcaatagaacgaccaaagcgaacactggtaatacctgctggcccaaaggttgaatgaggtaaacgcaaggaatccccagactggaaatcacgaataaaccagacaggaggcgatttaataacctctacgtttgaaatgaaatcaaccacgtcattacccagactattatcaaaatctgacgctgttactgggttactggaagggctaattgcgttagcggttttagcacccagaacaccgtaatactgtttaaccaatgcagcaacctctttagcagtaccgccagaagttgtaccatatcccagaacagtaaacagatagtagattttaatcagttccagcaaatcattacggctttcgatcacgaatgtattgtaatacatctttgttcgcttgtcagaaccctggaaagcggctttagtaccaacatcaagggcttctcttcggtctgccataataccgcctgaaatggattctacagcgccccataccatgtttgaaacaacacggctcaaccctttggttaagaaactatcgtttgcatcttgatagcggtggctgtttacttcgttatcgttcaggcttcgcggtagcaggatctggcaaacaggttccatagtaccaatagaactattcaacacttgtttgtacttaacattacccgtcgcagatgatagtatttgttttgggttctgtgctgcctgacgtaatgaacgatagttgtctttactaccaacaccattaaaatcatatgcagtgaacagaaggccgttattatacagactcgaagcattataagcgttatcgatacctgctgcacgttgggccggaaattcggcggtaacgatagtttgctttaatactgattctgtgattgcggcacccccagaggggataccgcgatttttaatatttttgagagtgtttatactgtcatcaataatagaaaacttcattatatgttccttatgccagcgctacgagcggtttatgctctgtgcgttgtactgaatgagttacgttgttgttaacagttttgttgttaacctgaatgttgcttgctttatcagcatccggtttatttgctgctaacggtggctgtgcgtcgatcggggtgctggattctgtacgggctgcaatcttgttttgcaattgctcgataaggtcagagattctatccttctgtacatcgtccagattaccttcattacgacgtttttcaagctgatccaacagttcatcgttaatgtatttgatatcggctgcatccagattttcagagttagcatagttggttgctttacccaacagatcatcaccctttttctcttcaccttctggcggctgttttccttccttcctcgcttgttctaacctttttgcttcttctatacgtgcgcggttgcgtttgttttcctcatcggctaatttttgtgcttcctcttcgctgcttttagctaaatcgtattgtttctgcatttcttccgttgctttcttcatattatcaagccgttctttatcagcatctacggttttctgatttctttcttgataatcagtaggagcaactttatagatagaaccattaggaatttgagaaggagttattgttaatgcatgacgtgctgcaatagctttatcttctttttctaatgccgctttttggtcttctagttcctgtttcttgatcataagaatatcttctttagtcaattcaagaccaaatttctgtttatcacgtaaagcggtgatctgcattccgcgtccggcattggtaatgctgtctataccagttgattcacccaatgattgaataagacgaccgataccctcagtgattgccgtttgtacagtttgtcccaataacttcataggctcaacgaacaagtcacgaagtgattcgcctaagttgttcatattaaagttgttcaaaccttcttcgatctttgttacgatagcctttacgttacccagatatgtaccaaatagtttttttgaggattccccttctttcaggatatcttcgaaccatttgcgtattgtgacgcgcaacacatcgaatgtaaagattaacgaaccaataaggagcgtccatttagcaaactttgccattgcttccagagagtaaccaatgaaacggctaaggatctgcgatgtaaagcctttaatagaaaccagacttttagcaatgctatccagagttttgcttcttttgtcttcatcatcaatgatgcgttttttcttagtgtctacatacggatcaggttcttccactggttcaggaagaggcttatgcttatcagtattttcatataaatcaacaagtttgttaatagcatgaaaaatagattcggtgttttcttccagcttaccgaactgaccattttggttaacgtttactgtattgtcaacagtttttgagttatcatcggttaaggatataggacggatcgggccaacgaaatcaggtagttgttcggctaatgattcctttttatcctcttcgtattgttctttgaaccccgcgaatttgtcacggaatttttcttcgaacgatttcaacccctctttgatatcaagagtattgattgcactttcaagggtgttatcgttgatttcctttaggtcacgggcgctttcagcatcaagggaggctgttactttggtgaccgctggttgtttgttgttgtttctgttcagaaactttttcttttgttcttcgttgaaataagagttagccattatcattcaccaatgatgttaagccctttgatggttttcccctcatgaataatgtatacttcctggaggacaccacgcgatacctgatcatattcgaatcggtacaggcaattaattaattcgtctcgtttatcctcagttaattctactggcttaccgtcaacatatgcctctttgatgaggaacggaaggtgagcatttaacaggctgggtttgtcaaagactaaccgcacattgtcaaacgtaaaatcatagcaaggttcggagattttgaggtcatcaagatttagcccaatttctttaagcgtattggcataatcagcgttattgtgtgcatacatatggatcaacacaaattcaatttccgctgctgtcagttcacgcggtttgatgtcatcaatgatgaatcgcatgatcgcaactgggtcatctttcagagtcttaatctttacaaaatgacgatacgacatcttagggatctcaatggctgttccatccggaagatgaacggttttaacgttagtcttcttgatttcaagccgtgtagtcataaatttatcaagagttttatttttcattattgcctcaaattgaacctgggtcattatttactatttagtaaataggatatattaggagggatttttatggctgaaaaaatcgtcaatcgaataacatcgattaaattatatacatcatacgaaaaatacattgataacgcatatactgaattgctacccgctcttgtctcgtttagtgaaaagacgatgattaacggctcatcggaaacgctgatgcagatatacgacgcacagttaatctatcagcaacttatccagccgatcatacaggtatctttccagtataacggtacacaggaacaacattattacggattgctttactctaacgtagatactgacgataaaaaccgctctgtgctgcgtatgaacctctctccgctgcataaaacgttcagacgtaagtttgcccgttcatttagtaacaacgccgtacagacgattacagagtgtatgacggcactgtatagcaaaatgaaactacttacccccgaagttgacggcggtaacatacgtatccctcctggatgtctaaatggtacatatcaggatatattcgattatatcagggacaacgggcaaagtgtagtttcttctgatttctgttatctgtgggaagatggttccggtattttccttaaaagttcaactgacattctggcccagacaccgatcccagcatacaaatttaacgttgataacgtgtttgttggcgatactgtcatattcacagaagcccagtacattacccataaggataacacaacgctgtttaaagacgccagtttctttagtctgtcattgactgataaaaagatgtacggtgatatactggctgatacagacacagagaatacatggatcttcacaaaccgtaatgcaatctatgataccaactttcagaacccagattcagaaggtaaacctttccaggcgtctaaaatgcaattgttatccagctatgaacgccggatccgattcgatataaagcagggtcgtttagatgttaaggtagggacaatcattgaggtatttggggaagagtatgcaggaaaatatctgatcgttgaatgtgttcgagacgtatcaaaagatttccacctgcaaacacttgaatgtatacaggtgggggaacctaccagcgccgctactacgaacacaactagcagtacttaatcctcaaacaatccgaggtggagatcgaaaacattgttattgacctttttacgggcctttatgatgttttcgtaatgttcgcgtggcaactcaaccaaaaaacactgtctgtcttctggagcattctcaacttgtgcttccagaagcggatagttcttaggatcatcataatcaatgttgttatcgagatccagaataacacaacgccaaatttccggctctgctgatgttttaacagtttgaaccaatgacgcgtttttcaatcccaaacgatgcgaaagaatttcatgggcgaattcagggtcatcataacggatctcttcaccattccaacgaataaggcgaacggttgcactcaatttaaatttgctcatatttcattttccttgtcatcaattcacgtaatttcttagttggcgctggagggtttttaatgatttcctggatctgatcccatgtttcgggggatacttgttccttttccatcacaactatatttggattatcgcaacacttaccaacaagaacagaacgcccacaattaaggcaaatcgtatcagggcattttccaagtttatcagggtcgatagattcaaggaatcttcttgctaccgataaccgctctttaacttctattgggtcatattctttatttttcatgctaacaattgactcccctcataattggtaggaacccgacaggcaaaaaacaattgttggtgttcccagtttttacgcgcctgttctggagtatcaccccatgcagcatcaaacccagttttcgcacagcaccagcgaagattcgggtcttcgctgatagtttcgaatatttcgagtttcttactcatttcaggtcaccgataatttccatcgctgcttcgatgttttcaacaccataaaaggtattcccacttacttcaaggagtttgataccatgaagataaaccccaaccagcgcaccgatagcatcgtggatagcgtagttgccgttttgaagttgatttgcagtgtgcataactttcatgatgtttctcctttcgtttcgatgtaggtaatgtaccattacattacccagaacacaagcattatttttcgatttcgtagcactcttcaacttcgatgtttaccagaggtacttcgatatcccatgaatccgcttgtgcatcgtatacggctttgtcttcgtcgttcagaggcagacaagtaacccaaccgtcagtaacgcgcatcacgcgcattttagaaaggctttcgagtgcgtccgctggcagtttttcaccaccgttacccagttgtgccaaacggtcttcatttaccagaacgattactttgccttcgagttctttagtgatttgcatgggatgttccttttgtctgtttcgtttcgatgtgtgcaatatacaaaaaagccccctgcattgcaagaggcttctttaacaaaaagtgctattaaacggcttctgttttcacttctaaaccaagtttagcaagcgcttcaactgccatgaaatgattttcaaacggaacttcaacagaaattcgaattgttggcggtgttggatcagtcagatattttgtcatttgacgatctttctggtttttgcaaaggatatccgccagcgcttctaccgcgtcagaattgaaatcgtatgcataatcaagtcgggattgcacataacgcatgttgcgttgaacataatccggatattcttcaacgatcggggttgcaacagccgcttcgctcatgcattcaaagttaggttttcggaaaataccaacacacttatcatcggattcgttatatacgaaaataaatgcgttgctgttcatgatatgaacgcactgatacaccggatgtcggtaaatcactttcagtactttcttcacagaaggtttgataatgtgattggtttcgaagcgggaaccttcggttactgtcagcagagattttacttcgtcgatatgtttaccggacaggtttgccataagggttttgtgtttctgataactactagtcataatatattctctcagtgatttacgtttcgatatgcaatataacaaagcccccgaccggagtcaagggctttttattaaaatagatctgcaaagacaatatgaatatcgtcgggttcggtcttatcgcgtcttatcttcttgataataggaaggaagaaactgtattccggttcccctttcttacgcgttttcgacttctggaggccgtcaacttccatttctacaatggccccaatgtattcatctttatgcgccatgatgtattcgcgatccagttcaccacgttcatctaatggaatgtatacacgggtaataccatcatcatcgtaacgataatcggtatcagttaacccagatccggtattcgttcgagccattccggataaatcttccaccacaaacccgccgaccttatggtcttctttagtgtgcgcgtagatatcaatgatccgtagttcaatcggggttttgtttttcagcttaacctgatcggctactcgcgaatctttccatttgaagtttctgtttttgagaatagaaccttctttaccatcattgcggtaattgttatagtcctgcttcgcttctgcaatgttattaaccagcttagactgaatcaaacgaacagaaggcagagaaagatccaggaggatatcacgcaacaggctaaaccgctcatcataagtctgaacactttcagcttcgccgtaatacacctcatatggaataatatcccaaacaacataaacaatgtttcgctgttcttcttcggtgatcgtccctttcagagatttgtttacgatcccgttcccttcttcgcgttttgcttcggcctgttcttcttctggggtcgatactttgcgaacttcttccgcaaataacgcaatgtcgttatcatcatcgtccatgaaagcagataaagaaaaaggcatgtctgtttcaggttcaggtaatgttggtacggttccggaaggaacataaatcaattctccatccagaactacatcatatcccagataatcgcgaatctttttcagatcgatatcaagctgagttaacccttcgtactcgttacccgctctcgataccttacggtttaatgcttccagcaaatcagccatgcaacgcgcaccatcggctttaagctgcgagtaagcagggaaaatgatgcgacgtaaagccttttcactaaacggcgtagcgaggcattgaggctgttcaggaatgagtttcttccataccctgtttggtaaggttgtgccagcaccacattccagatcgcggttaatgatacggcgtagcacttcacgatcgttaatgttcactgatgatacaatatccagtaaacgatcacgcgctgcattgcctgtatatttccggcttgctaaatcttccagtaatgctttgattgcatcggaaagcggtgttgtacctggtttcccttctaccagaggaaattgacgcacataaaacataatctgttttgtatacgtaatgcggaaaacttctttcaataattcattatcggcattacgttttaaaattgcttctttctctttggttttcagagtagacgcaagttcattaaggattgacaagatcatttagtttctcttcaatttcaaaccacgattttactaactggtgaggtgcatttgtttcttcacgttcaccacgtaacatatggaataacggcaactgactaatgacgttatgacattcgtttaagtttatcgcgagatcatcaacaaagcaaaccagacgattaccatactttgcttttgcttccaggtaacgatgagtttttgtttcaccgtggcccacgaccatcacctctttaaacgcagacgggaaaagagtattcaggttagcaattcggttaaggcttgccgttggtgttgttcccagagcggtaacagcaacgaaatcatactgcgttttcagacggttgatcacaatcaatgcatcatcatacgcattcagataacgaatgaaagaactgttattgtattcttccataaggattttagccaactgctgatcacatccgaagatttcggtcatatcacgaaatttttcatctgtaaccatttctaatgcaatatcagtaggcatgttgtgcttagacaaaaagaacgggaggccgctttgccattttacggcgatcccgtcaatatcggtaagaataacaggtttcaagatataacctcataacgatcaaagaaaagggtacttttgaatgcattcaattcacccaggaattgttcacgctcaaatgtccgataatattcaaattcgatgcacaacatatcatcatttgttacaccaatgccaacgacatcttgatgatatttctttgcctgttgaagcacgaacggatcgagatccgaacaatcgaaataaactacgtaactcatatcaacccttatacatataaacagcatctaccccagcatcaaaatcgactttatcaaagacaacgccgtttaatgcacattccttaacgtaggattcaataacaaccatgttatttgcgccgatggtaacataatacacacctgctttatagataacactctgaatcaacgttgaacgtaatgcatgttgcgcatacagtaacgctaatggattaatcgcgcctttgaacagaaacacgcattctactctttctttttcactcataacagatctctcaatcgggttaagttgcgtacaaactctctttcagtcagtacagtttcgtttattttattctttcccattgaatgtgtcaaggtactttttccggttgctgccagcgcacggcgaaacccttcattaaggaataacgcattatatgcgttttcaatcaggatttgatacgcctcagaggaacgatgaatagggatacctttccagtatagggtctggttagtccaccattttttctttttgcctttgaactttgcagccttacctaccagagtacatacatgggcttgcatatcgggattactgaatttaaggctttgtaaaaagccctccattgatgcacattctaccccgtcaaacgtgaatggatgaggggcgaagttgctcaacgcgcatgatgggtattggctacccgaaccaatgtccataatgaacccccgccgaaaagattaaatcatacaaaccgcgaccgatgataacaccaacaataattgatatccacgttttccaattatccacgatcttcaccttctttcttcccttcctggcgagcgcgtttgcgtcccgcgcgtactaaagaatcatagtaaggacgtttgcgatcgatgttttctgtacgatacgctttaccaaaatgactcgttttgaatccgtagtatttcacacttccacctcatggggttattgtgcaaaccacgggccggatcataacgatcataagttgtttcgtactctgatttaatggatacgtcacaacgagtgttccattgttccagagcgcttttaatttctttcactgagtcggtgaaaaattttacaatactcgccatacactaccaccttcataaaatgcatttagtttatgtaacatttctacacgggctgattcttttgcggggctgcaagataatgtcagaaccaacccaacaggacaatcaaaagcagtatcaatcgttactctttccagacgttgcccgtgatcacgaatcatcttcaaaaaggtatcagataactcagtattttcgtattccactttatatatgaatcgtgccatagttaaccccttgcacatgaaagataagaacgcttcttgaacactttaacttcgtggcccctaccgcttgcagcggtgttaagagtttcggcgtgacgcgcaccaagtaccagagttttaaccggagtaaccggagcagcgataacgataacagcggcccaacgagcaccaacagctttatcagtacccatatcgatagcagcagaagtatttttaccagccgccagaacgtaagcacgtgcttcacgacgagttttgaagaaaaccagttcattcatgttgtaagagcgtttcataatgtcatcctcataaaagtgttttcttgtctacgggattaactataagtgaatgtgagaaaggagtcaacaactttttacaccaaaaacgaaaaaagccgctacctttcggcaacggcttgatttttaatatttttcgtcaggctgaaacaccgcacgacacgcccacatagaggcttctttcagtcggtctttagccagttggatttgatggatacgttcaagcacctcatctaattcttcctctatcagcgaatcaatatctgaatttgatagtcgctgttcgatatcttccaggattgcacctaatgcattttcagcatctttgatacgatttacggtttctacttttttatcagtatggggtttataacccttgatatcagcaattgccattatagactctctgtaaaggttcgggcgataacgtcgcgttgctgttcaggggtcagtgagttaaaacgcactgcataaccagaaacacggatcgttaactgtgggtatttttcaggatgttcaaccgcatccaggagagtttcacggcgcaacacgtttacgtttaaatgttgtccaccttccaccttaacagttggctgatattcgatctcaatctctcgctttgcaaacggagtaacgcgagctttaccgatcacagaatccatagttaatgtttttgatactacgatccgaacgtcgttaccttcttccaggtagatcgtaccagtatgcaaaccttctaaaatttgaaatgctttcattgtattacctttacttgattacataatacctgaacgggttgaaatgaaacgccagcattgcacgatccaggttaactgggtcgctaacttcttgtttcagtttccatccagcataaacgcgcaaacagaattgcactttgtggatccgtagccacggtttgtaaacgtacaaaccccatgctgattcgttccacatgagcagatacccatgatttacagggttcggcccaccttctgtttttgggttgcctttccagttgaatttgcttgtcgcttcacgtcctaaaacgtgatatgcgaagttataagccttgtttctccacaaccagccaacacgctgcatgtataccccaaaatcccccagatgatagcgtatagacgcccaacggcggatatgtccaccatcaccatcaataggattatcgaaggtttccatccaccggaagcctttaggaagatgccctgttttctcgttgtagaacggtacaacaaacggggcaaacagaattgctaatactccagtaataatgtcaagagggacgagtacgatccaacttgcatactttaaaaagcgcatagacaccccaaaaataaggctatccgaagatagccatttgattatttgtttgtgttgatgtatacaaatgattcatcaaattcactgctaaccgcttcatttgtaaacggaatttcaggatttttgaaaccaccgctgataagatactggataaagaataccgaagtatcaagagaaatcaattggtgattgctaggagatatatttgttctacgaacgagattgacaatctcccaatcaaagaatcgttcgctatactctttcttgctatttacttgcggcgatgcaaagaacccttgtttagaatatgcctcaagcgctttatgaagttcagaatcaaaatcatcgaactcttttgcaaaaagttccatcaattttttattgcgattcgttggattgctattttctccgatgatttttctaattgccggagacatttcaaacagtttttgtaaatttttcatgttatctctttaaatttcgtatgcagagtcaatacaagattcgtaaagctgttctggcgaattctcaatgagaggcgttgttttaccaaaaatatccagatcgtaaggatcatcatccacataacattcattgaatttgaagttttttcggtagtccccatcgggcaatccatctttccattcattaaatgtcatgccataacgttctttgaattttgcgggagacatatcaacaaaaatctgtgtatattcgaccgcgttatggtatttcacagtttcacgaaatttcatataaacctcattaaaattagtgggctgggagtttctttacttcaccccgcattccggggaacctattaccggataccaacagagccttctccgtgagaaaggttgcatattccgaaccatttaacggcattgcgctacgcaccctaatttggtggcaagggtaggatttgcacctacaaccaacagaatcagattctgttcctcccgcttctctaagtgccttgccttgtttggtggcccctcccgtgacttgaaccgggaacctaaccattatgagtgattagctctacctattgagctaaggggccgatatttttagaactgtttgcggtagatttcgcgaacagccggatcaacagctttggcgtatttgcatacatcctcgaactgtacgatgtattccattacttccgaagcacgggaatttagttttccctggtgagcatcaatgatcattgaagtcattacatcgatgcgggtcggtgcttcgaggatgtcgcctttgtcgaaaagttttttagattttgcgacggtatcggcgatgattgcttgaatttgtttagccatgttggatctcttattcgtaaattgcttgaatcgctttatagtgtgcggttacatatttaaccggatacttgcgagcttcttcttttgttgcctttcctgcaatcagttcaggatccggcacgtttgccatttgtgcatgaggaagcggtacgcgcttacccataagcagggttttatattcttccggtacatccggcccacatgataacactgtgccgtagatcggttcctcgccgtgttgacgaacaccagtcacaataccagaaggtgatacaatttcagttccagccgctttagcgttggtttcaatcaaaacatattcaaaggatgcttttacactcagttcagacatacatttactcatttgttatttgatccggaaatgtttattcatttcttcggggtcaagttgtactacttcggcaccgtattgctgtagacgccatatccactcgatgccaccacgatcgtatttatgtagatatactacacgcttaatcatacctgttgcaacacaaaattcgatatttttcgcacattgtgagcaaggggaatgagttgtatacaaagttgcgtctttgatttgttcatgagacgccgccagcataataacgcgcatttctgcgtgtacttcgttgcgatctgaccattgtgaatgttcagggcgcttttcttcactcagtttcccgttatcatctaataagtgattgcactgatctgtacaacgatgactaggatcaaccgtattatttgcgcctacaaacacacgcccgttaccatttctcaatgcagcaccgacattaacagagacacattgagagaacttagaagcgcttattgctctaagcataaacataatatcatcaatcttcatgatacaccacgtgataaagaactttccagtaaagttgaatctttccatcatctaacactcgatgatgagcagaaacagaactgattactactttttctggactcggtcgaaaacaacttgtaaattttcgaacaagacaagcaatgaaagtatttgggttgtcgatttcgtcaatgatagtattaacagttacttcaccgaaatgacaagggatatcatatgcttttaatgcttccaggagcaccatactcatagagccaggatgatcaagcatctttcatcacctttagtagctgtttgataaaatcaggagtcgcttcaacgatatattctgaaccgttgattgtagtaacgcgaacttctgtctgatttttgttgatatcatattctgcaatcggacttgttactacatcaatatcagttcctttgatgtatccgaaaacaccgccataataacgaggatccgggtatacagattcgtccgtaattaccgctctatcaataatttttacgttcataatacagccgcccatgtaacgtagccagtaataggatttaacaccagcccgaaagattgggtgctgttagtatccacgtcatgaatatacacaatataggagtactgagaaaccggagtggcgctaacttcaaacccgcccggagctttaccctgttcctgaattttgttagcaattttttggcacaacaaacgaactttttggttaaaatcgcccagattttctacgcgaatgcgatcgccaagttcaaccatgatgtgtttatcttcacgaataacgttcataatataatcctcttttgtgtgggtactttaacatacccacattatatgtcaatcagaaatcaccataatcgacttgtaagcacggaatcccgtttgctcgccacattccgaccggagtgtctctatcgtccactgcaataacaggataatacttatctaaaatcttgtcaaacaaaatttcttcttttacttcaaaatctgtcctggtatcaccttcttgacgcataaaaatttcatccggttcaacgccataactcaacaggctaacccatgtatcatgtgcgcattgcggattaccttcacgcccagacacaacaacacacttataccctgcatttttgtacaggtgaaacagttgctggatcgggatatttggcggatcattgatcactttggtaaagtcatacgggctacgttgtcccactttggttagagtaccatcgacatcaaagatcacacacttctgattgtggggattaacaatttccattgctggtacgaacccacggatcttacgatactggttaaacatttcccaaagacgcgaaacgggtaatgcatcacgaccgcgtttgtggttacggcgaagcagttcaacaatagacacatcaaaatattcaatatgaaaatcagctttgtgttccaacgcaatttcacgccagtgatttttatcactttctttcagatgtgtgttgtgtatgatcacgtttttaccatctttcagagtggagataacaacgtgatcctgcatttctgcaatcatgtcttctttcgctttggtgtatttgtatccgccagcacctttacccgcattatacaaagagctacgcagatcatcgcgagagatcgtaacagtattacccaattcacgggctttctcatgcgcccaggtagtttttccactacccggaacgccaatagtcataaacagattcatttcactatctcatattcaattagttcttgactggcttcggtatgcagattgactgcaatcccccaatcgctatcaatccatagttcatttttggattctacagcatcatacgcctttccgaccgtcaagtcatcaaagaatgtatcaattattttgacttgcatttttcggggtatcccacggtgcatagaatgttatccgtctggtctttctgacgcttaacgtcattcatccagctacggaagattaacgaatctgggtatgaaagggcaacgtatggattaccatcataaggcatgaccagatatttcttcccgtcgatttcccttacttctgcaaccactttccatttcacattgaccggattcaccttagcgggtagcgtaggcaaaatcttttctggtggcttctcagcacacccgaccaacagaacgcccagaacgagcgctagtgtagcgattttcatttttcgtaatccttcatatactcttcaaaggacttgttgatcttgatttcgatcagtcctggttttttgaacaacagatctttacgtccggcatctttcactaactgctgatccttgcctttctgttcgacgtatatcactgtattactgttgtttgtctcttttactttcttgatatcagcttgtaacgctttgatatccttagacaattgcctgttttctattttggtatcaactgcaatgtaaaaaagggctattagggagcaagcaacaataataggccatatccacgattttatattaatcatacccaagatgcttttgatattcattcaaagtttcctcatatgcgatagacgcctgttcttctgtatcataatatcctatatgtttcgttttaccattaatccgtatttgtgctctatattttccacgagaagaacgatagtcaaccccttttgatgtggtagttttagattttctggttttgtttttcttcaatatattatgaacgggatcggattcttgaagattatcaatacaatcaccaaaatcaagaccatttttatgatcaactatgattggtaagtaaccatgaacatagtaaaatattattctatgcctcatgtaatttttcccagcatactttattttcgtataagggtattcttcacaaacaatagaacccgcttcttttcctctcttacttttatgatatgctttatcattccagtaaatttttccagtttcggggaaaacatcaacgaaagaaagcagggaatcaatccctgctttttcttgttctatcgttcggctatatgcgccaaatgatttcacttgtactctccaggaatgaactggtcgtaatttttaaccatcatttcaatgatgcggtcgaccagtttttgcggatcggtttcttcgaagtacttcataagaggcccgaagatgatccgaccgtcgtttgacaaatccgcgcttagactgatagcaaaatctttacgcgatttccctttattatcttcaatagctttgaatgcttttgcactcaaacgattgagactatcaaggaaaagtttttcgaaatcgtcaatctttttcagagagaccagatccgaactgaatagctgtttcaggtcatcgaccgtattctcaacaatatttaggaaaagatccttattgttggtgatgctatcttttgtgcgatgcaggttgacataccagtttgttttgatttttacaaaccctttcgttgtcagaacaacatagccttcgaatccttcattctgatatgcttcttttgcgaatgcatccagatccagtacttcgatattctcacgcttaaccagatacgcacgtaacagcgcgtcagcaaagagttcatcataagggatgtattcacccgtgatgttgtgacgaacgttcaggatacgcagatcaggagaatcataaccaacgacaatacggtttttcggggaaacgtattccatgttcaccgtatagttttctttagcgatctcagttaagcgggtcagcaattcacgatttgccattaacacgctgtgcgcatccatagcttgttctgatttaaccgaacctttagacttgaccgccagaaatccaccgtcaaggaaagttgagatcaaggaaccatcttctttaatcatcacgtctaaaacttcgcctaattcaataggagactcgttaagcgcttcccatgcctttacctcggcatagttaaaaaacttctccatagggcggctgatgattgatacgggggtatctccatccatttcaaacatgataccgcgacattccagagcaccaggctttagccagtctgtatatgaggccatgcgatagttaaagattcgaacaggtgtacccatcacggttacttgatcaacgaagaaaaatgtttcggattcaccacacaactgcatgagttgtttgtaaagggtattgataattttagtttgtgcctttgtcatagtgctgtttattccattcagggttgtattttcgtatcatgttgatttcataatcatgatatgtattttcatcgtgagtagtcacgataagtttcacagtttttcgttttttgatagccatttccaatcgacatgtttttaagatgttgctggggttggcttctctccaatactttgcattgcgatatgtgtctaaacgcttccacatatccctacacttaccaacatatactatttcatcgttaattgcaataaaataaacacaatgcctaagttcaccacacttaacaaaacttcgatcgatgcgaccacatttatcaagggttaagttgaattcagatttcatacattatatatccaaaaagtcaagtgatcttttcttaccacacaaaacattaaccacatgcgcgatgtaatcaccgtgacagggaagaggcgcacaggtacaaccaagcctctttccatcaagttctttcaattcttcaatcgtgatcgccccagtacgaacctgattctggaaccaggggataaacgctaaaatgttttctcccctggttcctgtgtgataagggttgccgaacttcgtacctctttgaatatcgacatcccaatcagttttgtacttgtttactacccgacaatcacgcgtatttgctggcccattttgcatacgcttcatcactgatttcagtattcaggtttccgacgaggtaagaacttacttcaacctcttgcggggcaacctgtacgttatcacttttgagccatttattcatccacggatacgggttagggatcggggtgaatggtgaatcaagccctaccgctcgcatacgctgatctgtaaggtgttcaatataagcgatagtgattttcagcgatacaccttctacatcaccaacagagaataaatgttcagcccattctttttcctgttcatatacttccaggaagatagccgttgcttcttttttcagcctacgggagatttcaaccatttctggatcatctttacccatttgccacaaacggattttactctgagtacctttctgatgcaatgcttcatcacgcgcaatcaggcgcataattttcgcgttgccttccatcttgccttgttcagcaaagttaaaggtgaaactaaacgacacatagaaacggatcgcttccagagcgttcacagcgtgcatacacaggtacagagcttctttgcacttagtggcctgtttagtgtattgctcgttataatacacgacagccggatcatttggtttatagccgctaacctgttcctgtagcatcatgatggttttcagcttatgacattcatcaatcagagtatcataataccgtgtcattgatgcagaacgtttcataatcgcttcattgcgaaggatttggtcgaactgtacagaaggatcaatgtgcaagttacgttgaatatgcgtgtaactacggctgtggatggtttcactaaacgcccacgtttcgatccaggtttccatgctcacatcggatgcaattggcaaaaatgcgaggttaggcccacgtccctgaatggtatctaacagggtttgatactgtaggttagaatcgaaaatgattttttcatgttcaggaagttttgcatactgcatacggtcagtagacagatcgacttcttccggacgccagaagaaagaaagctgtttttgcgtcaggctttcgaaaactttgtgtttctgcgattcataacgtgcaacaccagtatcttcaccaaaaaacataggttgttctaagtggttatgatctgggtttgtattcattactgttaacatgtctttacctttaaaaagcccccgaaggggcattaatcaaatcttacaacccgcgcaatcttctgcggcttcttcttcatcaccagcaccatcacgcgtattatgatagtacagagttttaacaccgtagtagttagcatacagcagatcatcaatgatatcttctgttttaactttcccgtcttcatagtttgccgggtcatagttggtgtttgcagaaatagactgatcgacaaacttctgcataactgctacatgagacagataccctttgttaccgcgtttagccatatcccagagcagatcatagaaatcaatctggttattctggttaggcacaacctggttatagtgtccttctttcgaagatttgatactcactaaaccgcgcggaggttcgatcccgttggtagagttactaacctgtgaactactttcacaaggcattaaagcagaaagagtagagttgcgcaagccgtatttcttaatctgactacgtaaccattcccaatcgcaattataaacaggtgctaccagttcatcaacagttttgcaataccaatcgataggcagtaatccgcgagcgtatttggtatcgttgtacaatccacacgcaccacgttctttcgccagttccatagaagcaacgagaaggttaaactgaaacgcttccattaactcatgaactttgtcggtatacgcttctgagtagtcgcaatagttgcttgctaaccatgatgcatagttggtgataccaacacccagagaacgacgctgtttagctttcagagcggcttttacaggatagttctggtaatccagcaggttatcaagcgcacgtactgcaatacgcgtgagtttcgggaattcgctgatatcagcgttatccagaacgatagccattagcgtacacaatccgatttcaccagccattttatcatcgtcatccagcggcgacgttgggatcgcaatctcacaacacaggttagacatacgaacaggaaccgtaaaactaccctgttggttgacgtgatgagtgttgaaaatgtatttgcgtcctgtctgtgcgcgttcctgtgctaaaagttggaacaggtcaaccgctttgatgcgtttcttacgaacagttggatctttttccaggctttcatacagttcttcaaatgcagtctgatcagcttcatagaacagatcatacagacgatcgttagcaacatccggactaaacagcgtaatgtaatcacgattcattaagcgtttatacatcaactggttaagctgtacaccataatcaagatgacgaacgcggttttcttctacgcctttgttgttcttcaacaccagaaggttttcaacttccagatgccagaaaggataatacagtgttgcagcaccaccacgaacgccaccctgtgaacaggatttaacagcggtttgaatatgtttccagaaaggaatcacaccagtatgaacagcttcaccaccacggattttagaacccattgcgcgaatatgtcccgcgttaaccccaataccagcacgttgtgaaatatacttcacgatcgcagaggttacagcgttaagagaaccaagagaatcacccgattcaattactacacaactggagaactggcgcgtaggagtacgtacacccgccataattggagtcggtagagacagtttgcgatcggaaattgcgttataaaaatcaacgatatgcgtaacctgtgctaacccagtttcttcctgatgcagacacatcgcaataagcataaacgcatactgaggggtttcaaagatttcgccagtatcgcgatcctgaaccagatatttcccgattaactgttgggaaccagcatacgaaaattcaaaatccttatcatgatcaattgcacgttcgaaaacttgaatatcttgcttgctgtatttttccaggatctctttatcgtatttccccgcttcaaccattttaacgatgtgatcgtagaacgggataggatcgaactgaccgtaaacgtctttacgcaatgcaaacatttcaagattcgatgctacgtattgccaatccggttctttaacagaaatatgatctgctgcatacttgatagcgatacgttgaatttgtttggtagtcataccatcgcggatcagttctaatacattttcaaggaatgcacgaacatcgatattatgaccatcacaggcccacttgagcactttgtatattttttctttgtcaaacggctggcgtacaccagaggattttactactactttaatgtcattcattctcttaccttgttaagaaaggggccgaagccccatttttcatactgccatttcagcttttagagagccgtgattatgatacccttctaaggttatcgagtcaaagaattcttgatctaaatcaagtaagctatttaccttcggcatttttagaatcggtaatggcattggtgaacggttaggctgtaaaagttcttttgcttgttcaaccgcatttttatagatatggacatcaccaccagtccaaaccagatcgcccacttcgtacccgcaaatatcagcgataatatgcgtcaggagagcataggaggcgatattgaacggcaaccctaagaagacatcaactgaacgctgataccactgtagagacagtttaccgttgattacaacgaactgaaagaaacagtgacacggacgcaatgccatatcatcaagatcaacggggttccatgccgaaacgatgatcccacgatcgtctggggttgatttcagttgttcaatgacttttgctatctggtcaacaccactaccgccataataactatcatcatccccataaagagaaccaaacgaacgccattgatgaccgtagattggccccagataaccagaatcatatcctaaatcaatagcttgtttttcatagttatcatcccagattgtgcgcttatcgctattttcaccccaggtcatccggcgaagttcttcaacgttggttgaaccggacaggaaccattgcaattcatgcttgcacggtttgaagaatagttttttacaggtagttgcggggaaacctctgtttagatcccatcgggcttgtgcgccgaaaatacgaatagtacctacaccagtgcgatcagttgattcaacaccgttatcaagtacaagtttaataatatccagatattgtttcattttatacctttttatatcgatcgactatgattttttcaatgcgttcatgttctttgatgtactgagtttcgaaatcagaaaattcatattttaacaatgcatcacccaattcagaagcagtaaacgaaacatcgcgtttaaatgcgggggcattatatacatcatgtccgtaaatgtgtgtcaaaactacttcatcaaccattttattattgattgaatctaaaagcaaccccttaccaccaatgacacatacatttttatctgggtgtgttgcttgcattgtaccaatagcagcagacaacccgccaccgtggatcacgtaatcagcaacctcgccttttttggttttcaaaaagctaccggaaccagacagaacacaatggatcctaccaggtagtttacccggaagagaggtaaacgtatttgcacccatgatcaaaacgctatcggcggtttcttctttgaagttctgtaaatcttctttacagtggccccacggcaagccttgctgatatccaaaagcgaaatcatcgtggtagatatcatgccccagcgcaaacaccgcttttactatgctcatattgcgatccacattttgttgtcttcaacagttacaatatagcctaatgcttcaatcataactttcagtttttctttgtacttctcatcatatccgcgaatcttctcgaattcaacagagaaaatactacacccctgatattttgcattgatcacgcgagattcaatatcaaaaatcatgatatccagaggacaccaatcaacagagtgaagtttttcgcgggttagtagtgttgtgttcttagggagtttcattccgtttcctgttcattcagccatgattcgatacgagatagttcttcatctcgcggggtaaatccatatgatgcgtcgatcatcccaatctgatcccaaacatcaatttccaggatctcagtcactggaggattttgtgagatatggtcacgacatacagcaagagcggtattgatggattcggtgacagtcagagtgtcaccctgtacagatacttgaataatcattcagaactccatgcatttttcaaagtaaatctttgttgggaattaataatcgtagcgcgaataacagcaagtttcatttcttcaaatttatttcgcgtcatatacaaaccaatcaaaggaaaatagagcctttcccattcgtaagtgtcgcttacttctttaacagcattgattaaaatctcagccatttgaaaatcggtaggaggaacccaaccaagattaatataaatccgtttttgtgtaccttctttcagattttccaaacgtaaccatgttggacaactcataatattttcctcaaataaaaagggaactgcgttaacagttcccattatagttcatttgattagtaagtcaagcgccacaattgaattgctgcatcaacttccttcttgatatcttccggagtgtctttgcgctgtgctttgactaacatagtcatcattttacgaatagtgttgttcatattcgctttctcacgtgctgcatgaacagcctgtgatttttccacttccggcgtatctttcttagccgcctgtggtttggtaggctgtgcgccgatttcgtctttctgtttcggtgctttttgctctgcttccttcttcacatgaggtgcggagaatttacccgccttgaagttagaattcatttgatctaaagcgctcttaacagtgttccagtcagagatcccacgtaaagatttcagagtatcagtgagtaggctaatgcttgcgcctttggtatcttctgcgatatcgattcctttcaaccactcaatgtgtttctgaccagagtacatgaaatcaaagctactgaatgagtagtatgctttacggtttacaacaatacgcttgaagttgatagtaacaccagcgccgttatcaaattcaacataaccgctggtaggcattacacgagcaccaatatcttttagtgctgcgaagtattcctctttaccgatacgattaacagtgcgttttggcttctcttctggcttcggcgcggcttcctgagcagctacacgtttaacaaaagatgctgaacgatgtcccgctgcaaactctgcgttcatcttatcgatcgcgttcacaacgccttgaacactcggtttcagtttctgcaactctttgaacgtatcaacgatcatatccaggcaagcgccgtcctcgtcttctaacatagttccgcgaagttgtgcagccggacgatacttagatacagcaggatcatacaccgcgctaaacacatacgcacctttacgcatcattacatgacgatagaaacgaactttcagtgtaccaacttcaacaaagatatcgtttccgctaatgtcagcgcctaacagcttacggaatgatgcaaggtaatcagcacgtttgtatttgatatttttctgtacagggctgaaaatgctttccagttttttagacgggaacaggctttccggagtgatcttatctgggtttttgccccattgataatcacggcttgccattttatgttttttagttccaaccagtacaaaggtactaacagaaacgttacccagtgcagatgaatccggagcggctaacccttgtccattcggaggggtgcagttgaaaccgaaatcaaagtaagcatcaccagaagtgaaacggaacgaagcataaacaccgtgactaccttttgttacttcctgtttgaaagtggtaggcaatccagtgtatttggtgaagtattccgcaaattcctgtgcgttaaatttggtgctgaaatagtttttcgccactacaaagtaagcatcaactttttcttcccattctttcttttgacgtgcataacgtgcgcgaacatcaccagcagtctcagaacgtgcgccactaggcccagtttttgtaactacgtcgtaagcctggttaattttctgcattaattcattgctaccaccacggtcggggtgattgcgtaaggatgcacgtttgaagagtctggacatttcagcgctggtttcgctaccagttgcgcccaaaactttcagtgcttcctgataagtcattttggattcagtgatcatttattgttcctcaaataaaaacaaagcccacgtttcgttacatgggctactttactgtatttatggatttcggtcaatagattttttcgaggaaccaaacagaacttttgttgttcttgattcgcgtcaactctatagggttatctttgaatgcttcctcaacatctttcatagtaactatatgtttttcttcaagaaaattgttgtggagataaaaccgctctatttccagagcggtttctaattcaaattctctttctaacattatgcacctcgatcattgatagtacactttgtgaaccgtccaactttctgcatggtgatatgtcgatcgaaatcttgcggatccagatcctgatgactgataatgatagtgttgccttcgatactatcaagtaaagttttgattgcatatgaaccttctcggtcaagtggcccgtcaaaaacttcatccaggatcagaagggataaatcaacaccagaaattttactggttacatcgcgccaggtgaacaataaagcaaggttaatacgtgctctttcgccttgactgaacgatgcgtaactaaaatcattacgacccagcgatttaatcgattcgttaaattcgtcatccagagtgaactgataatcagcacccaacagatccagatagtacgcaatctgtttattgaagtaaggaatataacgtttaacgatgctcgctttaacgccggaatctttcagcagatccgtaacaatacctctgaaatatttttccttgacaaatccagaacgtttggaatcaagttccttttcatcttcacggagtttttcaactggggattcgtcgatcaccacgtcttcctgtgctttatccatgacagcccgaacacgtttagccgctgcaacttcattttgaagtgtaccgcgtagtgattcgtatttggatttcagcccatttagtgtacgttgttgtgttagtaaatcatccatgattttctgtagctgatcttgtttgttcttaatcagcgtaagtttctgagtaccgtttttaatattctcggcaatctcttccatgcgttcaggagtggggctaattggctgtttacaggccggacattcaccacccttgcgatacatcacctcaagacgctgcaactgttctacgttcattgagaggcgtgtatagccatcacgcagtttttgaatatttgctgtttggtcttcgccattgatcacacattctgcgatctggctttgtagttcgaccaattgtgctttgatttgttttgctgtttctacgtgggaatcgtagatatcctggtaacgcgccgtattctgatttgcttttgcccgttgttcgtcaatgaacttttgatgtgttgcgatctgctgttgtacgtgtccaatctgcattgaaagcgtatccagttcacggttaacaccacggatgtatgatttgttcagtttgtccatttcactgatgatagacaaagacaacaaatcttcaaccagtttacggcgatctgctgttttcagttccatgaaaggtacataaccagcagtacccagaacgataacctgtttaaagcccaccaggttaatattcaacattgattcaagctgtgactgataatcaccagcggctgaatcttccggcagtttttcgccattcttccagatctcaaatactttcggcttttgtccacggatgattttatattcatcattaccgtattcgatcaacagttcaaccagacattttttcttgttgatactgttcaccagttgtccgactttcagatcgcgaaatgacttaccaaagagagcatatgtaagcgcttcgatcatggtggatttaccaccgccgtttttacccgtaatgagggttttctttgctgaatcaaaatcaatgacgatcggtacgttaccaaccgacaagatattttgataagtcaatgttttaaatttgagtttcatcaattatcctttgggatatatcactaatcatgtttgtaatcgtgctatcaaagcagtatatcacggaatcttcatccatgctattcaggacagtaaatgtccaaacctttgtttcgtgatagttgtctttaatcagagtgaaccccaatgacacatactcattataggaatcctgctgtactgcaacaatcacatcaaatccaaacattttataaagggctttatatcgcccttcttcgtttaaaatattaacgtaatcaactatttccattgctcgtaacctctgcatacaatgcactcattattgcagatacttcggtcttttcttctggagtgatctgcatgttgttgatgtactcactaatcaatccagatacacttttgatttcaaaatcagtatcgacttctgaatcagtgatcacgcgatcgacaatgttcaactcataaactgtttcttccagttttgtttgaaacttaggcaaatcgttatcaacttcgcgcacaatcaagcgaacagagcaatttttgtaatctgcaacatcaacatctttttgatccggataggtgatccggcgatggtggcatactgggttagcaatgaaagttaattcacgtttaccgtcgccataagatagctcatagaagcccctggtttcgtcctcatcgttcgcgctcatggtaagaggtgtaccgatatagaaaacgttagcgccttcgttagcgtgatgatagtggcctgaatacacgatatcatatttctttaagaaatcaggttcaagcccatgttcagctttactgttcttatagaaatagtatccggacagttcaaagtgtcctaagcagtattgagattttgactttttgatgaaatcaaaaatctgctgtgtgttttcttgacaaatccacgggatcaaatcgattgattgcagcggagaagtatcaagatttactgtcatcggttcatcaacaaccgtgaagcaatcatactgatcaagaatctctcgcggtgagttagggcggatcttgtctttaaactggcaatcgtggttcccaaccagaacatagatatgtaatccggcttcttccagtagtggcacaatacgttcacgaatgaatttcatcgtggtttgtgtggtggccttgcgcacatcaaagaaatcaccagcatggaaagcctcggtaatgccgtttgctttgcagtgttctacgatttgtacgaatacattgtataggttttcttcattccaggggttgtcctgacgcaagccagcgtgagtatccccgatcattaagtactttctcataagaccctcatagcccctttcggggctacttgtttgttagtgcttctgttgtgaagctacgatatttcgaattgatgctagtgaagtgttccacatcgtatcaatgaaatcctctgtatacggctgtttgagcatatcacgaagtttcttaaccgcatacacatactgaaccttattacccctgaatagggcttcctctgcgtgtctacggaggcgtttgatctcagtccggttcttcttaatgaatttttgtgctcgcttcaatgcgtcggcttctacacgttcctggatcttttgttgaatttcctcttctggatccacttcttccacactggttagtacttctttctcttcatcaatcataagtgatctccatgatcatagtttcggcgtttatcatataagacaaaaccccttcttctacttcgaaatcggggtttcttacgtcagttggatcgatgataaccgggattcccacgttttgcaactctaattttacgaagtagggtagcaagtcaatttcgtaatcgatatcagttaatattttgtttaagtcaattattgctttcatagaaaatcttccaatgttgggaatacttccgcttccttgtctttggttttggtggcggaagcctcgtactgagatagtttgtcatgtagatcttgaatgaaaccttcgtctgcaatactaaccatatctgaatcttcacagtcgtaaacgtgctcaaggaagaatttatatttcttcgcgttctcttttttctcgtacagaatacgtgttacgaatgcttgccaacatgctttgttaatgtaaccgtaaacgttggtataacgagtttcatcgaagttatgcagtcctgagattgcagcggaaattccgtcatcgatcatatccattttccaatcttcggaataacggttgaagttgtaacgacgtgatagcccgtttgcaatatccataatagcagcccccaactcattaggcattttgcgatcacctgtttcggcgatttgctttttccatgcacagaggatagggtataatttttcattgtctgcgtagatattggttgtttctttagtcatagtattcatatttcctctttgaagttaagaatattatataataactgtagacaaaatcaaatttcattctatattatttaaggttaaagtagatctaatgatctatagatcagatctaaattatataaaatttattgattttagtacttgacctacaatgatcattgtagtaaaataattattaattaataaattatagatcataaatttgatcagatcaagtattattgatcaaaatttttatggtcttttgtattgacttcatttcgtaagttactacaataaccccgttctttgaaaaattgaggtatgtatgagcagttttgcaagcatgtttaacttgaacaagctgatgcaagatgaaggggaacccgatgatactatggtcatcgatatctctaacatttccatcgctacactgatgaacaacttcaaaccaaaggaacaagcatccatcacgatcgaaatgattcgtcatctggtgcttgacactttacggtttaacgttgtaaaatttaaaggtgagtatccagaaatcgtgattgccttcgatgacagaaattactggcgtaggcaaaaagcctggtactacaaaaaacgtcgtcagatcgaacacgaagaatcagaatgggattgggatcgtctgaacaacttccttaatcctgtgttcgaagaaatccgtcagaatatgccttatctcggattaaaggttgaattcgcggaagctgatgatataattgctgttgttacgaaaaaagctgttggtgaaggtagacgagtattagtggtttctgctgatagcgactttacacaactacagaaatataacggtgttcgtcagtggtcgcctccccagaaaaaatgggtaacgcctaagtacggttcgccacgtaacgatctgcgatacaaaaatatcaaaggcgataaaaaagatagtatcgcttgcattaaaattagaaatgattatattgtgacgaaggttgaaggtgaacgcgccccagcggtaaaatcctctgagttagaggcatggctggaggcagacgatccgacaacattgatgacccctgaatgggccgcacgttacaaagaaaatgaggaactacgcgatttcgaatttataccaaaagatattgaaaattcgattattgaagcgtataatactccaaaatccggaagtaaagccaaaatggaacgttacttcatggataacaaactttcccgtatgttcgaaaaactgagtgatttttgaggtaacaaaatgagtgtagaatttttacaaacaaaccctgatgtagcaaaacaggtaaaagaactgatcaaagaagcatccaacgtgaaaactcaagttgagatcttcaacggtacgttcaaggatatcaaatccaaagcaaaaactgatttcggtatcgatggaaaaaccttcgggaaactgttcaaactgtatcacgaacaggcccgtaccgctttcgaagaagaaaacaacgaactgatcgaactgtatgatatgatcgataaggcgtaaagcatgatcggaaataagaccgaagtcggtttgtatatcgaaaatctggttgcctctgagggggcaacctacatggaagcaacgctacaatggatggatgaaaattctattgattatgcgatgctgaataaaacggttcctcgcgcgatccttgataagattagcgacgaagcgatcaaaggaaacatgcttcgcccatcggttgcgcttgaacatagttcatcaaccactctggacggcttcatgtgagattcaaagctccgtttgctgatagcgaggcgaattcacggcttgtgcctttgtctgtatacaagttatatctggcgatgaaaactcatttccaggggcgttttgatgtccttcaatacaactggcagatcaaagttagtgaaaacgcctttaacaagcgaaaggatagatatttctttgtaaaattagctcaacgctttacattcaaagaaatctattttatattcctctccaacttcgtagccaatccggatttctgggtaggcgatgttgatgaagatagtattgtcttttacaggcagtacataggaaagttacaaagactagataacgtgtttgtggatgacgttaaaaacgtgtacgaattcgccaaaatgaaagagatccccgtgtctctggtgttcaagtacagcgaaaaatcatcaacgtcctacataagcaaacttgtcctgtcaaatgtgatatcttacgaatcgtttttgatttttgactcatttttaggtatcataaataaacacgatcaagtagctgatgatattatttggtctgactttagcattaagttaaaggcatacagaaaaatatttgaccttactgaaaaagatatcataaaatatcgaaacttaatgaaacaaacgttaatcaaactaaactaaacgagaaaacagaatatgagcagcatttttaaacgtcaagatcccgctaaactccaggcacaggtagcaaatctgaaaggtggttccggcttccagaaagatgagaaagaatggaaactgaccctggacgcacagaaaaacggttccgccgttattcgattcctcccagcacgttccgatgatgaactggcgttcgtccgtatcgtgagccactctttcaagaaaaacaaccagtggtacattgagaactgttcctctacccacggcgattatgacggctgtcctgcatgtaagtacatttccgaaaacgatctgtatgagaaggctaaagccaacaaaaacgggccagaagataagctactgagccagatcggtcgtaaacaaagtttctgggctaacgtcctggtcgttaaagacccaggcgctccagaaaacgaaggtaaggtgttcaaataccgcttcggtaagaaaatcatggacaagatcaccgccgcaattaacggtaatccagaacttgatgaaccgggtattgctgtaacctgtccgtttgatggtgctaacttcaccctgaaagcgaaaaaagttggtgattggcctaactatgacgatagctcgtttggtgttccggctaagatcaaaaacatcgacgatgaagaagttcagaaagcaattttcgaaggtatgagcgatctccgcccgattaccgctgaaagcgaatttaaaccgctggctgacctgaccactcgcttcaataaagttatgggtagttcgatcggttctgctggttccagcgcttccgctgaccttgatagcgaactgagcaacttcgataacgaaatggctaagtttgacaatcagacatctgatgtgaaatcatctggtggtgttgcatcggttccggtaggcgaagatgacggcgtaccgttcgacctggatgattctgatacctccggtgatgacgacctggataaactgttagacatgtaatacaagcgggggcttcggcccccactcaaagaattctaagttagagaagaaatatatgaatgaaagtaatgtttttgttgactacatgaaccgcgtccgtaaatcctgggttgctaaactctcggacgaaacaaaagaactgtttaaggctatgcctcaagaggaacgttttaaacactatcgtgacattgatgaaaaagtggttgcggaacatcgtaaacttaccagcgaacgacgcgaagatccgaagcgtacaaccgttaaagaaatggctgatatgcttgacacagcagcggaaaccgttgtaaaatcacttattaagtaacacttattgaaaactaaaggctgaatatgaaattctctaaacaaactattgatatcctgaaaaacttttctcaaatcaactcttcgatcatgctgaccaaaggttcattcatcatgacgaaatcaatcaacagcgttgtatacgcagaagctgaaattgctgatgtgattgatgaagatgttggtatctacgatctcaactcattcctgaacatgctgaacatcgtcggcactgacgcggaaatcactcatgatatttcaactggtgaaatcgtgattcgcggcgacaagatgaagatcatcgaacgttcagcagacgcaacaacgatcccgaaaccgaaaaaacgtctggtgatgccagtagcagatctgattttccagattacctctaacgatttcgaaaaactgatcaaagcgtctcgcatgatgaaactgaccgacctgtccgttgaaccgattgatggtaaactggtcatcaccgcgaaaagcaaagaaagtcaatcaactttctccgttgaagtcggtgagtatgaaggcgacaatgttttcaattttgatatgaagattgataacatgcagttcatcaacagcgattacaaagtagagatttcctccaaaggggccgcaaaattctcttctgataacggcgttgcttacgtcgtcgtacttgaagcaagtagcacattcaagtaagatagttttaaggggctacggcccctttcttttacaccatttattttgaaggtatattatggaacttagtgaaaatattgaaatcatcgaaaccaaatacggtaaaatctctcgatctcctgatgaatttgcatgggatcagcgctatcgcccaacaacgattgaagagtgtattttaccttctggtgacaaagccgctatgcggggcataatcaaatctgggcgtgttgagaacatgacccttgtatctgattcccctggcactggtaaaacgaccctcgcgcttgtgttggcccgtgaggttgatgctgaggtgttctttgtcaacggttcgaactgtggtgtaaacttcattcgtaatgaactggatcgttttgcttcatcaatgacgcagaaaccaggcggaaagattatcatcattgatgaattcgatcgttctggtatggcggaagcacagaaacacttgcgtagctttatcgaagcatacagtaaaaacgtttctgttattgtaacagcgaacaacattaacggtgtgcatagtgctctgctttctcgttgtcctcctgttaaattcggtgttccgtctgatgctgaacgtatcgaactgatgaaacagttaatcaagcgttgtttcggtatccttgaaatcgagaatatcaagtatgatcctaaagtcattgcagcgtttgttaaagagcattatccggatgcgcgttctattatcaaagcgattgggttctactcgaaacgtggtgaaattgatgcggggatcctaaatgagatcgttggttctgatgtgtctcatatcattaccctgttgaaagaaaagaactataaagggttgcgctctgaggttattaaatatgcgtcagaatacgatacctttatcggaaaattgactgatacgatttatcctatcgtgaatcaggattctaaaatcgcactgattcagattgtaggcgaaaacaacgcgcaatacgggctggcgatgaataaagaaattcatctgcaatatctgttgatgaacttgatgctttctatggtctgggaggcgtaatcatgagcctggcggaatttctggatgaagaagagttatccccgcatgaatccgcttggctttctaaagattgggataaggttgaagaactggtcaaagagtacggcaaggataaagaaaacaccttgtttaacatcatagacgaaatcaacaacggcaaaacgccgttggttatcgatgaagtgtatgataagtactttgtagacaacgcaatgagccagcacatagacacgatatacaacgcgtatgtgatgaatctggtaggcggtagtatctctgaccaaatgcactataactattatctcaactctgttaggaaggctaaacgcttcggtgcatgggctaaactatcggaagattttgaagagaaaattattatcgaaatccttcgcgaaaaatacagtgtaaatacacgtacagcgatggaatatttgcaggaacttaaagacctcggaatgttcgaggattggaaaagaaaacacgcaaaggtcgctctgtctttgttgggtattgtgaaaaacaaagctgaacaaaagaaattggaaaaattgattaaacaatggtgatgtatgttagaaattcaactaatcagcgacgattcttttttaaagatccgtgaaacgctaacccgtattggtattgcaaacaacaaaaagaaaatgctctggcaatcgtgccacattctgaaaaagcaaggtaagtattttatcgtgcattttaaagaactgttgaaactcgatggtcgtcaagtcgatatgacggaagaagacgaactacgccggaacaacattgcgcgacttctcgaagagtggggcatggttaagatcgtaacccctgggttgaagtttgcagaagaaaacaacttccgcgtactgactcactcgcaaaaagcagattggatcctcaagtacaagtaccggatcggtcactaatcaaaaagcccttgcattcgtgcaggggctttgttatattgggtgtacaccattgagagggatatattatgactattaacgaaatcatggattcaatcaaatccaacgaaactttgatcatcccgattgtaaaagatgacatcttgttatcgttaacttgcaatctgtcagatacccgcacttacagctatgcacaacactactttcctggattttacgatcgtaacatttcagagtacacattgttatgcaatcaagttgaaaccactcatttctatgagcgtattaaaaaatctctggaattgatccaacaagcaaaagaagtctttatgaaaagaatggaggacgcgcaatgatccgcacttacatgaataaaattttcgcggcccgtatggataacgttattgaccaacgtgcttatgatgatctggtttcccttgcaacctgtcaactggatgaacatacagtaacggaaaggaaactactggttaacaaagctatcatgatggttaaccagggaattgcagaagcaaaatatcatagtataaattccagtatttttagcatgttattcgacgggtttaaacttgaacgccagcttgttcaactgagaaagatccgtgacttgttagcagaagggttgttggttttagaacatcgagtaaacttgaatttgctgtaggtagtgttacaatggaacattatattaatggagaatacaagatccaatgaatgaattttacctatcagttgaacaaatgggagataccatttacgagcgcttcgttgactctaacggcaccgaacaggtacgtaagacgaaatatgcgcccgtaatgtatcaacacgctatgaatggcgtagaaaccccatacaaagacatttacggcaagccttgcctcaaaaaacagtttgacagcatcaaagaagctaaaaactggatgcagcgtatgcgcgatgttgggatggaagcgctaggtatggacgattaccgactggcttacatttctgacatgtaccggaatgaaatcgaatacaaccgcgaacacattcgcattgcttctatcgatatcgaggtgaccgctccagaatttccggatccgcgtgaagcaaaatatccaatcgatgcgatcacccattacgatagcattgaagataaattctatgtatacgatctggttgagggtggccttgcggaatggtgcgcggaaaacgttgatcgcaaagacattagcgaagaagatttaaacaaaattgtttatcggtctttccagaccgagaagtcgttattgtctgcgtatatcaaagattggaaagagcgaacccctgttattgtaaccggatggaactctgacaaattcgatattgcatatatcatcacgcgatacctgaacattttcggtcaaaacgtggtaaggcattttagcccgtttggtaaagtaaccgccagaaccactactgacgcttacggcaacgaacaattaggatatgatattttcggcgttgctcaaatggatggtatggcgctgtataagaaattcagctttaccccgcaaccgtcttaccgtctggacgcgatcgcggaatacgaaactggtaaaaataaagttgagtatgaaggttccctgtctgaactacgccagcgcgatcaccaactgtacatcacgtacaacattgttgacgttatccgcgtacttgatatcgacggtaaacgaaactttattgaactggttctgtctgtagcgtactatgcaaaaattaacttcccaggggttatgtctccgctgaaaacgtgggacgcgatcatttataactctctgcgtgaagataaggttgttattccggaaaacagacgccatactaaaaccccttaccctggggcatttgtgaaggatccagttcctgggccttacaaatacatggtatcgtttgacttaacaagcctgtacccttccatcatccgacaggtgaatataagccctgaaacgattatgggaagttttgcggtacgtgctcttgaagagtatattaataagaccgcgccgcgccctagcgatgaatttagctgttctcctaacgggtggatgttccgccgtgatatcaaaggcgtgatcccagtagagatcaagaaagtatttgatcagcgtaagatgtggaaaaaaagaatgatggcgggtgagcgaaatcttgaactcatcaagcacgaactcgaacacttaacagacgcacataaccaaatgttcgatcctgactttgatttctatacagatttcagtgatgaatcgaaagcagttctgaaaactcttacaaaacaaatgcttaaagcagttaagcgcgtgtgtgagaagaagatcgcacaagcgaacacagcacagcttaaccgtaagatttctatcaactccctttatggtgcgttgggtaatgaacatttccgatacttcgatctgcgaaacgccagcgcgatcaccatgttcgggcagttggctatccagtggattgaacgtaaggtaaacgaataccttaacgacctgtgcggtactacggatcatgcatatgttcggtactgtgacactgactccatttatgtttgcatggataacgtgattgcaaaagttggtggtgaggctaaatttaaggataataaccattgggttgacttcctggatcgctttgctaaagaaagaatggaaccgatgatcgataaagggtatcgtgaactttgcgaatacatgaacaacgtggaacacctgatgtttatggatcgtgaaatcatttctgggcctccgttgggttccgaagggttgggaagtttctggactgctaaaaaacgatatgcggctaacgtgtgggactccgaaggaacccgctatgaaaaaccgaaactgaaaatcatgggtatggaaacacagcgatcgagtactccgacctctgtgaaagtattcctgaaagaagcgatccgccgtatcctgcaagaaggtgaattatctttgcacgaacattataaaaagttcgaagaagaatataaggaacttgactacagggaaattgctggtgtatcatctgctaacaacatttcgaaatatcgtgatggggctggctatccaatcaagggaacaccaaaccatattaaaggggtgctgttctttaaccgtttcactgctggtattgatggtgttacgccaatcatggaaggtgaaaaggtaatggttctaccactaagggataaaaacccgtggcaagccgattgcatcgcgtggcaatccggaaataaactaccgtcagagatcgaaagtgatattctggcatgggtagattatccgggtatgtttgaaaaacatgttattagtccattgactaatatcacggaagtatgtaaaattgattatgaaaaacgtgccagtttaaacgacctgttcggtgactggtaaactctaggggcttcggcccctttcattaactagtgagatatatagaatgagaatgaataaatcggaaaaattaaatgtcaaacaaagcactactaaaaaaactgatcaaaaactcgaatagccaaactgcatctgtactttctgaaagcgacgtattcaacaatattaccatcacgcgaacccgtgtgccgattctgaatctggcgttgtccggtgcgtttaacggtggcctaacttctggtcttacccttttcgctggcccgtccaaacacttcaaatccaacttaggtttgctgactgtagcggcttatctcaaaacgtatgaagatgctgtgtgcctgttctacgattcagaaaaaggtgttactaaatcctatctgaaatcaatgggtgttgatccggatcgtgttgtgtatactcgtatcacgacggtcgagcagttgcgtaatgacgttgtaagccagcttaacgcgcttgaacgcggtgataaggtgattgtattcgttgattcagtaggcaacacggcaagtaaaaaagaacttgctgacgcgctgtctgataacgataaacaggatatgacgcgagcaaaagcattaaaaggtatgttccgtatggttacgccttatctggctgacctggatatcccgatggtttgtatctgtcatacctatgacacacaagaaatgtacagcaagaaagttatttccggtggtactggtttaatgtattccgctgataccgcgatcatcctgggtaaacaacaggtgaaagaaggtactgaggtagtgggttatgatttcatcatgaacatcgaaaaatctcgattcgtgaaagagaaatcaaaattcccgctgcatgttacctatgaaggcggtattagtatgtattctggccttctggatctggcaatggaaatgaactttgtacagaccgtaaccaaaggctggcgcaaccgtgctttcctgaataccgagactggcgaactcgaagttgaagaaaagaaatggcgtgagtcagaaacaaatagcgttgaattctggcgtcctctgtttactcatcaaccattcttgaaagctatcgaagaaaagtataagatccctgatcgtgaaatcagtgatggttccgcgctggaagatttatacagcactgatagcatcccagatcctgatctgggtgatgacgatatcccagaatcatttgatgatatcgaagaaaacgacgaaattttataaaatatggggcttcggccccataaccgaggcaatgtatggatatcgagagcaaagcaaagaattatattgatgaagcgatgaaagatgttattcaggaacttctgattaacgatgaaaaaggtgttgcgcatctggtttatattcataaggtgttttgggatcatggtctgaaagtagaattcagtaccccagacgaagacaaagaagcgttgatcccgctggtgcatgatgcaatttatgcacagattaaagagcttgaaaagggttcagttgtcccaaagcctaagctgacattatgggatgtattcaaacaaaaggtttacaactttttcatgatgttcagcaacctggtataaggcaatacaatgatcgttgatacaatattttctaacctgatttataacgggacgtattttgtccaagcatggcctcatctgaaaaaggaatattttgaaggcaatgcacaagttttgtttgacctcattgataaacatgtacaggaattcaacggtattccgtcaaaaactgctttagaggttgcgcttgacaaacgaaatctaagtgatgtagtctacgaagacacgaaaaaggcgattcagtcgctgaaaaatgcgccagaagatttagattggctaatgaaggaaacggaaacatattgcaaagacaaagcaatgtatcgtgctctttctcgcgcaatcgagatccaggctaacgcagaaaaaccactggcagaacagaacaagaaacttcctggtgttggggctatccctgaaatcatggaggaagcattagcaatttcattcgatagttcagtaggtcatgactatttcgaagattatgaaaaacggtggatgctttaccaatcgaaggcgatgaaaattccgtttggtatcccgatcctgaacgcaatcaccaaaggcggcgcggaacgtggtacactgaatatcatcatggctggtgttaacgttggtaaatcactgggcttatgttctcttgcggctgattatctgcaacagggtaaaaacgttctttacatttctatggaaatggcagagcatgtttgctctaagcgtatcgatgctaaccttcttgatgtgactatggatgacatcgacgaagggaacattacatacgcagactataagaacaaaatggagcgccttaaagcgggtaaggttgggcgtttggtggttaagcagtaccctacatcgggtgcaggtgcaaaccactttagagcgcttgtgaaagagcttaaattgaagaaacagtttgttccggatgtgatcattgtcgattacctggggatctgtacttcaacccgtgttaaaggtgctgaaaatacctatattctggttaaagcaattgccgaagaactacgcggtcttgctgttgaaactaataccgtgatgtggacaggcgcacaggttgggcgttctgcatgggatagttcggatgtgagtatgggtgatgttgcggaatccgctggtttacctgctacggctgattttatgttagctgtaatcgagacggaagagttagctgatcagggtatgcaactgttcaagcaaatcaaatcccgttatggtgataagaacactttcaacaagttcaagttggaagttcgcaagggtaatcagcgctggatggataccgacaacagcgaatacgggtttaaatctgactaccacggcaatactatgcctaaaacagtagaacagacacaaggcccgatgattaaacaggctgaatctacccgacgtgaaaaaatggcacagattgcaaaatctgacattcaattttaattgactggggcgaatagccccataaagaatgtaaggtaatgaaatgactaagactataacgatcccgattccggctatcaaacttctgactggactgacactgatttttgcagcggctaaagtatttggcttctcgcatatgtcatggttctgggttctcttcccagttctattacccgtctacattgtagtaggcgttgtgttggtgggtgttgcgatctatctgctgttctcactgattgccagtgacaaggccgaagatatgtatcgctgggtaaaagccaaatacgaaaaacttttcaaaaaatcgtaaaaaggtattgacctgaatctccattgtggtaatataactcacgtagacaagatactgagttaaacaaaggagattcaaaatgaacgtattcaacaacccttacaacgaaatgctgaacccgaatgttgatttcagcgatggttattttgacgcaatcgtaaacagcatcaaaaacaaaggtttgctgttagcgatgctggaaaaaggcaaagatgacgttgaaggaagtgttgattttctctggaacttcctccctatcgaacccggtttcaaagttggttgtaatgaggaacaagcgaaaaacgttcttcggtatctcatcaataacgcataaaaattaagccccgaaaggggcttttttgtatctgtaggtattgcattctttcgcaaaagatgataccttaatcataacaaaggaggacattatgaaaatcgcattcgttatcactttcttacttgcagcactcaacatcgtaactggtaattcttttagttggtgggtggtggcaatgccttacattttcgtgtatagcaaaatcatggtgattgctggtgtgaatcttgtccttgctatcttactatttgtattcgccgccctgaatggtgaagcaggttctacctggaaagccatgaaagagggtgttaaagagggtttgaaatgataaatttagatttttgtaaggcagaaatgcaagctgacgcagacgaagaagaaccgaagttcgatagtcctcacagttcgcgctggatcgtagctgttgacgatgaaggttatgttacggtattatctcgaccattcattcatgatgcattctttgaatgtggacgcagcgcggaagatatcgggcttcctgattccgtcgaaatgcctcctggtgtatatgaatggatctgtggttttgaacaaactactgactgggaaaccggatatgtggacgggtgggaattctaccctaacgaatcaacattattgtatagctgggaaaatggcaaagttaacgaaagcggaaaccaagaaacacaatcagataatggatctggttcactctgacaaagcgctaacttacgaagagaagttgttcattattgaaaactttcatgaaggcgcgtttacaaacaattctgaattaggggcgttctttacccctattggacttgctcgcgatttcacaatcgatgcttgcacaggtggaagtgttattgacctgtgtgctggtatcggtgggttatctttcgctatggttcattacatgatgtacaatacgccgcgtgaaatcgtctgtgttgagttaaatcacacatactatgagttaggtaagcgtatcgtaccagaagcctcctgggtgcatggagacgccttaacaactgaatttaatcaggtgtttgatatggcgatcagtaatccgccttttggtaaaatcaaaacatctgattttaagggtaagtatacaggggcggaatttgagtataaagtaatcgaacgtgcatcacagatcgcgcgtcagggaactttcataatccctcaaatgtctgcaaatttccggtattcgaaaacacactgtttccgacaagatgacagcaccacatcaagtaaatgcaaaaagtttcttgatgaaactggcctcgttatgaatcctggatgcggtatagatactgggtattacctggaggattggaaaggggttaaaccactatgcgaggttgtttgtatggagtttgaacctgaaaccaaatctgatttattcactttcacaatagagtaataatcatgagtgatcaattagttaaaaatatggatttaacatatagcgtccggatgatccggctactcaaaaagccctggactgaatggactgcttacaagctggggatccttgatggacaaggcgaagtaattcgcaaccccaaaacaaaagaagagttagaagcgtattctccttttcatcgttcagtacgccatatcaagcgtagaatgaatgctgttccgtatatgagtgggtttatgaacttaaccagttcatatgataccctacgcaatcgctacaatctgacagaacaagagcatgaagaaatcatgttgaacgttccacgcctcaaagaatattatgataaggggcgcatgttagaggatatggtcgcgggtgattctggcggcgatacagaaaagattgcttctggtgtgactactggagcagtaaccaacatcgggccgaaagtattaggcgttacccgtgcagggaaaaggaaaaagaaatgataattcctccgctgaatatcactatctgggctactgctaacgattatacatggtttccaatttgtatcatgtatatgagtgacaacgcgaccgtttatcagaatcgtcgaaaaggttctgataaaattgatattgcaataaattattcgtttaaacaggcatttcgtggttggaagttaatgcttgacggaacagaaaagcaagtaagttcttgacagaaaaatcctcttagtctatgatattgaaatcatttgattaggaggatttacaatggcggttggatttggccctgctgacggtgttcaagataccatccaggcaacaatagacaatgcgatagattttgcacgttctcaaatcagaaacggagaatcattaacgcattgttttgattgtggggatccgatacccgaaaaacgtagggctatcgtgaagggttgccgttattgtattgaatgccaaaaagaacatgacgaaatgatcagcgcggggtataatcgacgaggatctaaagatagtcaactgaggtaagaaatgtatcttgatatagaatttgcaacccgaatcatgggatcactgcctcaaagcgaaatcgttcgtaaatcgggggcattaagcatcaatgcgcgttgtcctatttgcggcgactcaatgaaagacaagtacaaaaaaagattttggatctacccttctaaaaagggtgatcatatgaattgtggttgttttaactgtggttatggtgtaccgtttagcgtattcctgaaagaatattatccagacgattaccgtgattatctcatggaatcgtttaaggatcgcaattcgttaaagccaacgcatacagaacaaccgaaggaagagaagaaatttattcctactcttcaattctgcgaaaggttagataccttgccggatgaacatccgatcataaaatatgtgcagaatcgttgtatcccccgtgacaagtgggatcggttgtggtttactcgcgaatggcaacaactggttaatactgtgaatccggatacctatccgattgcaaaaccagaaccgagattagtgatccctatcttcgataagaaaggtaaaattgaatctttccagggccgtgctttacgtgatggtgctaagtcgaaatatatcacaatcaaagcctgtgaggaatcaactaagatttacggacaggatacgatagatccgctaaaaacggtttatcttcttgaggggccattagatagcctgtttgttgataatgctggcgctatcactggtggacagcttgcactttctgaggttccgtataaaaatatgcgtgtctgggttcttgacaatgaagcacgtcatccggatactactcaccgcctctttaaattgattgaggctggagaaaaggttgtaatgtgggacaaatgcccgtggccttccaaagatatcaacgaaatgataaaaacggacggcgcaactaaacttgaaattatgcagtatttgaaagataatactgtttctggactcacggcaaaacttcgatttaagtcgtgggacaaatcaccgaaaaaatgagattgatatgactactgataaaactcctgtatttaattcatgtgcgcacctggttaacccggaagatctggaatttgtagattccgaatatcaaaaggttctggcccgtaatggcgatcctttacaatccatgctggatttacaaaaccatgcgcaacaaagcctgtctgataccctgcattgggttccgcgtcctgataatctggaaacttgcggagaaatccttgattggctgaaactgcaagacgacgcgatcgccgacgaaacccgcgaattgtataccgctctgggtggaatgtctcgcggtgttaaacctgcatccggtgtttggaaaccgtggaaagcaaatcaccaggaattgcgcaatactaaatttgcggatctgagtgaagaggatcgtttagaagttctgtttgaacttatcgatcaatggcatttctttatgtgcaaattcctggcgctgggtatggatgcggaaaccatctacaaactgtatgcactgaaacaagccgaaaacctccgccgttgggctaacaactactaatggatccgatcatcgcgctagtagctgttggggttctttcttatggtgtttgcgcgatgatcacatatcttttcggttggtgtgtgtttcacgtaaatggcgttgaaagaaaacttttactgattatactatcagtgttttggtttgttggaatattctacgtttgttatgaggggcgagaatgattacaaaatattatatcgtcgttagtaaggataaagacgggtttaaaattcccttcattaaggaaggagagttaacacctttgttgtttctatctccggacgatgctaacgagtataaaaattcgattatcaaagaatatcatgataagatgaatccagttaaacaaagtggtcttagccgattctttcgaaaggaagaagttgaaaccgtaaccgaaaagaaaaagaaagatatgcgttggtttattgaacacgcaagtattcaaggggtattgattaaagtatgagcgaattaacttttgacgatctgagcgaagaccagaaaaatgcacatgatcgagtgattaaaaatatcagaaacaaaatccatactactatcacaggtgggccgggtgttggtaaaactactctggtaaaatttgtgtttgaaacattgaaaaaactgggtattagtgggatctggctgacagcgccgacacaccaggctaaaaacgttctctctgaggcggtaggtatggatgcaacgaccattcactcagcactgaaaatcagccccgtaaccaacgaagagttacgagtatttgaacagcaaaaaggcaaaaaggccgctgatctgtctgaatgtcgtgtgtttgtggttgaagaagtatcgatggttgacaaagaactattccgtatcatcaagcgtactattccgagttgtgcggtgatcctgggattgggtgataaggatcagatccgtcctgttaataccgaagggatcaccgagctttcaccgttctttgatgaggaaatttttgatgtcattcgcatggataagattatgcgtcaggcagaaggaaacccaatcatccaggtatcacgcgctatacgcgacggtaagccgttaatgcccctcatgaatggtgaactaggggtaatgaagcacgaaaacgctggtgacttcctgagacgttattttagccgtgttaagactccggatgacctgaacaataatcgtatgtttgcttacactaacgcaaacgtagacaagttaaacacagtgatccgtaaacacttgtacaaaactgatcagccgttcattgttggtgaagtggttgtgatgcaagaaccgttagtgacagaaggccgtgtgaatggggtttcgtttgttgaagttatctataacaacaacgagcaaattaaaattcttgaaatcataccgcgttctgatactatcaaagctgaccgatgcgatccggtgcaaatcgattatttcttgatgaaaacagaatcgatgttcgaggatacgaaagcggatattcaggttatcgcggatccggttatgcaggaacgtttaggcgattatttgaactacgtcgcgtttcagtataagaagatgaaacaggaaaccggatacaaagccccttggtattcgttctggcaaatcaaaaacaagttccagacggttaaggcgcttccggtttgtacgtatcacaaaggtcagggaagcacgtatgatcattcatacatgtatacgcgcgatgcatacgcatacgccgattatgaattgtgtaagcagttgctttatgtaggaactacccgcgcacgattcactgttgattatgtctaagggcttcggccctttgaggttattatgaaaattattgttaaagtcaaagatgtagaaaagattttgcgagaagttgaccgtattggtagagaggggcttgattatctcgaagggttcaattctatcgatatcaatttgttgtttgcaaaattgcgctgcgttgtcaacgcaaacaaagaagttgggttatactgtcctaacgggccgacctacacgtggggaaacatttcacaagatatcgaattcacttttgaagagtatgcagtgatcattgatactttgaaaatgggtcgtaacattcgtgaaaacaaaaacatgcttgagggattttaaatgaatattcaccttccgcgcctttatgctgaattggttgccgatctgattttgaaaagtgatcgttctacaatggaagattaccacgattgggaacatctggacaattttacagaggctgtagaaaacatgatccgactggaaaaatcgattgctcgttgtgggcttcgtcagttcgggatgatggcagtaactccaggcatgatcgaatccgttgatgttactccggaagtcgcgctatcattggcctatttcatggaatcgtataagcggggtcgcgaatgagtcatttacccgtagatttcgtatttgattatgaaagtattggcccgtttccaaaaggaaaactagctgaacttagctatgttccgtttgttgatgatccttatgatccgcctacctttcaggaactgattgctaaaggaagaaagtacaaatttgacatccggaaacaaccagaacgcatcaaagatgaaaaaacgatcgaatggtggaaacagcaatctaaagaagcacaaagggttttgttcccttccgatattgacatggatttgtacgaaggtcatcgacaattctttgctgatttagcggctgacggtgtgagtcgttggcagtcatacgattatactcgcggccctgaattcgatcgttctatgctaaccgatgttgtacgaactatgacagggaaacttgacacgttcgaagatatgccgaccgtgttctggaatagccgtgatgtgcgtacagctattgaaaaccgtttactgactcgcggagtgaccacgtgtccactgcgtaaaggcatgttagatggattcattcagcatgattcgattcatgattgcgctaaagatgcattgatgctaatctatgctaaacgttatgctctggggctggaagaacctccatccttagaagagacagacgaaaacagcataggaaagaaacgatgatcacattaactattatgggtcgccattactacgggaactcgattaacgaagcgaaagcaaaagcctttgatgatatcattaaccaggatctggttaagattgaatctgatcgctatgtcgtgcaaccaggtgatagcctatattctatagcaaagaaactgtatggtgttggtgaactttggcctgatatcgccaaaatcaaccgtgattctattccggatgcacgtctgatccatcctggtatagttcttcgattgccaaaactggtaaaaatttaaaacaaagcccttgacttcggttgagggcttttgttatattgggttctcagaaaggagattgatatgaatttcactaaatttgaaatccggttgttgattacgctggctttttgcggagcggtatcattgattagtttgttaacgtatatcgctgtaagaacaacgatatggcttcatgactggtttactgtacttgacacaattaaggggtgatttatgcgtatagcgattattggggcggctttgggtgtaatcggcgaccgtttagtaaactgtatgatcgaagagttaaagtcatcgccctatccattttcgatggaatggaacaaccaatttcctaatttggttggggaagaacccacgatccataaagtcaaaccataccgaaatccggttgtgcctaaatcattgcaccgtcaatcagtaaacaggggtaaatgatgtcagaattcgcgttagctatccttgtcgtggttgttgtaatgggttcgatcctgttttgtcgcatgtatcagttagatgatacacaggaatggttggacattaacgaaaaacatttccgtaagcactttgcaggtgaatttgtttttgtgaaatttcgtagtgactacaaggtcgagtttgagtttgacggaaaagggaacaactaccacataatcacttctgttattgatgcaaagaaaatctttgataagacacagggcggcgggatccgtaaattgctcaaagaaataaaatagcactttttgttaaagaagcctcttgcattgcgggaggctttttggtatcttgtattcatcgaaacgaaacagagaaaggaatacgaaaatggttaaagtaaaatatgcagcacacgttaaagcaggtgagattgttggtttaactttcggtgctgaaattggttctcagtgggcgctggttgaaaaggtagaagacctgggcgataaagtagcaatcactgtgaaaatgcaaaaacgttttactaaccgtcctgtaatcactaagaaagtgaagaaggaaaaacgtgttaatactcagactttcgaagaattcatgaactggtgcaaaatgtataaactggatacctactaatagcactttttgttaaaacattctggggtagctttggtatagttaccccatcgaaacaagggaggaaattattatgatggttaacggttctctttatcaacaagcagttgcacaatggaaacagaaagttcaggatgcagaacgcgggatcgcttattgtgatgaagcgttggcaagcaatcttgaaaactgggaacgcaaagagtacgagaaagttaagcaacgccatttgaacgaactccctgcattaaaagaacacttaaaatatttgatggataacgaaaaaagccttgcatagaataaccatctttgatatagtacttacatcgaaacgaaacacactttaggagatataccatgaacactttcgaaatcctcgcagaaaaagcagcacctttcatggaagcaatgcacaaagcgcgtaacgctcgtttccaagattctcctttcgaaactgttttctttctggagaaaggccgcaaatatcatcgtgttgttcaggatactcgcaacaaagaaactggtgaaatgttcaatcagcgttctgttgccgccttcatcgataatgatggtaatatcctgaaacctgcaagctggaaagcaccagcaaaaggcattcgtggtaatatcttcaatgacgcagaccgcgcgattgaccaaagcggttatgtggtttatcttcgttaacaaaggggcttcggccctttttcttaaaaggaatatagcatgagtaacaaaaacgaagacgctaaaatctggaaagctgtaggggttatggctgtaatcgctgttgtgggttactatgcgtataattcctggcaagaaacgattgatgcgcaagtacaggaacaacaaaaagccgacgcaatcgaacagcataaccagcttatgcaattgcgctcgctgggatataccacgaaggaagattttaaaaattcctttggtgactataccggatccctttataccgcgtggggaatgactgacggcgattacatgtacattgaaacagatcgttataatgtcccacaaagtgtatgtttctatagtacgccgagagacaacggcaaaatcacgtcatacgcaccagaattcaaaacgatttctgttgatatgaagattgacgggggagaaaccctatcatttgccgctaaaggaaacaacggatccgagcggttgtgtcttctttctcctactcgtttcttacgcaacattcaagacgcgagtaatttaaaaattgctttaccatacatcaaccattatgatattgttgatgaagtaaaagaatggaacgtatcgcaaatcggggtgaaattcaaatgagaaaagcacgtaaaactaatgcagtgttgatgattaacggtgaagtaggaaaaccttgcaccaattctaaattcatgcacattgcagggcttccgggcatgacgcttaaaacgtcgtatgatacccattacaacgaagaaactacttcggtatacatgggagaagatctaatggctgaacgcatcatgcaatgcattcacttccctggtgaacgtccttcaattgattgttatatttttggctaccataaaggtattgtaaatgaatctgtataaagaaaatgatctctatgtttctgcatttggcctactcacgtatcacagtatgtcggctggatacgggaaagagttcgattttgtagcaagcgttaaacgacatttggaacgcagcggcgggttgtctattccgcgccaaatccattatgtttgtaaagaaggggtgtttttgaatggtgttcctcatgtgatccctttcaacgtgtttgaaaactattttacaaaatacgttgttcaacaaacggagacgacatccgagaatactgcaacgcgagaagaaacggcgatcgtacttgataagttttttgaaatagctcataaagtgaagaaacgcacgaagagtgatgtggttcatcacctatcagcggaagttggcgagatcagcgaatgtctcattcagcctcaacgcggcggtaatatcgttgaagaaagtattgatgcgattgtgtgcgcacttgatgtgatttacctggaactgggtactactcacggacggtacgaaattgcaaaaattatcaatgaaatgcttgcagaaaaattagataagtggtatcgtacttgtaaaccttgagtttacttgtgaggattatatcatgttcgtatatcgtgtggaattttcttgttctttctggaatgattgtacagaaaaatggcaaacaaaaagcggcccatatgtcaatcgttatgtgtcaatggatactgctgaatggttggatcaattctgtatgaatcctgatatctatattgatatggatgataaccgacatccagcgccggatgacgataatcgattgatgcgcaaccttgaaaaagataacatagactttcaagcggctgggttatactttggttttcagtcaatacagcgcctttctcgttggttcaatgcatatgaacgcgagtacatgcacaatgttggtttcgtctgcatggtatacgaagttgaaaagttgtatccgggcgcacgtcaatgtgtttttgacatagacaaagcccgtttagttaagatgttaagtttaaaagagatttattaatgcctacctatacctataaatgcaccaagtgtaataaagaatttccaaaaatggcaagcattgctacccgtgatgcaccgaaagattgcgattgcggaggcgaagcaaaacgaacggttgataaacctcaaatggttcgtgatggtttcccttataacaagtaaaccccgaaaggggttttctttttcatagaaccctatataatgtcagtgattaaacaaagaggtgaatatgagtttagattttcttctggcagatgatgaaccagaacagaaaccacaaccagccaaaaaaggcgcaaaggttgacgaatcattttgtatgagcgatcgcgatcatattcggttgcgtccaaatatgtacgtcggatcggttaacaaagaagcgcatgaacgtttcataatgggccaatatcgcaaggttgagtacgtggaagggttggttaaaatcatcaacgaaatccttgataactcgattgatgaagcgatccgaactgaattcaaacatgctaataagattgatgtaaccattgatcataatctggttaaaatctctgataacgggcgcggtattccccaggatgatgtaaaaaccccagatgggaaaatagttcctaaaccagttgcggcatggactatggcaaaatcgggttctaacttcgatgataaaaaccgcgtaacgatgggtatgaatggtgttggttctttcctgacaaactgttatagctcgatttttattggcgagactgcaaacgggaaacgcaaagtaaccattaactgtacggacggcgcacagaacatcgattaccgaaccagccccagtaaagaacagggtactactgttaagtttactccagacttctctatgtttggtgtaactggtatcgatgaagaaaccaaagaagtgattaaggatcgcttaatggcccttgccgttgctttcccgtctgtgaaattcacatataacggcgaaacgctctctaatcgcttcccgctgtacgcttccatgtatggggataaaaccattgtccagacaaataatcgcctcagcttcattctggcgagcactgaggacgggtttaaacagaaatcctttgttaacggtctggatacgaaaaacggcggtgttcatgttgagtgtatgattgatggtatctattctgaacttgaaccgatgatcaagaaaaagcatagtatcgagatcccgaaagcacgtgtaaaagaatgcttaactcttgtggtattcctgcataactttaatgcacctgcattcgatagccaaacaaaagagcgattagcaaatacagcaggtgagtttaacaatcatgcgaatttgaactacaaaaagatcgcaaaaatgattatggataccccagaaatcattactccgatcattgaatccgcattgattcgtaaacaagcagcagaagccgccgcgatcaccaaagcgaaaaagaaagcgaaaaaggcaaaaattgctaaacacgttccggcttccggtattgatacccctggggtagaaacaacattgtttctgacagaaggcgattccgctgttggtcagttcatcgaatgccgtaatgaagaaacacaaggcgctttcccgctacgtggtaagcctctgaatacatggggtatgagttttacagacattatcaaaaacaaagaactgtttgagctaatggctatcctcaatattcatcctggtgatacttccggaatgacttatgataatatcggcatcatggtcgatgctgacgttgacggcggcgacattttaactctgttgcttgcattctttagccgttggccttctttgttcactgagaaacggatccgatatattcgaaccccgatcgttatcgctaaagttgggcgcgaggaaaaatggttctattctcttgatgagttcgcaccgttccgcgataaagcaaaagatgtacgatatatcaaggggctgggttctttacgcaaagaagattacgaccgtgttctgggtgatcagttgaagtatgatgtcatcgtacttgacgacgaatacaaagaagtgttagaactatgcttcggcgacgaatctgatccgcgtaaagattgggttaatggaaaacacaaattttctaaggttgactaatggaaagaagtattaaagatgttgtacaggtggaaggactaacgtttgccctttacacgatttattcacgtgcgatcccgcacctggtagacgggtttaaacccgttcaccgtttctttattcactctgctatgcagggcggaacgggatttcagaaagtagcttctatcgctggcggtgttgctatgtatgggtatcaccacggggaaacctctgtagaagaagcgttatcccttatggcggcgcactggtgcaataacattccgttattcgaccgtgatgggttctttggttcccgtttggttaagaaacctggcgcacctcgttacatcaagtgcaaactatcgccaatattcaaagcaatttatatggatggtgatttaacgccagttcatgaagatccggaacatgtgccgccagcttactatctcccgatcatcccgatggtactggttaacgggtttagcgggattgcaaaagcatatgcaacaaacattccgcctcatgatcctaaatcggttgttaacgggtgcattgcatatctgaatgataaagatttcacactggatctgaaatatccttactttaaaggtgaaatcacagacgggacaatttacggcacgtatgaattgcaaggtaaaaccaaattggtgatcaccgagatcccagtgaagtatgaccgtgtgaaatacattgcaatccttgacaagctggaagaaaaaggcgttatcgttagctacaaggatctatcgaaagaagattttcgttatgaagtaacgctcaagcgagagtatgccaatgggttaacccgcgaaaagatcctgaaagatttcgggttgattgaaaattcaaacccaaacattaacgttatctttgagggcaaactatactcatatgaacgccctgaaacgcttctaaaggatttcgttgatattcgtatgaatgtatatcaacagcgtatcaataagcgtatccaggaaactaaggaagcgttagataaagcactggcaaaggttgcgtttattgctcaaatggtagaatctcctgattctctgcgtggccttagtcgcagcgaagcggttaaattcgtgtctacgtggataggttgcgagaatcatgccgaaatgttagtggctatgaacatctaccatctaaccacggacgaaagcaaaaagctggaagacgaagccgaagaattgcggaaacagttgaaatactgggaagaaacaacccctaaaattgagtatctcaatgatttaaaagaactttctaagaagttgaaataataataaagcctcttgcaatgcagggggctttttgctatattggttttgtaccaagcaaaggagattctaaaatgttgaaaactcgtagtgcaatggaagtaacccactgggcgcgtaccatgatggaaaaacacggtttgatcagtaatggttggacattccggatcaatggacgcattacaaaaactctgggccgttgcagttataccaaaaaactgatcgaactatctggtcgtcatgttgcggaagatatctacgaggatattttagacactcttttacacgaaatcgctcatgctcttgtcgggcgcggttatgaacatggtaaagtgtggcaagctatggccttgcgcctgggtgctaaaccttcaccgagtaaaacaactacaaaggatgctaatctggttgataagaatgagatcctttactgtttgttcatgaaggattatcaaggccgtgaagtctatcaggctaaagctgataagaagttttacaacgatgtgatgaacggtgttaaggatatgaaaaacatttggatcagtgggcgcaaggcatatacaaaaggccgtctgtatatccgtccagtaacccatgaagaacttgcatacattcgcaaagaggggtaaggtatgacacgttgtaatgcgcctaagttgggaaaatatctgaccatattcggattttgtgcgttcttttctatcattatcggggctatcgtgtggggtatacttgatatgaagaaacagcaggtcgaggaagaaaaattagtaaaattccttgacacatattgcgaagtagtagaatatggcctgaacaaaaagccaacgaagtactcttgtgaccaagttatttttaatgttaagtgagaaataaacaatgaaattacgcgaagatacaccgcaaacaatctaccgagttggtacagataccagcaagggacgaaacaaactatctctacgcgcaaacaagaaagcgtataagatcctttcttcgacagtatacaaatacaagatccgcgcaatcattcgcgaactgtcttgtaatgcgatcgatggacacaaagaagcgggaaatcagaacccgtttgatgtccagttgccaactgctgttgatcctcgttttgttattcgtgactacgggatcggtatgtctcctgatttcgttagtgatgcgtttaccgtttacttcgaatcaactaaaaatgattcaaacgacctgatcggttctatgggtctgggttgcaaatctccgctttgctatgccgatgcgttcacagttgaatctgtaaaagacggtatcaaatgcggttacacaatctatatggatgatggggaaccgttctgcgatcctctgtatgagattgaaagtgatgaacctaacggggttactatcactgttccggttaaagttgaagatatcaaagaatgggaaaacgaagcagcaagggtatacgaatcatttactgatattcgtcctaactttgttggtgcttctattctcaaaatcaactatcagccgaaagaagcaaccaacgatagcggggtgatccgtcataaatcagcatacactagcggtgtatatgctcgcatgggtaacatcatttatcctctggataaagatttgtatgatacctcgatgttctattgctatacagaaagccagtatacgtatattattgacttcccaatcggtgaacttgatttcatgccttctcgcgaagagttgagtatggataaaatgacagtagggattgttaaagaacgtctgaaacaaatcagccgggtgtatttcaatcgagttaaatcagaattcgataagttacaaaccgttcgtgataaactgacgtggttccattctctgccttcaatggtacaaaactttgttggtaaagatgctaattttcgcatcaacggtgattctattggctggatccatagcgaactagtcaaacccaacaaatataatgatgattatattgctgggtattgggcgaacgaatacgacggtaaagatgcatggtatcaggtaacgggtagcggaggccgctggagcaagtataagccagaaacaaccaaacgccaggacatcacacgcatttattatccgtggaaacagaagaaactcattctgttaaaagtggataccaacacggttaaaccgtatatcgtcgggtatgctaaaatgcataacctaagccgtgttagctttgttgcatattacgatagtgattcaaagcgtgagattgttaatgatatcgttcggaaaggtcattttgatgaatcggaaattgtgtatctccgtaccagtgaaatgacaaaagaaaaagagatctatgatgcagatcgcgaaaaatcaaaagcgctatatgcaccgaaaaattcagaaccgcgcccaaaaaccccgaccgtatatcgttatgagttggatagtaacggcaatctggcaaaaacttctctgtttatgacaaaatcagagtttttatcactggataaagccccaggtgttcggttgtatggtattgatgaatatagccgcttagatggtgaaaattccagattgtctatggattcagcaatgaaagaatctactttatcgcgtatcatgcgccatactgggatccctgttgtgtttgctatccgtaacagcctctggaagtggatcccggattcaaatctggtatgctttgatgatatgctgtgcaagcagtatgttaaatccgaaaaggcattgaaagataattgcttgcctggatggattggcaaggaacactcaacagaaacaaacgcattgcatagccgttttggtgtatcgcttgatcggattgtgaaaaaccgatataatgaaaaactgtataagattgttgataccctcgaacttatagtgtgtctggaagggtatgagaaagatggtaaaaatctttccagggcgcgttgtccgattctgcgtgaatctgtagcatcaatgcgcgttaaacgcagcaatatgaaaaaacgtgttgatcaggcatgggaaatctttaaatcactaaacccgttactggcttcacttgttgaacatagcgattcttattcaattcgtccgatttacaacaacgaaaagaatctcagtgagtttaagaaattaatacggtggaaataatggtcaaaattcttgacgaagtacaacagaaagctatctataatggatggttgacgggggcaagtaaaacagcactggcccaacagttcaacgtaagcgcccgaaccattgggcgcgttatcaaccgcaagttagcggaattccctaagaaaagggatgtaaaacaaaagcctaaagtatcagacactgtaccgcgtatgatcggatctgaatcgttcattacggttgtatacgaagggcgcgttttcatggcgggtgaaacacatccgaactttaagaaagcgcatgaaatgctgaaagctggtgatgtcaaaggtgctgtaacttgtttggatactcaagaagcgatccgaacctatagcaaaggcaacattaaaatcattggtcatcagcttctatataaagatgtagtgtttgattctgatatcactcaacgaatcattcgcgaaatgtataacgatcgtccgtatgaacacctggtaaacttctttgaacggttgatgcgaaacccttcacgcgatgcggtataccagctttacgggttccttgtacataatgacattgaactgaccgatgatggttgttttcttgcctggaaacgtgtacgcgataactataaagatctcgctactggcaaatttgataatagtcctggtgtgactgtctccatgcctcgaaacatggtagacgaagataaaacgcgcacctgttctactggcctacacgttgcggctaaatcataccttccacactacgggggcggtgttggtagagtcattcaggtaaaggtggatcctgctgacgtggtagcgatcccagtggattacaataacgcaaaaatgcgtgtatgccgttataaagtcatgattgatgttacatatggttttagccattactaactaaacaaccgcgcctggagagttctgggcgcataggagactatcatgaaatttaaaaacatgccttcggctaacgaaacccgcgctagtggtgaatctattctcaaaaccgcccgtgaaatgtgggccgacgaccgggtagaatccgggaaaggttacgtatttcgtaaaggatttggtgcattttatgttgcaaccacctttatagtagggtatagttgtttaggaatcgcgtggatgcaacgatatcttgaacgtgctgttctttttgtgatacgttttctgtttacattgatcagcgtagtgattagcatcccatttctgagcatcgccttgtttgttaacgtaaaaacaggcgaaattacaaaattaggcaaactggtatctaaaaaatatgaaaagaattctgacaagacttgacattcacaaatatgcaattaaaattggtgacatgaaacgcggaaccttcaagaaattcgaaggcgtggatctgaaagaaaacgggttttacctggtagttgatgataaaacagggcgcgtagtattccgtttctacgtagcaccaaatcaacgccgtaaaactggtgctagtcgtactctgttacgtatcaagcgccgcgaacacgaaccgtctgcgatggttgcgatgctggaaagtgcttctctgtactatgtagcacatgacaaaatcaaaaacctgttcggtttcccgaacctcaacggatcaacgttcgaaagtgctattcaaatgcgttatggtgctggtgaaaactacaccgagtggaaccgcgcactgaatgacatttatgattttgaatttcaaccatattgatgtatactgattaaaactaaccaattgagataaattatgaaactgtttaataaaattcgttctgtagatgaaatcgtagcaactttcgacaaaaccctgtctgaactggaagcgcgtattgctcacgataatgagcaggttgcacaggttgcagcagatcgtcaagcagcagaagaagaacatcagcgtaagctggcggaactggcttcaaaagaaagcgatcatactgcaagtgcaacccgcgccggacgtatcgcagacaagatccgcaaactgctggattgatacaggggcgaaagcccctaaatatttttctttaaggggcttatatgaataatttggtagcgaaacatgatttcaaccgcgcttctactcaccgcgatcgcaagcgagcatttaaagaagcaaaacgtaaacagaaacacaaaggtaagtgtgatgaaaaccgctttgatcattcttgaagaaattcctgaaaatacaacgctttacaacgtcgaaaccgacgatagcgaagtaattgagatcctcaaaaccgcccacgggcattatgtaaacggttccggcaacaccaaagaacaggattatgctgttgatgttgttaacctcatgctggggccgaataccgatgataacctgaaatgggcgcgtgaatccaacattcctgaaaagtatgttggtatgttctatcagtgtaacatcgatagcaaatcaccgtttgaacctgaaaagaaaatcgatctgattgttcgcactgggttcttcttatgagtatacaaattctgttcagtaaagaagatccattaggtacggaatcatcggttcagcgcttattctggcatacagattatataaaaaatcgatgtcgtggcccaaacaacacatggggaagcaacaacgatattgacaaagcaaaaatttatcctcgcggaaaggcgtactggaaaatttttgatattcatcttcataaaacaatgaaagattcgaatgaatgattaaaaagcccttgacttcggtcaggggcttttgttatattagccatatcgaaacgagataccctttaaggagaaataccatgactaacgcaaccgtagttactaccacttacttcatttcttctggtcgtaaaaatgcaatgtataccttgcgtgttgagcgtagaggtggcggttatacttctgataactatatctgcaacttatctaccgatccggagaaagcggaagcgaaagcgcgtgagtatttcgaccgtgtttcagcccgtttaactgaaactgatactttcaaaatggtattccagggctttgcagatttcgatctgttcgaacgtcgcggtaaactgtcagtgttcgatactgaaaaactggaactgctggaaaaagggatcatgccgattggcaagcgtaaaggcgaagtaattgcagaaatgccaatgtttactgttctttggtgggctgaccagtctaaagaagacaacaaaaacagccctgtatttgacgccgtgtgtgcttactgcatgggtgttgcactggagaaggattatatcgccaaacgcgaagaaatccgcgaacagtgggaacaagagcgccaggaacgcatttctaaagctaaccacatcggtgaaatcaaacaacgtctggaaatgaccggaaccgttgagaaagtgatttcactgggatatactcaagtttcttactacacttctgtagaaagatttatgaccaaaattaatgttgatggtaatgttgttgtttacttcggtaataacattgcaaacgaaggtgatgaaatcactttcaaagcaaccgttaaagagcacggagaatacaaagacgttaaacaaaccatcgttcaacgtgtaaaggttttataatgacatacgaagatatgcttaatgaagtgtgcgcgggtaaaaccgcgtaccgcactaccaaccctgatatgattgtgtttcgtgaaggggatacaatcatcagacgtacacaccgcaagtgtgaagtaaaccaggtattcattgccacggtagaagaacaaaaggctactgattgggatatcgtcattgacgaagaaaaccacgatgagctagatcatccgatattcattttgagtgaaactatcggaattcgaccattcatgcatagaaatttttgggggtatcaatgacgttcgatgaggctatgagagccgctaagagaggttgtaaagttgcgccaataggtaggccattcttcgtgtattatcacgacagcgctggatacaggcgggttacgttgggggtttcggcaaggaatgaagattatgttccggatccgtgggacaaattgaaagtttgggatatttacgagaaaaatagcccggtgatgaacttctttaaagcaatcaaacgggctattggaagaacacacaatttaacaccagcattacgttaatcacctcactcgacctaaaatacgcgcggcctgtccacatatgatgtttagcttcatatctggtgtatcaggccgctttgcgtaccattccatcaaaaccgatccagaatagtagttatcaagattaaaataagggcaactaaaagtataagctactggcacaaaatcacgtgtcggtaggtaggaacttgctttagtggatgaataatacaagccatttatatgattcgtgtattcttcggatgttttatcgatcggataaccgccgaggtttttaggatcgatctgggatggtaattttccctgatattctacaatgtcaacaaaatagtttatattctttggtctgaatgccaataccgctgaaaaatccgcgttggaagtaagatgaactatgctcaactgttccaacgcggattgattaaacttttcagttctttccatttcgatagcccttgtatcgactacaagggcaccttttatcatcgggaatatatcagtccatttgtaccaagttactaccataagaaacataaccattattagaattatttttatcagcaattgtttccatgttttcacacccatcacaaacgagattacccgatcaaataaggctagtttatccacgggatttctctcagccatttttataagactcttcttaggttactatacgtatatttaggatacaacaaaaggctacctatatggtagccttttaatctatttaatattatgaggtgaatttgttggtttatctatcaaacgtattctaataaagcaccaaactggttatccattctagcctcaaaatacccattgagaccgccagcgttttcacatctatatcttctccaaccatcactcatagtagttccgctgaaataaacatcatactggtctccaccggatgcattaaatatagacactttaactcgcctatcttgaccattccaaatagaaaggcaataagggtcgcctttgatatttgtaatagctactagtgaacccacatctccaccagggaacgcattcagcgtcggttggtttgcagagtctcctatgtttactgctaaccctcttttaaagaatcctctatatctagatggatcaccagaagaaccctgtgcatagttaattctgaaaattaaatggaatacgctttgtccaatcatattagacatccaaaacggtgtccctattcttaatttggccccagcttgagccatccacgactcaccagtttcagcctttgctgaacttccgacccacggccctgttactgccatagttatttctcctaaaagatggggccgaagccccatgcattatttagatttaagttcttcaatttctgctttaagatttttaacttcggcagaaagctctttaacagattcaacgagaagtgcaattactgagttataattcagacgaagcataccgccatcttcttcattatcttgagtaactgcttccggtaagatttcttgaacttcctgagcaatcaacccagcagaacgagtagtaccgccagaagtgttatgaagctcgtaagtattaccggataaggtttctactttttccaaggcgttctcgataactttaatatcagatttagctctacggtcagagcgaatctcaacgttatcaaaagaaccattacgagtacagaagaagtcgccaccagctctgaaatagaaattgtcatctcgaccatagccgttaacattaagaatagcctggtgataatttcctacatattcttggaagtataaggaaacataagcaccattactaaatctacttgttaagccagcggtatttaaatacgcgccacttccgccgccaggataattagtagttgagctaattccgttaaagttactaatagcacctgggaattggcaagaaccactgttccagaaattccacgtcttccctgagataccaccagctcttatactaacgctaccaggctcatcggcccaaacaaggcctttttccgtaccatctgctttacggaagactaaatgagtgttaccagtgttctggacgttaaccgaagttgatacaatgaactcttgattaaatctagcccttccatcaacagttaaaacaccattaacagcagcatctcccgtaacccaaagtgatgtagtttttaactgatcgcctgtaattgttaaccgcccagttacagtaccacctgctaacggaagatacgtgtcgccagcattactaatagcagaagcaaccttatcatcaacatatttcttgttggtggcttggttattctgcgtaggagcatcggcaatttgtacatacttggtagtaggaacaatgataccgccattagcattaataacaccattaacagtcgctgcactagaaactgttagctgtctgttaatctgggcatttccgtaaacagtctggtttccatcagcatctactttgaatatatcattaaacgtatcagcaggattaatttggttgttggtatttgttgataccataatagtaaacgagttagatttactaatagccatttttcctgacataccacttttcttgactaaaccaatatcagagtttttgccaagaacaatcattctgttatcttcggaaacgctcaagttgcctgtgattttcgagttctgcgcctcgaactcaccaccgactgtcattttaccgttttgatcaataactgtagattggccggaattatcaccgttcggtcttaaatggagtgcctgacctgtttttgcataaatcacaaaagcacctacagcggatgaacgaacgccagcgccataagaccattcaagcgaaggctcgttgtacctgttggcttttactctaatctcagtaccagacgaatcaccgaagggtcgaaaagcaatatatttagccgaatctgtagcagaagcagaagctgacaggattaacgcaccgagactaccaccttgtgcttcacgaaccatagccccatttttaaatgtgatggccgggtctgcattaccaacgccgttgacattcaatacaccaaatgccacagattgccattcaccaacaccgaggttattacgagcggcagctacagaagttgcaccagtaccacctaaattaattggttggacgccagcaacaacttctttccatgcagaccatgagccgttttgtccgtagcgaacatacgtaccttcaacgccgccgttctttgtagtaaaggtctgcttacacgtccaatcagtatcagaaattttacgcaaagataaaacttcaagaacaaagttgccatcagaggtaggtttattagctatattagaaccaccaccagatgagaagcatttatacatctgacgagtacctgggtcggttcctttaatgacaagaccattaaggtcaacagtcttatcagtaatatcaactgcctcttcggtgccgcgataggtctgattaaaaactaaatccccttctacctcaagaccgctggatttaactagaatatatttactaggagctggagtagcaactgcatcttgataaccaaattgcacgtgtccttcaggagtaactttaagcattgctacggtagcaccgctaccaactttacgtgcaagggttaatctgctgtacttgtctgagttctctgaacctaaatcaaccatcgttccattagggttttcgacttttaagttagcgttaatagtcaagttaccggtcatggtatcgccagcacgagcaacagcccctaagtttgtacgagcagcatccgctgtacttgcgcctgtaccacctttagcaatagacagaataccatcagtaccattgtcaaggttaggtttattcatttcgtcatagatacgaatagccacactctcaactaaaccttccggagcagttgcagaagttgtgtaaccagtaggcagataatactcagtataaccagcgatagacagcagagcaactttaacaccaccaataaacgcgcgttgagtaaaccacagctctaaaccctcagaggtacgaaccagactataacgcatttggttagtgttatcaattccaggatcgccgattcgacgaatttgcagataagaactaatgtttgcgcttgttaatgttgcgggaatgcttctagcgctacaatcgataaagtcaatagaactgtgcgtattgccatagttaccaccattagtcaccattaattgcagacgactctggcttgatccagggtcttttaaaagagcaactttaatccaacgagtttcggtgcctgtagttacagggaaattatcctgtttaagttggcgctcgttttctacattagtcagaagagtaccatctttaccagggccttttccactcatggcataataaacctggtaatttctgaacgacagattactatcattggttaattgaagaacgccagagcctttcaggtttttaatgtatacatcgttagcacctacgcccatttctagtgtaagagtgcttccattcgaaattttaacagctttattggtggttaatcttaaatcaccaggaagagtggtattacccgagccgtcaagcaagaccaattttcgggcttcaacgttaccagcaccgcgttgtacaaactggattgtttcagtaccatcgtcaatagtaccgatttcaagaatgccgttattgcttgtaccaccggaaccgatgtaccatccatcattgctggcacatttaccgacgatatgacgagttatttcaccacttaaattctcgttggtgaaagtaatagttttaccttccgctacggtaacggtatcattaagagcactaggcccatcaactgttaattttttggtatttgtttctgggatacctttacccgctaactgaacgatcgaagaaccatttttcgtgtaaatggcataatcagccatgttgatcgccagttcaccatctgcaagctgacttgtagtaggtgttttccccgcaactgtgctacgtaggaattgaattttttctaaatcagccatgtttcaccttaataagatccaaaatctatgatagtccctttagtaattacctggtcgagccgtggtacgtgttcgggacgggaagccgcgcctgtgctcgcgaattgcggggcagttaacagccctgtcattgtatcgccagcgcgtaataccctgctattagcatttgttgtgacattatttatctgtccatcaacataactttttcgtgttgcatgacttgcgtcagtagggttagcggttgtaatactgatttgtttttcaaccgtaatattaccctgagtgtttaaatcaccatttcgagcgttgatgactaatacgcgaccattagtaccagaagatgaacgaataccaataccataccatgatacaagatcaatgttggcttttgataatcccgcgccatcaccattaccagaatataaaccgttctggtcacttccgcctgtgaaagtagcgttaatttgtagcccctgtttaaaggcaactacacccaaatattgaccaccgctttctttagaaacgaagtcgttatttgatgcttgcggtttatcgttttcagtataaaccttatatccgcgataggttagagtattaccaaccggaaccagcggaaatgtgccggagtgccaaataggtaaacccccgactgtagaaccagcttttaaatctgccataataacccctttttacatatttataaggcccgatgatccgagcctttgtttatgcatcaacttcacggaattcggaagcagaataatcgccaccaggataaaccttagtattcggcaattcaaatatatacggtgttccaccatcgatcatgctgttcattctgataccgttaaccccaaactgtgcagcaaagttttgaccagcttcggcagcagatacctgaaccatcacgaagttacggatcgcagataaactatccgtagcgggtttaggataacgagatacagcaacgttaaatccatcacaaccactagggatcgtatagaactgttcaaatcgtaaccactcatcaggtttatttgcaggaacttcaatcaccgatgatgaagtttgagcagtacccgtaaaccatcgaacagtaacccttgttgttgatccagcatccaataatgctttacttgcgtaaaaatcaccagtaatcatcatagccaatccaggagccataccataatcagctagtttagagatcactgggtttgcaacaggatacactttatattcagatccattggttgaattgtattcttccgtatcttcaacagatcggaaaggtacaccagttcgaccaacatcaccaacgttatcatagacaagatcgattgatgcgcgtgaatcttcttttaaaattccatcgttagcgtaaaacgattcaatcagtatacgagattttgatgccccatacaatgcaacatatgcagaatttgggaatctctgagcgaaatcagcgccttgccacataacggatctttttttagcaaaccaatcatcaacgatttggcttgttttgtattcaccgttagtcattatcaaatacagcccagaaggttgagcatccatatattcaacaaacgctttgtttgcagttgctgaattatcattcgataatgtgaaggttttaattggatcaactatagcattgttaattctccatacgttgataccaacactaggcggtgtgcctaccgccttttgatttagtgtaaactcatactgattaggaaccgcattgggatgtgttgcctttgcggttattctgtaagttacgctgtttgtttccgatagaatttgcgtttctacaaaatcggggccgaaccccgccattaagtttgacattatgccacccactcaaatttaactgtctgagtaactggatctgggtaaatcttaacgttaccaactttgatccaatcggtaacagtcatgtttttaaccgtagtaccaacagcagacgttgcaccaatctcgccagcagtaggcgggttgttgctggtatacatgcggccccactcatcaaatttacctgtaattgggttcatctgacggatccagaaggattgcgccagcgcattaacaccagtaccagaggtcggacgaggtgcccaaatctgataagtgaatgcagttccgttaccaaactgcgttaaagtaccaggtgctttaacataggtataacgggttacaatcatgatatccggattaatcgggtctggttcaagaaccggaaccgcataaccaggaagcaagttgtattgtgccgatgctgtgatctcagccgtccagttgcccctagatgcttctgttactgcatccagcgttgaccaagccgcttgacctgcgatgataattgaactgttgtttactgtcaaccgtccagacatcgtatcacctgctttgcgtacatacgtagggttaagcaaggtttgcgcgttcttctcagtaaagactttataagagttcgcagattcttccgctacgatgttgccagcatcagaagtcaggatcttagttgtcttatttttagtacccatagagagaacagaaccagcagccgtgatcacggtatcattacccagcgtcactttgctaatcgcctgaatttcaggagcctggaatttaacgttagctacaacgccgcgagtatcattatacacagaaagatgaactgtgccagtgttgcctgttgagatcattgcaatacgcccagaggctgaacttgcttgaattgaccagtcgttagatgaaccaccattcaaacgaagtttacccattgacgaaccatcaccaacgttcagatctccactaacattcattacccggaaacttgcgtcagcggttgaattaatgtcggcctgtacagtggttgctttcgttagagtcaatgccccgttaaccgtctgatcaacatcacgacgaatgaactgggaagaatccagattatccagtttatcagcgtcaaccgctttagcaccgatcggtagataatgtttcagcgtcaggttcaattcataaggagaaacagcaacacctacagaggcgtaaccatcatccggaagagtagaaccagccacatcattaccagaccaagtaccaagccccttagacagtttcacagtaccgcgtaccagatcggtagcttgccatgaagtatcaacctgaattgtatttttcaagttcttcggagaaacagccttgtttgcaacggtgccagcagtagtttcagtagccgtagccacctgaatgataccttctgcgctctcagtcgctttcttagcgtgtaacttcttaggggtgacaaatactgtatctaatgtccctgcgttcgtctcagactgtgtagcgacgcgtaaagtaccacgttgagtttcagttgctgattgaataccgatgttaaccgtagtccagatagtcccagattgagttaacccgtcagcagtagcaacagtaatatggcttgtatcgtccagataacctttcagtttagacggtacgatcgctttattagttacagtacccgctgatacttcggcagtggttgcaattgcaatgatacctgtcagcgtttccgttgcagcacgatcattaagcgttttaggtgttaccgctcgcgtgtaatcagtaccagcgtttgtttctgtctgagttgcaatctcgatcaaaccaatacgaccatcagtagaggttttcttgtgcagcatttccggagtaactacggtcggaatgtttgcacttgcaacagtaccgttaataacttcggtttcagaagccagccatacagcaccagattgtaactgagtcgctttatactcacgaagagttttaggcgttaccgctttctgataatctgaatgatcataaaccccagtaccagcctgagcacgatccgtattggtgttaggagcaccaccagtagcaacaagggcaaggataccagttaaggtcggcgatgcaatacggttatgcaactttttcggggttacaatcgtaatatcatcggtgcttccgtttgtttctgcctgagttgcgatttctgccaatccacgacgggtttcagtcgctgttctttcgttcagcttcttaggggtaacaatcacatcatccagatagctatcggttgaaagtttgttaacctcagcagttgttgctaaccgtgcaataccacgacgggtttctgtagcagttttatttgctaacgtcatcggagtaatagcagtttcgtcgttcgggttatcttctaggtttttgtttacttctgcttgtgcagccagagcaataacaccagtacgcgatctgttagttgcgtcaacacgttcaacgatcggacgataattagcaacaacccattctttcgtagctttcaggtaagaaaactcgatatacgggaggtaatcactagcagcattaaatgctaatgaagttacactaaaccaatcattaggcggataatctttgcgctgcgggaactgcatcatatttttgttggtgcggatcttgtccgttgtaccatctttaactttgattgtacagttctggtttttacccatcatataaagggatacgtaaacgcgatcaccatcagcaacatcagttggaagggtaacagtaacgtttggtatagtcccagaagggtttgcagtaacaaaaacgtaatcattaggaaccgcgtttaaatcactgtagatacgacgcagacgaacacgattatcagcatcatatactttccattggctattctgtgcatcaaagatgaacataccaaagccggatttctggctagttacagaagtaacaccagtaattgcgccgtcagaaatagtgtgtccactacctggataaatctgcaaaacggctacgttgatagagttcattttatcagcgtcataggttgtgatcacatcaccatcatttgcatatttcggcaactggagagtgattttacctgtagcactgttacggaaaactgtcatgccagattgtaactggaatgaacctgttccggttgcgttcacgatctcagaatcgcggttatccagagtttcagcaacacgccatacgttaccgttatagataaacgttgcgatcatgtacgggtgggtcagtcgatactgtgctgattgtacagtacgtaaacggatctgacgggtgttagacttaacaaggatactgttcacacctactaaaccaccgcaatctttaaacgtgattacgtcgccctctgtcgggttgtccggcagcaggtacagaagttcagtaaagcgtccatcagccataatgtaactaccagattcaataatgctaccgtctggagtggttacgttactataaacccatttcgggtcattacgagttgcgatccatttggattcgtcgaaagccccagcaggggaagcaatattctgttttgcgtaccagatacgacgcgcataaatgatcgccatgtcttgagaatagccacgggtcgggtcatactgctggattccgttaaattcattgaaaaagtcaacgttaacgccgtcactcagcgtattacgatcagccttcccaacgttgataactttttcaccagcagcatcaaggccacttcgtgcgcggaatgatttagctaccattatcttttttcctatattgtattcaataccaatatttatatacaaaaaatggcccgaaggccatttaactgattatttattacttccgaaccatctttttatatttcttgattgtttcgtctgtaatctggtttcgcttatatagaggggttacaccgaacgcctcaacaccacgttcattaaggatcgttgctacgatttcctgtctgataaaccagcgcttaaccttttccggaaactgttcattgatacttttaaacagtttggcttcccaactatccagcgtttcaggatggataatatgatcaaacccttccagaaaatcaatcgttgttgcgtgaatagcgtttgctactttgcgaatgtattctttattcatgcttcacccaaatactctttcaattgcatataaccgccaataaaattaccatctacaaagatccgagggtaagtaaatgccatgcttcgactacgaacacgtttcgctaactcttcaatgcggggtctatcgtaatcaaaccccacactgttatttgctggctttagaacagaataaaattcgtattctaatccatgctcatcaagtaatttccgagcttcaatacaaccataacatttatgaagcgattcgggaataccgtaaatctcgattttcatcaattgctttccttcgtgccggagtgattttgctaatgatatctttctttgtatcagaaagcatacgctcaatcaattccaccgcttcaagttgttgatgcagagaaagaaggttgatgatttcctttttctgttcatcaatagcagcttccttgtcaatcgcgtacagcttattatcaccgaaaacatgctgtaatgcaaattcaagtgcctgtgaatccgtcggcgctgatagtacagaaatcgaagtaatccgcttgacaaaaggataatcaaatcgcagatcattgatatcttgttgaacaggttttacagtcatccacattttaggatcggaagatacgaaatttaaatcaggcgcggcgatttcttctttagtagcaatcttcggttcttcttccggtaaatcatatggtttgaagtatttccagatatggctagggatctcatattcgaaatcatcttgcagaacataagcaatgtcctcagtatccccaatcgcaatacgatcgattgtaatatagccgttgtttttgatcaattcagctaaagcatttcgccaggttttttctgcaaattctttagcgtcgatgttcagggtataagatttaccttctaataattccatgtgtcacctcataaaaaagggtgccggagcacccagtttaatttacttgcttacttctgctacttttcgagcagctttgcgaaccaggtcggaagcagtacgcagattttgaagcgcgtcctcatgggctttaaccgcttcttcaagctgtaccattgcttttgcgatttcttctttcttagccgcttcgtctacattgatagcgatagcgctattaccggaaacgctaacaggttcatcaacagttccggttgccagttcacggaagaacgaacgttcagaatcaagcagatagtaaccaacaattccggtcggggaatcaatggtttctaccgttttgctcaattgatgatgaccgagcgaattcgtatggtaaacggtgtatataccattactatgttcatcggtatatgatttgatcccagggttagcgccacaacgatttttaaattgctgcggtttaaccagaacatacgaacggccttcaacaaatttagtcggatccagttcaaccgacattgccgaaccgccatcaagcatttgatcaagatctgcggttgctggtgcaacaggcgcaaccggagccgtaacgttggcttttttcggtttggctttctttttcttagctggagccgcgccaacttcgacgaaataacgagcttcccacgaacgcagagagatataagtcatttcaggaggatgatcaattttgaaagtatctgaatgggttttcgagataatttttacctcgttattcaggaatttttcgatctgcttcgcctggatagtgtttgctatgttagatccgccatgtgaattggtagtaaacccttcacggtcaaccagtttgtaagttttaccaaccacgaacgttttcagttcatttgcttgaactgtccacgggcaagaaccgcgccctgtattacggatggttttcaggggaatgttccacttccagcaatagttacgtgcttctttacgggttttgaaattcaggatcatgatattatctctcaattaaagttaatcgtcatttacgatgtggtaagattaccatagttacacattaggtcaagcaatatttttaatttctatcgaatttttagcgaattcgatcatacgttgattatctgaaccgcgaaacggctttttcgttggcaaatctttttcatacttaccatcaatcagaacatcaatgtaaggaagtagcttagaacgttctgggtcggcctgtaaagcctccagtgtatatcctgtccataaccatacgtttttctttggaagttccttagaaacgcgctcaagcagttttaggatagtaggatagttgtcacggtaaagcggatcgccgccagttaatgtaagtccatcaacatacggattactcaacagagaaatcagatggttttctgtctcttccgtgtacggtgttccgttgcaagggttccatgaactgcgattatagcacccatcacacttatgattgcatccagccacaaacaaaacaacacggatcccttttccgttgaccacatccatgttataaattctaatataattcattcaaatctccatgtatagcctttataactttttatttcaccgcgacagcaagaatgaacctttcttcacgaggatcagttctttgatccgttcaacaataacgatgtattcccatttagctaacttttgggtatcacaccacttttgaaactctttcatagcctctaagtgacctttactccagtacatttctgcaatttcgttgcaaagagtttcagtagcagtgtttttgattttcataacatcctccttagttgacaagaaggatgttactacattcagatatacaggtcaatacttttatggataatattgaatgaaaaatgaaggatgtccttcgtagttcacatcaacagcaccaattttaacgattgcatcgcggcgggtagcctcttcgacaatctgatcggttaggcttacaatctcaccggatacccaatgcaatttgtgttccggatctgtagccccacagaaaaacagttcaatttcgttagcttccagttcacagcgtagatagttcaaattacgtgaatttgttttgttgaaaatcataatattgcctcaaagttaaattatcgtatatcatcccgaatcgaatcaagaacaatgtaatctatcccattcactcgtttaccactgggtttacgatagcgaatgttacggcctttcatatcagtggcttttgaaatgtagaatgacttcgtttcgcgtagccattcactccattcctgatatgaattaccgacatttcgacgcactttagcgtataacggaaacatcacaaagcctttagtttcgcaagggtggatttatggatttcagcctgtttttctgaatttttcagattgcgttcagcttcccggatcaggtaattccggcgagagcgcaacaagttgagaacatctttcgctttacgggcgcgtttaccgaacagatgacaagtaccgagattgtcaagcatgttcaggagatcatagatttcctttgcttcatcctcttttggtaataacggtttctctttaacaacaacgtgttttttgaataattcacgatcgctattagtaaaaatgtaagattctgattcaaactttgtaccaaagtaatcagtaaaccctttaacaccgaatacgtcatactcagtaactttaataggaaatactaccttagacaaatcattagccgaaaacgaaccgccacgaatagccaagtttcggtatgcagtcccaaagcacgtatcatcacgaaaaacaaatttatcttttgtccaatacatcataaatccctcaattttgcgccgctaatgagaacatctttcatttgttttgcggtgcggatagtagttgccagttctaaagagacatcattacgatatgctgtgccgtcttcacacagaaccaaaccaggacggcccttgatagggttgatgacttcaacgcgagttggatgattttcaactttgtagcctaatacaaacgcacatgccactacatcggtcattttcttagtcagtttcataatctgtctcctttttcgataggcccaatataacaaaagccctcaaccgaagtcaagggctttttgattaattttgatgcttagtgcgatgcatcatttctttgttcttaccttcgttgaacccacggacagcgggagcacccaaatagccgcatgtacggcgcgtgacgctcattttttccggatcatggttcccacaatgggtacaatgaaaaccgtcttctgttggtttaaattcatcatcagagccacactcaaagcatttatcaaccggaaggttagttccgaagtagtccagtttatccattgcataatcccagactttttcaagggcttccaggttgtttttcatatcagggaattctacatagctgatatgtccagcagttgcaatgtaatgataatcggcttcatagtcgattttctcgaacggcgttaccttgcggtcaacgtccagatgaaaactgttagtgtaccagcctttatctgtgatccctttgatacttccgaatttctcatagtccagtttgcagaaacgatgacatagagattcagcaggggttgaatacagactaaacccaaatccggttttctttttccatgcttcggtcgcagcgcgtagatattccagaatcagtctacccatgttctgagaaccgatccggtcgaatgggtgttgtccagatccgaaaagcatcagagtttcatgcaatccgatgtatcccagactgatagaactacgcccatttttgaacagttccagaatttcatcatcgggtttcaaccgtacaccaaacgcaccttctgtataaaggatcggggctacactggctttaacacctctgagactatcaatacgagtcatcagggcttcaaaacacagttccagacgttcatcaaggatacgccaaaatgcatcatgcgcgtcttcatcttcctgtgcttcggcttcaattgcaatacgaggaaggttgatcgtcacaacgcccaggttattacgtccatcaagaatttcattaccgtgctcatcattccacacgctaaggaaactacgacaacccataggagatacaggaacgctagaaccagtaatacgacggttattagccgcgctaataatatccggatacatacgctttgaagaacattccagggcaagttgtttgatgtcatagttttgatcctctggatcaaggttaattcctttttccataaacataaccagtttcgggaatacaggggtaatgccctttttacccagtccacgaatacggtttttcagaatcgctttctggatcatgcgttcaaacattcccgtaccagtaccgaaagtaatagtaacgaaaggtgtttgtccgttggcagtatgcagcgtgttaacttcgtattcatacgattggaaagcatcaaatacgtctttttctgtttttgaaatagcataatcttttactaatgctacttgatatttgcgagcatcacgtacatgtttagcgaatgtcttctccacataaggagccaatactaaatcgacgttagcaaaggtagttccgccgtactggtgagaagcaatctgtgcggtgatctgtgccatgagagccgtcgcaacaccgattgatttcgggggttcgatgtctgcgttacccatcttgaagccattagccagcatacctttcaaatccaccagacagcagtttgtgtatggcgtgaacgggctgtaatccagatcgtgataatgaatatcaccggaatcatgcgccgcaacaatatgtttcggtagaatatggttacgcgccatatgtttagaaacgataccagccagaagatcgcgtttagtcgggaatacgcgagaatctttgtttgcgttttcgttggttaattctttgttactaagagtcatcaaacccttgatatcacggaataattttccgttttgttcacgggcgatatcacgatcatgacgatattcgatatatgcacgggcaacagtcggatttgtcttcattaaagattcttcaacaagttcttgaatttgtgaaatcttcattgctttaccgttgcggatctgactacgcaacacaagcatgatcgcggagtcagcatccgtcatcgtaccgccagctttatacacagcattgcgaattttttcttgatcgaaatcgacggttttgccgtcgcgtttttctactttcatttcgttgccttatggataatatctaaattgtgtccaatctcgttaagatatttgatcagttcaaccccgtcaacaggtatatcccgtcctacaatctcaaggagttcccacatatcaataacggtgataggagaaaaattagtcaatgtgcgaccgcgatcatcaaacatcgttcggtctttcggtttgacataacacaaatcagagtcaccccttccaagcatccaatcatgtagagatatgatctttttgtcagtggaggatatcaacatcatcagctttttcttctgttgcgttgataatcgagcgtttagatatttcatttcgttgccttcattaattgctttctatattttgcggttaaggctttgcgttcgtctttgtcggcgtactcgaagcccatagaaaccatttcggcaatcatatcaggtttggtaagtcttgaaaaccattttaccttatctggtatgaatttgtcatgaatacggttttcggaataatcttgtttcagatatgcaagcaggttttctaaccagtggatgtagtcaacatcacgggacacaagaccggatcggttgaatttgtgcttcacaataccttctgtaccgttacataggttacacagtaggccgcgcacacgtccggcgttttcgccgtctaaagcatggtcatggtcgaggtgatgtttttcgatctcaccctctaaagggcgcttgcacagagcacaacagcccccttgtttttcaaagagagcttgtttgatcgtggggtagtcttttttggtaattcgtttcgtcagcataataacaccattcagtaaggtgtcattatttattacagggtgcggacatactcacgaagttggtcaaacccgcctacatgtttaccgtcatggaaaatctgaggcatggtcatccggcgcgtaccaaccagggcttcgagttcatcgatcaccgcttcgttcagcacaggcttaccgtcttccacggaatccgcaacagatacgaattcgtatgggtgttttttcgcatccagcaaacgctttgaattcaggcatggagcgcaattataaacagaagggatataaccaaaaatcttaaacatatgttaccttacattaagtcatccagtgtttcagggtatgtatttacgtcgcgtttctggtagttacacacgtagacttcttgcgttttattttgttcgtaagaatcagtatgctggcctaacagatactttttatcgaggttatgcacattatatttttgcatccactcgatcaggatatcattttgctttcctgcatgatgtgtcacgtttgataaaccaaacttgataccccgctcatgcagggagtcaaggaaagcatataactcgcgttcgtgatctgcgttccagaatttgttatacaccgcatcagtgatcagatacggaggatcgcaataaacaaaatcgttatcgttgatttcaatatcagagtatgaaccagaacgaaattcaattcctgtcacattctttttgaaatgttcgaaacgtttttctgtcataaagttgagggttcgttttcctacagcagcgttaaaatcgcctttgtcgtttgtccggttaacgttgctgaatgaatgcaggatcaggacatagagccataaaggatctttgttctggttgtattcatcacggaatttcagatactcttctttattgtctttccccagccccttcgatgcaatcaattctcgcaccggagacaggtcaggaagcgttttaagacgctcatacatatcaatcagcgtcttatcataatcgttgcttagaacgggtttagggacgtttagcgacacactaaggccaccgcaaaaacaatcaatgaaacgcatgtatgaacttctttcggggaacagcttgaatagttcaggtaatagcgattgcttgtttcctgtgtatgggatcacaccataataactcataattcacaaagccctttttcaaattttgcaatggtatcgtacttgtaaccacgattcactataaagcattgagtttcacccaatttattgatcatgtcaatagctttctgttcgtctttcttacctcttaattgtaaggcaattcttacgatctcttttagtgtttcgtcgttgacttcttccagtttaaaggaatacccagcgattttagcaaaaagccccttgcgagctacaaggggaatgttgtcatagaaaatcacggttcctttgttgtttttgcggatactaaatcccggcacggttcctaatttcctctaaagtgtcacgggaagtaatctttccgttgacatagtatgtgatcatagcatctttccagccttccggcactttctgttccagagtatcaatggttttaaagttaacaccatcagtgatagtcatcaacaacccttttttactctttttccattcagcgccttttggacatttatacacaccagtccacacaccgttaattttgattgcgcacattttcatcgcatatttttgagtgtcgcgggtaacttcttgaagcaatccgccgcccataccaaacgcgatgttttcagacgcccaacggttagactccatccagttcaacacccgattgattgtttcagggccatgaatttcatcgccttgaatgatccttactgctgggtgtagtactttatacccttttgagttcactgtatagccaaagatacggcccagttcttcaagagcgtacatgatattgtctaccatatcaccagaatccggacgaactaccagagtaccgcccttagaaagaatcgaatctttatattctgcgatacggcgaaccgccgctttaaaatcccaggaatcatacacacatgcatacatcccttcgccgaagatctcaatactgtttttgtacgcaaggtcttcgttttcttttccgtaagaaacggtagtggaatgttcgcgagcaggaattgaaataccagccgccatttcaccatcatcaaacgctttctgacaatcttcaaacagagagatagccataatcagcgcttctacggtatcagtaccgaggaagttatacaggtgcgcgaggccaccaataccagcggattcagcagaagaggttccacgtgcgccgaagtcatgcaaacgggtacgtaacaccatatcaaatgcttcaccttctagatcggaggttttcttgagatatttcttcaacacttttttacattcgcgggatagagttgctacggttgaagggaaccatactcccctgatcgctagggtttctacgtgtcctgctaaccacagcgcatttttcccagcatggaaagttgcaaccggatttttaatcgctactggggttccttccggaatcgctctgaattcaagagggatgtaacccagttctgcaatttctttccaacctttgtagttgaagatttcgcgcccaaagtgcattttgtacaaccgattagcaaaatccacgttttccatagtcaccggacgtgataggatttgcgcaaggcggttacagccagccgtaactacttgatcaaatttaccaccacgagattcaatataaaacagcgcctcttcggagccagttggatattgcgaccagtgagaaaccttataggaatctacggaagtgatgatgctgttcagttcttcgaaagttttgttgttcataaacgtactccacgttttaggtttattttaaaatacccgatccagtcgttcgggatggattgtattgtgatatttagacttacaatccttactggtttttctgccattcgaacagaaaactttgtgatacgttgtctttgtgtgtttttctttgcacacagggcaaacaatcacagaacctattttagcagccttagccacttcatacaagttctttacatcaatttgtctttcttttgtgataacccgaccacggaattcagcaacaacagtttcatcacgtacagaaccatcactatactgaactttttgtttactactttttcgtttggatcctgatatttgagaggaacccgataaaagtttacggagttctaaacggtctttataagcaccacgattaacgcagaaatattcaccgtcttcttcgtcatcaaaatcagcccaatcttctaaagcctcagcttcatcgctcatagtggttccttagaaataatctttgttgctcaacaggtaaacccggttatcgttgtagtcaatgtaagcatcccaccaaccagcacaatcaacaccatcaacttccaacgcctggataagaacgctacccgctacgttgtcgtattcgtacattgcatgtaattcatccagcattgcttcaacattggcccgtaagcctttaccgttgttagcaacaccttttgcttccaggcaatatccagcataagttgctttcattacgatttccatgatgtttatccttctgagttagtgtcttgtctacgggagttagaatactactataaccaacccccgtcaacacctttttaccaactaatgtaaaaagtgaattcacttacacggcgatctgttttcctttcaggaatgttgaaaccgaaaacttcgcgttcttcctggtttcgatacgtttgattgtacttactagccagagaatttgtgatcttagcggcgttgcgtttttcttctgtatcgaattttagcccttcttcttccaaccattcagaaactcgttggaatgcatagcgagtacattcaatacccagacaagagccgatatcgtgcttcatatcatagataaggttttgttttgtcgcgtgtttcagaacaccttttgtgattgtatcccgcgcatgttcgatcatcttagtattctgatcgttgataatttctcttgctcgttctgcgagagtgggtgatcggccttctaccggagtttcgccgtcagtaccgatactacgtacatgaatcatattttcacctattgcgttattaacagcccatctttcgtatgtttcacgaagtaagggcgcatgttcaattaccataaaaaatccaacgttgggggtttgatattgatccctaacgtatcacacacatcgttcaatacactttctttgaagagattgaaacatggaaccctgtacaacctagccaatcttacagcgatcgcggttccacctttaacacatccttcacgttcttccgcccaaaataaaacaaaatcagttggattgtcaagattttcacgaagaacttgaatcgtgtttcgtgcataccttctttgaacgtattcattctgtgtatcgaagttacctgctacctttctggcttcgtcagcggctttctgtgtgtttaaatcttgaaagtcgatgatatcctttccgtttgaaaaaaggccgttaaacccgttctcaggaaggattatacacctgttatccggactatagtcaaacagaaagtgactatccataccaggagcgccgccagaataagccctgatcccgcgttcgttcaaagcacgtccgattttaacagcaatgtttgcgatacgttcaggaggtttacggctaccaatcagggtagccgcttttgcatcaaccagaatctgattaaaattcatgattcaggattttgccccatacagggcgaatcatgttttgggcttcggttacaaacagcttcttagccattgctgggtcttcgaactgttcgaggaaaggcccgtgattacggctgatttcttcgatagcatcctgaacagttaagcccataatgcgaccgaaatctttagcagtgatcgaagccagatccagtttcgaaagaacgtttttcacacggttctctgtaaggtaacaaacaaactcatcgagttggtttttgtctttttctgacaatgaaaccggagcattaaagcgggttgctttcttcgctttcttctcagtgaatttggttgttttgcatttgattgcaacgcgttcaccgtttggcataaaagcaggtgaaacaggtttcattacaaaaccttctgcaatgttgccctcttcaacgtccatgataggatatacgaattcgccatatactgtgttatcgctaccaatgccgctatttgctttattcaccacagattcaaacgtgatcggcagttctttgatctcttcaaaagtaccgtatcccaacagcggggccattttcaggccatgagatcgagagatcagcgagcacaggttatccggaaggaattcaccatttacacggatatcgaatacgtagaaatctttttcgccgtaatcaacatctttctgtacaccgcgccccgcaaattcaccgtagacttgaataaccaaatcatcatacgttccggtctttttgagggtttcccacatcttacggatccctggtgaatactttgcaactactgctgaacagccataaaaatcttcggctggcttcacaacatcagtacgctttgcgggggtaacggtaattccgtcatcggtgataaaactaaagttagcaccgtggatcttttcacgcgcaacccacacaccgccagtaagcccgttcataattacaccattgatgaacttaccttcataatggttagtaagagaagaatatttcttaaacataatttaacctttcattttcacacgtttttcgacttgataaagtgctttacgcagcaacttcacttttacttcatccagaatgacatcacccttaacgaatgcatctagatttgatttttcagcattagcagcattgataaccgctattgtattttcttgtgtatatcccagacgtggattaatacgttccattgtacgggcatacgggctaccgggtttattgctaaacatcttgcctgaatactgacaacgttcagttgtcatcaatactttccaatcttccagagtaaggtcaaaagaatggttgttctttgcggcgtgttcatgcttgagattgtatgaacgcgcaatacgcagatccagttcaatagcagacgcacggcggcgatgctcaatgagttcggggctaagggccacaatctcaggttcttttgctttacgaaccgcttctacatcaggagcggcttgatttggttttacgtttgaagtagcaatactagcccaacgatccatcgcagatttacgcatcagataatccccgcatcttgaaacgccagcgccatagaggtgttaagatgttcgcgtttaaacgggcgaggtttcttttctttcttcatcggacgtttagcacgttctaaattgtacacacgcttacgatggatttcgatcgcttcgcggcgcattgcatttttaacagggagatttgcagaacggaacgcgcggatacgttcaatttcctgtactacctggtaaatatcgccgttatctaacccatgttcacgggcaatttcggcataacctttacgcaaatcattgaatttgaaatgaatttgcactttttcggcttgagacagttcggaaatgctacggtgtacaattttcatattattttcctttggtagaatcgatttttgcaactacattcaacacgctatcgtttcggatgtcaacattttttagaacaaaagttactaccgtatacactccagcgctcatgttgaaattgtcaacaaacgggatctgctgatcatcaagagtattaaccatttcttccatgtcatttggatggtcaacgttgatgaaaatactttccgatacatgatttttgtatcgagttccaattcgttcatcgagttttttacacattacatcaactaacatttgtttgtcaatgcctaaaacaccagagtagatcacatgatatagtttcatacaatatccttttccgattcattaacaattgcaaaggaaaggaatgtaaaagcaacccctaacccgaccatccagatagccgttaaatcaccatacattgatgaatacgcgcccatcacttctaagcgatatcccagcaagaaaacgagatacgccaacactttatcattcataattcctcacaaaacgcccatgctgcatggtaaacgctcgcgcctttgtcttcgttcatgcatacaacatcaaccggacacacaaccctgtacagaacaggatccccacctatagaacgtgcggcccttccagcatatatacgagctaacccgatatcagcggtaaagaaaacacggtctaaatttttctttctgcccttttcagacagagtatcagaatcacagggaggcaataacatgctttcaataccagcagcagtacacgaaccgtgataataaacaacgttttcatttctgcaatgtatcgttttcatgtatcctcccttaaaaagatgcttacattatatcaaatggataaatccatgcaagaaatttctcggtctacatcttcttttgttttgttgacatacgccaggtattcatcggtatacattttccgctttctggctattctttcagcagccgcgcacatttgagcttctgacggtttataaggcaacctttctccaaatccttcaacagttagacgaacgaaaggaaccgcagaagttataatgtcattaccatacgcataaccatttttagtaaatacggctttgttgaatcgttcatggtgtacgccttcaacctcaacctgatcaccatagtaagcaatagtatcaatgcgatggttaagaatgatagcaccagactcaatgattttcagtgcagcggcctttccttgttcgcgagcataagccacgatttcataagaaccgatatctatagcggaaccatgattaccaacgatgtaaaacatggaattaattaggtgcttagagatatatgcatacgttttatacatctgatactgttcattacgcagacacatacccgctttgtattcacgtcgtaactgcataaggttttgaatcacttcatcaatacgccatccgttagggaattcggcccttttctcacgtgcgatatggatcaacgcgtttccatacatcgcgttaaacgtcatgatccggatcccttcaacgtaaccatcgataggggcttgccatgtaatagggctatatatcggatcgtggtcaggacgcattttaggggtatggtggcgaaggaatccaacgtgagccgcaaaaagatcttcaatctcacgggagtaatagttgtaagagtccatgtcacggttgcgggaaaattctacaatgaagcgatgtaaattgattttcatatcatataccttatggtttaaagttcttccggcctatccgtcgaacaccctaaccatacaccactgtcagaaagcatgtcaataaataatagaaaataaactggagaattttacatgaagtcatttaaacaattcacagaaagcaccttaaccgaagcgctgatcaccttcggaggccgtgcttatcctaagttcggtcaggttgttattcttgctggcggtgctggttcaggtaaagggttcacactggaaaaactgctaggcatcgaaggtattaccctggacgttgacgccctgaaaaaacttgtaatgggtagcgataaactcgcagcagagatcaagaaacaaacgggtcatgatgtcaaaacaatgaacctcaaaaacccagaaaacgtatctaccctccatcatgtgatcgccgacgttttcaacatttccaacaaaaaccaaaaccgtgtttattccggtattatggcagcaccagaagatcgtaaacctaacctcatctttgacgtaacgttaaaaggcatgagcaagctggcaagcatcgcgcgtgatgtcgaaacgctgggatacaaaaaagaaaacgtacatatcgtatgggttatgaacgatgtgcatattgctatgcagcagaaccagaaacgcgatcgtgtagttcctaaagaaattctcatggatacccacgaaggcgcggcccttactatggcgaagatcctgaacatgggtgattctcttaaacagtatatggacggcgacatttggatcagctttaacaaagttggtgttgatagcgagatcaagaaatcaagtaacaaagggatgtttgttgttaagtcaaactacatcaaagttaaagcccgtggtaagcctcagaaatctgtagctgaactggataaggaaattgtggctaaagttgcagcatacgcaccgaaaactgacacttggggttgacattaatgattaaacattatagtatgcatacacaaactgaggaattgatatgaataagtttttctttgatatggatggtgtattgttcgactgggaaggttcatttgtgccaatgtatggcgaaccctctatgatgacagaagatgagttgaaaaagtgcaaagcaaaaattgccaaaactgatttctacgaaaatctggaaccaatcaaagaaggatttgaattattccatcatttaagaacacttggtgatgtagcaatactaaccagtgttggtaaattcaattctgacggtgttgccgaacaaaaacgtaaagcattgcaaaaagtattgggttacgttccagaattccactacgttaaaagtagccatgaaaaagcagcattcgctggtaaaggaattctgtttgacgatcgggcaaaagcggtgttgcctttcagaaaagcaggaggtaaagcaatcctctttgttggtgataagaaaacagcgcttgatgaattaaaaagattgtaaaagaaagggaaccattgcggttcccttttttgttattgattagcctttgcaagcgcttccgtgactagctgaatattttcttccagggtttccgcaaggaaaataccaggaactttattagctagatgagaattgttccagatttcaagatgtttctggttgcgggaaatcagaacaccacgataggcatattctgcgaactgttccggatagtcaatgcgactaaaatcgagacgagggatccccagttcagcgcaaatcttatctgtatagttcagtttttctttcataacccaaagagggctgaccgcttccgcgcgaagcagcaaagtagcaggatcaccgattcggcgttggaaactccattgaaggaggtcaatcccagcctgaatacggggaaggtttttataaaaatcagtacgcaccaaagaagccgccatttcgtcatatcgttcttttggcgttccttccggacgtacaccgaacttatcataaaaagtctgagaaaattctgctaaagtgtcgtcgaaatcaaaaagaagtgtattcattgtttgccttattttattggtcaggatctggttcaggagcaggagtcaatgacaacagactaaccagtttaccattacgagattcgattacatgaatatcaccataatcttcaaacgcctctttcagagtatcaaactctaatttatatttttcttccgcataatctcgccagtcgtcgcctttctcaaaagcatcaacgataatatcgtatagccagtatggaagatatgtaaaactggtatttctccacggaataggatgaaccgtagtccatttttcagttgccatttaaagcctcttagatttcactcattttatgaatatagccgtttcgtgaatcctggatctcacattcaccgttttccatgaacgctttcaggatcgtttgtacttcctcactatacttgtaatcagcataatcagttttccaatctttaccctgtgctttttgatacagaatttcatcaagtacccaataaccgatcggggtaaagctggtatcacgccacggaatcgggtgaaccgtccatttagaaacaagatcatcagaataagtggtcacggtgattgtatcagacgtggtttctgttgatgattcttcatcagcaccgtgttttaagatcagggtataatcgccagcagttgtaccgtcaaccgtagttgtgtaagtatcggcggttgcgcctggaatatctacaccgtctttttgccaacgataggccagaaacacatcacccggatctagttcagtagtttcaacctctaaggtcaaagtttcgccaatcaaaagttcgtttttgttggcgctaattgttacagaaggaattgccataaatttaacctcttatgtttattggtatttatagccggagtattttaccgttacacgttccgcatttgtcgtagccgttaacacgtccatacccattgcattcaggacaaaacggagtagtaaccccgaaaatgttacggatcgcataagtggattgttcttcggtcaacccaacaaacccatcagttttaataaaatgttctttttgtgaagaaagcatatcggtatcatcatcaagaatgagatagtttttacatccgaaagtatcgatccatgccttgatttcatcaccacgcattccagtactatgagggaagttagtgcaagttttaccaatgatccgatacaatccccacggataaaatatttcacgtagattatgggtactgttgccgattctccacgtagaggaaatgacgatatcacaattagcgtgattcactatccggcgtaagtgtcgtgcgcattcgatgtccatatgttcaccaaatttcatgcaccgcatattatttagaacgccatcgatatcaagaaaaataacgttaccaatctcgttaccatcgctcaaatcttttaaacattcgtgatttaagttcatatttcacctaaaagaaaaggggccgtagccccttgttaatcaatagaatccgcgagcttcattatccagtctacgatctgcaatcatatgagcttccatttgacgagatacgtaatcaggatcacactccattctttcttcttcgtagttgtcccaggtatcagcaacccatttagaaccgttccaacgagcataaccaggttcggcatgaacaggataatttgcttccgcagcgtggcgaagtgcttcacctacagtgtaataaggagctttagaattgacgattttcttaacttcaccattagtccaaacaaacagaactgggtagtaagcatttttcatcatgttcattttgtatttccttcttcactgcgagagccattcccccgccttcgaatacaatatactcgaacagcagggtaaggtcaactactttttaaaattattttttgaacgtgtcgaactggctatttctggtttcgcgtacagtaaccatcccatcacggtgcatgtaccatgccagtgacttgagggtttgacgcgctgaataatgaggacaaccatcagggtgcttataccaatccggattttgtttcatccaatcatagatccaatacggacacgtataaaagccagcattcgaaacagagcggcccatcatgatgatagacggggtaaacccttccatccatgccagttcatcagaaaccgtctcagaatcgcttgtaggagcttgtagagcgtcgggaacaatttcaatctggtcggcaatttccggagcaacatcaggaacagatggttcaccttcgtatgtaacaatttccggatcaggggagtcgatcaacagttccggtttttcttccggtacggcagcttccagatcagcaagcatattttcgaatgacttctgacggttcagtttgacatcaaacgtttcttgcgcgtaggtagcaagctgtaatttggcttctttttgttctaaggctttgaaaccttcaaccttttcgtaatcaatactcattgtagttctccaatgtttatcattatttagcctataaatattcatataaaccgtatataggatacacatagtggatatcgaagtcaaattccttaacactagtcatgtgcagattcaggcagaggctaacatagtctatgaattgcgcgactatttcagcttccagccgccaggttatcagtaccaggcaaaatacaaatatggtggatggaacggctacatatacttgatggactataacgggaaactgccctacggtttagcctatcttgtaacaaaattcgcggagtctcgcgggtattctatctggatggatcctaagatccacgaaacagaagaaattacccagccagattttgacaagtggttagaagaacacccagtatacgacggaaacaagcaaattgatccgtattggtatcaaaaacaatcggtgtttcatgcgattaaaaaccgccgtgctgtgcttaacctcccaacgtcagcgggtaaatctcttattcagggattgatatctcgttggtgtctggaaaattacacaggcaaagtactaatcattgtcccaacaactgcccttgttgatcagatgatcggtgatattgtcaactatcgccttttacctcgcgaggcaatgcttggaatacgttcaggaactgctaaaaacagtaatgcattgatctacgtgtctacgtggcaatcggctgttaaaatgcctcctgagtggtttcagcagttcatgtgtttgatggtggatgaatgccacaaatcaaccggacaaagcatacagaagatcatcaacacaatggatcagtgtattttcaagtttggcctttctggttctctgaaagaaggcaaagcaaacatgatgcaatacattggcgcttttggtcaaatcttcaagccagttgatacaaatcggttgatgcaggaaggtcaagttaccaaccttcgaattaataccatcttcatgagatataaagaggatgagattaagaaaatgaagggggctgattaccaaagcgaaatcaagtatataacatcgcataccaggcgtaacgcatggatctgtaagctggcgttgaaactggcaagggaaaaagatgaaaacgtgtttgtgatgttcaatcagatcaaacatggtaaatggctgtatgagcaactcaaaaaggtatatgacaacgttgtatacatttctggggaaacggggattgatgagcgaaacgaaatgaaacggatcgcggaatcaacgaaggggctgatcgtaatcggttctattggtgtactgagtacaggtatttctgtcaagaacctgcatcacatcatcttcggacatccttgcaaatctgctgttatagtcaaacagtcaattgggcgcgtactgcgtaaacatgattctaaatctcttgctactgtttgggatttggttgataacttagcaacgctggcaaagtccaaaaatgctaaaaataaatattcatacaaaaactatggtatgaaacacgcaatcgaacgagtacgcatttacaatgaagaaaagtttgactacgtgatcaaacaaatcgaaatttagaggtcaaaatgaagagtttcaacgattttcgactttatgaggcggctattgatgatttcatgagcaaggtcgcctcttgccgtactatggacggccttaaagagcttgaaaaatattacaaaaatcgtgtaaaagaagttgatgttgcgccgtcagacgatatttctatgcgcgatgcgctgaaaggtcgagccgaagaattaaaggccgaactcgaaagcggagaagaagaaaagttctaaaaaaagccccaaccgaaaggaaggggcttttaattttgggacgcaatcagcccaacacgtacatttgattatagccagtgaggtactattctggctttttttactcatgcccttgatcgaaggtatattatcaatcaccccgccgaaggtaaactccatcggacggcgcaaaagagtacgcctatcatccagcattcttttatcaagcccctttcgggtacacatgtatttaggacgcgattttgttgcctccatcgcccgttttgcctccgtaatggggaactatgggatccaggcaaagaaccccgtacaagcctcattcattacgcataatcggtttgtcatgcctatggcatagttttacctatcctaaaaatcaggatgttcgtcagattctaacagatccggacgttcatcacgatctgtaattccttcaccgtaaggaatcataagattctcctacagcaacatttgaacttcattcagatcatcggattcgttgatctcgccgttttttgttttttctgcgatgtagtcagcacagatagtactacacacgcgcccggattcagtcacaaaaccagtagaaggaaccggacacttgcacactacacatttttcattttcagtagacattatgcaccactttctaatttacggatctctaacatgtttttgatagagtatcctttgtttttgacgatatccagtgctttgctggtgaaatctaccaccatgtcataatactggatcagcttgttggtttctacaatcttcggatccccagcgatcgcgattttgatttcagtagtcccagtatacaccacttcgcacatttctttgtcatgtcttccggtgtagtacaacatacgatccttaacatcagcttcttttttcgcatgaagttggatcagttttttcttcgcgtttgaatggtaacgaagccatttagcccaaatcttagggatatccgctgattctgattgcaacttgaggggatctatcagcatatccttttcaagttcattttgcagatcttctaatttcaaactcataacatactcaccaatttacccagttgatctataatatactatattaatttgtagtcaaatttaaattgatctaatataatatattattaaaagaataattatacatgatctaatttataaaatcaaatttatttttacttgatttcaaaaattatttgatctataataattataattaataaattttatcataaatcatttataaattcaagatttaatattaattataattattaaaagatggagtaagtttccctactccacctattgaatattatccccgttgggttatactatcaacccagtttaggaagttttatacccacaatctgactcatcttagatttacctgagaggtttacccagtcatcacctttcacaagtctttcgtttgcagcagtggtatatgggttaaccgataaaccgtagcgcatcagaatagcaactttaggctgtaaggattgaggatcaacagaaatcttgatcgaacctgcctgatcagcttctgtgtatggcgtatagaacagagagccaacatgatccatttcacccagatcgtacttgcaaccagtcaacaggtaatcaaacggtgtattggtgtcagtatagacataataaccgtttttaagtcgccctgtcgctaacgggtgggtttcatcggtttcatgcatccaaccagacgcagccagaacgcctacaacgcgagaagaggccaggacataggtagcttcaaatgaagtcgttctattcatttcctgccccatttcacacactaattgatacaggaaacgacctaaagccggagcatcctttgcagtgtatgcggttgtagcatcgaaaataccatttgtgaccacaccatcaacgttgtaacgatttgatacgttgatcagagtctgaatgatatctttgtttacttcttcactggcaacagtacccaaaacatcttcaatcacattttctgcgttgaattggtttgcttccagatcctgcataagttccacggtcatttcagttttgaatttacgggaacgaacgttgatattccaacgatccatttcgaaagaagttgtactaatatcttcgctggtttcatactgacttgttggcgcggcttcgcttgccaggcgtaatttattgctgaataatgcgaccataatcgcttcattaatatcagcacctgcgagagttacgctatcagttacttcgtatacaacatcacttgtcgggtgtttgaaaacttggcctttggtgtaggcagtaccaaccgcaccaactggaatgttatcacggcttgcatacttaccggaataggtagcagcgctggaaaacgtcatatcgcctttagggttacgataacgcacaccgaacagagttgcggtaggtaaattagtttcctgaatcgctacaagttcaccgtagatcaggttgtttaccgcacgggtaagagataccagatccggacgggtattagctacgttaattgtttctgttccggttgcctcatcaagaacctttttagacaggccaggcggtagctgtgactgacgcaccagcttgttaattgtgtaaaatttttcactcattttatgttcctgcgttattgacaaacttttctttatttatgtaataaaaaagggaaccttgcggttccctcttggaaaagttggctattacagccctttcacataaaccttgcggaagtatgcgtttttaccgaacatttctttggtaatcataccagaagtgatacggtcggacggagcctgagagcgagagttcgcaaacgggttgatacctacaccgtaacgagttttgaagcccattactggctggaagttcttcggatcagaaccacgcagcggggtcagcgcaacatacggagcgtagtagataccagcatccatttcgttatcgcctttgtaacccacggtgaagtaatcaccacgtgcatactggtcgatgtatactttatacacgccacccagaacaccagcgaatactgctttagtggtgtcaacgttcagagtcttctggagaccttgacctgccggagtgataccgctatcgatacgagccagagcggaaaccacgttacgggaagcgatgatgaagttaccagcaccacgaccagtttgacgtgcgatttcgtttgcttctttgtcgatctgaatcagcagagctttgtagctttcaccagcccaacgagcgccacgaacatcaatcggatcctggaagtcaaacgcaccagctttagagccaacggtctgagtgaaaccagttttaccaacctgtgcggtatagttgatcatgtcaacgatttcgcggttgatttccagcatgatttcggttgccagaatagcagacagttcggcgtcagcgtccataccgtgaacagcgcggagatcctgagccagttctacagagtactgtgctttcagttggcggctacgtgcttcgataacctgcttatcgatacggaagcccatttcgttccacgggttgctagtagaaccgttgaactgttcttgcagttctgctacactggtagccataccgtaagaaatttcagccagagtacctttttcctgttcggcgataacagcagcatccagagcatcgtcggtagaaccagttacagtaaccggagcgccagaaacgttctggaggaacacacgaccagtttcaacgaaatcgtggaacacaatagcgccgtcagcaatagcctgagcagaagtcagtttggtaaagccgttgctcggagccgcgccctgaccggagtacatgctatccggggagaacatcggatggaatgcttctttagcaccggaagccagcggatctttaccgtacactgcgcggagagcgaacacctgaccagtagggccagtcataggctgaacaccgcagatatcgaacgcaatcaggttaggaatcgcacggcgaaccataccgattacagcagggccgatgttggtgatagcaccgcttgagttaccagaagcgattttggttgcgtcgtaaccgtggtcaccagcaatttcagcttccgccaggaaaccaccgaaggattcaacgattttctcgtcgcggtaaaccggatcaacttctgcgtctttttcctgtgcttccataatggcagcaatcagttgttttttggatttggtagcgatatccggtaagccttcctgagactccagaagatcgttccatttttccatcaattcgtttttcttagacattgtttcttaccttttgaaattaagaaagggcttttgccgcttgtacatatttattgatcttggatttctctgccggaacactttcaactaccggaacaaagtcatctttcgtttgcggagtatttacagactcgtcaacgggtttttcagctttggttgctaccatttcaacaattgcgctgagtttattttcgaaggttgcggaatattccagcccttcaatcagagattctactttttcgacctgagattcggtcaaacctttagttttctctgaaactactgcattgcgtttcatttctgaaatttctttggtcagttcctgattcgcttcaaacagggttttaacttcctgctgattctcagtcagttcgtcttccagttcggcgactacatcaacctgttcttccggaatgacaacgttatgttcaaccagaacttctttgaggcccatgatcagggattcaaacaggtcggctttgatgtcacgggaaacggcttctttgttttctttcagccattcttcggaaatgtgcgcaaaatatttatcagcatcttcgtacagcttagtttcgatttcagcggcacgttcagttacctgagcttcgaccagttcgtcggaacgttccgcgatctgggtaatgtgggattcagcgagttttgcagcgccagcttttacagcttgttcgaatacagtggtgaatgtcgctttcacgtcatcagaaagttcaactgattcgaaaatgctgtctaactcgaccggagtatccaggttctgggcttccgccagcagttgttctttaagcatttttgattttcctgttgttttgtttaatgtatttatagacctttcaaacgctcggacaatgccagaaaagcgtcatcagcactattattctcaacaagcggtttgctttgctgattttccactataggcttaacatatgcatcaggtgcgcttggcccccagacgacatcaacgcctacagctaatttaaagcccttttgtacaacgccgtagcctttgccggaatcggagagcttacctaatccacgggaagaaacaccaggaacccaaccagcacgaatcaacgccgccagtttgtcaccatcaccaccgtcgccttcaacaacaacagcgcggccccaaacatcgttacccttccaccacaatttttcaatcaggatgcaagcatttcgcggatccacattcgggcgcggagggtgattcatttcacctaatgcttgacgggtgttaacttgagttctaatataatcgttaactgcttcttcaagtacgtttttaggatacaaacgacggttacggttaaccttttcggcttgaaggaaaataccttcgatccgcaatttaccgtcttttgattccccaacagattctaaaatagattctgaaacgtcaccgcaaggtaaaccccattcttcgattaaaagcatatcgccgttttcgttgatttgggattcattcatatttatagccccagtgcagcacgtttacgcaatgctttcttgcgcttacgttgtgcgcgagtagcaattgacgggttagcacgttttgttttgagagcacgacgcgcgatctggcgacgttgggatttagttaatccggtagtctgatacgcattacgctcacgggttttcctgtctttgaggcgttctacgttgccacgggaatcaacatgcttgacaattacctcatcaagtgttaaaccttcaacaaccgccatcatagcaagggctaaatttggttcggtgaccgccaaattttcgatgattttaaccgtgccttcatcgatacccagaatatctacacgggctttcgcttcgtctaaatgttcctggagatcttcggcggtgatttcgatgtcaagttgcatttacacacctcactcatcatctttatcggatttatcatcctcggctggctttttatcgcccttttcgtcatctttatcagcgccttcgtcgtctttttctttgtcttcttcgccttcgatgcgtacagcttcggcaagttcaacgcgtaattcgtgacgaagcgcttctgtgcggtcttccatgatggagtaaaaagtttttttagcttccaccagattaccgcttttgattgcttcgataaattctttcatcaaaagttttcctcttccgcttctggatttttaaaacgttcttcttttgattcttcttctatctgtttggcttcgctttgaatttcctcatcagacatccggagaacttctttcattacgtatttatgggagatatatttgccgaccaccccttcaagttggcccatcaggtttaaacggcgttccaaaatctcaatatctttgatttcggaatagtaagaatcttgctgatatacaaaagcaatcttacttacgttttcatcccattcatcttctgtaatgattttcttcgcgatcaagttagtttttaacggatccgcaagaacagggttgaattgaatttgcaattcgcgaataaatttgctaaagttcaattcgtcgcgggtaataccgccatcgttacccaactggataccgccatcatcgcgaggcatacggcttaacggaatacgtaacgcttcatacagcttacggttaaaccatttaacatcgtcgatatcagagaaggcagtgccaccaggaagcgttgaaacttcggtaactgctttaccatcacgacgcatcagccaatagtcctctgtcattgacaggttattttgctgattcttaactttaccagtgctcgcgtcatatacaacacggttttttaagccctgtgcaatgttatttacgtactgtgtagctttagggccacccatctgacctacgtcgatatagaacacacgacgttcaggcgcacgggtaatgcggtaaatcaccatagcatcttccagcaaacgcaactggttagctggcttgacagcgcggtgcaggtagcctataatgttgttgtcgcaatcttcaaggccgctatgagcgtaaacaatcgcagagcgaggaatttttaccttgtcattgtgactataaatctgtccgttgtagctataaccgtttttcggtgcggtgtatacgaagtattcacgatagccacggaaaattttaaccccaccgggtagggtttctgtaaccgattctcggatcagttccatgcaacggggatctaactggcgcaattctttgatgccgtcagcttcatttttgtgcatgattttatggaaatagatacgcgaatcaacataccaatcacggaataaacgagatcctcggttatcgaaatcgtgaatattcattacggtatcgagttcttccatgatcttatcttggatatttttactaaaattcgttttagtaagatccatcgtaacaatatcttttccttgttcattaacaatcgcttcgttaatgatttcagaaacagcgttttccacttccggatatgtcatgataccacggtatgtatttattagctgtgttttgttctgaattcgcggatcctgtccggaatagaactgttggaacacagaagaataacgctggtttgataagtccgtttcgatttcgtgcgccccatcgttatttttcggaggcgcaatcgaacctgtatcatcttttaattgggcttcaaattccatttcatcctgtttggcgaaatttttgaaaaaccctaacacattgtctaatccaaaaaagttcatttacaactccgaaaaataatgataaggggtattgctacccctgtatttatagcgtttaaacccaccagtctagcgcgaaagtacactcaaaagtgctcacttcgttgttgctatcccagtctaaagtaacctcaccaacgttggtcgggaacaggccataaatggtatgttcggcggttacttcgtcgttacggtttttttgtttaaccgtagcggtttttttgtagtttgcagggatatcccctgtaatgtcttcacccataccatgcagcatgtttgaccatgctacgattgcatcacgggttgtgtgtgcatcgtcgttatataccgtgattgtccagtcatcataggtacggtcaccagcaacgttaattttgcggttcatgtaacctaccggaactttttcaacggtagacgctggcatagtagcggctttacattttaatttaaagtttttgcccaggtacgggatctctacttcgaacaggttcggacgtgcgaaatcaccggattcaaaggcgcgtacaatatcagtaagcattttctaacctctatgtgtatttataggggcttttcagccccttacatgttatactgacgttgatccaatcaactcatcgaaatccgcaccagttgaggttgctacgaagttcagtgtgatgtagttgatagaacgtgctggtttgacgtagattgatgcaataaactcattgcgatcaataacatccggcgtgttgttcgtagtgtcacaaaccacacggtaatcgtatacaccgcccagagcgcgaacgttagacatatactgtcctgcatccatacggaaggaagaacgagtgaaatcatcgttattctcaaacagtttatattttgcgttatcgccaatgtctttcttgatcatgttgaacaagcgacgaacgttgatacggtcaaacgggcttggaacagtcgttgcggttttatcaccgtacagaatgtatccagcaccaccagagaaaccagtaaccgcgttaatctgtacctggtacatagaatcgcgatgcgcgttagtcggttcgatagccagtttgatgcagttacgcagttgaccacggttgtagccagccggagacatccacggttgcgatacctgatcggtataaacacagaggccagccatatcacccgcgagcgggatccaacggttaacatcgttgtatttatcatactggaacttatagttaccgtcgatgaacgcataacttgaacttacgttcatgttgttatcaactggggtagtattaccgattttgtagcctgtacgccattctacgaggttatcaacggcctgagccagtgggatattaaccagagcagaacgcggcggagaaacgaatacaacgcaatctgaacgggtttcaccgatagacacagcgtgtttctgtacagtagacgaaatttcggcagtttcgccagcacaagcaccagcaatcagcagaggaacatgcagagattcacgatctgcgaacatatcccaaccagccatgagttcatcagcgcctacagtggagtttgcagaagtaccgccgcccagttccagaacgccggagaatccgacaggccagtttagggacgtaccatacagatactgcgaaccaccgtttgcaaagaaatcatccatgtagatcgttgaaccgtagatatctttatcacctttagcggttgacacgataaacgtttcttggataataccaccacggcgaacgataaacgcgtattggttatcattctgagggccaaagttcatcgaactgcgaccgctgtttttaccagacttaccagaaggataagacttaatgacagccgaagaatcgtatgcagctttagacagaatttcaaccgttacggtgctacccatttcgccaggataaattgcaataacagacggtagcttgtatttggtgcaaagtttctggaaagcagttgcctgaatagtttcttttgcggtgtcaaggttgagcagagtaatacccggatcaacttctacgccgtcgattgtaatcgtagcagaaacaccagaagaactggaaacgatttctgtagtccagccactagacagatccggatatacaccaacctgtttagcgtgtgcgatgatcttagtgctcggaatgaacacagacaggactttaccctgatcatcaacgctggtaacaacaccatcttcttcaataacaacgttattgtgtttaactttgatctgatcgtctactgcatagttagaaccagcagcggtgatcgtggttttgatctgattatagatcgcggttgcgttttttgcggcttctttatcgacgacacgaacaacacgcagatcctgaccgaactgtaaaaagtttacagcgttcatgaaataatcagcggtgtcattgtctggggagccaaaatagtttaccagttcgacttcgttagaaatctgacggatctggtaagctggcccccatgaaaatttaccaacaatagcagcacgaccagttgaatttcgaacaacggtagattgtaccgatgtttctttagtttcaatgcctggagagattaaagccattattaagtttcctctaaatttatataaacgaaataccgtgttggccgacagatattgtttcgtcgccactcgttacgataacaggacataacatatcttcataaagcagttcgcgctcacgtgcgaatacctcatttgccaaccgcaaatcgtctttctcgcaaaattctgcgaatttcatttgtgttgttagccatgcaaagcaaaccagcgccataacgagatcgtcatggaaaccttcttccgcagcccacgaaacacctttttctgagaaagtacgaaattcaagtattgtctttttgttatttatgatgagtttatctttctctatcaagtcttttagggttgagcatccaatcgctttcgatcgtttactttgtttcatccccaaatcattatagctatcacaaataacgttatcataatccaactcagaaaacaaagatttagccactgagtggcctgtgctatttagctcgatataaacccatgcttcgttgtacatcataagataacgtaacaggacatcaggcaaaataaggtgcgatgttttgtttgaatgatatacagcaacctgttcaaacggcatagatgtaatatctataatatgcatcgcgtgatagtcctgaccgcgcccttcggctgggtcgagtaccgcaatatatttatgtccctctacaggagctttatactgataaaaattagtttccgtttcatcagtatcaacccatgagagttttgacaatttccagccagcgatcagggttccgttggttcccatgaattcagcacaatgttcctgtaaaaatgcttctttacttgaactggcgatcatcttcgaagaccatgaatagccgtcatcaaatacgccatcatcaccgtctgtatacaaacgctctttaaccgatgtccagatcgccgtgtatggtacgaagccggattttccttctatagcagcgttccagatatcatagaagtggttaagcccgttaggtgtcgttgtgataaggattttcgatttacgaccagaagaaattactggctgaatcgctaaccacgcatcaataaagtttggaataaacgcacattcgtcaatgtagatcattgcgaaggagttaccacgcaccgcatcgggagaagatgcaaacgcaccaattttacatttgttatcaagttcaatagaacctttgttccattcaacgataccaggttgcaagaaatcggggagaagttcaatcgcctgttttgtacgatccagaacttccgcagacatagaggctttatgagccaaaacgccaacatatttatcctcgttgaaacacacaaagtgtgcaaggaagatagcaacaacggttgttttacccaactggcgagacaggttacaggcaaccatacggtttttatgcatttcgatcagcatttcgcgctgatagtcacgcaactgaaccttaattgtaccatagtcaatgtgggtgatcgcgcaatatgtttcagcaaaataaacaatatcatcacgacatttaacccactccatcaacatctgttgcgtccatttcgtttggatgtacgcgcgtttcaggtttgggtttccgttatatcgagttttcttgtttcctttgtttttatacgtcgcaaagtttgaactgtctttcgcttgaatatcaactttatggataccgttaatttttaggtaatcgctaaactttgtcggataccattttttatcatgttcgctttgcgtccactccatcccaaattcatcaattttctttttcagataatcgggatgcattaatccgattgggtgatctgattccttactcggatcgatcgtcggttccatttccatcagggtttacctctaccgcttcaccattaatgaagccttcttttggttcgtatgcactaccatatttctgcattaattccgtaggggaaccaacaaatacagttgcattctctatgttcatttcattaccgccgccattacctttttcagatcctggttttgttgtttcttcggtaatttctcgcatttctttatgaattttcatcaatccctggttagaattgtttaactgattcatcagggttgtaaaaacttcaacgtgtctcggagattcagagtttttagcgttatgcaaggcaatttgtgccatatccatgatcatctgattcatgtaatgcgcggttttacgcgcaagtgcatagtcttcctctaaatcaggttttcgatctgctgggtgtgactcgacatcaacgagttcgagtttttcatatacaaccatttcttccccagtttcagcaccagggagattttcaagatcaagtagttgttttacgctaaattcttccattattggcccctcggtttaggaggttgatcaccgctaggaattgggatatcattagcatacgtttgaatgtattcttctcccgtgtaatcctgtataggcatatcagccggatccacctgagcatcaacggattcgaaattgtctttgtccaacgggttcatattggaaaagaaatccgtgtatactgttctgatctcgcctttaatctcgttaacaggcggatacaggtagccctgtaattcaaacattaaagaccattcaatgtgtcgccgtgtcgttgcatcgccttcaaacgatgtatcaggggaaacagattgcagagatattttaatatctcggtctattttaatgtcgtttttatgtaattctgtaatacgacagttgaaatgcggctggaagtatggcagtatctgttctatgatctgaaacacatcatcttcgtaacgggtatacactcccagttcgaacatgagacgatacggagcagggttaaactgcgttactgtttttccaggtgcgcgtaactgcgtcattttttggtttaccgcgatcccagttttacgaattgcgttatactgcaaatcaacgagggatagattcatacgcggtaaaattgtttccgttttagcaacattttcctgactgtatgcatagttcagcttgttcatggatgccaggaatttttcttttgatgcgtaggtaatcggaaccttgataaatttttcttgttcgccgcgaacgcgtttaacttgcacgtgattgaaaagacaacccatcaagacaatataatttcgcagcgaactattataccagtagccaaacattttctttttcctgtatgggttaaagcgggtataagatttctcctataccctacatgtatagggtttcccctggttatatttatgggaactgtgcgaacggtgatccgcgcccgttaacaacatcaaacgattcaatgaattcatcaccttcatcttcaaaggcttgatcttcttcgtattgttcaatattggtatccgccaacccatcaagatttcgaataggttcgagatccaaatcagcatcgggagcaaggttaatcccttcatttcgttgcagtttaggatccaattcttcgccagtatagataaatttaacgaggttgattttacgttgaggacgatcgccgaactggaagaacgggtcaaactcaatccatgtaatttcaaacaggctgttatccatagggaaataaatcaaatctcccagaacagggatcccgccatcagtttgatgtgcaaataaacgaggattgatcacaagtgtcatttcatcgtttgacatcataccgaatttactgtaaaaatctctctgcccttcgtagtttgcatacgaatcgatgtatgctgcaattttccacgattttgtaaacttcgattcacggtcttcacccaaaattttatcaatattaacaaattctcgacggacgtaatacatatccggagatttcatttgaattgcttcggctgttagtgaatcatgtaactgttgagtagggttatacttgtaccagttaacatacgggtttgttacttcttgtcttaggttccgatcgacgccggaaccatcttctaactgtgcaaacagactttcatcccaattttgcatttttcctccttacatcatcaacactggaagtgcatcagacagtaacagaagttcttgacggaggttttctttttcttgcatagcttcctgaatcagtcgggttccatccggagcaacaccaccaggtaattgcataccctgaaacttagccagcacctgaccgtttacctctttaacaagagcagttgcgtaatctttcacccaacggttgttatacgcagaggatgaaccctgaacgcttgtaccttgaccagccttcacaccgcctgagacggctttgtaggggttattgtatatatctgctatagttggcttatcttcgccatcagaacccgctgtagcgtatccagagacgttaccgaccatactgggtacatcaacaaaggatctgatcattgcttcgataacaacaatatcaccatctttaacggttccgtatactgcaaactgtcctgtgtcgtcgttataccagtaatccggaagcggagacaggagatcttgcattgaccgctgatagctcatcatctgggtaaaatagcccatatccgcgccgtatgcgttcattccgtaggtacgtgatgcacaaccaccaccgcccagagaaccaccagtaaggcccatcaggaaatcagtaaaccacggataaaccgcagtaccatccatcgatacaagggaacccatgttagtacgcaacactttagtaattgcgaaaatatgttctttactcagatcgaaaatatttttcgggttatccggccccagggtaagaatgatataccctttgttagatccattgtaatgatattctgcatataggtctaatgctcgttgaatgcagtcataaacctgatctgttgtcacttcgattttgacgatcggagcacctaagcggcgcagaatttcatcttttaattgtgctgggttgttcgtaatcataaagatcctcaaaaggggccgaagccccttgttaatcgttaagcgacagtgatcgccagttcatcagaaacgatgactttatggcttgcatcagttaccgttactttgtaggttccggaatcagaaggctgtagcgaatcaatggtaaatgtgttagcattagtaccaacatttacgccgttcttcgtccactgataagacagcggagaaacaccaccagtcatagttacgcttagagacaatggatcgccagtagtatattcagtatcaccagttaggttagtaccgaatgacagaggcgggtttttgctctcataacggagatcagcgtcagcttctttgatgtacagagccagtttagcattcagatcttcgatagttacgcgatctgcaagtgcctgtgcaatgttcaacgcttctaaatcctcaacacgtttattaaggtcggcaatcagtgcataaatgccagtttcgttaccttctgcgttatcgcctacctgagtgaacaggttgcgggttgtctttttcaaaccagcgcgagtaacaggatcggaactaacaccatcaccatagatttctttgttaatctgctggctagttgcaacgaggccactagaagagttacctacaatgccttgcagttcccagagtgcgctagtgttggtgcgcaattcaccctcaacaacactcaaacggcctttgatactggtaggatctgaatcttcaccaacgtcaccagttaagatcgcaacttgtccctgcaatccatcatcgccggattcacccagaatcatttccatatccatcaatctgcgtttagtttccgcaatatcataacggatactaccctgagcagaagccgtaccgatttgaccgttaatggttgcaatttgtgcagtgataccagttaccggatcattgatttgtgtagccagagaactaacggagttttccagactgttcacacgatcgttaatggaactggttgaacttgacgtgcgaccgatataactattaatcgcatcaagttcattttgcattacaatagaaccatcctcaaggatcttgattcgcgcatagattgatcgggttgtggcaagaccagaatcacccatttcagcacgaagttcttttacctcttctgtcagttgtcctacttcggaaagcgcccaatcatcttccagtttggttatgcgagtttcctgcatagaaatagcacgttggttactcagtacgcggtatttaaggccagtaccagtagaagaggggtcaacatcaccatcaacgttaaatccaggatatgaaccaacttctttcttaatgtaaatgatatcattacgaattgtgcggtgtttaggatctttttctggatcgtattcaccaatttcatcgttttgagcatttacagaaagggttaactgtgctaccttgttctgtgtttgggtgttagataaagttaatgcccgaacatcctgatccaactggttaacttttttgattacgctctcatcaccaatagcatcaatgttttcagtaatcaagttaacctgatcgattacttcgttgattttatcattatgggtgatggtattttgttctaactgaaccgcgttctgctggatgtttacaccagttcggttaagactaccagtgtttgacactttatctggcgaaccgtccagagtttcaccgtttttgatccaaataatcttcgtttgagtcgtggcgtcatctgggacgccatcaacaaacgggatcttcggcaacgggtttaatttgtcgatgatcatttaataacctctattgagtacgaattacgtagtttaatgcgatgtttttcatgcgggtttcttccccacccacaccagtggctttagttatagaagcatcaaatacgcgagcgctttggtcattcttttcggcgcttttcagttcgtaaactgcttgccatttaggaatattaccgccgttctggtagataagctgtaatgggtgttcatgccagcccaacatatcgccttcatatgtaccatacccacgattagggtttagtccacgcccacggtcatgaccacgtactgcaacgcctcgacaatctggaaggttaaaccaatcaccgccaccaccaaatgtataacctatacgctcaaaaagtaacggatagttatttttattcagtgagcgaccatcacaaatatacaaactaccgtggtcagtctgaaaaccagtcatgacaatagcacctactgggaaatgccaatcaagatctgtccacgtctgatatttgttgttatatattgcgctattctcataaagagaaccgttaattaccgcatttcgatcactaggtaataccgcagcgtttgaagaaagtgcagtgtttgccacataaccaacagttgttgctaatttgacaacaccgaactgagatccagttgcacgggtattgattaattttttcgcagtaatcgctttggtgtcatcagtacccgcgtttgcttctgcctgtgatgcgatacgaataacgcccaggttgctttcagttgcagttaaacgaataaacgtataaggtgaaattgcatacccttcacggatcgtaccagcctgaacctgtgcaactgttgccagttgtaccaaaccttgcgaactttcggtcgcacttgactgaacaggaaccagagacgcgatcgcttgcttgactttaagcggagtcatagttacagtgttatctgtaccagcaacagcctgtgcagtggtagcaattttagaagaaccccaaaccgattctgtacctttacggttattgaacacatagttcagagatcgcggagtaatagacgatgcatcgttagttacggttgtagattccgcatcagtcgaatacttcgtataaccccatacggtttgtgatgctttagggttctgcatacgatatgctaacagtttcggagtaacaatcttattgttatccgtgccagcgtcaatatcagcttcggttgcgatctgagcaataccacgaacagaagttgttgcgataggaagcccagtatcagtacgcgcccaactacctattttttccaacgcatcttgtacgttggttatggtatcaggccaatcagtacctgttgggtcaaatgtcacgtaaatggatttatcacttacgtggttgattgtattgttactcatgtgttatccttatgcaattcgtttgaagtaatacacggttacttgcggagtaacattaggtaagaaaccagaacccaacttaacccatgaaccatagccactttttgcggctacgtcgatggttccgatttgacgaataccgttttcggagatatttgttgccgggtgcgaaacactatcaataaatcgacattctaggatcgtaccatcaacacctttacggttaacttctgcgaaatatttttccgctgcaacaaattcagtaaatttgttgtatgccgtttcacaaacagttgcggcgttagtcccattatcaaagatgaaaggaaagccgtacacgtgaactacagcctgttcttggtctgaatcgatgttctgtacaataccatcaaaagaaacgctctcaacctgctgtacagcgattggaggggcatcctcagtcatggtaacaacgccgttaatcgggatttgctcgataagcgtatacaggtcatcaattgcggattgtacgtttccatacagaacaccgcgttttgtttggtcaatgtttggttctccgatcgaacgtttaccgccgatcagaggcaacttaccataagtatcatactgtaagtaatctgcttctttagagaggacgcgagcgccctcccttgtttttgaaatatttttgtaagccattatgcaacccttatccagcgatgtgcagtcatatacggtggaatagttttgattttatcaggtaatgtgttaccatgattcactttcaatgtatcctcacggtatttagtgtatccagggccagaagcatcaggatctaactgacaaccaccaatgatcacagcaccattttcatcagcaataagaactttatcttttgatacaagttcaggaacgttgatgattttgatttctgtaccacgatcgccaccagtaccacctgccgtatgactcggttgaccaccactatctaaatcattattgtttaatgcgaaatcaggatccgttgcatttgatgtccagccagccaggaaataaccttctgcgtaacgtttccaaccaccaaatcccatataatcagcagggtttgccgggttgtgtgcgttttcatagatggttccgatcgggtggataatatcaaacatagcctgaatatccagaatacgcccctgataggtttcccctgtattacgcattgttttctgagaagggttattataatcggtatattcgatacggttcgtcaatataacttcttcttcgttattgagataaaccttatcagctttttctttaataccgccagttccttcccaatccatcagagtaccaatatcattgttaaaccaacggatcgttacaacgtcgccggattccagttcctgagcaaacttgattgaagtcactacagaatcagtgaatactaaactataatcctgtcctgacggaacccatacaccagagttaccaacacacgtactttcatcaacaccttccgcaccttcacaggaaaacgccggatagtcagcgtcaccgcctttaaccagttgtttaccgttgagaagcagttcaaacgagttagggttaatcaacacgcgagggttaacaccaaattcagcaggtgtaaactcttttttggttgccagatcacctacccactgttcaccaggaacggtttccagagaagtatcaccagtctgatacatgcgcatcacatacgcttcatagctcgaacgccatgttgctaacccatctagataggtaacaaattgaagcgtgtcaccagcgttacacgggtttttaagacgtactgaattaccatcaagtgcaaccagttcaccaggagcagagccaatcgatccatagtctgagttatcagcattgaatccgtctttctcatcgatgaacagcaagttaccgcgatagtaaacttcgaacgattgcaggttgtattcattaccaacaccgaatacgttagggaagtcagtttgtccctgagtagcaatatacgtttcttttgctactgttgccagatccgaagttgtgattttgtcaatctgtttgttttcgacgtattcccaacggcccggagaacaatacaccaattccacatccataaaatctttaaacagatctttaggagttggggaacctttgatagtatcaccagttgcggggatcagtctaacgttgttggtagcccaacgcgaccacacatcacgcagacgaataaccttgttataatcgcctacgccgcctttcgggaggtttacggtgattttgtttgcactggtattcaacgcccatgattcaccaaattttggtgatagcgtcgtacccgcaaaagttttccaggcacctgctggatgggggatctcaccatcccccagcatgttatacaattctgtaaagttgttgttagtcttttgaccacctcgacgcaggtaatcgcctgtaccatcgtctacaatctgacctattaaaatttcttgtttcatgacgcgatccctgatttaatcgtatctattgctttaatcgtgaatttaattcgatcttctttgatcgcttgcacgttagcgtatacgacatcaccagcaccgacagtaaagtttaatgtaaacatttcatcttcactgtttttcaaaatagcgtattccgttgaataaatcgttttgtgtacacgatccacggtcattaaaacttctgccattttggtaactgtaccagctaagttttctgcgtatacaagcaccttagccccgctaaattcgctatatccgaacataggaatagcagtcgggtttgctttcagtacaagcgccgtagtgtcaacaggcatcgttttagaaccgaacatagattctacagaataatcccattttgttaccgcaccttcttttttggtacaccagatttttacaaaggtgtaaggtgacgtgatatacaactggtctgcaacccccgcgatagtatccccaacttgaggacgaaacgcgataggacgatcaacagagacactacccgtactatttatgaagtagcaaccttcgccaaccttaccagaaggaagaacaacggtaatcgaacctgttgaagtatctatgtcatgcagggaacccagttcgatcggtgtgcttgaatagtaagtgcgtggtagtttctgatagtatccggtagcatggatcaccatgttaccgacaccttcgtttgcagacagcatacgcacatcaccaaacgcattataaacgttggtgatcatttcgttcagtttaacaccaccatcataaagcgggtcgcctgttgatgggttgccgatttcaccgacatcaattagtttttttgctgtttggtaagccattgtttttccttagaattcgaatacaatactcacttcctcagtctgatcaagggagcgaataataggttgtctgttttccatgtaaatcatacgtccggaatcaggttcaagcgcgttagcattatagtaatcaccagttgctttcttttcaggctcggtcgggcttgcctttttaatcaacgggtttacaataatacttatctgacggaaccctttgttaccaggaagcgtagattgcgggaagaaaagagaatccatgtatgcacgaaaacgcattgaattcaccttcaaccgatacactagatcgtattgtcctggataccattgaatcacgttatcataaccccaacgtaccggatcctcttccagttcgccagggaaaggaactacgatatgttcatttgtacagcggttgatcacgacatctggcgggattgtgtagaggtattcccatttataaccgtctcccatgtcgatcccgttagcttctccgcgtggaggttcactagattcatgagacggactccagataccgccgatcctgatacattcaagttttccggtaatgctcgaaatggagcaagaaccgatatcaggaacatcaaccacacgataaaccatccaacctttacccggatcagtacggttataaggtgcggtgtttacaacaacaatatcgttaaagtaaaagattttcgggtttggataacgagtatcaccccagtctttacgtggtaaaattgcatctatcatatcaccaggaactttagtagccccgatcatatgcgtccacatatcactaacaccatcggtgctatcatttggatatggcggggcgaagttagggtcggattcgttatccgaccacgattcagttcgtccaatagacatgtaaatcgtgtttagatcggcggcatcgccgatcatatctttgaagttcatcaagttttcggttcggaattttgcagtaattaccgaccgatacaagttttgttgtgccatttaatttcctaccttaatctgtgatggaggatttggatcacgtgggtttcctgcatcatctttcagtcgtttatccaccaaattacggaactgtgaatatttaacgcctgagcaatcgaacaacggactttgatcgaaccgtcgcgcagaaggaagaacaccgttaagcggtttttcttcaatgtcatattccggaggtacatcaaaaggttcccccgctcgcgggtgtacggtgtacagaggttcaccagtaaccaggtcgaattgttggtttccgttaccgtccatactcgcaatgcgatcaggccagaacttaggataaccactatcgaagcggtagtttctcagaatatcaatgattgtctcgttatgagtcattgacaaaccagagttgatgaatactgttaacatcgtaatacccataaagccgaatcctaccggatgaacaaacctcaatacgtcatccttataacgggaagtcggtagatttgaacgaattttcatcacatagtaagatcgtccacggttgatatagtcgatcgagttgttagccatttgtttaccgcgaacaccacgaattaccattccggtgaaattggttttttctgacttgacaacctgcccttcgataaagttaccttgagcattatgcagagtcattgaccaacgcaattgaccattttcatagtcacgttcgatgtatgtaacgttagcgcgtccagttggtgtatagatcgtccggcctacgatatcctgactgatatttgttgaactaaccaaaatatcatattcgagactgttggagctttcgatctcaacggaaacatcttcgttatacagcaatttaaacaggaacgtataacttgcttcgatcccttttgttgaatagaaatcacttgcacgtgattcgaaaaatctaaccactgcctcacgtttggttttatccaggtaaatgttacggcggttgatttcagaccacaaatattcaacgttgtttttctctctcggatacttgttccggatgaggttcagcaatttgttatagtaactgttgcttcccaacgaaatgtattgcagatagtattcaccaaatttttcgaactgttggttgtccagatagctttgcggagcaaaacgagtgatcatgtgactcagatcagggtcgattaatccaggttcaatatccggcgtatatgggttttcacgttcctgattaaccagacttgccaccattaaagtgttatcgggtttccagaaaatagtgagttcatcccttgcgcggtatgacagttcatagaatccaattatcctaccacctgagcgatacaacagaacaccgtttgtgtacttcgtaaaaccagtaaacttgatattattcaagtagatagtaactgttcctttgtcccaaacttcatggtttacacgaatcgttgacgcaggagacgcgctatcagtaaccagagtatacagggtttccggataaaccaccagaggacggttatcattggtgatccatgtgctaaccttatcgcggaaatgccagctaaagtttgcttcattgtagtactcttgcggcccaaagttccatactgtaggatcgttctgatttgcacgaactgtagcaaagttaatcgaaatgctcgcagtataaccaggaacaagatcgtatttcaccgctgaatgcacatcttccggatacttttcaaccagatctggatctggcaaagtgcctggatatttgtagttaccaacagaaatgtaaacttcatcgccattggttgacatattggtatattcatgagtgatataaaaacgttcatcttcggttttaccataaacacgggtaaacgtctttgcattctcatcccacagataaacgccagcatcgtttgatgggatcacgttagctttgacagtcggatccatcatcgccgttttaacttcaccagttaccagaacgtatagacggtcattcagcacgtccatttttttaacaacaattttatcatttcctggtacgatggtatatgaaacttcatcaaaaatacgttcaccaaaggtcggcgaaccaggatcagtatcaattggtgtgttacgtaacgcaatacggcgcataacgttcttagcagccacgtagagccattcattagaacaagctatagcttcggcatacttcgacactcctcccggtagacgcgcatatgtgttgtatgaatcaacatcaaaatctaaccctgactggttccccagcttcgcaaacgttacatcatcagaagaaaaacgaacttcatcagaagaccaacgaatatctgttgacgtgcgcccgtaaaatatgcgatcgtatcctaacacatacgtagtgttagcgctctgataagcaacggtacgggaaaccggattgcctacacgatcgtttaatgctttgtagtaataccacgtttggcctttgtcatttgacactttagccatattctgaaaacgttcaaacaggtaaagcaatccgtttgagtataccaggaacgtgcgatctatatcattacaaacgtgttcgatgtgatcttgaatttcatggtagctttcttgtttcaggatcttatcgctgatctggcttacatcagaatacaggggagagtatacaaaatcctcaaccatcagagaagccataataacatcatcgttaaaatcgacgtaatcacgattgtttttggcgaatttttcattgataaacgaatcagcaggggtgaattcacgcatggttgtatatgcgtaggcgttctcatcaaacgtccataattcatcgctgatcacccaatcagaaggttcaaacccttcatgagttgtttgaatacggaatttataacgtgtatttggggcaacctgatcgctaaaccattcgttttcgtagctataacccaactgcgtccagattaactcttcgtctggaataatagttccgtccatatcacggctacgggccaattcaaccacataatagaaatccatgccaacatcatcccatttaagataaacgaagttagcagccagcttatcaacgcgcaaactcgtaatcgaaggcgctttaatcattatatttctccaaatttgcggttatgtatatcacgtatttataaaaagaaaaacccctatccgaagacaggggttaacgattattgactgataggattcatagtcaatgtggtgtattgaggacgtaggtcattttcaaacacgatcaacgatccatcgcgagtaaaaatggtttcttcgagaggctttgcggttagctcgatataagcagcactgaaactatcggcggatacgttcagaacgcccagatcaaagctaatgaaatcggtataatgagacaccgatcctacttcgtaatatttattacgggttcctgcatctgttaatttttcaaagtcatcacctgtataagcagcgatcgaaatatccccatccttgaacgggcctattacaatttttgcgttaccatcctgatccatttccgtagaagcataacgaacaacataactttcgtcttcttcgttggtgaacttgaacgtactggaaatgattgatttcgattccacctggttcaagaaatggatcccagacataggagcactgtaatagttgtcaatttcacggagcaatttaatatctgcttccgaaccgataatagaagtatcagactgatcgacataagtcaacatcttagatacactgaacgatttgttgaaaatttcaacgttgtcagtatagtaagagtcgatcgacgaaataacctgaccgcgtaaccattcctctgattccgtcaacttactgatatcatacgttacttttacagattgcacaatatacagatagttaggatccataatcgacggggtgatcgtcgcgaggttatatttcgaaagatacgtttgcatatcttctttctgtaccgatgttaggcgtaaacctgactttggtttaacagaaatgaaagcataaccaggtttttcgttatcagtaaagcactgtaccgcctggatgatagatccaaacctgtgagacaggaaggattcataatccgatgcagttacacaacggcgttgtgtttcacgcataacaggggctagttctcgaatacgctcgatatcttccgggtcaccaccaccatcagcaccgacataatcaggggtgttggttgggttctctttaatcgccgtgatgctaatattggttaatgtatcgacatagataaaatcttttgcaccgttagccgcttccccatcggttgacagatattcaataacgatagtcgaaccattagcaggtttcaagcccccgatatattcggcggttagtgcgccacccgccacttgttgacttgcttcaccttcaccgaaataaacttcggtatgtccatcaacagtttcacgcatgtagtaaatcgtgcttgcgcctgttgcgtttacaatgctttcgtttgtccagtcgtcccattgtgcgccgtttacagttaaacgtacctgactacggtcaatgtttggatctcggatcaggatactcgaaccgtcataaattagttcagtacgaactaaacggccttgcaccaggttcagcattgatgtatagttgttattactatcacgaacgataacaacgtcatctgatacaacaaaagaataactgtctgtattctttacagtaccgatgaattttgtaccgcgcgggatacggatcgatgttggggtcagtgggttagcagccgtaatcataactgctgtacttgcagccgtgcgcgaatctggcatatatcccagttcttgagcagactgtacaacagaactacgcaatgcagccgtgcgaataaacgattcaaatagagctgtgttacccatctgctgaatataaagagtagcatacgacagaaggtcgatcagtacgttcattcgcgagccggaaaaatcgtaatccttaaactcttcttgtccacccagccaatcaatcagatctgttttaatttcttcgaaagtacccccgataaagatatcggggatttggttaatctgttttttgacagtcttagtcttagcagtagccattattataaattcctcttgatcattcgactatttagtatttcagtactggaacacatacactaatagaaccaaagttgattgctaatcctatgagagacagcaatttattcacatattgtgtgactttactcaacgccaacgtacaaatttggttatagattactttgcagtgatctttaaaagagcgcgaactatcaatgaaatttttgtacagagactgagcaccagtaatcgcattttcatatgacttgagaagatcgtcaaatgcgacaccacagaagcctaaaaactcgtttattgtactcatcaaaggcaatttctttaattcttccatcgccatgctgtatgtatctttcattgcgtcttgtagagatccaatctgttcctgtatagcgtcatacgcggcctgtgttgcagctacagcagcgtttgcagcatccaatgcagattgataagccgctgttgcttcgtctgttacagcgccccacatccagtttaagtactggttgaattttctctgaattgcatcacgttcgaaaatctgactttttaacgttttgtaaagttcctgcccctgttcataaagccctcggatctgttcgtatgactcatcaacaaaagccttgactttttcctgtgcttgttgatacaaatccattgcagtgaatccagggaagttaccgcccagaattatatcaagtggtttgatttgcatcatgatgttacggatagccagcaccacagaccataacgggtttgggacttccggagggatagcccatgtttgcatgatccgaccgtataagtcgattaatgcaacgcaaccgttttggaacatcgttaaacaccaatcaaataacgcgctacaagcatccacaaggtcgcgagcgccagctttgacatattccacagagtaattgtatgcgcttcctatggccccgtatattgcgtttatgacggtttcatatgtttgttgtccggatttgatgattgcattaaacgcatctttcaaagtctgaacagaattatcaccaaacaccagatcgtaaatgttgatcgcaacacctaagatggttacttgaggcaagaactgattaatcaatccccatgcaccaccgataatgttaaatgcagcgctaatcacttgtctgaaaactttcatagcagtttgccatgcttgctgtgacaatgcgagcgcccccgccattacttcttccatcgatacggataaaccatcaaacattgtcgcgatcccgaatccattctgtacagcacccgttaacatgttaaactgtagcttgaacgtattacgggtttcgttccatgcctgtaacatagcatcactgatatttgtatatgcgaaaccaacagttgccggaatgcacgaaatatcagcacggcttaattcactcggtaatgccccataagtggaaggcattgcaggaggaacaggaggaatgcttgtatctgcgttggtgttaacctgcatacccgtatatttgcattgatgcgcccctgtttcatcatgcttcatataggctatacgattaccattccaataataatcaatattggtgaatgcgccagtgtcctgattatacgtctgacgtatgcgagcatcacatacagggtttgttccggaaagatacccaccactgttttcgaccttatacatagccagttcgccagggtttttgtataggtttgattttgacagatccgcgccataccaatcattaccaccattgattttagttgcaccaatagatgtaatgtaagcatcaatttctgcttgagtgttgaaataatagccaatcttcggaacaaggatccctgttgattgtccggtatttggatctgttcctggtgaattgacaacaggtagatccgtgcttctatgtccgaatggttcttgagtataaagatgagtaccgattttgattatctcggtatcccactcaaccccaacagccggataattttctgtatgcccttgccagataacccgccgataatagccagcgg

SEQ ID NO: 4 - DNA, 178765 bp, Unknown
  source: /note="Description of Unknown: colon-1 Bacteriophage Sequence"
cagcgacgaagcctatgcaaaatggcgacaaaaatacgcttgattgtcgcgtcgtaaacaagtataaaggtagctgggatgtcgatattcagagaggtacgaaattcggcaatcccttctacaagggaacacgggctgaaaacataatgaacttcatcccgtatttccaaaacttgattcgaactggcgtgatcacaatcgacgaactgaaagcattggacgggaagcggttaggatgtacatgcaaacctctaccgtgccacggtgattatattgctcactgcgtcaatgtgttgaccggaaaggtgaataagttggatatataatggacgatgtaacatttggtgtaatatttcctttgcgtctgggttcagacaagaggatagaccggagtttcgttaaatgtggcgaattccggcattgtgtatattttattgaaatcgacggtcggatagtgtatgttggaaaatgtcgtgatttgtggaagcggttagacacataccgcaattcgaaatactggcgggaagcaaaccccagtaatattctgaaaaccgcacgtctggaaatggcaatcaaaaaacgtaagcgtgtaaatcttatcgtgacaacacacgatgaagacacatatcatgattttgaaataaacatgatccgaaaaatcaatcctgaatggaacaaacagcactatgacaaagctaaccaaaaatcagaaaactctctttgaccagttgatgaaactgtgtaacgaaagcgaatgcttctacttcattgatcaaaaaactgtgatgcaaaccaatgttcgcatctttaactatcgcatggcgagctattccgactggttaaaacccggtgctctggaatgtcgcggtatcatgtttgtgatggatggggaaacccccgtaaaactcgccagtcgccctatggagaagtttttcaactatgccgaggtaaaggcatgggaagcgctgaaagcctctcctgtgacgattggtgaaaccgtagtggatgtgatgattaaggaagatggttccctgatctccaccttctgtgattccggctatctgggcgttaagtctaaagcatccgttcaatctgaacaggctatggacgctatgagcgtgatccagactaaccgcgcattgttcgatcgcctgaccgaactggttaatgatggtttcaccgtcaacatggaatacgtcgcaccgacaaaccgtattgtaattggctatcaggaaccagcagtggtgatcctgaacatccgtaataacgacacgggcgaatatgtcgattatcaggatatcttcgcagatggtgtattacgtccgttcctggttgagcgcgagaaaatcgaagtcaccgatcttgatgcgttcattaacgaagcctacacgaaagaaggtttcgagggttacgtaatcaaaacagaaaaaggtttcgtgaaagcgaaaactaactggtacgtgaaccttcaccgcacgaaggatagcatcaacaacaataaggatctgttcttaaatattgttgaaaataccgtcgatgacctgaaacaaatgttcctcgatgatatgtacgcactcaagaagattgacgcgttcgaaacgttattccttgatagtctgaatcgtctgactgcaaaagcattccaggcaatcgaagacacaaaaggcaaatcacgcaaagactacgcgatcaccctgagcgcagacttaacccctgacggtcgtatcatcttcgggcctatgatgcgttatttcgatgataccgataaacaaaagttagtcgataacatcgttgcattaatggcgaagaactacgaacagtttataccggaagaatataaatgacaaagtgctttggcgctggaagcacaacgttagaagaagagaaagcagggatcgattccctgcttctttacgttgacgttttcccagaaaccggaaaaattttttggaatagcaatgcagcaaaacagaatcagggaaaagaagctggttctattatgagcaaatcaaaaccttacgtgagaattcggcacggcgatagaaaatatttaagacatcgcataattttctattactgtaatggttatctgcctttgcttattgatcataagcatgggttggaagctggggatggtatagaaaatctacaggaatcagatccgcttcataatatgctgaaaagaaaagctaaatcaacacctaaaacggttaaatccaaaggtgttgattacagggcttcgcgtggaaaatatcgagcacagataaagatagacgggaagcaaaaacacatcggttactatgataccgaggaacaagcatcaatagcttacgaggaagcgttatatgaatatcaaaaacgtattgggtacgtttaatataagttcgtggatatggcctgtaatagttgctggttcgttagcagggcttttgtacatgacaatcacgctgaaaagtgaaaatgaccaattggctaaagatatcaaagagttacaggctgatatcaaaaaagtcaaagagacaaacaacaccaatacggtgatctatgtcgaacaaaaaggtaaggatcagcagttggtcaaggatgccggacgtaaagatctgctgttcaagaaaccaggactgatcgaaatcaagatcaacaagtccttcgaagagtatatggcggagtacgacaaatgaaaattgcaacgttagcccttgttctgggcgttctgttggttgggtgcgcggagaagccgccagaaaagattttgcctacactccccgctaaggtgaatccggttaatgtgaaatggaaagtggttgcagaagtccgagagattgacggtaaaaaataccttgtcatgccttatgacggaaacccatacgttgccctttcatatcccgattcgttaatcttccgtagctggatgaatgacgttaagcgtcagaaagaccagacggataacattctgtgtaccgtgggataccctgagaaatgcaagtcaaaataatcaagtcatttttccgtgacataaccgaaggaaaggtttatgatgcgaagaaggacaaagaaggtctctggatcgaaaatgactggaaccgtgatatgtggctcaatctaacgaatgagcataacaaagaactgattgaatatgagattgtgtaatgaatctgtttattactgtaggtgtaccaggtagcgggaaaactacatgggcgaaagaaaaagcacgtcaactggggaacacgctgactgtttcccgtgacgatatccgcaaaaccctttactgtgctggcggtgatctcactggctatcgcttcaccgaagagaaagaactgtttgtttgccgtgtgcaagaagatacagttcgtaatgccctggcgagtgggaagaacgttatcgttcacaatacccatttacaccaaaaagatcatgatgtgtggcgagagatcgcgaaagagttcaatgctgatttccatatcgaatggattgatgccgatatcgtagaactcctgaaacgcaaccataaacgcggtgtgaatgctctacctgtttcccgtgtctgggcgatgttcgaacagtaccgtaaactccgtggctgggttccggctatgagctatgcagatccgagcaagccgaaatgtgttatcttcgacgttgacgggacactgaccaaagttggacaacgcagcccgtatgacttcacaaaggtgatcaacgatccgcctaaccctcctgttcaagaactgttcaggatgtataaggccgctggttatgcctgtgttgttgtgtctgggcgtgagggtactgcacagtgcgcacatgataccgctgcaagcctgatcggatacgatgttgacctgagcgatggtatctacatgcgagaagaaggtgatcatcgtcacgatttccacgtaaaagagcaaatacttgttgaaaagattctcgataagtattatcctgttcttgcagtggacgacagggatacgccagtcgggatgtggcgaatgaacggtatcccatgtttccaggttgattacggcgacttctaaaaaacagttgacagtgagtgcgggtgtgataagatacccgcacaaacaaaggagaatattatggttattcgtgaaaatgaaaatgtgatggttgaactgggtgatcgtgttaaagttgagaatcctgttgaacttcaactgaaactcaaccagttaggccagcgcattgctgataaaattcctgctggttatacagtgaagattgtccgcgatggtcagttctccttccttctgggtattctgagtcaacgtaacatcgttgaacaacagttcgggattcagtggaatccggtaactaaattcgtaacatgggcggcagtattatgagtgacaaaatcagaaagattcatcaggcatggctctgtactgaaccaacgatgcttcgttatggttgtgtgtttgggttggttgataatgatcctcaacaggacattgcaacaagtccggttgttgaatacgcgattccggcgaacaaatcgtttgttgaagtggtgacacgttcaggtactacgtatcacatcgtcaaccctgataacgatttcatcaaagacattctgaaatatatggatgaccgttaatgaaattcaaagtaatgaatatgctgagagcaatcgatcggagtcaacgttctcaatgtatttcgaatcgtgtaggtgctattatcgcgattggtggtcgtgccgtcgcgtggggcgaaaataatacggttgaccttgattgtcgttgcaactcatgcaacaatcatatggtgaatgatgacggtaaactgaaagcggttgatcgtcctgaacattcagcatggtcaaacgataacgaaattcatgcagaaatgaaagcgctattgagtgcgcacacaagaggtgttatactcaaagacgcagcactttacacaactgcatcgccttgccctaactgcgcgaaacatatcgaatggtatgttgctaacggggcgattacatcggtgtattatctcgataaatacgatcgtggtaatgatgaatggatttcacgcttgcagaaatatggctgtgtcgtggaacaaattaaacgggaagagttagaatcgtttatcgacttttccaaagtagtgtttaacaacaatgagtaaagaaatgtctgaactgaaagtaaaagcatccggcgaatatgtgatcatcgaagctactgcgcgtccgcagggttccgaaatcaaatctgaatctggtatcgtggttggtgtacgccagcacggggaacaacctttttatggtaaagttgtttctgtaggcgtagacgttccagcagaagcggcagaacgaatcatgggtaaatatatcccactgccaagcgctcacatggcgaatgttcctgaccctgatctggttgcgggttacatttccgaaaaagaagcaaaagagaaggaaacaaaatacgtttccgcacattacaaagcaatccaggcaatctacgagatctaaaatggctaaatcaattcaagcaattatcgctgatactgtcagcaagtccaaaaaactgttcgacaaaggcgaaattctggaagcccccgcgcgtattgacgtaatggcagcaatgatcattgacgcgcatcagggtaaactgaaatcccgtgccgatgaagtcatggcgtacatcgtccagttcgaagacgtatgtaaatacgcgaaagatgttgacccgctggttcgcgaaatttatcgcaagcagttctaaaaattccggccctttagcttaattggttagagcgggtgactcataatcgcgcggttgctggttcaagtccagcaggggccaccaaatacgcaggtgtagttcaattggtagaatatctggtttccatccagattgttgagggttcgagtcccttcacctgctccaattcgggtgcgtagcgcaatgccgttaaatggttcggaatatgcaaccttatcgtatgcgataggctctgttggtatccggtaataggttccccggaatgcggggtgaagtaaagaaacttccagcccacaaatttaaaagagaaaaatatgaaaggtcttcaaaagctgtttgagttaaccccaaaaattcgcgaaatcgtcgctgcatcaactgaaaaagaaatcaacggtaaattgatgaaactgtttaccgaagaaatcactgatttcgataaagaatatcgtaaagcgttcgatgcgtattctgttgatggtttctttgcatcaccgcaggtgaatagcaaacacgaatatcatcgacgattctttgactggtcgatcgtcaatatcgttcgtcgaactgatatcgaacctacgaaccatcagttgatctctatagattcttctgtattctttatccagtaccttatcactggtggatttaaagcagaaggtatcccgttctgtaacgaagctctggaagaagagttcgcagaagcgtataagtatatcaaagcagttcgttaatcaacaggctatcttcggatagccttttttctggagaagcatatgcgctttttgaaatacgcaagctggcttgtactggttcccctggatattctttcgggtgttctggctattctgctggctcctttcgtggttccgttctacagtgacgaaaccggacacttacctaaagggttccgttggatggaaacattcgataacccgatcgatggtgatggtggacatatccggcgttgggctaacatccggtatcacttaggcgatctgggtgtgtatgcgcaacgtgtaggctggttgtggcgtaacaaagcgtacaacttcgcttatcacgtcttagggcgtgaagcacagtcagacttcgcctggaagggcaacccgaaaacagaaggtggttccgatccttcgcgtcacggttatctgttgatgtggaatgattcggcatgggggctttatgtcttcaaaccgtggcttaaagtcggaaaggttcagttctgcttacgcgtgtattgcgggtggaaactgaaacaggaagtaactgaccctaacgggctggatcgtgcaatgctggcgttccatatcaacccgttacgttattatgtcgtagaaaggtaatacaatgaaagcatatcagattttagaaggtttacacactggtacaatctacctggaagaaggtaatgatgttcgtgtggtggtatccaaaaccctcgaaatggattcagtgatcggtaaagctcgcgttgctccattcgcaaaacgtgaagttgatattgaatttcaacccactgttaaagtggaaggtggacaacacttaaacgtaaacgtgttgcgccgcgaaactctggaagatgctgtgaagcatccagaaaaatacccacagttaacgatccgtgtgtccggctatgcagtgcgtttcaattcactgactcctgaacaacagcgcgacgttatcgcccgaacctttacagagagtctataatggcgattgaagacgtacagggctataagccccattcgaaagaaaagatcgacaaagtaaaccgcatcaaggccgcagaagttgccctgggcgaaatcttcaaagaactggatgaagagtattcaagtgattacgcggtatcagataccgattcattcactacagaagaactcgatgcgatgcttgaacgtatccatcaaatccaaaaggcgaaagaccgactgaaagaagcctctatgtgggcgtgtcgtgcggtgttccagcccgaagaaaagtattaaaaatcaagccgttgccgaaaggtagcggcttttttcgtttttatgcaaaataatgcttgcgctgaatcgtgagtgtggtaaagtacacacatcgaaacgaaactgaggatgacattatgaaaacttacaacatgaaagaactggtttgcttcaacactcgtcgtgaagcccgtgcgtatgttctggctgctggtaagaatacctctgctgtaatcgacctgggtactgataaagctgttggcgcacgttgggctgctgttgtggttatcgctgctcctgtgactcctgttaaaactctggttctgggtgcgcgtaaagccgaaactctgaaaaccagcacttgcggggcgggtggtgttcataatgttacggtcattcgaaaaagatcttttaatcgagtcggtgtatgaaggtatacggggaaaacagaaagaacaatctccgaagagattgatgtaatcaatgaatttctatgtagaccatacgttaagagagttattatgaatattggtagtggtgattcatacccatcatgcgcattgagcaacttcgccccgcatccgtttacgtttgacggggtagaatgtgcatcaatggagggctttttacaaagtctgaaattcagcaatccagatatgcaagcgcatgtgtgtacgctggttggtaaagccgccaagttcaaaggcaagaaaaagaaatggtatcgcgatcagaccctatactggaagggtatgccgattcaccgtgaatcagaagcatatcaaatcctgattgaaaacgcgtacaatgctcttttcctgaatgacgggttccgccgtgcgctggctgcaaccggaaaaagtaccttgactcattcaatgggaaagaataagatgaatgaaacggtactcactgaacgtgagtttgtacgcaacttaaccagattaagggatctgttatgattttcttgattgtggtcggtatcctgttataccttgctgttggtttattctgtgctgcaaggttttcctggtgttttggtgttagtcataacggttatcacacaccagcaacacggattttaaaacataccatttttccgttgattgtgctattctggcctttcttcggggtgtggttcgtattcgcactattttttgactgagagatattatgaaagattatgatgaaagagtagaatgcgcgttcctgttcaaaggcgcgattaacccgttggcattactccacgcacagggcgctttgagttctaccctgattatgggtgttatctacaaagcgggtgtgtattacgttaccatcggcgcaaacaacatgaacgtgatcaacagctacgttgaaaaatgtaagctgaaagatattgtgttcgataaagtcgaaatggatgatcctggcttcgacgctgtttatatgtacaagggttgatgatgggttacgtaatttatttcgattgttcggatcttgatccgttcgttctgcaacaggcaaagaaatatcatcaagatatcactggtatcagtgtcacgaacgatgatatgttgtgcatcgaatttgattattatcgtacatttgagcgtgacaaattccttgcggatattgaagcgtttaaaagtacccttttctttgatcgttatgaggttaaatcttgaaaccagttattcttaccgacattgacgggatcgccgtaaaatggcagtcggggttgccgttctttttgtctaaacacaacatgccgaccgatatcgcgctggatatggttacggatgaaaagttccgcgatatgaccgaaatcttcgggtgtgatcaccaactggcgaaaattctcatggaagaatacaacaacagttcgtttattcgctatctaagcgcgtatgacgatgcgttgattgtgatcaaccgcctgaaagcccaatatgatttcgtggctgtcacggcgctgggaaccactcctacggcaagccttaaccgtattgcgaacctgaacacgctgttcccttctgcattcaaagaagtgatggttgtcgggcatggtgaaaccaaagtacaccgctacctggaagcgaaagccaaatatggcaatcgtctggtttgcttcgttgatgatcttgcggtaaacttaaacgaatgtcataacgtcatcagtcagttgccgttattccatatgttgcgtggtgaacgtgaaaccccgtggtcgcctcaccagtcagttaaatcatggtttgaaatcgaagagaaattacatgatcttacagattctaaatgaactcgcttcgactctgaaaatttcagagaaggaagcgatcctgaaacgtaatgcaggtaatgatctgctgaaagagattttccgcattacgtacacgaaacagattatgtttcatattaagaagttcccgcaggtggacggcaagccaggcacaaccccgctatcgaatgctatcgcggatttgatgtctgatttggcaacgcgaaaatatacgggcaatgcagcccgtgatcgtctgctggatatcgtatcatcggtgaatgagaatgatcgcgaagtgcttcgccgtatcattaaccgcgatctggaatgtggtgctggtacaacgttaccgaaccgcgtatggaagaaactcattccagaacagcctcaatgcctcgctacgccgtttagcgagaaagccttaaaacgtattcgcttccctgcttactcgcagcttaaagccgatggtgcgcgttgtatgtccgatctgttagagaatcagatccgcaaagcatcccgcgcggggaatgagtatgaaggtttggtgaatctggacaaggatctgaaaaagattcgtgaatatctgggttatgatgttgtacttgatggagaactgatttatgtccctgctgaaaaaactgctgtcgttccttcaaacagcgttccatttagtcttgctgggtttatgggcgatgacgacgattctgtttctgaccttgtggcagatgttaggcgggaagctaccgagaacgagacacaagcggaagcgaaacgcgaagagggcaacgggattgtaaacaaatccctgaaaggcactatcagcgacgaagaacagcgcaatatcgtttatgttgtctgggatatcgtaccgtatgaagtgtactatggtgatgctccgagtgttcaaccatattgcgatcgctttagcatcctggaaggtgcgctggctggctctggtgtaacatcggttaagctgatcccttctatcctggtgcagaactatgcggaagcgaaaaaggattacaacaattaccgcaatgacggtaaagagggttcaatcctgaaaaacgttgatttcaaatggaaggattcacgcgttgcggatcaggtgaagttgaagaacaaaacaccgatcgaactgcgaatcattgacgtgtacgaacacaccaaagaacctcataaggttggcgggttcgtggttgaggacttatcaggagaagccagaacaaacacaggttccggtctgactgatacggattaccgatacgatgaagacggtattaaccgcgtgtacatcccgttagaagaacgtggtgaactggatcgcgaatacattatggcgaacaaagatgactatatcggcgctatcgtcgaaatggaagttgacggactccagaaatcgaaaacgcgtaagaagggcgaacctgagttcagtttcttcctgccaatcatcaagaagattcgacgcgataagaccgaaccggatgacattcacgttatcttcgctgatctgttttaaatagcactttttgctaaagaagccccttgcatatgtgaggggctttttgtatattacacacatcgaaacgaaacagacaaaaggaacatcccatgcaaatcactaaagaactcgaaggcaaagtaatcgttctggtaaatgaagaccgtttggcacaactgggtaacggtggtgaaaaactgccagcggacgcactcgaaagcctttctaaaatgcgcgtgatgcgcgttactgacggttgggttacttgtctgcctctgaacgacgaagacaaagccgtatacgatgcacaagcggattcatgggatatcgaagtacctctggtaaacatcgaagttgaagagtgctacgaaatcgaaaaataatgcttgtgttctgggtaatgtaatggtacattacctacatcgaaacgaaaggagaaacatcatgaaagttatgcacactgcaaatcaacttcaaaacggcaactacgctatccacgatgctatcggtgcgctggttggggtttatcttcctggtatcaaactccttgaagtaagttggaatacctttggtggtgttgaaaacatcgaagccgcgatggaaattatcggtgacctgaaatgagtaagaaactcgaaatattcgaaactatcagcgaagacccgaatcttcgctggtgctgtgcgaaaactgggtttgatgctgcatggggtgatactccagaacaggcgcgtaaaaactgggaacaccaacaattgttttttgcctgtcgggttcctaccaattatgaggggagtcaattgttagcatgaaaaataaagaatatgacccaatagaagttaaagagcggttatcggtagcaagaagattccttgaatctatcgaccctgataaacttggaaaatgccctgatacgatttgccttaattgtgggcgatccgtaatggttggaaagtgctgtgataatcagaatatcgttatcatggacaggaaagaagtttcaccggaagtgtgggatcagattcaagagatcatcaaaaacccacctgaaccgacgaaacgtttacgcgaacttatgagcaggacaacacgttatgaaaaatgaaccaagtaagactgtgcgccttatccgttgggaaggtaacgaactccgttatgaagacggcgatcgtgaattcgttcatgaaatgctggcgcacaatctgggattgaaaaacgctaacctggtgcagatgcagcagacagcagatcctgacacatggcaatgtgttattgtcgaactgaatcctaacaaggaatacacagaagatgaactgtttgcgctcacagagaacgctacagcgcgtcagaagtgcttcatgatcgatatgcctcgcgagaactacgagaatatcaagaaagcccgtaaacagaacaagaacaacgtgttcgacctgttcatgggctatcatgaagaaactacggcctaagcctcacttgttttgctggtgtcgttagtagccgctgccacctgtacacattccaatgtttgcaggtggaaatcttttgatacgtcgcggacacattcaacgatcagatacttccctgaatattcatcccctaacacctcaatcaatgcccccactttaacatccattcgaccctgattgatatcaaacttaatccttttctcatagctggataacagttgacacttcactgcctggaacggttgtccctgtttgtctgggttctggaagttgttctcatataccgcgttccggttcatggtgatccatgcgttttcaatatcggtactcgccaggatatcactatacagctttttatccgtcattgagaaactaaagaaacttgcatccactaacagggtagtgttatccttatgcgtaatgtattccgctttagtgaataccaaagtgtcacctaaaaacgggttactaacgttgaacttgtaagcctttatcggggtttgtgcgaggatctccgtattgcttttcataaagataccggaaccatcttcccacagataacagaagtcagacgagtctacgctctgcccgttgtcacggatgtaatcaaacacggtttcatacgtcccgcttaggcaagccggaggaatacgcacgtttgatgcgtcgatcggcggcgtgattaacttcatatcattatacagtgccgtcatacactctgtaatcgtctgcacggcgttgttactgaacgaacgggaaaacttacgacgaaacaccgtatgcaccggagaaaggtttaggcgcagtatagaacggttcatatcatcggtttcgacgtttgagtacagaacaccgtagtaatgttgttctaacgtctgattatactggaaggatacctgaataatcggtttctctgtcaactgatagattaactggttatcatagatctgcatcaatgtttcagaagtaccgttaatgatggttttctcactcattgagacaagggcaggtaacaattcaagatagacgttatcagcgaacttttcatatgttggatataatttaaccgacacgatgcggtttataactttactggacattagacatcctccctttatattctatttactaaatagtaaatatcgggatacttgaggcgatcatgaaagagaagaaaaacacacttgataaatttatggttacgcgtttaaacatcaagaacagcaagaataaagtagttacgttgcctactggtgaacaggttacgattccccgtctgggctatcgtcatttcacccagattaaagcaatgaaagacccaatgcagttgcttgagtatatcatcaaagagattcaaccgcgcgaattaaccgcagcagaaaccgaattccttttgattcacctgcattatcataatgacgataaagcaatggcgatattgaaagagatcggcattaatctgggtgatatgaaaatcagcgaagctaagtatgaacatacttttgataaccttcgattggtattcaacaaaccgaccctaatgctggatgatctggcattactgcttaaagaagcgtataacaacggaaagccgatcgaactgacggacgaaacccgtattcaattaattaactgcctgtatcgttatgaatatgacgatgtaaaacgtggcgtactccaggaagtctatattgtgcatgaggggaaaaccattaaagggcttaacatcatcggtgaatgataatggctagcaatccatattttaacgaagaacaacgtcgccggatgcagaatccaccaaaaccacaggcgcaaccaactgttcgtaagatccaggcaacgttagataaagattcgatgcgcgagttaaaggatatcaatgataacacccttgaaaccgcgctgaatacactggacatcaaagacagtgtgaaatcctttgaggatcgtttcaaagagaaattcgctggcttccaggaacaatacgaacaggatcaacaaccacttgctgaacagttgcccgattttgttgggccagcgcgtccaccatcattaacagacaacagcacaaccagtgttgataactccgtcagtgtatcgaaccagcataacccatttgcgaaaatcgaaacatacaccggaacgattgcagaagcaatcaccaagtttatcgaactcgctgaaaagaaaccagcccccgcgccggaacctgaaccagtaccggaagaggaaccggaggtcgatcgggacaagaagaagatccgcgataaggataaagacgagaagaaattcagtaagcgcgttcttgcgttgctgggttcaatcaaggataatacatctggtcttctgtctcgctttatcggatactctctcgaagcgctggcgaagtttgccaaatggactttgattatcggtagtatcgtgtttgctattgaagttttaggtaaagtcatcgcttcatggtttaatgatttgcttaatgatggagaagcatccaaacaactttttggatcatatttcaacaatataaaagcgttagcgaaaagtatagatgacggattagataaattaggtgataaagatgcaacattagcagaaaaattaaaagctctgttagtagaaccgtttaagattctgggcaataccattaaaaccgcaatcacggaaggtatcggtaatctaatctatgctctgggcgaatataccggatcagaaacgattactaacgccggacgcggaatgaaagtatcagcactgcgcgacaaacaaaaatacggtcttgacattgatcccgatgacctgattctgctgaaacaacaggagatccaggatcagaatgataaagtggttgaggcacgttctaaggttgtcgaacaggttaaggctactcaaggtacattctcatatggtttcgggcaacagacggacgcacagaaagcgctatctaagcaattggaacagatgcgcgatcgtgtggctattgaagaaaagatcaccgaagagaagaagaaagaactgaaagcattgcaggaaaaccccacactgttacaggctgaggttgataaagagaatgccgctaaccgtaagcgcgtgaacgaaaccaaacagaccgaaaccgagcaagcgaaagcgaaacctaaagcggatagtgaatttgatcagggcgatgaaattctgaacaaagacaatctgacgggcaacgataaaaaggtaatggaaaaactcatagaatcgcttgaagagaaaaacaattcgaacaagctgaatgaggacgacaaagaccgctatcgtgatatgatctcccgctggcaggaaaagatcaccgcagtaccggaaacgagtgcaagtattgacaagcaaccggaagcagcgaaagcccctgttcatcctacaacgcctaacagtgttcaggtcaataacaaaacagtaaacaacacggttcagcattcagtacaacgaactgaccgtaaaccattgattgcattagcttaaaggaaatttaaatgaaaattacagtattgcaagacactgtacaatcatttgcagaaatcaaaaatgctggcatcccctctgggggtgctgcaacaactaaaaacgcgttgactcaaccgatcgtaacagcggaatttccttcccaacgtgcagcaggtattgataacgcttataatgcatcaagcctgtataataacggcttgctgttcactgcatatgaattcacgggcgggcttgcgccaggtagcaaagacaactaccgctcattacgtcaggcagcacagaatgcgcaacagatcctgagcgcgaatacaggcaacgttcgatataaacaagttttgaatagccgtactattggtacgctcaaccccatttgtcaaatacttttaccgcgaagcctgaacgataacgaggttaacagccaccgttaccaagatgcaaccgatagtattgttgctaaaggaccgtcaagagttgtgtctaacgttatctggggcgctattgagtctgctagtggtggtattttggcagaccgtagagaagcagttgatgttggtacgaaagcagcgtttcaaggttctgataagcgtacaaagatgtattacaatacattcgttatcgaaagtcgttatgacctgttggaacttattaaaatctattatctgttcacggtgctgggatatggtacgacatcaggaggaactgccgctgaaatagcagaattagctaaacaaacaattaataaatcatcaacagcaggggcaaaacttattaataatgcaattgcaggaaatggccctacacctactgtatctaatggttcgattataagcgatcaggctgtggattttgttactaatatagaagttattaaatcgcctccagtgtggtttattcgtgacttccagacaggtgacagtttgcgattccctcattccacgttcgggccagcaggtattaccagtgttcgtttcgggcgtacaatggacaacattgtaaatacgttaagagaatcaccgaacaccccgatcgcagttgaaatcgaaattcagtttatggaactgatcgatatgcgtcaggattcgatttttgatacgcagtattaagggggaacaatgttctatagcgtagatgaatttttgtcaggaatggcaaaccgagacttccagcgaagcaacttgtttagtgttgtattcgcaaccagtccagcatcacgcattctcgacagcacgatcgggagtatccgcgatactttaattgatggtactatgagttccattaacgcgaataacccgaacgagttcatgaacgctattacagggggcgtaagcaagctattcagctatacggttgataaagctattatgtccctgaacaaaacaggtttcagtaaaatcatgggggcgttaagccctcgtttaattacttccctgtttggtgatagtgtttacggacagatgctaacagaattccgtgacaaaatgatgtacaatatggggttgagcatcgttggcgttcagttgcctggtaaaacactgggttatgaatacgtgtataatggcggtgtaccccagatccgattcacccgaccggagaatggtgaattatcgctaacgttccgtgtggattcagaagcgcgtaacctgaaagtattcaacgaatggttatcagctattcgtgatgatgtatcaggccagttcgcattcattgatgaagtatcaagcgcgatccaggtaaacttacacaatcgcgatggtgtcccgcacagcacgtatgtattccagaagtgtttgcctgttaaagtcagcaacccagaactgagttatgaaagcaataacgaaatctggacattcactgttgactttgcctataaaacaggctggcttgttgaagcagataaagaaggttgggacggattcaaacaatcacttatcgaaggtgcagcaattgccgttcgtggtgtggttacaggacaataaggggcgaaagccccttttgaggttaaaatgattgatataatccgcgtaaaactcccaggtggagtgaagcgattccctatgtttaccgtgcgcgatcagttgagtttcttactcacaagcgcggacatggaagggaagacgctcacagaacagcaagaaatgctggatgaaattttagatattctgtatccgggttattcccgcaccgaacaggaaaacatattcactaaggtgtattgtgtatcgttcggtaagaacgcaatcaagatccgaatcaaaggaagcagcggacaatcagaagcattcatgcatgtaactgattacgttctgcaaaatgaatatgcccttgatgattcgcttactctgggattcaaattcccgaaacatcgtaacaacagtgaacaattattccttgaatgtatccagtatgtcaagcaggacggcgaaagatacgaatggaatgcattagacgaggatacaaagaacgcgatcctggatctggtgtctattgaagatatggaaaatatcgttaaactgttacgcaagtcctgtcatgttaccgtgcgtgatattgagttcagcgacttattgacactgtacaaaatcctgttcaacaaatcagaactgaatgagttcttcaaaaccaactatttgttaaataagaataccgtacagattgaacctataatgaatggaagcccgatggaacgttcaatttacgttgcattgctggcggaagacttgaaacgaaaagagaatgcaaatgcgtaaacataccccccgacatatcccaaaatataatgtgacttatcgcccgttaaccattggcgatcttgatgacacggataacttcattattgaaggtgatgtgttcaggcatcagcgcgattatgtttacattatggctctgttcgacagtatcaacaaagagactgtagatctccaaatcaaatgccctgaatgcggggaactgattaagtttgtgctcaatcgccatcatatcatggtggatgaatacgaagaaaagctgtacggcaatgagatcaagatttcagtcgaaccacaccgcaccggaaaggaagagttacccgaactgattaagtttgtagtcatcgacggtgaacaaatcttatgggatgactgtaaagagtcagagaaagaagccgttctggatagtatcgactatccggtctttaaatcaataaatagcgctctggataagccagcaatcgttgcaaacattccggtaaggtgttcgtgtggctacgaacatatcgttgcactgagaggcttagaggcgtttctaaaggtggttggataaaatgggtgttaaccttcgcttactgtatagcgatatcgatcccaacttaacaaaagactggaacaatgacgtaaccgcctcgaaaggggcggcagcggtaaagaatagtctgatcggtatcgtaacaacacaaaaaggcacacggcctttcgatagcaactttggttgtgagatcggggaacagattttcgagaacatgaacccgctaacagcggaagcagtaaggacttcgattgtctccgcgatccgcgcatacgaaccccgtgtttacaatctggatgttgaagtgattccgcagtatgacgagaacgcgatcaccgtaacgatttactacagcatcattgatgaaccggaagaaatagaaagaatcaaactccagctatcatcctcataacaaaaaagccccgaaaggggcttttcttattccatcacgatccagcccattagctgttgatatcgcaattcgaacggagtgatgaaagagcggttattgacaaccttcgtcccgttataggacttaatcacttcctcaccacgaagcacatattcgtatacttcatccatcgtatcataacgcacttcttcgacttcgaagcagaagttggaatattcaatcatcccgatcttgttcgcgtaacgacgttcgatacaaccctgtttttcaatctgagtaatcgcagtatcaatgaactgcgcaagtgcttgcatgaaattactacattcgacttcacggcctccgcttgagatagccaggtaaacgcggctcaatccatcattgccgatgtaaccgatacagtcaccgccaatatagacagaccagactttacccatcggccccatacccatacgattctcactacgagaaacacctttcagtaacagtgccatgataccgccgcgaacgtaattcattttcatgataagccccttattttttcaggttgattaaccaagatggttgggtttctaaactaaccgctttccaagcatatgcaacactataaccggaatacgtctgacatacaacagcattttcatttaaatatttcactttgtgatctgcctcttgttcattcagggcagcacacacgatattcttttcatacactccgccgtttggctggataatggtttcttcaatcagataaacgctgttcatgctaattccttctcgattgcttcgatgatgtggagaacgtaaccgttcagttcttttgctttatcagcggcttcaaccataccataacgaggaacttctaaaacgttcgcaccttcgagcaggttgctttcgatgtctacgattacatagctctcaccgattgccgcgccttttctccagtcttttacgaacttcatcattttagctttcatgttctcgttccttttggctgttccgtttcgatatgtgtaatataacaaagccctcacgcgaacgcaagggcttttttggattaactgaatttattatagagagtaaaattaatccctatagaattcagtgctttacatgttgcatcaagatctgttggttcgatttcgatgatgtatttcaacgctgtgtttactggaatggtttctggttcttcgaaagatgccagggttggtgctttcaccgtttctggttcagcaagcacggttttctttacgtcaaacgcttctttgaacttgttgattctttttagcaggtcatcaatcaattcgatgttagctccgtcgaattgtctggtttgttccagcatactcgtaatctttccgtatgtagtgcgtctggtttgttccgtgtaattcccgacttcataacggtcgatccggtcgatgattgcccgaatgtgtccaagattagcgcgatcgaaatacgcaatcagcttagattttctgaacacgaacatatatggagcattaccgacaatgtaatgagttgccgttagaccaaaactaggatcgatcagaattttaaccgtgttgaaatacgggattaaatttatttcacgttcaggtaaacggaaaacttcatctttaaagttcttcccaatccggtcgatctcttccagagttttacccatcatcgacgaaattatttcaatttttttagatacataagccatttttcaattctcatttaattaatgcataaaagatttgacgtacttcacgatttcttcacgacacatatcgaccggagtatcctcagcaatagcagcatgacagaagatttcaccatccagccagaacgatagcatgtactgaatatcccgaccttcgttttctttctggtgtttcttgatgcgatcaaatgcatcatccatgctttcggtagctgtaagcatttcagattcacccgctacagcagccatttccccagcttcatcactgaattcgctttccagttcttcccagtatactatcgttatcatggattaccccaaacagattttacatttacagagaggacattccgcctctttaacgcgcaagcgctttgttgctgttcgcttcgctgtgttgtgatcatacacatgcaaacagcgataacagatcaccaatcgtttagccgtcataaccaccaccgcaacgaacatcaccttcaatgaacatttcgcggttatctctcaggagattgtatttcttttcgagttccggcccgaatgcgtccgcgtcgtcataccagtcatagttataacttccggtttcatcgtcgtattccggttcgccgccgcgctcattgaagtgaacgattttaacatcatccagattcagttctttcaacttgtcccagatgcgggttatttctacgctattacatccgaacgcttccagtgtgattgtgccgtcatcgtgtatttgaggtaaatcccagcgaggacgagtatcatcaaacatatccatcagagattcaacgtttgactcaccgtaaatctttgcaacttcctgttctttaccagggcggacaagtcctatcccgataatgaaactactgcttgagctattgctcacgaacccagaacgaatcttcatcgtcttgcctcatatttcgcgttctccgcgattttctcatgatacaggttgtatgacaacaccagcgggatacttgccacgataaggccaatgacaaccatttgatattcgcgcttatcgaacgccatgaatgaaatcgcagcgcccagaataaacacacccaatgcaatgataaagaatagagtcattttgacagggtatccatgcagcgtgatttttctttcaggatggtgatcacagtttccatcgcctgttgtacatcaccgtcaaagtgaatcaggaatgttttgtgtagtcccatgatcagacggttgacaatgtaagccatttctgacggcaacagtttaccatcttgatgattgtacttctcaaacaggcggtagagttctgcgctgttgcctggcttctcgatgctgaaattatgcattccagacagaagaccatccagatacagaacagttttgttatcactgcgcaggtgtccgccgaccttgtagtagttgctgaatacatacgggttttcgcggatatcttcgataccgaattcaccatgatctccgatattgccaacatgggcgaagaaattatggtcttccagttcgagaaggattgcaccctttttgtaagggaacccgactaaatcgatctgccagccattttcaccgacaaatacatcatcaacaaccacgaaatccggcagcataggcgcgtatgcgtggttcttttcgttgttttcacgataggcttgtggttcggacaggtacaggatatcgccttttacaacttcaccccagaatacgttacgtgacatagtattttcctcaatatgccccctttcgggggcggacattgttagattttgacttctttttcttccaggacaatttcacattcgaatgatgtggtttcccagactttccagaaatcggacggaatattatcttctttcggaagaatatctttcgcagcgatagaaactttggtttcttcgaagtccagatccgcgaaccatgcatgtgctactacaacaccgtacattacgcgacttaaacgagcattcagtttacggacttcctgaatcgttgcctttgtctgcttatcaagatactcgactacctgatctttgtcaagcgcatccagttcagatttcacctgatcgtaagcccacaggataatcaggtcgccgttgttcagtttcttcttaccttcttcacgcttcgcgacggtagccgctacagcaggaagggaggaaacacccttgattttcacgttcagttctttcgacatgtaaacatcagtcgattctgtgcgctcaaccttcggagagaacccgtaatcacgaataccctgttcagacagccattcaccagcagcctcaccaaagcgctgtttcagcccttctgcgttgcgcagtccgatcgcgttgtcacggaagaacttcataaccttctgacggcctttcaggatttccaggcgcacgttatcagtcacgaactctttaccgcttaacccgcgagtcatgccacggttaaccagaggcagagaggtaaagtctaccagaacagacatacgatcatcaccgattttttcgagcggcttgatagtcaggccagaagcacgaaggtttttcagtgtcggaatatcggtttccagcggcagaactttaacgttcacgataccatctttaacgatggtgaagttacgcacctgcttagtttcgattttttccggcagaccgaattctttctgtttgctttctgggatagtcacatacccttccagatccgtgttgatggaaatgttaggacgggaactgttacccaccagatgtttaaccgatactttggttgtagtctgggtgaacttcggaacccatacttcatgcgctaccatttgcgccgccagtgctttacgttcttctggggttgcagcgtttgcgatctgttcagacagttgatccagtgtatcatcttctttctgtacagtctgacggcctgtgcggttgtacgcccagtgctcagaagacaggtcgatcactgtgtcagtttgtgccagcagttcgagcgcatcaaccagagtgaacgcgttttcgtctggaaccatgttgtaatcaataccatcaacaaaacgctgtgacggatctacaacagcctgtgcaatcaggtcttttgcgttggagtagtcctgtttggtaaagcagttgtcatacgctttgatcagacggacatcacccagcttttgaagcactttccatgccagatcagggttcattgtgtgtagtgcatgataaagcacgacatacagaacttgctgttcactggcgatgtttggatcgaagccgtcaacatcattgatcgcgttgtcacccagcgcccagatgtttttgatgtgttctggaaccagcacaacaccgtttgcagcgttcaggacatacacgcgcccttcgtccaggtagatcgcatgggtagcgtcagcaactttgacttcgatacgtgcagaagtttgcgcagtgatgatttcggcaaatgctggttcgtatgcgtcgaaaccttcaacgaatttgtgtaatgcgttggttgcttctgccattttttccagcagaggacgattcacgtaataaccgtattccaggaacgcgatactgttgaaagtcagtggcagaaccgcacacgctttcaggatgtcatcggtacgccagcagttatcataaccgtctgtcaggaagatcaggctgttcaggttgccgttttcggattgcagatcggtagcgatttccgcagccagattcaacggctcaacgaagccagtacaaccagtaggtttcaggtaacggtcgatagccgcgcagatgttagacaggtcagagacattgctaaccttctcaccacggaacaccgtgccgtaatcgcctttgctggagaagtacaggatcgaaacggtgtcatcctgtttaaccagactcgccagatttgcttttaggtgtttacggatcttaggcagttcgttatacattgaaccggatacgtcacacacgaaaacgtggtttgtcggggttggcttcgatacagcgtttttgaattcgatatttgttattgacatttaaattttctcgtatttgaatttttctaaaatttcgttaactttattgcttactgcttcgactgtacgatcacacccgaacttacgcgccaggagttcaacgtattcatccatcgtagtgagtttggattctgcaatgtcaaacgcaagcgcatacattaccggattccatacccgaacgatttggagagtatactcgttcagttcaaaacgttcaagatattttcgcaaagaaaatacatcaaacggtgcggggcgatcctggctaaaggggatcgaatcccctaatgcatagcgaggcataacaacacagacttcggtttttaacttatccatcagtgatgactctttgatgtgtgttcaaggttacggaagatgtttccatgttccagttgagttccgatcgggccgcattcatcggagtacgtgaattcatagataaacacgccgtcctgattgccatacttcgtgttgtactcttcatacaaccacattttgatcagagcgtctttctcttctgtgtccagatcgtaccagtctcgcccgtcatacgcaagcgcaatttgagggtttgaacggtagcgggtttctgcgctttcttcggtttcccagtcatagcgtttatcgtcgtagaacgattcaaagctattacccagatgaccgcctaagtcacggtgaacatgattgaccacttcttccgctgttaacggaggattgtagtaaccgcagttcggaacgcaatcacccatcatttcgcgcaggttgtcgatattagtcggatctttcgggaaccggacgatgaaactacttgatgaactgttgctcacaaaaccagaacggattttcattttacatcctcaaattgtaagttttctttggttgcgttcgcaatggctttttcgttgctcagtgttactatgcgcagacgttctccagtaaagccgtcgcattcagtgatacttacccagtcaaaaggtttagccatttcaatcgcacgttccagcgatacggtagaaccgaccaaatcactaaatgtatagtaatcttcgcttaaactttcaacagtataaattttcacgatactttaccttttgtttcagatttcaggacgatgttactgtaagggtcttttgctaccagttcccacaggtcgccagggtgttccccgctacggtagacggatgaacgaatgatttcgttaaacttgctcagggcttcgtcgatgtcgtcatacccgcgtttgaggggcttacgattgcgacggatgaagaacatttctttggtcttctcccagcgttcggcgtttttaaccttcataccgcctccattttaccaatgacttcttcgtatgtcacagggttaggttcatagccgttagcgcctattgtatcgcctactctgtttcctactaaagaagcaaccgcaactttcttaccgtctttccacgcagtgaaatgcagattatccgcaacatacgggaaggtttcgtgattgttcaccgcgtcgatacagtccagaatggtatcagacgcgcagatcagattaccaggttcataatcaaccaaacattcaacagtgtaaatcataataatttcctcacgaaaaagcccctttcggggcttgattaatcagtgtccgaacacaccacgaatagactctgcgaacgcgtacagttcagggtttttcgctttcactgtttcgatttgttccaggatgtaatctggtttgtatttcgcaccgaaccagcagtaagagaaagaacgatcccacatgaacacgttgtagtattcaccgttacgcacttcaaccatcacgtaacctggattagaacccagcgggtaatctttcagtagattgaatttcgcaccagcgccagtacatccgttaaacaggtcattaaaagtcatggtatgttccttttcagtttcgtttcgttaaagctaagataccactatcaactactggatgcaaacacttttttgaagaattttgtttccggtctttctttgtacggacgcattaccaaatctttaccgtccagcacggttggcttaccttcgagttcgatcaggatgaagtttcctttatgatacttcaatacgccctggctggcagaccattcatcattatcccagtggttgtaatgccattcaacaacggtatcgatcgggatttctggttgatttctcataatactttcctaatttgtttcgctatggcttcaatcacgggtattgaaactgaatttcccgcttgacgatatgcctgttttttactatccggtatgataaatgaatctgggaacccttgcaaacgaaaacactcacggggagtaagtcttctggggttctttccttcctgcaacaccagacattgaacgccgtccttgtaatactgctgggtgatagtcccagtgtgcgtagaatcgcttgtgacggcctgataaccgaatcccttaccgtttgccttatttcgttccttacgctctctaaagcccttccatgcgttatctgagagggtgaacgaatcatcagcgtcttcgaggatgtcgcctacgcgtgtaggggtgcgcggtggaaccggaaacgaaaagaacacatcatccaggaagcagacaataaacacgcgttcccgtctttggggtagtccgaaatcctttgtgttcaggcgttgatagaatacgttatatccttcggcctccagaagcccgtaaatcgttttaaacgtcttccccttgtcatgggttagtagttcaggcacgttctcaaagaacagcacacggggctttttagcgcgtataatgcggaggatttcgaagaacaccgtaccgcgtacatcatcaaagcccagtttcaatccggctttactgaatgcctgacacgggaaccccgccagcaggatatcatgatccggtacttcgttttcatcaatctggaacagatcaccttgtaggttatcattgccccagttttcgatatatgtttgctgtgcgaacttgtcgatttcagacgttaaaaggcattcgacaccgccgaatgccttatcaaatcctaatcgaaccccgcccacacccgcgcagaggtcaattattttcatacgtcaaaatcaatctcgtcaattttgtatgagttttcgtcaatgtccgcccagagggttacattaacatgtttgctatcttcgtacaactggcgaccatcaatcccgcccgtgtaattgctttcggtacgttcagtaacttccaggcggaggctatcgcgcatgatctgaacaacagcctgttccagtgtaaccgcgtctgggtttttggtatcgcccagtacaacatctttaacgttcaaaataatatcagtcattagtaaaacttcccgtaggtgttgaaatttacatgtgttgggcttgcttcgttgatactgatttcataatcgtaatcctcatttgttacggaacgatcatgtttgataacatcaacgacatatacccggaagaatgcatgatacagagcatcacggatcttttcagcaagcaccagaggctcactgtacaggttaatcatatcagaaacaatatcctctacgcgaggaatatcacgtttctcgatgtaacccacatacagatttacatctttaaccattagtgccactccgttttaataccgtgtcggtatgcgtcaatccccagcggggtaatcagcaaccatgctttcgaattatcgtgataacccgttactcttcgagcgtaacctttttgaatcagggaatcacgccctgatttgctgggtacgtcattgaaatctaagtctagcactttagttgcgtatccgtaaagtttatacagaacatcaatttcagcgccggacaatttaggatacatcatttgtaataccccacaacatgatcgctgtatatgcgttcgatgaaatcgttccagaactcgcgatcaacttctttcggatatgttgaaatcgctgcaaggcgttcgacttcgcccataacttcttccagtttttcctgtacggttgcgaacggtacgccgccagctttaaccagtttcaggaatgcgctatcaggcagaggataaacgatatcaccatctttgtaaatctggatcaactgcataccaccgcgcaacgcgtgacttaatgctttccagtcgatcccgttgttggcttctgcttgtcgtgcgcgttctccgtattcatcccagagtttatacacagacttacgcatttcatcggctttgatcgtgaactggaatttacgccccagcacttcatagaagtcatgacaaccagatttcattgtcgtgtcggtaacgaatcggcagaactcgtttgtagggaaacgatccttgatgtcagacactttcacttcacgcgtatagcgtttcatatctggcgtgaattcctgaataccaccgatcgtttcggtttctttcagtacatcgacaacttcgcgcagtgcagccaggcgagaacctttcacaccatattttgcggcttgcttgcgaacataaccgaacaggccagttagttcagtggtgtaaaaacgccagcggttagcgcggatatactgccagatttcagagttagcgatcagcttatcatccgaagcgtgaagcatatcgagcgctacggtatcaccatcacacgcaaggctgataaacttagtcagactatacaactgacgatcaacgtcgtctacggtgtttttagagcttttatcgcccgtgctggtgtcgatagtcttcggggctttacccaggagaatatcgcgcgggtgcgggagaaagatccctttatagtctttatcgcttgtcggtgtgttcagtccgtacaggtgagaaccgaacacggtttccattacagttttcaaaattcaacccccaggatttttgcgataccgcgcagttcagcggtagtgatttcaggaacaacaacagcgcgagaaccgaactcttttcggatcttttcactcagttcagcacgatactggatttctttgtataccgcttcgctgcgatacatataaaatccgccccagcccccgccactaccagaagtcaatccagtcttacgatcgactttctcgatgttccagcttttcaaatcagcgtctttatcagtggatgcatacagatattgacgcgcaacctttagaacgtgaaattcgcgagggtttgctgttttacgggtattgtataacctttcgccaggatcgtaaagggtatcacccactttcacatcagttaaatctttcggattcatttcattttccaacgttttgacttttcacagtagaacaccggaagacgtgccagaactggcttcactacgtcttcccctgtgttcgtgttatgaactacttcgatcgtaagggattgcccttcggacggccttacaatgtccagttccaggatctcacgattaccctttgtattgatttccgctacgtagtaatcatgcccgttgatgtttacgacatcacccataataacgctaattgtgtgaatcatgagtatgcaaacttaattttaacattcagggaatccagcaggatcgcatcacgtccatcaatgatggtcaatcccatgtatttgttatcgtctgcgctcttgcgtgagtacatgcgacaaaccagagaaccatcttgtgcgatgtattcgacgtggtattcacggcgttctgacgtgaagatatccccaactacaaccggacgatcgacgggttggcgtttagtcccttcgtaggacagtttgccgttgccgtctactgcgcattcaatgcccttatgtgtgacgctcgcaacagtaacaggctctacagttccaccgatcagcattgccggatctttggttcccagtttcatcaccagtgtttgacggatattatttgacatcggttctgtaacaaacacataaaccatatcgtttttatcacgcgcaacggattgcagggtaaaattcttcgtgcctacagaaccagtatgattgattcctacacgattcctacacgattaccaggttccagcgacatacgacattttacatcagagataccgctaagggttgctactttcatgatttaattccttcaaagtcttcattagatttccagtacacgttgaagttacggcaatcgtggtcggaagtcaacgtatatttttcttttgttttctcgtcggtgatcaccatcgtttcattttcgatggaatccacaccatagacgaatactttatcaccgcgcttattcaggaacgcgtcacctgtttgaatcaactgccagcagttgacgggtaaaccacccgcacagatcggacggtttacgaggcagtaaggacgtttaatcatttaaattcttccattgcataggaagtaagatctttgaaataccttgcggtgttgccttctgggttgtttgtaatctccatcaggataacagcaccatcaactcctgctttcttagccatgaatgaaatggcttcggtagcaataatcgttgctttcataacatcagctttagaaacgttgatcgtattcatttttcttccttttcattattcatgcggtatgtgtatataatacaaaagccctcacgcgaacgcaagggcttttttaatcttttatcagagtcccgtgaaagctacaacgatttgatagtggtcatcgaagaattccccttgtcgttgtacgacctcatgtaagggcatccagaacgcctctaacgcatcgtcagaaccgcccataatacggggcagacttccatcattgttaggctctaacttgatgtactgcgccacagtcggttttgagaagtgtacggaacgcttcggatgatcgaacagcatcgaattacggattgaaccacggataaccttttcaggaaccttgatccgtacctcttcgagcagttcgcggatcgcacaatccaggaacgtttcatttgcgtttttgtgtccgccgggaagggctaacgcgtctttacctggggcgaacttacgacgaattaccagcaggtgattgttgcacacaaccacactatcacccgtgcaacagtttagcgcgtcggggtatgggtagtttttgaatttctccaattcgctttcccatttctcgtattcgtagaataaacgccagaacgtgtcttccatcatccatttgtcgatataatcaacggttgcttgaggaacaaagcgcaacagtttcttatcccacccgtttttatggttaaagataatcggacgcagatcggttgctgatagatccttgccgttaatctggacaggtggaactggtacgtgtgtccatccgaacgctttaagccagtatgaacctgcatctttttcgtaaccgtagatagcgattttgtcgcctttggtttccctgatagcagtacgaacagaggttttccatttctcttcgttgtaaagataatctggaatgtgctcaaactgaacacgaacaacatcttcgatcggaaagttagtattaagccatgagaagatcatggtttgacgctcacgcgctgtcagagggtttaaaacgttagggtaagcatatgctgaacccagaaggatgtaaacgatctttgcttcttcgagtgctttacgcaccattgctgcatgaccattatggaagggttggaatctgccaattacgacagctttatcaaattgtttcataacgtgctccacgtttaaaggttaatcataaaacagacgcaatcaccaatacaccaagaaaaccgccaataaagccgaagaatagcgaaatgaagatagtaaggatgatctgttttatgttcattatagtattctcgttttaggagtcaagcccccaagagcgggggctttaaaaccttatttacgagaatcgaaaatcactttaccagcgtaatcagaacccatgacagtttgaggtacaccgccctgatatttgtccgcgatggtctgctgaacatcaagttctttccagcggatcatttctggggtgattgtgcgttgcagaatggcgttcgcttcggcttctttcttagccgcatacagacgggcatcagcatcacgctcgttagcctgtgcagcattgctacgggcttctttgtcggcaattgcctgaacaactgcctgttgagcgatttgctctttacgtgccagttctgctttttctgcgttcacctgttcttcacgaattttcgtgttttcaacctgtttcttaatcgcttccggcaggtcgatgtcctgcaagaatacctgtttcactgtgtaaccgtaaggacgggcatactcttcaacttcctgctgaattgcgatctgtagctggctttgaacttctgcgttatacagatcctgtgctttcggtacagatttaccgaactcacggacggtagacagaagtttttcggtcacgtacttatcaagcgcctgatcctgattacccgcgttgatacggttgatcggggctttattaccatcgaactgcaacatcacagtcatatccacagtggatttgaatttatcctgggatggaacctgcaatttgtcaaacttcattgcgatgtctttggtgttgaacacctcgaaatcagccagtgggtttaccaggtggaaaccaggcagaacaggtttcggtgaaactttacccatgaaggtttgagtttttaccgtaccatcctgaacgatagtgtacgagttcggaatcagccacagtgcagcgattacgcccagagcgatcagagtggttttctttgggttgtttgcgatagtgtttaagttcatcattatttccattgggtttatgtttcaattcgatagttattctatcatcactttttcgcttgtcaaactctttttaagaaagttttgtcagcttgtaaatcgtttgatagcacaagcctttgatctcgtccaggacgttcttcaatgaactatctactgaatcatagatctcgttggcttcgtcggctattttacggagatacgcgaccgtgtcaagcacattttctgtttttaatacgggtttgtatcgaccagtaatgcctatatggatttcggtgaacttatcaaccaaatcctgcatatcttcgtaaaacccttcaaatgctttatgctgtgaatatgaaccagtcgcaaaatgtgcgctgtgcatataggttacagacattaagcaagtgccaataaaggcatcaattttactcgcggtatcgcgttctgttacttcgttaaacgtctgcatcttcatcccttatgaacgatgaatagcggcgaattcacttgcaacccgtagccctaaacgtttacattcgggttcagatttgcattgtttttgctgccattttcgttccatgtaattatagaatagttcactggtatttacgctgggagggatggtgtcaagatatacctgtagcgccgcgttgatgtagtaatcgaactctttggcgactacggatctatcatcagcatgtgatgacggagacaagattaacaaaccaaacatcagcgctttagatatgcgtttaatgttcataagcaattctctacgtgcttacggatcaacaatagatccgttcctgtatatatttatagcaaaaaaggggcgattcgccccttatgtaaaattagtctaaaaatacatcaagttatctcataccagcataagctacgctcaaaagcgcggatcttatttgcgttctcgatattttcatcccatccaatcacgccagctttcatccggcgtaactcctgacgcattttagcgcgtactttcgaatcaatctttttgactgcgatcgaaagcatcgcggagatatcaccatgagctttgttaccgtcacgattcaggtttttatcgaatcggatatatgcacaacctgatttgtgtttccagttggttgagtaccaacgaataccatcagggctttctccgtgctgtgcataatactgtgaaaatgcttttgtctcttcgatttgttcgatagaggacttatcacggactggaacatatttcttacggtaagtacggctcatagtgttctcctttgtttgtctgaatacaccttaacagttcagaccaacattatcaagaagtttttcgtgataatgtttgcgacagagcgaaacgtatttgtcttcggctccgatctcaacctgctccccttcggttacgaagttgccttgtgcgtcgatacgtgcaaccgtagttgctttacgcccacagtgacacattccgcgcagttctcggatctcgtctgcccaggccagcaaccagtaagaaccctcgaacagattcaactgaaaatcagtacgcagaccgtaagccattacagggatttcgagttcatcaacaacgcgacatagatcgaaaacgtttttcttcgaaaggaattgcgcctcgtcaacgaagatacaagcaattttattccggcgctggatgtcccagaacagatccatatcaggcgcaatcaattcacacttttcgttcagcccgatacgcgaactcactgtgtttgatgtgcgggtgtcgatcgctggcttatagattacaactcgcataccgcgctctttgtaattgtgcgcgtccgtcaatagtcgcgcacttttgccagcgttcatggatgcatagtgataatacaatttagccattgacacgctccacaaacttaatatgattctggaatttgccctcaccttcatggtttttgcatgttttgtttgaacagtatatccaccaatcccactcgtcgtaagggggtttgtcaatgttcatgacgcaaatcaaaggaaaatgacaatccagacaacgaactttttctataatgtgtgcgttagccaattgaaaaccatcctttacccatgagtttttcattatgtcgcgcaagatgctctttgatttccggtatctggatagcaatatcatactcttctttcgtcatagtatgatttgcgcaacccatacacccgcacacctgcgcgttacaccaacggagtgttccgtatgtcgcaatcaccttcattgctttagctttgattttgtcagtcatgattagctcgctccaccgctaccgcatcacgaacagcatcggtgatttcattttcaacgaaatccaggatatccgctgtaatatcgtcgatacaggattgattgtagttacgtgaatcaggatcatcatcttcggcataatcctgatacgcttcgcccagttgtttcagcttgtgttttaacagcttttgttcttgcggtctcatgataaatccgccttatgtggatcaaccgatggatcgaagtgaacaacgatgattggataatcacccgtacactcgtcgataatggcgctaatacgcaaccaatcgccaccagcaagccccgcaccgataagaggggtaatgataggcaatttttcaggaaacgcactggcgcgttctacggcgctcacaaagcatgatcggattgcgtcataatccacttgcgggccagtaccccagaatttaaactgagtgtaggcattgaagacaatctgaccttcttccgtcatgtagatggagttagtgcctaacttacgctggtctcctttcatcgtcaatgcatcaattttgaacgcaccagggattttgtgcttcacttctttagcaatacccgcacccatgttgcaataacagttacacccatgaatcaagtgtacttttcgtttcaggaacaactctacagcgttccctttgatttctttaataatcattttcatcacctgtatagtggcggtaagccagcacagccagccccgcgatcacaacaataacacacattaagatataacctgtgttcatttaaattggtcatcccatctttgccacgcttccaactcgtcatcatatacagggaacgagctttcgtttggctttttaacgtaataccagataatgattgcagcagcaatcacacacccataaaagatcactaatcccaacatcagtataatcctataccagcgttatattcttcaaccaggtaagtacggagtttttcacaacgttccttatttggcgctttggtgcagaggttcatcatcggttcagactgcaaaaactcacgctgtttaaccagcttctgacgcttgaagaggtgcgcattttcttcgccccatacataagccgcgtccagttgttcagcgattacctgttcacataccgcaacgtctttaatgtcacgattattgcagagttcagccagtcgatcatcagcatgagcaaagccagcaaacagagtgagtaacagcgcaagttttttcatcgttttaccttagtatgaatcgttttcgataggggtataataatgggtttcgcagacataagcaagcactgatcgcaaactatcgctttcaaattctggcttttgattgcgtttcagactccaatccgtgaagcacatccagcgttcttctgcaacgtcaaaggctaaccagtacatattgaactgtgaacatgtatgttcgaagatatcgaacagcaatttgccaccgatcggcttcacatatggcttcacgcgttgaagcgatttcaggactgtttcgaggttactgcgatcctcattcatcgcgatacgaagaatatgctgattggtttctgggttatatccatcaatccccaaacccatatcctggaagaacttagtcgaatcatggaaaatctctcgtccgctgttcggtgaattgatgtaaaactccatgcgtttcttcggagtcatagcacggacgcgggaagcggttttgtgatcgatctcttctttgatgtctttgcgagcgttcagaagtttattcagcttttcctggtaaggtttcattaccgccctgatctcgtcgatacgttcatcaacgatcgctaactgctgttccggtgtcagtttagtttccatgttaagcccctacgcgcacaaagcgatcttcaattgcatcattaacacattcgtaaatgctaacgtcattcgggacgtgcttacgaatacccactttcacgatatccatgatctctttgttgctgccccacacgttcaggttgaagtaaacaccgccgctatgaattgtgctgttgccaacatcaagatacgtatcttgactttcgcagataaacagtttgcgtttttcttctccgtatgcgaagtagatactgaacgattccatacgatgacgatcgaccgtgatggtttccactttaacctttggatctttgttcagttcatctaacacaccctgaatgatgtgcagcatgttcggcttgatgatagtcggatgactggtgataactcgatgtgatgtgctcataatttaatcctcaatagttggtacacacataataaaaaagcccctgcgaaaatgcaagggctttttatcagataatgcgtttttcttctaacagcttcgcggtatggttaaccatgcgagcataatcacgggcttctttctttgaatacttgaaccccgcgttgtaactcgccagcgcctttttcaagtcgcctttgtggtaatcaagccagtattccagttcgtgaagtgcgtacttggaaccaccccgaagggtttcgagcttattgattactacgcgtttggaatatgatttatccattcgtgcggacgcgctacgggctgttacttgaaaacaaccataagcatgatgattctttttgcctttccctacgttctcacatgcgcgagactcgatccaggcaatagccgctaaatgatatcccaaacgtttcgatgtttccgattcaactggctttgcagttttgagatcgtattcgttaccgatcctgaaagcgtactccaaaacctttttctgctttggtgtaatatcatccaattccttaacatagctgggggcattggctggcgctttcttcattactgttgcttgttgtagcggtaaagttgacttcacagaagggagtgtttggataaactctcctaacggatcagtcgccgcgttgccagaaaaagagcataagaaaatgctggcagcaaagataattttcttcattgtaatacctatttgtaacaagagagggctatgataccctcgtcttattatttatgcaacgattttacgctgttttgcttcggtcagctttttctcgatgaattcagcaatgttatagtttgaaattgacgcaatcggatcgtacagcgctataatttcatcaaacgatacccgaaccacatgtttaaagtgaacgctccagctagtcgtaaagatttcgctgttgttgaacccacaatcagggctgaacatggcgcgatattcgtaccctgtgtattctttcaaacggtttgcgctgtgcgcgttgctggtgatcaggaatttcccctggtgagtctcaaccacaaagaaatagcccagacgttctttattgtccagcatcgtttcaaacttacgattattttcttcgcgatcaacacgggtttcgatcatcttccagacctgttcatattcaggccaatcatgctcgacaacaaccgcttccaggggttctttgtgttgctcttttcggtagcgctcaactttacttagcaccgcagagagaagcagtttatcgctatcacttaacgcggaatcaatatccgcatgtttcatcacgacataacgttcttcacgtttcatactactacatccttatcacagaccggacaccgaatcacacgatacacatcacgaccgccagtgtaatcagttgataccttttctttgacatcctgcgcagtgtatgacagaacagcaccacaacgacaggcagtttgttttggggtaatgcttacaacttgaaccataataacctcacaagaatagtttcacttcgctaccgcatttcgggcagacgatatgttttttcacgatgtaatcagcagcacggaagaaaccgttgtagaacacttcgtttttcttctgtacatcagacagttcatactctaacccacttttgcaattagcgcaaacggtaattagctttggactgataataacgttgatcatgtatacctcacgaaaaaggggccgaagcccccttgatcaaaaattgtcttcaacaaaagctgcaagtcgcccacgatatacggtatccaggatcacatgacttgaatgaccgtactctttaagtttttcaaccgcatacacaaagccgttgttaacagcagtattgcgcgggttgtcaatctgtttaatgttcccgcatagtatcagaagggtgttctcaccgcaacgggaaatgatggatttgatttcgtgattgctcaagttttgacattcatcaacaatcagaaccgaacctttacccggatcaggatgcccgattgagcgcccacggaagtaatacaggctagggaactggacaacgtttttctccagcagcccttctacgtatttgtcaacttccggttgatccttaaacagaatgttcaggctcgtaatacatggttctacagcaggacgcagtttttcgccaagagtaccaggtaagaacccgatttcgcccgacagagggctatctgccttgacatacatcaggtttgcgaagtgtcccgcgtttaccatgtgcattgcaccagcaacagccagcatggttttacctgaacccgccgcgcccatgatggtcacaacgtcattgtttttgtccagaatagcatcaacgaatgacgcttgcagagcatcgcgaggctgaattgttttcatcagcttacgctttaacgcctgttcgtgcttaataggcaacacttcaagctgaaactctccagcattcaccacacgccctacaatctcaccacacgatagaatgtattggttagggtagaaatccgcgtcaggaagcgatgaatacgttataacggcaacaggcccgacatactccaggacttcaacagtttcccagaacagaggcaggtcgatataacctgaatacaacacatcactatctttcagcgagtcatcgccagtgtattgaagaaccgaacaacctttagacatcgcgatcaacagcatgttaatgtcacgagtcaccagagttgcgccctgctgaatacaagttgcaatgatccgcgcatcctgtttatccagagggaattcttcggtgccgtcataatcgacgattttcagtgttacgctttccggtactgctgggttcgataagtttaacgaaacccctgtttgggtaattgcttcataattttgtcccaggattgctttggacaaaagccggatcgccagtcgtgcttcatgagcggttcgctctttgcttttcaggtgatccagttcttccatcgttgcagcggtgataatgatttcgctgtcaggttcgatgtaagaatagattgaatatgggttactaatcaaaacattggtgtctaatacgtattttgacatacattaaccttatgtggtttcgttaaaaaatgtgccgaaaacctctttcgctttccggtcataaacggcttttgcttcttctggagtggtataataccccaaaaattttctttttccatctatgtttatctgcgctttatacttcccatttgctttgtgataagaaacacctttcaaccccgtactgctgtttgaattacatttctttttcatcgcgttttgttggttcgtcgctttctgtagatttcttgctgtatctccattttcaacaccatacacatgatctacgataggaggaagataaccattctcaacgtaaaacactattcggtgtcgcaaatacatagaacctttaaaatgaatttgggaatactcgttcttgcttccggcttcacttccaggagacatagggccgcgctgaattttccaatacacttttcccgtagatgtatcaacatctacataactcagaagagactcaatcccttgaatctcttcctgtatggttcttgatgaataaccatgacttttcattacatacccaaacggataatatggatatatgggaacggatgaagatgacttgaacgcatacacaaggtcagcgtttttgccagttcaaaccgttcgtcgatcgtcatgtcgcattcatcgaaaatcaggttgattgcctgatacttgatggtctgaccacgaaagattgtccgcaaatcctgttttttggaaaggaggatcacgttatcatccccgcgatcgataccatttccgattgcttcatccatcgccatttgtttcgtacaagcaacgtagatattcagtgtccctttcgactgcttgatgatatcgaaagccgctttggttttacccgacatccggcccatatccagcgcagtttcgaagatagacaccccaccgcattcttgcccccaacgcccatcaatgattcgcgccaggtgcaggttacgtgactgctttacagcgtcaacatagaattgtgaaatcatgttgtcgccttatgcaagttcaacgtgtggtgcgtcgataaatttcgtttcaatcggaaggtttggatcgttcttccagttgataccgtaacgcagttttacgccctgttcatcagcggcttgtttcactgcattcaggacaggcaaccacactttcgggttagtctgccagccagcagggagaacgctaggatacagatccacagcatcaccagtgatgtgttttgagttcatggtctgggaaacacccttgcggacgttttcgcgctgttgctctacggtgcgcagaccttcgcgtacaccaaaatcaacaggtgagagttccagagcacgttttaccaccttaaccagttccggcttcacgccttgcaggttgttcaggcttttctgactaaatttaaacatacatacctctttatgaaaataccctatgggctacacagggtatttacggtttaagaggcgcaacgttttacatgtaaccccaaatcgattcttccgcgcgatcgcgtttccagcgaatcgtcatttcaacactttcctgtttgtcatcaggaggaagtttatcattattgatttgttcaatatatgcttgcgcatctgcttcgctacggaacaacgcatggaaattataatggttgcgcccagttacgttacgatcatccagagagaattgacctttattttcccaatcatcatacacagtgattccgttaacaaacagccccagcccacgatgttcacgcgggaagccagtgatgatatgttttcgacccatctgtgccttttcaccagtgatactgattacttcgtacaggattgcgccaggtttgatatctttcaggacagcacgtttttcaaaagcgttcataatgtattcctcacaattagttttcatatacagattaccacaatctgttttgatgtcaacaaggtctatcgtttttatttgggaaagttaacgtgaacaggcgatcgtgtaatccctcgatccgctcatacgcttgtttcaggatcgtcttatcttctgggttcgttgtctcgatgcagatcagttcgtccgagtcgatagcgatcacatcatccatcagtgaagcgaatacgttcacgtcagggtgagtcaattcctttatctccgcttccatcccgtcatgctgggataacagttcgatgatatcgcgctgtaaatctccctggtacgggaatccggtttgaagatggttgataattctttctgctttggtcatatttcacctacaaaaaagcccctttcggggctgggattaaatgtctttgcactgacaaacaccgtatttggtgaaaggcttgtcaccgctcaggtaagaccagaaatcgcaagcctgttcagcggtttcgaagattgcagcatcatagaagccgtgttcttcgttaccatctttattgaggaacacaggaagccagctttgcggtttgaagcagtcagtaacaactacccaaccttctttcgctttcattgcttctttgttcgcttcaaccatttccagcatttcgttcagtaagttcattttaatccccttgtttatctgtttcgttgtctacgagagagatattatcacaacggggattagtgtcaacagttattcgaaacgaattgtgctatttttgaaaaacattccagagcacacagatcctttgatctgcttgccgttcacaccagttgcttcgaatccggttgagtatgtgtctttttcagaacatgcaaaccacttgtaacccgtgaactggatgttcgtataaccctgtgcttccaggatacgctgtgcctctttctcgtcagtacagcttgactgcaagaacacaacaacgacaaccatcaaaatacacacaacaattttccacataatttatactcttttaaggttagttttgctggcttcgatccagcttacttggttagatccaatatcacccagacatacagttgtatgactaaatgtgttcggtaaagaaacaccatcaggagataacaacaaatcatgtacacttacgctggttgcatacaaataaccaccggacgtatacagtgtttttatgaaatcatatgaatcgttgggccacttgaaacggtatttctggttccagagttcaacttcatgcacatcatattcatcgaacaggggatcgttgccctttgtcgcttcgtaaagcgcaccgcgccattcaactaaatccgcttcgatatcacttacacaaaactcttcttttgcgctaagtttatcaagcatcatttcaatagtgcggatagccatgcttaattcacgatcgagtttcatacaataccctcttcttcgagcacttcccagatcaggcgatccaggtgcatcaggttccacataacggagtcatacgaacccagcgagcgggagtaaatcactccccatgaacgataagccttttggaatgattcagcactgttttcatcgtgcggcatatcgtcacccgaagcgatcagcagtttcagaaccatcaggctattgagcgcctttggcgtgaattcctgttcgcttaacttcatcgcgtaccgttcgatgatcgcgattgacttcggatctttaatacgcccatctgtacgacgcgttttaaacgcgctcattaattcatcaactacggcggtacacttcatatgcttcatccttttcctgtgcagacatccgattataacggatctcttcgcgctgttcaacttctctcacggcttcggctttcttttcagcggtcagtatgtgatgtactacagcgtttcggatttcccagagatattcaatcatctgcatatcttcaacggtgtgatagcctttcgcatcacattcaaatacaatttcatcgcgttctgccattgccacctgtgcggtagaaggacaaataaccattccagaatatttttcaatcaacgattccagtgtacgcggttttgctggaatgtcaatagataccggaaccattcgcatcgttgaatcattatgggattgataaatcatcagaatgtgatctccgcaaactgcattctacgctcaatcgcatggatagcgttatcacgctgatctttgttttcatatccagcccaggtaatcggggttgaacagatcaggtgaaaagtgattgctgggtgtctcttcccttcaacaacgattgttgcatcatcttcgatccaggttacgtgatccagattcaccggatagtttcttaccgtgacagtttcaccaaccataggcgacacatccaggatatcacggtcacgaacgtatgatttaatacgagatacgattaacattattttaactccactgcatatacatcggtttcaggggctttgtgtacgcgcatatctttaccacataccgcataagccggacagttacggcaaccgttatgatccttgttgccagtcagttctttacggaactgttttgttttcgggtgttcccagatatccttcacaaaatcttcggcttccagaacatccagaccttcttcccagccaccttcaacccagcgttcggtaaacgagcaagggaagaactgaccacgttcattgatgtaagagctaaacatcgtcgcttcacagtcttcggcgtattgcttgtactgttcaaagttcgggtgtccctccatcgcttcaacgaaagcgggggctgaacagctatcgaatccaaatcctacaccagaatcgaggcaatattcaacaagttttttatattgttcgcgggtaacggtgtcccagttcttaccgcgtcctttttgtttcagtcccaggaacacgatcgcgttgacttgtttcaggcgcggatcattcttcacggcatcaaccacgttaaacgcatcatcataggttttcgagctaaccatgaagtgaaggttgatttgctgttgtccggcttctgtcaggttcgctactgagtcgaaagcgacatcaaaaccagcgtgtttataaaccgataccgcaacagccccagcaaccgccgctaaacgcgctgcaacgtcttttgatacgtcagcaatggtaaggttcggcacaatgcctttagaacgcgcatacgccatcatatcgaacatatcggggtttgtttgcccctgtgcatcagcaccgagtgcgcattgagtaagccagggcattttgtcgatgatttttttgaagttggcaagatccatgttgaacccgttcgggttattggacttgtagcagaacccgcagagtttacccgctggcccgttgcatttggtagtgatctcgatatcgagaatttcggggaatggtgcgtattctggatcgtgggaatatgttgcaccccagcgagcgaattcaccagtatcaacgttgaaattatagttgtagaacttcgagcgagcgaagcgcatattgccgtgttgatagatgaacagggacggcgctttgatgctggtaacgatatcgacagttttcataatataattctcaaaatttaacatgggattggaagacagcgcgagcaaggctttcattgtcgaacggtatcgactggtgtttctctttgctgtcaatgttaacgcgccagaactcactcgaaccgtttttggtggagtaatgcatcagcgttaccgttttattcttttccaggaaagtacgtttgtcaatctctgttttgatttcgtgctgcatcattttacactccgtttcagtttacgttcgtcagccagttcttttttgtacagtttaatgtacttcccgttaagggtgcgaagctgttggaaaaccttgttgcacaaagcacgtttcgctttgtattccggcgtattgcggattgattcgatcgtcatacccatttcgtttttagggtaagcgcttaactccgcgccgatctctctgtaccagttgcttaactgttcacgctgtgctttgtactcttcaaaagttaacattataactgatctccgtaatctttcgctgcatcttcgggggttgcatccagtcggtaaagctcaacggctaacggactgggtttgatttcgcggttcaggatctcactgataccgcgaaggaattcgatataaggacggaatctcatttgatacgtaccgcgttaaaagccttgttgcgcagttcataagcctgttcaagctgttcagtagtgaacagagggctatcggtattagtggtgaaactgcaaatggttttgttgtcggcgttgacttcttcaacaacgatttcataaccccatgccccgctgtactcacatttcacgttccggtacttgatgtaaaccgctgcaacatcttcttttttgtagttccggcttttgtagatgatttccatgatatcctccttcgtttcgatgtgtgtacaataacagatcagggttatggagttttagcaattcgtgctaattacagtagcatttccatttgcaacagaacgctccagggattcggcggtaacagtgaattcagggaaccattgaccgatattgcttgaccaccaccagacattcacgccgtcagttttgaattcgatgttcaggtagttactgaaaatatgtttcatgttattccccttatgccattttcttagcgattttccatgcggctttgaacgctggaacatcttcaacatcaacccagaaaccagaaccgaaaccatcgttgtagcaagggcaaccgtcgcagtagttttcccaggtcatcactttaccaccaacagaagcaccagtttccatcgcacgtaatgcatcttcaactttttccagtttttctgcattgtcgtcataaatgatgaagtaccatttgccgttgtattcgttacccagtttgattgcttcgcgaacaagtttcatgatgttttcctttctctgtttcgtttcgatgtgtgtaatataacaaaagcccctggcggttgcaaggggctttttaaacaaaaagtgctattttgtttcttcgaggattcgaaggatttcggcgcgggtgattggatgttttgccagctcacggatcgcgtggtcaacgtgtatcttacacatcaaaaacttctccccgcacttgtcgcatgttgcatacatatcgccatgtatacgcccgatcccatcggttacggaatgatgcatccaggcgtaaggagttccccgcatccatccggtagcaacatgtttacattctcgttttcgtccgaacatattaccacccgttaggattgcggaaatgtgtttgccagtagcgcagttgttcgcggttcatgttttgggtatcaatcaccataccctgaatcatctgcaacatcatgcgggtttgattgacatcctccaggctcgctatacgctgttttaaggctttgttttcctcttctaactcaaccatacggttgtatgcgttgacgcgctccagcggcatatcaggacgctctttgaggacacgggcgcgggatacttcacattcatgatttgctttccagtgtgcggcttctgattctgctttttgcttgtctcgaagcgcgagtgacagatcgctaaccagatccagaaccgtttgcggatctacggtttccagatattttccgagaccctcttcccagcttttaatctgtgtagggctgtcgccatatggaacaccatatgagaacgcgcgtttatactctttgcccctgaaaccatattcctgatttccctggatgctcatattttcaacgagagtccacttactacccatcatagaagaaatcgaacgggctgatttttcaatttcttcaagtttttcacttgttactttcattttgtactccacaaatcatattgtgcgcgaaggatagcgtaaaggctaccgatattgattgaatcgaccggacactggaacaaatcagagcgcatcatattgaactcaatattgttctgttcaacgaagttgccaatcattgatgtccagcccatcaccaggttatatccgtcttcggataacccgtaagccaggttaaccctgatacaacgcttatcagccagttctacgctgatacagttacttgaatgcatagaattgcatggaaatttgctaggaaacttacggaacatctgggtaaggagtttagccgtttcaatgttgattgcgcgttcctgatccctttgcgcctggttgtcatgacggcgattcagatacttttccatttttgggttgagattcacatgttgcataatatattcctcacaggtttaaaacgttcttttccggttccattacatgaactgcatttcggagatcggtcgctatcatatcgccccgatccgttacatgcaacacatttccgtaatttccagccatacacgaaccgcatgtaataatcggttcgtgcggccttgcgttcgtggaagttcatactttgttgtaaacctgaacaacccacatttcgatgttcggtgagtaagtaacgttcaccatcggcatagtgcggtatttgtatgcggctttgtacgcatcgagttcagtcggaacacagaaagagaaaccgttgtcataacgttctgcgttagaaacttcacaaccaactacagaagcaatgtttttgttcatgttcatgatgttttcctttctctgtttcgtttcgatgtgtgtaatataacaaagcccctgcattgctgcaagggcttttttcactttaatcgaatttttctggcaactggtctacaagtgcttgagtttgatgaagttcttcactcaatttatcacgataatgaaccaattcgcgggttcttgatgcggaatagctaatgagtttatcagcggtagcggtgtaaccgtaaccagcacacgcgatttccagttttgcgttatcgccgttaggtacgcggatatgagcatacgccagcaagtttttaaccgcttgcaacagttcatgatcttctttgccgatgataaactggtttggttctgctgaatccatatacagttcttcgtctttgttcattttgcagccttatacatttccaggacgcggttcatgtgatcttgagattgaggcacacccgcgaagttcagtttgatgaagaattccagacgatcctttttggtgcattcatccagccccagggcaggtaatgaaatgttttcaaaggctcgttgttcgtgtcgtggtatttcgtcccagaacaaacgggaaccgtccggcataggaatcccaatttcaccttcgtagactttgataatcgtcgtcaggcgttgtttgccgtcgatcacttctacccaatgggtttcgttgaactgactatcaaccgcgatcgcaatgataccgcaagggaaaccactgatcagggtagtcagaaacgcatcttgctctttctgcgtccacacataggggcgctggtaagatggattcagatccagatctttattcttccaccaatgcagataactcccaaccatgatcgcgtgatcgcgactgcgaaaagttaactgatcgcggatacggttatgaaccggaatatcatctttagacatgattcaccacccagcccaacaaaccagtattgatagccgcaacggtaaggcaaatcaccgccaacacccgcgcgttatgaactttggttttcagttctgcgatctcctgatcattttcactttcgaactcttcacgggttccatagtaaccaggatcagcagcggttgccggacgaactgcatctttttcaacgatggttgcataaccgctcgttactttcgttgctccgtaccagtcaccgcgatcgttattgatgatcaggtgatcacccttcgcgttatgcttcgacttaccaatgacaactacacgttcaccattcataatataatcactctttcacgttttgttgtaagaactctaacagctttccttcggcctgtaaagcataaagtttattcagctttgcgatattttcaaagtctgatttttcgctgaacgaccagaccccatcatcggaaaccagcgcaccgattgatacgccagtttcaggatcacgcgtcaacgccagccccaggggatgcaggatatctttattgattttccaaatcagccccaattgagataaggtgttgaaatcaacgtgactcatttaggcaatgccccgaaagacagcagccccatacgatgatcgttatctgattcaccagtgctgaattcaaattcttcaccgctgatactgatagcgcggaaaccgtctttcaggtatggcaacagatacagagggatcagcatcatgtttgaatcgtcgctccacttacggaagcccagatttttcatttcttccagcgtcaaatcattcggatcgacgggttcgaaatcaggggaagcgtaaaggcgtccaggcagatcgcgaatatttttcacggtgaatgaatcaccccaggactgatacacggtaggttcagcggcgcgggttgcggtagccaggaggatcatttgacagatttgaaaagttgttgctttcatgatgtatatcccacaagtttagatagaagttgtcccatagtcttacgcgcatgattgcggatctggctatacggaacatatttgaaaccatccatttctgtgatggttcgcccgttcttcacaaacgtagacgcacagaaacatttatcggcttcggggtaattgtcgcctttatacacgaataagtaaagctcttttttactggtataatccagtcttccgaggctttccagttcgtgcggttcaacaagcactccggtttcttcgaagcactcacggatcgcagcgtgaataggttcttcgcctttttcgatatgcccctttgggatgtcccaatgaggcgtttcggttgcatgacccatcaaaacgctgccgttattcaggaagagaataccagcagaccgttccattactgtgctccgaacttactatcgtatgctgccagcgctttatctgctgcatcaacagcctgggtatgtttgttagcggagttctcgctgaatacttcgcggtaaatgccaacccagagagatcggcgggtatgttcgctttcttcgttgacgcgagaagccgcaaaagcgttatgctctttgattagttgcgccagttgcacatcatgattgttttgttgaatagctgtagaagtcataattcacctatttctttcagttcagttttgagtttttcgagggttgattggtactgaatgccgtgtcgtggattccccagtcgggcataatacagcgtaccagttttgttgatatccgacaacacctcttgatcgagggtagccggatcaataccgaaagccattttaaacatggtttccgcgtctggggcgaatccgtgatagaatgcaaaccccagctttttatcaaactgcatcagggatactttattcactttttccataatgttcttcgtagtcatcacattcagggagataagtttcgcagaacatgcacagcgtgaagaaagtaggctggcgaatcccgatattatcaggtaagtacatccagaacgtgttagcaaacacgatgaacgttttcaggttttcaacggttacggtactgacaccatcataaccggattgagcaattgcgcgttccaggggaacagggtattgctcgcagtaatcgacgtaatgatcgcttgttaccagcgcattagccgcctttacgagatcggtaattttcatgctcttacatattccactttgacaggttttgcaataaggcgttctttggtgaagccttgcccgttacagatatcacaagtaacgttgaagtcttccatctgatcaacccagccagaatccggtaagccagaaggatacgtgttaacacgcacaacttcgaaccctttaccatcgcatttcgggcatttgtgcgggtactgggatttaaccatactcagcagttgccccagcgttgttgaacgatcgaagcgttcgaccagtgccattacatcagcaatacgaatcgaaccagcatcaataacggtatacaggtttttcggtacatttgagcgcatagtatatttctcacttaaaaatttttttgatgaaagagaggaacaatccaccaccgaacatgatccagtatcccgcgccgtcaccattaaacaggacatacacagcgacaccatagcaaaagatttccgcgatattcagtaagtttctcataactccctcctttgtctacaccaggtattttaccagaaagtagattactgtcaacaacaaagttttatcaacccacttatcaccagtcattagtaatcccctacaggttgagaagatgcaacgctcaggatacggaaagagcattcattccatttgcaataagttttcgcacagtgaacagtgcctttcattacaaacccgtttgagaacaccagccagtaaagtttcatgattgcctcctttgtttcgacacccctaatataacaaaagcccttgcattcgtgcaagggcttttttcaaatatttttcaacatgtgtagttgaggcggacaatcttttgaagcaatcaggcgatccaggcgtgacataacgcgtctgtagccgtcatactcgaacttgattttgggtgcgatgtagtttatatggatcgcgtttctcgtgttcaggctcaacgtgtactcaggaataacggttcggaatcgtacagcaatcactggtttttcgtgagcaacagaatcatccatgttttcgaacatctgaacagtgaacgcacaggcaaacactttgccattaatccggcgatatgcaatgacttcctgcataccttcgtttttcgctttcaccgcataatgcagaacgttacacgaataatgtttagcgagactattaagaatttcactgtagatcgcaaagtcttttttgactgacgcggaacgatccaggaatcggtctgcgatgtgatctgtagtcattgaaacctttgtcacataccaatcacttaacgctttactgaaattttggttaacttctctgcgtaagttattgataacatacatcaatcgtgctctgttcataaatcacccattatgtttgaagaactcaatctggcataaccgtttttcggcggcttccttcgagtcatattcaccaagttcttttgtgcgatcgtggttcagaataacccatttatcgccgcgatgttcgatgtgctccgtgatgtcttcaactttcttatcaagatccagcggttcagcatcttcctcgataatagtcaaatctacgggcagtgtcaacagtcttttaactccgctggtatcttcgatgtgggaatcatatgcgagcgttacgtgtggtttgtaatcgtcataatcgtatgttgctccagcatccattgcatctttgaagcggctatggagataatcagattccagaacgcccacgatcgtattaccgtatttcgtgtcccacttctccacgtcaaccagtcgggcaggttcagagataccggaggcagggaacagatcaaccgtcttacggctatacacaatcgttgtatgcagttttgcagcggaaacaggattctctacaccaagaagtttttgcaccttcgcgagcgcttcacaggaagcctgatcgaacttcgcacacatatagatccccgaatcaactacgggtttcgctacttcaagaaaacttttcatgtgtactccaaatgaaaaaggggctttcgcccccagtggttaaacgcctaagcgttaattatgcttttgatgcatcaatcgcttcattatcaccagcgatttctactgttgctggcagaagtgctttgatcgcgccgatcagggcatcaggggatacaccctgcgaaccgtcgatttccagaagaccgcaaatctggcctacgagttgacggtgatttgccagttcttgttctttaccctgaatgatttcgttcaggtcgaatacacgggctttcaggatcaggacatcgttttgaagctgttgggtttggttttgttcagtcattgtttacactcttaaaagattgaatacattaagcacgttgcgtttcaaatcgtctaacgtaccattatttaggattgtataatcactcaagccaggtgtcaaacctttctccgttgaatgattatcttcaataccagtttcacgttcaaggaacacaaagcgagtcccgaacttgctcaggtatttatattcgtgcggttgacgcacatcggtaatgataaagtgatccgcataggatttcaacattttttgaagcgcaattgaagtccagatagacggatctattttacaaacaatatcagtcccgaacacctgcatcaaacggcgaatcgtccagggctggctgttttcttcgcaaattttatgagcgataacatctgcgttactcatgaagaacccacgagaacttaattttttgataccgctagaaaacagcgcgtatgcgtcgttatttgacatcaccagcggggcttcacgatcaccctcatagaatgggttcttcgctgccagcgctcgcaattgcgtattatcatgatgttccatagaacgtttcaggatagctttgatttcgtcggctaacgcgataacttcaacattgcggaagttatgcacaaccatttgagcaacggtatctttacccgttcgctttttaccacaaataccataaatcatttttgcgttttccgtggagtcggcacgatcacctttccgtcgatttcaatttccatgtgtgcaaagttgaacatcgtcatacaggatacggcttcatccgaatcattagtatacataagctcaagctctccgaggttggagggccaagcgccatagaagcgaaatgtcgctacagtttttgactgcgagttatccaggatatgcaaggccattgcctgttgtggttcactccagcgaacagactcgaaggtattgaaatctacagtaccgagcatccaaaggtaaaccccaagatacgatcgcagttcttcatcaacagcaaaacgaatagtcagtggatcgaactccattgcagatccagggatcttccctcgaatcattgggttcagtgggacatccgtaattggaatgttgatagaaggtagtgtaacaccctgaacttgtagtttcaacccttttacataatcattgtcaggaatatctaacatgaagttagtaggtgaaatctggttcaggatcatagcagttgtattcatgatgatctccattttatagatatttaggttagaccgtgagcgaagcgaacacacgaacgaagtgagtgttgggtaactaaactacagaactacattattatatttttatattttatatatagagaaaactgtagtttttagactagtttttgaacagttgttaactatccgtcttcgcttcgcttgacggaactcgcttcgctcgcgatctaattttttagttgatctattcaataaataggtatatcatacctatactttcaaaagagattgaaaacatgaaatcattcaaagaactactttctgaatctgttcagaacaaaaaatttgctaaaaccgttgaacttgttgatcgcaacggtgttgctccatcaaaaggtcagatcggtttcctgcatttcgcacacggtgctgattacgatgtttatgcgccggattcccacgatctcgcttacttcggtaaaggtgttgtccgcctgaaaggtaaaaccactggaaaaacccaggcagcgtatattgactgggcgaaaggcactgtttcattctacagcggtgatcctgctgatgacctgaaatttgacaagccgctgaaattcaaaggcgcttccctgtacaaagaagccgaagaaaatctggatctgtataatcagttggcggaagatttcgaaattgatctgcctctggatgaagcactggtgaaaggaaaggtgtacaagctcccatgcaacgatatgtgtttgttgtataccggacgtaccaaaaccaaagctacaggcgaatacgccgtgtttacggttgtagatgcctctggtaagcctcgtctggtatcgggtaaacgctttacccaggaatacaaaggtgatgttctgtctaaactggttctagctgaatcagaagatttgaacgaagccgctaaagatattcgcgaaaaagttattgctgtattggtgaaacgtgggtttaacgaaaaagacgcagaaaagatggttgataaaaacctgaaagatgcgatgaagattcgacctggtgcaacccctggcaaactcgcggaaatcgtgagtatcctgtaaaaaaaataaagccccttcctttcggttggggctttttgttaatatctgttccaaactttcttcgcgctgtatggttttcctttggactggaaagcctgagtaggcaaccaaactgctttcgcccaatctttcggggcgatttctgcaagtggtgaacgtagatgggctggcaggtaggctttgatcatttgatcagccccgcgcattcccttcacgttgttccagttgattttcagcttagtcttattcgaaagacggtctgtagatccgtatccacgtttcaggagttcttctaaaaactcttgacgtgctcgcggtggcgcataatgcaagttcagcccgtacataaccaagttacccgctttcgaacgtcccgaacccaggaagatgatcaacgggaaccgatcccagtatggcagggtgtctttgtattttgcatcgtagatgaacgtatacaagcgccctgttgcgggtttcgcgaccctgtgcgtcttaatgctggttttgatgaaatcaccaaaccaatcggtcgaatctttctgacgtttcgcagcggttacaccaacagtcattttcttcaaactgttgcggaaatcgtttacgatatcaaccgcgtgttttttgcgatagtcgttacgtttgcgtcgggcttcggtttctgctgtacggcgttcgatttcatcatcaatctgctgcttgtagcggtgcatagactttgtgaacgttgcgtatgcaatcccgttttcgtccgcgaactttttggctgtcataccttttaattttgcgcgtcggaatttgataccaagttcaacccattcacccagctttcgcttcggtggcggttttggcttgtcttcttctgcgatgatctcgaactcaaaaataaagctcataattccctccgtttagggtatttattgccctttccatccgaacacacgtttcaacgtgtcctctgtgatgatcttgaactcccagcccttttgttttgctgctgcattcgcggctttccatttgtcaatgtttaccgcataagtatacagcgcatcaacaaatttctttttgttgtgaacgttgttgttcgctggcttaggtgggggcaacgtttctttcatcggtttgacttcccaaaggtaggtcacgccgttatccatttcgacatagaaatccatgaagtaacgccgtcgctttccgtctgcgttgctgaaatacgggatcacaacctcttcactgttccagcgtttcacatgcgggtttctgtcaagccagttcataatatatttttcccagcttgacctatacgttatctttcgcggatctcccttatatttctgtatgttctggggcataaaagaccccttgtatgtctgtcttccagccattttagatcctaaatatagtaaacattagataggggaaattacaatgttgttctcattcttcccgcctgttgattacaaaggcacaccaactactgatatctaccgcgattatcgtttttactttaaccgcgtgatcaggaattataagccgcgtacatatcaactgacaggttcattaagacccgaacaattagcggaaacgctatacggaaaccagcaatactactgggttatcctgatgcttaacgataattacgatccgttttacggatggattaccgatcaggaaacggcttatcaatgcgctatccagcgttattcaaaagcaggtggtgaacaagttctttatcatatggatggtaagggcaaccgttattacaatttggttgaagaccctacgaatcccggtcattggtatgacaaaggcgataagaacatgcgttatttgcagtaccagggaacattagtccctgtagatatttatgaagatgcagtgcttcaaaatgaagcaaaacgaaccatcaagattattaacccctctgatattcaatcgttcgtaagcgattatatcaaggaaatggaaaaggcgaatctatgaaattcggtggaaatatgcattcccctttctttgagggggtggtcgaaaacgttgatgatcctcgtctactggggcgtgttcaggtgcgtgtatttggtgagcatccggcacagaaacaaaaatctgaaactatcggtattccggttgaggaattgccgtggatgatgcctattcaggatattcgcagcgccgctatttccggtgttggtttttctccgactggtatcacgcgcggtagtttcgttatcggttactggcgcgataaatggcaccaggacggcgttatactgggaacctttgctggtgagtaccgagagaaaccggacacccagaaaggcttctgtgacccgtttggtgagtatcctcgttatgtgggtaacgatgttaacgttctggctcgcggtggcgcagaagggcgcggttcttcgagcgtcactatccgtgatgcaaacagttcattagcagtcaacccagacgatcgcccattggacgagattccagaagataaccgacctgatactggtgggtttacgatagaaaaaatgatccgtggtgatgaaggtattagattgacgtggtattatgatgttaaaggttataccatcgggatcggacactttttcttgaccgcaccacaaggaacagacccagcagttgttaacgctgcgttatctagacaaattggcagaacggttactggtgttcctggatcaatcactgctgatgaagcgagtgttttatttcaacaggatttagctaaagttcataacgatattcagaataatagcaaagttcgggaagtgtatgtgacgttaaaccgtcctcgtcaaatggctattgaaaatatgtgcttccaaatgggcgttggcggtgttgccaaatttactaatgctctggctgctatgaagcgtcaggactggcaaaccgcttacaacgaactgcgaaactctacatgggctaatcagacgccaggacgttcttcacgcgtatctaaaatcgtgctgacgggcaaccttgaatcatacggtgttcaggttccagatccagaagggcgttcattgagtgctgcttataatgcggtggttctgcaagcaagcaacccagaagatccttttgttcctggcgatacccgcgtaatgttcgaagaacctaaatcggcatatgctgctgaatatccatacaacatggtattcgaatcccgttctggacacattcaggaatttgacgatacaccaggctttgagcgttacaaccgcgttcacccagcaggatcatacgaagaaattcgtcctgatggaacccgtgttgttaaaatcgttggtgatgattatcagatcgtcatgcaaggccgtaaattaaacgtcaagggtaatttacaggtcgttatcgaaggtgacgcattcatttacaatatgggtaacgttcaacagaccgttgatggtaacgtgaccgagttcgtgcgcggtaacgtgaatcaaaccgttgaaggtgaatatgtggggctgattaaaggcaacgcagaattaaccgttgaaaaagatgcaaccgtaaacgtgaatcagaatttaatggctaacgttaaacagaatgcaaccgttgccgtaactgaggatgcaacaattaccgcaaaaaatgctctgattgatattgagcaagatttggatattggcgcacgtaatatcaacatgcgagcatcgaataatactttcattgattccggcgcactgactaagatcactggcggaacagtccaggtaggttaatcatgatcatggattatgaaaccatcattgatgggattatgcaaaattttcagcatccttgcgatgctgagatccccgctggatattaccgacgcgttatctggcagggacacacagaaaattaccccgctgttggggtagaatgggcgaccgaaatcatcccgatcggaactcacctgtatacgagttcccctttcgggcagaaaagcgatccgcttccggtggtgaactctccaaacgtacccacaaatccagatggaagccctggagtttctactgacattttggttacgaagattggttattatttcgccactcaagcggatattgatgcctatatcgaatctatcggggctactaagctcgcgggtaatgactggtatggggcggatctgtcaaaagcgaatctgttcaagaaccctggcgaactcgcgatgtacaaggtggaaaactccggtggttatttgctgacttctggcccccgttgcgatcagcgaatccgacaggtatacaatcagactacaggcgcgtttaccagcattgattattactggaatggtaatcgtattgcgtacatgaaacacgacgaatcccccgcgcaccagtgcaaatatacagggatgtcagtaaacacgaacgcagataccagcattcctccggttcctcctgctctcccgtcaacgtatggggcgctaccgagtgaagccagattattttctgctcgttctggattgggctgtattccggcgaccgtagggttcccgtatacaaatatcagtgatgctatgctgtctgcgtggaacgagactcgtaaaacgttcaagctggcttttgatatgctgacgggtacgattaagaacggtaagggcattgcgacgatgtttgacgggctttcgatcgggatggaagaaatcacagcgggtgctctggcattgtcacagcaagcatggcaaaccgcaatgaaggtattccgacagatcattagctctgcgtttaacatcgtgggtggggcgtgggatttgatcaagaatttcctcccgactgttgcgatcatgggtgttgcgatcaacatttacgatctggtgtttggtgatagttcggttcaatccctgaaagattctttccaggctctgattgattccggcgcacagacgtatgaaagcgtcataaacgcaatatacggggctataggcagttcttacaactacgccgttgaatatgtcaaggctggcgctcgcgaccttgtagacgcttgtagcgcgttatttgactggtgtttgactatgttccaaaacggttgcgttgctttggtagatttgtacgggcgcatgatgcagatctggtcaatgcctccagaaacaccaaacccgctttggtctgcggtgctggctatccgtaacatcatgaaacagattaaacctcttgatgtgattctgggcggtaacttcccagggtttacagcaatggatctgtatcagcaagcacaagcgaaagtgaaagcgttcattgatgcatcctatgcgcagatctccgcactgtatgatcagggacaagaattattcaaaaccctgaaagcacagacacaggaaagggattcgattaaacgtaaattcgatcagtacctaaactggatgtgggaacctgtaaaggaagcaacgactgctgcttatcaggctgcacttgatgccgctaacgctgctgtgaatgcgactaaggccgcatatgagggaatcaaagcacagattgctaatctgcaaaatgggatgaaagacacctacagcatggcaatggctgaactcaagaaactgcctgtaatggctcagattaaccagttcttaggttactgtggggttgcattcgatgacctgttaaaaacgtatgagaacgcgctgacgggcgcacaatcgctatataaaaactttgttgacagttcccgctcgtttaaggacacatgcaaggtgatttataaccagatttgtacgcttgctctaagtaaggtaactcaatacgtaaacaaattattgtcattaatcggactcgcgatcacattcggttcaattagtgtttgcgtccctatggttcaatactaaatacccgataacgaggggtaataatggctactacaaagaaacaaattaatcagatccccgatatctttgtcggggctacttttgacgaaatcaaatctgacttaatcaactggctccgaggtcaggacgaattcaaggattatgatttctccggctcgcgcatgaacgtacttgtggatctgttatcatactgtacactatacattcagcaaatgagtaacaccgcactgttcgaatcgtttattcgtaccgctgcattgcgtagttctgttgtccaacaggctcaggatttgggctatatgccggactcccgtaccgctgcaaatactgcgatcctgatcactgcgaagaacccactgaacccgacatcgatccgtattccacgcggtacgaaattcattggtacagtgaaagaaacaaacagtttcccgttcgtcgtatccgatgacgtggtgattgttcgtgataaagacaataactatgtttcgatgttgaacatcgtacaggggcgtttagtccgtaccgaagtcatctttgatggttctacgatcctgattcgagatcctaacatcgaccgtagtcaggttcgcgttactgtcaacggcgctcaatgggatgactggacaaacgaaagtatcgtaaacgcaacgggcgcatcaacaattttctacatgcgtgaaactgtggatggacataccgaagtttactttggtgaaggtgaaaccagccaacaggtcgcaggtggtgctctgactgcggattacatcggtggcttgaaacctgcaaacggttcaaccgttgttattgaatatatttcaaccaacggcgaagaagcaaacggtgctgaaaactttgtctacgtggatacgttgacaaacattagcattacgaatattgttgagaacccgactgattcagcggactatgtaggcgctgatggtggtggtgaaccggaagatatcgaacgtattcgtgaactcgcgcctattatgcgtgagacacagcgccgttgtgttactgcatcggattatgaatcgttcctgtctcaccgtttcggttctgttattcaggcggttcagtgctttactgataaagaaaaacctggctatgcgttcatcgctgttaaaccgaaatcagggttgcgcttaacctctgttcaaaaagaggacatgcaaaactatctggcgaagtataacctggcgactattacgccgtcgatccttgacccgaactacctgtatattgtacaaagcgttaaagtaacgtatgatatcagtaagttgatcgagtctgaggaatggttgcgtggtcaagtaatcaatgaaattgacagatactacacagataacgttgaaattttcaacaaatctttcagtaaatccaagatgttgacttatgttgataacgcggacgtgtcgatcattggttcttctgcgactattcagctattgcgtgaactggataactattacagcgccccgatgtctggtattcacttcttaaaccaggtgaaatcacgttctgttgtttcgaatgggttcaagtacacaaatgctgctggtgattcgtatgatgtgcgctatgcgtcaacagatatgaacaccacgaccggactcgcgaaaatggttatcgggccattcaaaaacggtgatatcggtatcgcagcctatacaggaaacgattttgataaatatcctggagtaaccgatcgtgataaatattacgaagtcggctatgtggaacattttaatgatttcattagtttcgatcttggtgtcctgaacgttccatccgagcgattcagcgctgcttacatcgaactgactggtacacctctggaagagaacattttcacccgtgatggttctctgattgtatttgaaaacgatctacgtcctcaatatacaacgttgacgatgaatccaatcagtcaataatttacaacccctgtcatttggcaggggttttttgtttgctaaatatgggatataagtaaaacgcaaatttggagaaacatatgattaaagcgccgtcaattaccagtttgcgcgttgataaactggctgctaacttcgtttatttgaagtgggatagcgtcggcatggatttttactatgtcgtggaaatggcagaaactcgcggggtaggtggtgtaactattccagatgaagatttaacctggttccagttgggttatgcttatgtaaacgaatggttttcttccgatgttcagcccaacaatttttacaagttccgcgtcatggttacgcacaagggctttgaaccgtctgactgggtttatacagatgaactctggacgtttacccttaacgcttacgcatattcaaccatgcgtgaatttacgccaagcgatgcattcataaacgagaaattcgcaaaaaataatcagaactacgttaactttaatacagatgtggtaatggcagcgttgatgaaagaagactttgtgttttctccactttacactgacgtatcccagatcagcgataaaattcttacacaagaaaactatcacgaaatccaggatcatattgaacacgtttgtaatgacattaacagaactttcctggtagcgtcaaacggtttattgtacctgtttgaacgttttcagaacatggcgaaggtgtcaaacgacaaaggacaaacatggcattactacaaggcgtttaacgaccgcgtaggaaaccctgtatcgcgctctgttgcgtaccaaagccgaaacacaacctatgtactgggttacgatcgtatcttctacgggcgcacctcaacggatattcgctggtctgcggacgatgtgcgattctctgctgatgatgttacgtttgccaaactggggaaccagactggccttgatttcgatgtggactcatacaacacatttgctaaactgcctggtaacgtatcgaaatatgcagaagcaatggcatgttccgatgactggctctatgtggttgctaaaaacgttgtgcgtcgtatcgcactgaaacagacaccgatcgacaccgatccgagttctccaacgttcggagaaaagattttcgatactgacagctatacagttgtccctggaaatgataagatcgttgtcaagaaaatggatgtgatggatggtattctctatgcactcgtaacgggtgaagtgaaaaccgctctgcaagatcctacaaaacccgctaacgtggttccgtccgctgctgctggtgtgtatcaatggcaagaaaacacgaaaacctttgtgcgcctgtatgggaacaccgaggaagaacgtttttatatccagcatgaatacaccaatatgtcaacgaacggcacggagatttttatttccgtagcgaactacaaatatccaggcacacttcccgatcctgaattattgatcgagaaccctgcactggttggtgctgtaaaatatgatttgcgtcctggctatactgccagccttgcgattaactttgcgacgattcgcgctcatatcgacgacccgactgtttggaaatttggtgcgcaggaatactacaacgaggcgaactatagctggttcttccgcgactctgtgcgcacatggatcactaatgataaccgtcctctggtggtgtatccgaaaatcacctacagccttgtaaccgatagtgctggcccttcgtcatcgcttcgtgtgaacaaagaggtatgggatcgcggacatgttacgatttacattaacaacattaagtttaccggattcacgaagtatacgaacggtgtgttgttgtataagagttcaggcgaaatcattgggttctttgaattgagttatcgcgcccgtgacagcttaactattttctggaaaccagataacacgttgctgattgccgatctgattcagcaggaacgcgaaaaaccgtatacaccggatctgtcacctggtttgattgacccagatttaagccatatgattacgcgctttgcgcctcaaagctatctggatcagcaatattttgagaagttcggtgaatattatttgcagttcgtttcgctgggtgaaaacacctactataacaagctgctgaacctgatcaggaacaaatatccgcgtgagaagaacagcgtagaatatctgtggtcggaagtaaaccgccgtaatatctacctggataaaacgaagcgcgatcaagtggtacgtttctttgaatctcgttgcagtgatttttactcaacgaaaggcatcgaagcaagctataaattcctgttcaaattgctgtataacgaagatgtaaccgtagaaatcgaaagttcgaacactctggaatatgatattctggttcagtcaacgaatattagtcaggacatcgtaggccggacgatttacacaccaactgcaagagcaaacgtgacgtatatcgaacgccagtatgatgacggtcaattacgctggtcaatgactctgcataacgtgatcgggaacttccttgaagggcaggttgtcaagtctgaaaagactaacttcacgggaactattctgcgcggtgtgcgtggtaagcaaatggcgaacaactcgatcgactatttcaaccgtgggcgttcatactatgtgatgaaaattcgttcgaatctgccagcgtcacgatataaggatgacgttttacgattcgtgcatccggtaggctttggttttatcgggatcaccatgttaacggtgttcattaactccggtttgtctatgacacatagcgaaacgatcattgatattcttcgaaactatcgcttcgatagcggttatccgaagtattggcctgatcgtgtagcccgtctggacggtaacggaaaccagacatttgacctcgtaacaggcgaagcattatacgaaccacaccctaaagcgggacaaccgttcgatgttccaccagaatatgacgttgaagaacaaccgctgaatggtgtattaccttccgcgcgtcgatttgatcaaagtcctctgttcgatagttctgcggttaaatactctcagttccgtaacttagtggaaaaacgattgaaagacgacgcgggtaatcctcgcgatccgaatccaccgactcagagaaaggtagcataatggctcaacaaaacatctaccgtgcggttgtaactggtaagttccgcacggaaaacatgatgaactttcgcgaaatgatcggggatgaccccgatcataactcgatctatatgtcgatcgggcgtactgaacaatgggcggataacgaatccgatcctgaattcgcgcccccttatcctaacgatgatacagatggtatcgttgatatgtggacgcatatgatcgggatgacgaaagtaccaggcgaaatgattgatgcaatcgttccgcgtaaagactggggcgatactcgatatcctaacccaaaaatcttttacattaatgacatcgtggtagtaaactccgctccttataaccgtactgattacggtaaaggatggatggtgtatcgcgttgtggacgttcctgatattggttcttgctcaatctccagtatcacgggtaaagttgaatgtgtgcgcattggtggcatttggacaccgacccacgaatcggtcgaacctccacgcggagaagcgaacggtatcgacatgggtgacggctatatctgggaatatctctacacgatcccgcctgatgtggttattaaccgatgcacgaacgaacatatcgttgttccgttcccgaatgaactcgaagaagatccggttcgctggggttatgacaacgtgatcaagtggtatccagatatgtatgatttggtgttccgaatgaaggttcactcaatgcgattccgtgcgtacatggattccctgttcttcccgcaagcatctttacctggcaaccgtggattccgtcaggttagtgtaattgtaaacccgttgctgaaaaaggcgcaaccgaccgatccagaagtaaaagcaacggggcagtattacacgaaagaacagcttgaacttgactcagggcaaatgatctacatggaaaaccgtcaaccgattattcgttctcctgatcagaccgaagaagtcagtattattttcgaattctaaggaaaaccataatggcatatcaaactggtaaaaaattaattgacgtggggcagatcggcaacccgtcaactggtgacccgctgtatgacggcggtgttaaacttaacgaaatcatcaccaacatgtacaacgcgtttggtgatgtgcgtttgttgactgcgaatgatggtgtgggtacaatgctgctccacgcgaccggatatttccagaaactaccacgaacctattattcaggcaacccgatcgaactgggttcattgcatgatatggatacctcaacaggcccgattacggtcgtgcttccatcgggtaaacccggcgaagggttctatttcataaatagtaacggtagcatttctgttgatcgtcctgttgtattccgtccgcaagttggcgatggtatcaaaggggttcaggatcagctttacataacctctccatatactcagattaaaatctggtgtgtgaagaaagaaggttctgtttctacatgggattattctgttgaatcaatgtttggttcaaagacaatgcctgttgatactaccaaactcattttgaaagcatcaccaacggctattcctatgtttggatatagcgaatttagcggcgctaaacttctcgtatacgcggaaaacatgacaggcacagtcaataaaacagcagaaattctgcttgccgtcgatcgtgtggctaagggcgtttattcaaccgaatacgcagttcttaaaaatacagaagatgaaatgtatacgcttaattttactgttggcgctggtgatgttgtttacgcaaacgtgcaatcgaaaaccgaagatcgtattaaattctcgatcaaagcggttgacaccatcaaatcagggatcgcagcatgaaacaagaaattattatcggtaacgtggttgacgatggcgcaggtgattatctgcgccgtggtggtcagaagactaacgccaactttaccgaattgtatgataagctgggtgatgggagtatcccgcatccagcgggtgcgtggaaaacgcataccgcgcctacgctatcccctatctttggtgattcatgggcgctgaacacaagcaacaaccgtattacggtaaaccttcctaaaggcagcgtaagcgattataacaaggttattcgtttacgtgacgtatggggtaagtgggcggcaaacaacgtccgtatcgtccctgcaagcggagataccatcaaaggttcaccgaactacaaagaactgtacaaagatttgatggatgtcgaactggtttattgttctcctggtcgttgggaatatgttgaaaacaaacaggttgacaaaatcacaacttcggatctggctactgtagcgaaagaaacctatatcgcgactcagggacaaactgacttcctgaatgtgtttggccctggtaactcttacaacgtccgcgcactggaagtttactatcgtggtaacttgctgtacatcgacgacaagaacgggtttaatgcatcaaacagcgattacggttcacctggtgcgagcgccggacaactgatcgaactggatggtgtaaacatacgtcttaaaaacccgtgtaacgctggtgatacgcttcaattcgttacctatctggatggtattgccgcatggcgagcgacgtatgaagcgcatactatgcgcgtatataacacgggtgacaccgaacaggtaagtatccctggtgaaatttgggttggcgatctgccgaataaactcacattcaccactgctgaatttggtatcagtccgcgaattctggttaacccgaactcgttcgaactgctgctgaacggtcgacagcttgttaaagcaggtgatgcggatctcccgacatttatttgtgagggcgcagaaggttatgacgaagatagctgtattgcaaactccggtttgtgggttccttctggtcaggattacagtctgatttttgttgattccgaggttactggtattaagtttgctcaacctctggaaactcgcgatgtggtaactattcgctggttcaacaatgatatcggcactgtaatggaatgggacggtgtaggcggtattaaagaacacaccgataagatttatctgaataacgaagaagaagtaacgctggttaatcagattgaatacaccgattataacaacccgactcagaaaaccgcgcgaaaagtcgcagaaccgtttagtggtcgtcttctggatttgcaagcgttctttgacgttattcacccaatcgggacaatctacgaaaacgcgcacaacgatgctaacccaggcgattatatgggctttggtatctggacacgttatgcggaaggaatgttccttgctggatggactaccgacgaagcagatagtgatttcggtttgaacaacaacgatctggatggttcaggtcaaccaactcacacttctggtggtactggtggcgaacgtggttatgaaattaaaccgattaacgttcctgaaatccattcaaccgataaggtgctgattaaggatgacaacgggatcattattatcggtggttgtcaggttgatccagatgcaacaggaccgggttacactaaataccgtgaggatgtattgaaagtaaatcagggtaacactaccccagataaactaaaaacgctcccgccgtatattactgttcaccgctggataagggtagcataaatgacacagtttatttccaaaacaagggagggggcgaaagtcccttcccgcgaagcagattttttgcaatatgaaatgggttcgaaattaccgctgattggcggtaaacgtaccattggcggcgcaaacgtcgatcaacttcgaaaaggggtagaatacccaaacgtacaatcagcaattgatgacttatattctctgtctgaacaaatccctattaatggggtagtaacaatggcagaagataattcaccgtctgcggttcagcaggtcgaaagcattacgtttgatggtactgttcagaacccagatccagatcagacgaaagcgactgttcatgtttacgggttcccgtttgtttttgacaacacaacgaacgcatcaaccgtatgcgaaaccgtttataacaaatttactgaatttgtgaacgatgaaaaatatttcgatctggtaactcgaaagggtttaaatggggagatcctagaagttcgttttattgacgcggttccgcatcctgtaacgaacacttccgaaaatgggatcagtatggtaggtacgatcgacgtacaggctaaatctggttatggtacatggtcgaaattaggccaagcagatcttccggttactcctgctgttacggtttactatttcaagcgtattgcataaggacaataaatgaacaacacaattaaccacgtaagcgataaatccgtttacgtgacatttgatcctgctggtacgcaatggcctagcacgtacacgaatgttcagcaagcgcttgcatctatcggatcatgggcgcgtactgatgttggcttgcctaatgccgcgcctggtgtgcgtggtattgctgctattgctacacaggaaatgattgatgcaggtacagacacacagacgatcgtaactccggctctgctggaataccgtctacaaaaccctcatgcatcacaaaccgtatgggggtacacccgttacgcaactgatgcagaatcagtaaccgtaacgaacgatctggtttcattaacaccgcgttcattgaactatgtgtttaacacccgtcagtcaaaagaaaacgtctggggttctgcaaaactgtcaaccactgcacaggcaacgtctggtactgatgacacgaccgcaatgactccgcttaaagtgaagcaagcaattgctgctatggttccggtacagtcaaacgcaactgaaagtaatttcggtttggtacagttggcaacagttgccgaagtccgcgcaggtactatccgtgacggtttcgcaatttcaccatacacgtttattcgtctgactgcaacagaaaccgatttaggcttactccgtatcgctacacaggaggaagtaaacgcgggtactgataacacaaaagcaatcaccccgcaaaaacttgctgctgtgaagggttctggctctgcatttggtttggttaaattatcaacagatgtcaacaccggattagcgaataccgcgttgtctgctggcgctaacgtagttccaagcaacagaaacagtgctatcactggcggtgcgctgtatcagggttctattgttgctgacaataaataccagacacaaagcgacgttgaagtaaatattccgatcggttgtatgatgctatctgcatttaactccgactatggaaatatttttatctgtaacggacgcgcaatgaaccgcaacacataccctgttctgttttcccgtatcgggtatacatacggcggtgctggggatattttcaacctcccagatatgcgcggtgttgctgctcgcggtttcgatgctggacgtggattagatcctggacgtggtttcggtacttaccaggatgatatgtttaaatcccacgaacaccagttacagatgatctatcgtaatggtggtaatcttccgtcatccgaagcaatatacgaattgaaaaattcagaaaagaacgaccagttaattatgcaactgaatccagcatacactaaagctatggcaactggcggaaacgaaacgcgaatgaaaaacgttgcagtcaactatgtaattcgagtacgataaaggggttaatccatgatttcaaaacttaacccgttaccaaagatcccgtttgttgatggtgtccctacggacaccacacaaacccagatcaattggattgttaacggcgaaactctcgatggtgctaaaaccaaaaccactaacgagggttctttaaacagatgcggtgttctggttcaaaagaacgcggtacaattagaagcaaacacaactacccagacatcaaaaatcaacgaagttatcgatcaggttaacctcattaccgaaaacctcgcggcaatctctgatgaaagcgtgatcgacaaactggataaagttgtcgctgatgctgacgtgctgaaagtagatatgtcttctgtacaggcaactacagcaagccacactctgaaaattcaggacatcgaaaaggaaattggtgtatgggatgcaacaaccgatcctaaacatcgcacgattcgaaaagatatcattttcctgaaaggtgaactgggggcgtatccaggcttcaacgaagatggtgatgttgatccgtcctctactggctccggcgtgaaatacaaggtaatggcgaacgctcaggcggtatccatccacgaagcacgtattactaagctggaagatgactgggtaaactcagatgtaggtcacttgaccgatgaagttacggatctgcgtaacgaaatggggccgaagcatttagcaacgtttgaatcagtttatgttcgattgaaccatatcggtgacgatatcactggcattaacaccgaactgtcaaacatcaacacgtatatcgggcgcacgggtacaggcggatcaggtagtattgattcacgcatgaaagcggcagaaacgaacatcgttactctgcaaacccagatgaatgatccggttgttggtgttctgcctcgcgtaatccttctggaaagcgctgttggtaactcgcaggttccgggtagtatccgttacgatatcagcacaatgaaacgtagcattagcgatctgaatatgatcgttggtgaaacaagtgatgatggtctgcgcggtgaaatggcacaggttatgaccgatatcggtactgactcccagccaacaagcatcaaaggccgtctgcttaatgtggaaaacacacagcgagacgatcaccaggcactgattgatgttaccgcaattgtgggtaatacgtcaactggacttgttgcggctaatatcgcgatgggtaaagctgtttatggtgacgcaaccagttctgatccattcctcaaagatggtattcagaaaacggctcgcgacaacaaaacagcaatcggtgtgaaaactgctggttctgaaacaggtatctataagctgatcgctgatctgactactcgcgttgctgctctcgaagctgctggcggtggcggtaatgttgaacaacgtctggatgatctggaacagaataaagcctctcaccaggatgttgctgacgctctggttccgtatattacggaagttgaagcggataccaaatacgaagcgaagaaaattccattgtcatttactcaaaaccttgtcggtcgtaccgattatatcgagggtgatgatatttctttatctgttaccgttacgggtggtaaactgccttacgtgtatcagtggaagaaagggactgaaaatatcggaactgattcaccaagtgtaatgatccagaacatcactacaagtgattccgctgtatataaagttgtcgtaactgacgctgaaaataccgtgattacttctgatgaacttgacattaccgtatatccgattcctaagttcgacacaaacttgagtgatgtttctgtcgttgatggtgatcctctgaatctggaagttgtgtttagcggcggtaaaactccatacacctatgtatggcataaagacggatctgtattaactggtcaaactggttcttctatcgtcaagtctgctgcaaccagcgcagatgcgggtgattactatgtaaccgtaactgacgcgatgaacagtaccaacgattcaacaaccgcgactgtgactgtaactactcgtccggctctggcgtttacaacggatcttccggcaacgaagagttacacaacaggcgataatatggatttagccgttgttgttactggtggcaaaacaccatatacatacaaatggtttaaagatacggttgaagttactggggaaactggcgcaagcctggctacagtagcagaagcgggagtatataaagttgaagtgactgatgcactctcaaccaaaattacctctgctgaatgtactgtgacggtagcataattttaacaaggggcgcaagccccttttgaggatcatatgattacgaacaatccagaacagttaaaggatgaaattcttcgtcgtctgggcgcaccaatcatcaaaatcgaaatcacacaagatcagatttatgactgcattcaacgcgctttagacctgtatgcagaatatcattataacggcacaaacaaaacgtatctgattttgacactgggtgatgataacccgcgcaacgtattcgacttgagcaaagaacacatcttcgcgatcacgaaggtattgcgtacaaacatgggttcattaaccacaatggacggtacagcagtttatccgtggtttaccgatttcctgatggggttgactggtggctctctgggtgggcgctgtgcatcgagtgtgtacggtatgaacgcatacggcgcggatatgggctactttacccagatgatgtcctatcaacgctcaatgcaagacctgctggctccactgcctgattactggttcaacgatgatactggtcagttctgcgcatgggggcaggtgaacaaaggcgacattatcgttattgaagcgatggttcgttccttcgttgatgtccctagctccgtaggaagcgtcgcaggatacgctacagcgggttctaacgcagtggaagaccaatccatagccgacatctacgaaaacccgtataacagcgttgtaggcggtgtacgagcgggacagggttcaactgttacgggcggaacgtctgcatataacaaccgctgggtaaaagactactctaccgcactggtgaaagagatcaacggacaaattctggctaagttccaggggatgcaattgcctggtggtgttgctccagatggtacgcgactgatccaggaagcggaaaccaaactgcaaagtctgcgcgatgaactaatttcgatgtctgacgcagtaccgatcattatggtgtagggggaataatgcaaaactgggatgaaagtttattcgctcagttgtctacgggggaaggggttgatcgcaacttaaaggatcaggtcactaacccgtatgtaaactggtacaaatacaacccgacacaacagctacacgattcactgacagcagaatcaatccagatgaaatcgcctgatatgtattacgtccggcgcgaattcgtgaatattgataagatcctgggtgaagaccgagaatccaaatttacgaagtcatggaaaattgctgcttatattgaatcgtatgccaactatgaagggcaacgagatttctttagtaaatttgggttgagttcaaacgatgaaatgacactggtaattaaccctcgtttgttcgcacatcaaactgatggtggtattcctgttctgggggatttggtttatttcccgatggacaatagcttgtttgaaattacgtgggtagaagccgatccgttctatcagttcggtgatcgtcctcaacgcaaaatcaaccttgcgaaattcatttacacgggtgaagaactggctcctgaattgcagcgaaatgaaggaatccatatcgaacctgatgcagaactggatctcgaaccaattcgaaatcttgacgggctggctgatatcaacattgaacagtacgaagaagacaaagaatttgaaagagaaggtgatgaattcatcgaatcttttgatgttgtcaacggacgcggttcaccgtttgcaagtctgccataaatacgttatatgggtataggcgaaagtctataccctcttcgaagaggattttatgatatggttgcaaaaatctctatagaacaaagagaacatcaattaaaagaacgttgtgcggaattagaactatcttttgatggatgggtagaccaatcagcgatcacaaaatattcaaagttttatgttgtttgcagtaaaggacatagaacagaaaaacagatcaaaccatttgtcaacaaaagtcgtccaaacggatgttatttgtgttcccctaagatgaaaatatcaaaggaaaacagaatcaaggaaatcaaaactcttacagattcaattggatatacattcatagatttcgttggggtgtataaagatgcacacacaaaaatatcaatggtttgcgataaaggccataattgggatgtaagtatagttgcttttctcaatcaaggtcatcgctgtaaaaaatgcgcaacgtctgggttcaatccgaacaaaccagcatacgtatacgtacaatcactatctggaaaatttctgaaatttgggataaccaacagaacaccaaagaaaagaatgtgtgcgcaatcaaataaatccgtttataaacacgaactggtttatcaaaaattattcgataaaggtattgatgcaatgagtattgaacagaagatcaaacaatctcttgtttgtggcgtagttgataaatcagatatgatggatggatatacagaaacaacagatatatccaattacgataaactgttgaatattatagaaggagtataaaattgtttggatactggtataatagttcgctgcgtaactacattgttcttatgggacaattgtttaaccatgttcaggttaaaagagtacgcggcgatcaagaaaaatacatcaaggttccgatcacctatgcatcgaaagagaagtttctcgcttccatgaacaaacttaactacacgttgagtcaggaaaacgttgctaaaacggaaaccattttaccgcgcatgaacttatcactggtggatctgcaatataacgcaatccgtaaaaccagtatcgcggtcaaccaaaaaatgacacagttagcaaccccacgaaaaactatcacacagtttaaccctgtgccgtatcgtcttattttcgaactgggtgtgtatacgcgatatgaagatgatatgttccagatcgcagaacagattttgccatattttcaaccacacttcaactgtaagattaccgaactgcataagaacgaaatcacagttgaccgagacatcaaaatcagtctccagtcggttgcaccggataccacattcgagggcgatgcaaatcaacgccgtcatgttgagtggtcattcatgtttgaattacagggttatctgtaccctcctgtaaccgatgttaagggcgaaatcagaaccgtttacacggatttcttttccaacatgaacccgttagataaagataactttgaatccgtggatagtcaagccgatccggtagatctgcctatgcaggactacacgggcgaagaatatattcagacgtactcgcacgataagccgatcccgtctggtgatgaacctcctaagccgagggaatgagaatggatgaaaaattagatttacagcaattgctgaatatcgattccctccctggcggcgttgagtctggggaggatgtggttgtttacgagaaacttgaactggttgatgttcaatcacatccagcagaccggaaaccggatctggaagaggattatacgctcgcgcgtaagactgcgcaccatatgaatcagatgatcatggatatggcgcagatcgcattacacaacgcgaagaactccgaatcacctcgccacgtcgaggtattcacaagcctgatgaatcagttaaacgtttcaaacattggcctgatgaagattcacaaagaaatgcgtgagattacggaagagactacaaaaccaggtgctgaaaaaggcggtggtggtagtgaaatgaatatcgagaatgcaaccgtatttgttggttcccctacggaactgatgcagaaatacggcagtgcatatgaacccaaagagggcttcattaatggtgaagctgtagaggtaaaccctgatggaaatggaaccgacgatcgatccgagtaaggaatcagatcaccctatcggattaatgcatcccaaatatctgaaaaagaaaattgatgaattggggatggagtggacacaaagcgaacacgataaaaaatggtatccgacaacgttcagtgactacctgaaaattaacggcattcaaaaggtcgatattcagtctaaggacagttcgaactttgccacgtacaaaaataaaggcaacaagaaaacccgatataacggcaacccaaacctgaaacgtgcgtatatccagactaaatggacgcaacaaatgttgatggagtgggtgaaatgtcgtgatgatatcgtttattttgctgaaacatattgtgcgatcacccacattgactatggtacaatcaaggttcagttgcgtgactatcagcgcgaaatgctgatcgaaatgcacaaaaaccgtatggttgcctgtaacctgtcgcgtcagttgggtaaaacaaccgttgttgcaatcttcctggctcatttcgtgtgtttcaacgaagataaatatgttggtgtgttggctcacaaagcctcgatgtctgcggaagttctggatcgtaccaaacaggcgatcgaactactgcccgacttcttgcagcctggtattgttgaatggaacaaaggttctattgaacttgacaacaaatgtaaaattggtgcgtttgcatcttctcccgatgcggtgcgtggtaactccttcgcgatgatctacattgacgaatgcgcgtttatcccgaactttgttgatgcgtggttagcgattcaaccagtaatttcttctggtcgtaaatcgaaaatccttatcacaacgacacctaacgggcttaaccacttctatgatatctggaacgctgctatagaaggaaaatccggcttcgtgccttacacggcgatctggacatcggttaaagagcgattgtatacagacggtgacaacggcgtatttgatgacggttattcgtggtctgctaagatgatcgctggctccagcaaagaggcattcttgcaggaacactgcgcggaattcatgggaaccagtggaactctgatcgctggctggaagttgtcaaaactcacatggatcgatattgatgaaacggaaacgaacttttatcagtataaacgtccagtagaggggcataaatatgttgcggtgcttgatccagcggaaggtcgcggacaggattaccatgcaatgcacatcatcgacattacgacgatgccatttgaacaggttgcggtgtatcactcaaacaaaacgtcgcatcttattttgccggacatcctgttacgttatctgaatatgtataacgaggcatggatttacattgagctaaatagcacagggcattcagttgccaaatctctgttttccgaactggaatatgagaatgttatttgtgacagttacaacgatctgggtatgaaacagactaagcgatcaaaagctatgggatgttcgacgctgaaagacctggtcgagaaagataaattgatcataaataacaaaaagacaatactcgaatttcgtactttctcagaaaaaggcgtttcgtgggctgcggaagaaggatatcacgacgacctcgttatgtcgcttgcttgtttcggttggcttacaactcaaatgaaatttgccgaattctgcgagaaagacgatttaagactagccaatgaagtttttgcacgggaacgcgaacagctatacgaagacgcattatgtccggttatcgttacaagcggtgatgaaacgatttcggttggttctcacggtatttcgtttatataaattagaggaaattctataatggctttacaatctccaggtattgaaaccaaagaaacatcggtacaatctaccgttgttcgaaattcaactggtcgcgctgccattgtcggtaaattttcatgggggccagcttatcagatccgtcagatttctaacgaagtcgaactggtaaactattttggttccccagacaacttgaccgctgactatttcatgagtgctgttaacttcttgcagtacggtaatgatctccgtgtggttcgcgttgtcgataaagatgccgctaaaaacgcaagcgcaatttttaaccagatcaaaacaactatcgcatcacagggttctaactacactgtgaacgatactattaaagtaaaatacaacagcgttgttgtagaagaaaaaggtaaagtgtccaaagttgacagtaacggcaagatcctctcggtaatcattccaagcgaaaaaatcgttgcccgtgctaaacagattggtacttacccagatatttctactggctggactaccgaaattgtttctcagtcttccggtgtttctgcgtcgattacgattgacggcatcgaaagcgattctgggatcactctgttgaacctggatattgcaaaagaaacaattcagggaaccgctttccagactcttacccagaaatatcagttgccgtctgttgtggctctgtatcctggtgaactgggttcaactgttcaggtggagattatctccaaagctgcttacgattctggcgctatgatttccggctacccttctggggtttccgttaagaacagcggtcgttctgtaatgacctacgggccacagaccgataaccagtacgcttttgttgtgcgtcgtggtggtattgtacaggaatccttcatcgtgtcaaccgagaagaccgataaagatatctatggtgtcaacatcttcatggatgactttttcgcgaacggtggctctcagtacgtttacggtacttccctgaactggcctaaaggcttctccggtatcctggagttcggcggtggtttgtcctcaaacgatactgtaggcgctgatgaactgatgaatggttgggatatgttcgctgatcgcgaagctctgcatgtgcctctgttgattgctggtgcgtgtgctggcgaaaccgtagagattatgtctaccgttcagaaacatgttatttcaatcggtgatgaacgtcaggattgtaccgtgtttgtgtcgcctccgcgctcacttctggtgaatatcccgctggcaactgcggttgataacatgattgaatggcgtactggctataaactcagtggtggtgctgctgttgataacaatctgaacgtaagttcaagctatggcttcctggatggtaactataaatatcagtatgataaatacaatgacgtgaaccgttgggttccgctggcaggtgatatcgctggcctgtgtgtttacactgatagcgtttctcaaccgtggatgtctccagcaggttacaaccgtggtcagatccgcaactgtatcaaactggctatcgaaccgcgcacagcacatcgtgacgcaatgtatcaggttcagattaacccggtaactggtttcgcgggtggttccggcttcgttctgttcggtgataaaacactgactaacgtaccgagtccatttgaccgtatcaacgttcgtcgcttgttcaacatgatcaagaaagacatcggtgataacgcgaaatacaaactgtttgaaaacaacgacgatttcacccgttcttcgttccgtatggatacaggtcagtacatgactaatattcgtgcgctgggtggttgctacgattaccgtgtaatctgtgacaccacgaacaacacgccggacgtaatcgaccgtaacgagtttgtagcaacggtctacgtgaaaccgcctcgttctatcaactacatcactctgaacttcgtagcaacgtctacaggcgcagatttcgatgaactggtaggaccgcaagccgtataaagtcaagggggctgaaaagcccccataaataatccgaggttaaaaatgcttactgacattttacgcgcctttgaatccggtgatttcgcacgtccgaacctgttcgaagtagagatcccgtatctgggcaaaaactttaaattcaagtgtaaagcggcaaccatgccagcggctacagttgaaaaagttccggtaggataccaaaaccgcaaaatcaacgttgctggtgaccgtacctatgatgactggacaatcacgatctataacgatgacgcacataatacgcgtgacgctctggtagcatggtcaaacatgatgcacggaatgggcgatcagattagtggtgatattccagcgaactacaaaaaaaccgctacggtgaaacagaaaaaccgtaacgatgaaattaccgccgatcacaccatccacgggctgttccctactaacgtaggcgaagttaccctggactgggacagcaacaacgaagtgtcaacctttgaggttacgttcgcgctggactggtgggaataaaggttataaatacaggggtagcaatacccctatcattatttttcggagttactatgaactttttgggctttggcaatgtacttagctttttcaagaatttcgcccgtgaggacgaattagatcttgaacagcaattaaaaaatgatacaggttcggtcgcgcctcctaaaaataatgatggtgcttatgaaatcgaaactgatctgactaatcagaaatacgcaagcgtattccagcagttttattctggacaagatccggcgattcagaacaaagaacaattaattaatacatatcgcggcatcatgtcttacccagaagttgagaacgctgtttctgaaattattgacgatgcgatcgtgaatgaacagggcaaagatatcattactttggatcttgccaaaacagattttagtaaggcgattcaagacaaaatcgtagaagaatttgataacgttctaaatatctatgactttgataacatgggtgcgcgtctgttccgtgattggtatgtggattcccgtatctacttccataaaatcatgcataaagacgaaagcaaaggtatccgtgaactgcgtcaactcgatccgcgttcgatggaactgatccgtgaatctatcactgaaacccttgacggtggcgtgaaagtattccgtggttatcgcgaatttttcgtgtatagcgctcctaaatctggctatacatacaacgggcaaatctatcagcataaccagaaggttaaaatcccgcgctccgctatcgtgtatgcgcattctggtctggaagattgtagtaacaacattatcggatatcttcaccgcgcagtcaagccagcaaaccaattgcgtttactggaagatgcgatggtcatctaccgtatcacccgcgcacctgaacgccgtgttttctacatcgacgtaggtcagatgggtggcaccaaagcgacacagtacgtaaataacattgcacaggggcttaaaaaccgcgttgtgtacgatgctaaaacgggtactgttaagaaccagcaaaacaacctgtcaatgacagaagattactggttgatgcgtcgtgacggtaaagctatcaccgaagtagacacgcttccaggcggtgctaacttctctgatatggatgatatcaaatggtttaaccgtaagctttatgaatcactgcgtgtgccattaagccgtatgcctcgcgatgatgggggtatgcaaattggtggtggtggcgaaatcacccgtgatgaactgaaatttagtaagtttatccgcacactgcaaattcagttcagccctgtgctttccgatccgttaaaaactaacctgatcgcgaaaaaaatcatcacagaggaagaatgggaagagaacgttagcaaaatctccttcattttccagcaagattcatattacgcagaagtgaaagatattgagatcatggaacgtcgcctaacgttaatgtcacaggttgaaggtgtagtagggaaatatgtatcccataaatacatcatgaaagagattcttcgaatgtctgatgaagacattgacgaacaagcgaagctgatcaaagaagaatccaaagaagaacggttcaaaaatcccgaagaggaagaggaaaacttttgatgaaagaatttatcgaagcaatcaaaagcggtgatctggtggaagcgaagaagcaattctattccatcatggaagaccgtaccgaagcccttcgccaagaaatgcgcgttgaactcgcggaagctgtacgcatcgaaggtgaaaccgacgatgacgacaacgatgacgatgacgacgacaaaggcggcgatgataaaggcgacgacaaagacaaaaagccgtctgataaaaaagacgacgataaagacgaataagaggtgtaaataatgcaactcgaactcgaagaaatcagcgtcgaagatctcgaaccccatttaaccgaagcgaaagcccgtgttgatgttctggggatcgatgacggcactgtgaagatcatcgaaaatttggcggacaatgaacctcatttagccctggctatgatgtccattgtcgagggtttgagtttagatgaagtcattgttaaacacgtagattcgcgcggtaatgtggaacgtaaaaaagaccgcaaaactcgtgaacgtaatgcgtatcaaacaactggtttaactaaatctcaacgtcgccaaattgcgcgtcgtgcgctaaaaacaaaacgtgcaaacccttctattacaacccgcgcacagcgtaagcgtaaaaaagcgctccgtaaacgcgccgcattagggctataaatatgaatgaatcccaactcaatgaaaacggcgatatgctgctaatcgaggaatggggtttaccttgtgcggatatttccgattcaattttagaatcggtcggtgagtcgaaaaaagacggtaaacttcggattgaaggtattttcctacaagccgaaaaagtcaaccgcaataagcgactgtatccgaaaaaagtattagaagaagcagtaaacgattatatcagaactcaggttaatacccgtcaagctctgggtgaaatgaatcacccgccgcgaccgaatgtcgatccgcgtaatgcttgcatcctaattgaaaaattatggtggaaaggtaatgacgtttggggtcgcgctgttgttgtcgaaggtgataacggtgatggggataaactcgcggcgttaattcgcgcaggttgggttccaggtgtttcttctcgcgggctgggtaaactttccgattctggaaaaggttacggtatcgtacaagaagggtttaaattggcggtaggcgttgatgttgtttgggggccaagtgctccagatgcttacgttaagccgattaccgaatctcagtcaagcaaaacgcttgttgagaataatagtgctgatgatgacgctttcagaaaactctctgaacgtttgaaaagtctatataaataatatcatatcaaacaggaaacttagaaatgcttaaagaacaactgttggcagaagcccagaacctggataccccagttgagttagacagcattttcgaatcagttgaactttctgatgatgcgaaagcaaacttcaccactgtattcgaacaagctgtaaaagcaggtgctgcgaaactcgctgaaacccacatcgcccagatcgcggaacgctccgatgaactggttgaagcccaggttgccgaaaaagctggcgaaatcgaaaataaactgtacgaagatgcgaataaatacttcgaccacatcgcgcaggaatggctctctgaaaacaaagaagctgtgtcccgtgatatcaaggccgatctgttcgaatctctggtaatgggaatgaaagaactgttcgttgaacacaacgtagttatcccagaagcgcaggttgatgttgttgcagaactcgaagatgaactgaccgagaatcagcaggaagttaaacgcctgttcgaagctaatcaggctcaggctaaagagatcgccaacatgaaacgcgataccatcgtttcagaaaaaacaaaagatctgactgaatcgcaaattgaaaaggttcagaacctgatcgaaggtttggaatattccgacaagttcgaatccaaactgaccgcaatcgttgaaatggtagcgactaaagcggaaaaacaggttgaagagagtaccactgctcagacaaccactaaagatgactttgttccggtgaatgaaaatacacctccagcagagaaatcgaagatcaataaatatgtacaagcggctaaagccctttcctaatcttataaggtaagaaacaatgtctaagaaaaacgaattgatggaaaaatggaacgatcttctggaatctcaggaaggtttaccggatatcgctaccaaatccaaaaaacaactggttgcagcaattctggaaactcaggaaaaggatgctgatactgatccagtatatcgcgacgaaaaaatcgttgaatccttcggcggtttcctggcggaagcagagatcgcgggtgatcacggttacgacgcaaccaacattgcctctggtaaatccagcggtgcaatcaccaacatcggtcctgctgtaatcggtatggttcgccgtgcgattcctaacctgatcgcattcgacatttgcggtgttcagcctatgactggccctactggtcaggtgttcgcactccgtgctgtatacggtaaagatcctctggctggcggtactcctgcaaacgttcgtgaagcattccatccgatgttcgctccagacaccatgtattctggtgaaggtgcaaacaccgcgtttgctgctatcgcaactggtgttgctatcgcttccggcgctatcgttaagcacgtattccaggaaactggtgtcgcgtacttccagaacgtaacctccggcaacgtaaccgtaactggtgctgatgctgctgctctggatgctgctgtaatcgcagaaaacgagaaaggcactctggctgaaatttccgaaggtatggctaccagcgtagcagaactccaggaaaacttcaacggttccagcgctaacccgtggaacgaaatggctttccgtatcgacaaacaggttatcgaagctcgtagccgtcaactgaaagcacagtattccgttgaactggcgcaggatcttcgcgctgtacacggtatggacgctgacgccgaactgtctgcaatcctggcaactgaaatcatgctggaaatcaaccgcgaaatcgttgacctgatcaactacaccgcgcagattggtaaaactggtttcacccagaccgtaggctctaaagctggtgcgtttgacttccaagatccagtagatattcgcggcgctcgttgggctggtgaaagctataaagctctgctgattcagatcgacaaagaagcgaacgaaatcgcgcgtcaaactggtcgtggtgctggtaacttcatcatcgcttcccgtaacgtggtttccgctctggctcgtatcgacagcggcatcactccggcaggtcagggtctccagaaaactctgaacgtagacaccactaaagcggtattcgctggtgtactgggtggcacttacaaagtgtacatcgaccagtacgctcgccaggattacttcaccgtgggctacaagggtgataacgaaatggatgctggtatctactacgctccatacgttgcgctgactccgctgcgtggttctgatcctaagaacttccagccagtaatgggcttcaaaactcgttacggtatcggcatcaacccgtttgcgaactctcgctctcaggctccggcagatcgtatcacctctggtatgatcagcaaagaaatgtgcggtaaaaacgcatacttccgccgcgtgtgggttaagggcttataagttgttgaaaaacaacgactttttaaagggaaccttcgggttccctttttgtttatataaataatgaaaactattgaggctatattatgaaacatataatttataaaataacaaacaagataaacgatagaatctatatcggcgcacattcgacagatgatattaacgattcatacatgggttctggtaaagcaatcaaagcggctcaacggaaatatggaattgagaacttcgtaaaagagatcttgttcgtgtttgatacaagcgaagagatgtatgaaaaggaaagggagattgtaaacctagatttcgtcaatcgtccagatgtgtacaatatgggcgtgggtggttctggtggccctatgctgggaatgtttcattcagaagaaaagaaacatgaaatctccaaaagaactcgtgaaagaatgacaccagaagtaaaagaacgcctttcaaaaataaaaacaggaaagaaacaatcggaagaatccaacaggaagcgttcagagactatcaaagctatgtataagggttctgcattcgacagaaccggatctaagctcacagacgcgcacaaggccaaaataagccgttctgtgtcgatagatggagttgtttatgcaagtggttctgatgctgctaaagcgttggggctttctcgatctggccttgattaccgtttaaagagtgacaaatttcctgaatggaaattcgttgcataaataaacaatatactccctataaattcaggaaccaaagaaatgagtgataaacactacacaattcacaagttgatgcgtcagtctgcgcttccgtctggtaaacgagaaaaagttatcaacgaagcaacaggcacgaccgacatcaacgtacagaacacgcgtccagaactggtttctttgactcgcgcggttaacaacctgatctatcatgaactggttgctgtacaagaaacagaactccctgttgcaacactgttcggtgttcgctatcgcaaccctaacggtgatatgactttctccagtgctgcaacctattcaggccgaatctctggacgtacagatatcgacgaaatcgatctgactaaagcctacgttaaaggtgatttgttcaagcatgacggcactgacgttgtttatgaggttatcgcaccgattaccctgaacactctggatactgacaaagacaccgcgatcatgaaagctgtgttccaaagcaaaattcgactggttagcgaagccgctgatacttctaagtatgaaaccagtgaagatatcgcgtcaacctccttccagatggatcgctggaatattccggtacgctcgcgtaagtttaaaaccgaaatgacggttgaactgatgcaggatttggaagcgaaccagttcgaagctgatggggtgatcgaagacattctgggaaccgtggcaagtgaagaagtcaacaaagacattattcaaacactgatcaccgtttccaaacgttacaacgttgatggactcgttacggatggtatttttgacggtactaccgcatacaccgcgaaggatgctccagcattgggtcgtatcctgtaccaattagcgtgtgaaatggggcaggaaatgaatagaacgacttcatttgatgctacctacgtcctcgcaacagcgcgtgttgtaggcattctggctgcgtctggttggatgcacgaaaccgacgaacaacacccactggcaacaggtaagctgaacaacggttattatgtctatacagacaccaacagcccgttcgattatatgctgactggttgcaaatatgatctgggtgatatggatcacgtaggctctctgttcttcgctccgtataccgaagctgacgaagcaggttcaatcaaagtatccgtagatccggcatccctgcaaccaaaagttgctattctgatgcgttacggtctttccgtgaacccgtatactgctgaaagtgattctgatcgcctgatcaaaggtgatgattggtctgctcttgcaggtaaatctaagctgagtcagatcgtaggtattaaattacctaaactgggttaacaagttttgttttgagaagaccattatagtaataaagatctataaggtcaaacgagcgaagcgagttttcacgaacgaagtgagtgatgggtactaaactacattattatatttttatattttatatatagagaaaactgtagtttttagactagtttttaaccagttgtaaactgcactcactcactacgttcgttcatgtactcgcttcgctcgtagatttgacttcttgatctaactggttataatgttactttgttttgaggtgatacatggctgaactaaaacttgaagatctacaggctgaacttgaagaggatatgcgtattgatccgttgaagttacaaagcgaatcagcagacattcctaagatttggtcaaaatggcttcgatatcattcgaatgctaagaaaaaacttattcaactccaggcgaagaaagaagcgattgtaaaagatcggttattgttctacactggtagacacgaaagcgaaatgaccgatgtcatttacactggttcgggtgaaatcaaaattgctatctccggtgatcctaagaccgttgaagttaacaagctgatccaatacttcgaactgattgcagagtttaccggaaaagcgctggatatcgttaagaacaaaggctactccatcaaaaacatgttggagatccgtaaacttgagagtggtgcataaaatggcagaagaatttgattgtaaatgcgttgtttgcaaacaaccgatgaactcccgcaatacggcgtttgtcaatgatgctggcccgatctgcggtgtcgtatgtttgcaatatctcaacgaaaggaatgatcgcggtatcaatgaagccgacgatctgaacgaagttcaaatgttgttgtaggtgtgaatatgaaagactattcaaaaatcgactttaacgaagtatttcgtttgctgggattgatggaagaatgtgtgaccagggttcatgcacttcgaatttcgtttgaaagtggttgtatcgaagacgaacgcccagatttatagcagtaaatataattgtagggcaagggcatgtttaccgatggatgcattttcataatcggataaacctaatggcctatatggaatgcaacatatattcgtgattgggattttttctcaacctggaacctttatgctaacagtgtgcaacggcacgaactacgattgactaccccgcaaatatacgattgcatgttgcggcgaatgtgtcacagtaccccttgtggggcatggctggctgattaatcagcttacgcagtttagaatagcggtgacgacaccgcgttaaaaatcaactatgcttcaaaattaaaaagccccttcctttcggttggggctttctttttaaaacttctcttcttctccggtttcaagttcggctttcagttcttctcgccgtcccttgatcgcgtcacgcattgaaatgtcatcggatgctgcaacctcgacttctttcacgcgggtgttgtaatacttttcaagttctttcaaaccttctagtgtccggcacgaagcaaccttattcatgaaatcatcaatcgctgcttcgtttacgaatgtagtaaaacttttcattttggcctcttaaatttctatctgtttgatcgcgtagtcgaatcgttcttcattgtagatccgcacacgttccatagcatgtttcataccgtagtttgtcgcactgtatttatttttggctgtcttagactttgacagcgtagccaggttatcaacgatatcccatacagtagcgagcgctttcgatccgtgcttacgaagtacacgaccgatagactgtttcaccacaacagcagatttgcaagggtgcgcaaaaatgatgtggtgtaggttcttgattgagatacccgtactcaataccccgatcgaaccgatgacgattaaacctttcgtcgattccgcgattttcttcatttcgttacgatcgtcaatgtctgtatcaccattgaccaacaccacgttatcgtaaaccttgctcaactgctcgtacagccattttccgtgctctttgtaccggaacatcacaaaggcgttttcgttcttctcacgggctaatttgagcgctaattttagaatccacgcgttgcgccgtgtgtggctggttacgtacttgatttccgtctggtagtccgcacccttcaattttttgacctcttcttctttgtatcgaaggaagatcgtgttaattttcaggttggtgacttgaccatcatccatcaaacgacgcgtatcaactggtttaaagactttaccgaacgcaccgatgtattgcatcatgttcgttttcccttctttcagggaaccggataaacccagtttgaagatacattgatccatcgtgtcgataatctttttgatgctcatacctgttgagaggtggcattcatcaaccatcaagcacatgaattgttggaaccattcggcaggcattttaactgctgattgccaggtagaaacgtaaatcagtgcattactgtttttcactgtaccggaacggatacccagcattgccgatttcgggaacaaacgatagtttgcgatgtcctcgatcatttggtcaacaagtgcggtagtcggaacgatgatcaacactttcccgctgtaatgttccagacaccaacgagagataagcccctgaatcagagatttacctgctgatgttggcaggttaagaacaccgcgacggtttttgataccgtggaacactgattcgcgttgataccagtacgggtcgatctgtttgtcgccgtcataaaccggatgttcgctaacccacttatcaaaatcttcttgcgtgatatcctcagtttcgtggatctttggatcaacccagattgaatacccgcgtgattctgcgaatttggataccagataggctaacccatacgggagtttcccgttgtagtccatcaagtaaatgtaaccgttccatccaccatatttgtatttggcctgatactgatagcctgggggctggaagctgaaatagtcacgcagttcatagacaatgtttggttctgcctgaatctgtacgtggcttgtgtttaaaaatttgacttcaatatccactatgattaccctatgtacaaagtatatacgtatttatgtcataaatattggataaacacttggagataccaatgaacattgattacgaaaaagttgatgggttccgtaccctcgacgcaaaagaacagaaaggcgctttagccgattacgctatgactgtgtttgcggttaagctgaacaaacaaaaatccttcgataacatgctggcggatctggttgctgctttaccggaagatgaagaaaagccggaactgctgatcgattcaccagaaccggaaatcgtcgcatataaaggtgaggtgactatgggtgaacctgtcatcgaagccccgaacgttcccgatgtggttattgatgcttctgcggattttatggagtacgttaaagaggtcgcgccggaagtagccgatcaaatccaattagtacctgatgtcgtagaagctcctgtaagcgcttctgacgagtccaaaggcgaactggtatggttggaagggtttagcccgacaatcttcatgatggggcgctctgcgagttctaacgggtattatacctgtccgtggtggatctatgactggattaaacaaaccccagactggtacaaagatcctgatagctgtccacatgcaagcgcaatcgacacaatcaaatcacttgcgttctatatcgtgcgcgatggcgaagttcgtgttcgcgaaaccagaaatagccgattcgaaacatttaagttttagcactttttgctaaaaaacttgttgacgcataccctcgtttaaagtatatttgtactcgaaggcgggggaatggctctcgcagtgaagaaggaaagcaaaatgaaaaacgaaatgatgaaaaatgcttactacccagttctgtttgtttgggctgatggtaaagtgaagaaagtagtcaattcaaatgctccttactatactgttgaagaagcactgcgccacgcttacgaagctgattatcctgtccctgctgaacctggttatgctcgttggaacggttcaaaatgggttgctgatacctgggacaactacgaagaagcaaaaatggaatgcgatcctgattatgtttctcgccaaatggaagcgcacatgattgcagaccgtcgcctggataacgaagctcgcggtttctattaaaattcaaagggggctacgcccccttttttgtaggtaaaatatgactgaattaaatcacgaatgcctgaaagacttatcagaaggtaaagagatcggaaacgtcatcttccttgatatcgacggcgttctaaataatatgcggtgcatgaaatttggtgagcatatggacattgaatgtgctcgacacctgcgccggatcgtaaatcatgcgaactgtgatattgtcatttcctctacatggaggatcggcaacacaacccatactctacgggaaatcttctacccgtggggattgtatcgcatcattgggaaaacctgtacgaatctaacagaccgacaagcaggacgcggtgatgaaatcaaagcatggatcgacaccttcggatgtaagaattaccttatccttgatgacgataccgatatgctaccggaacagagtgaacatttcatcaataccgatgggttcgtagggctgacagaagaacaatccacttacgcgatccgtaatgtgttcggtgtaacaaacccgttctgtcctgaatgcaacggctatgggcgcgtgaaccaatatgataaatgtccgtcttgtgacggcaaaattttacttctctaaatagagaaaaactaaagaggttttgaaaatggctacagaaaaatggactacggtacacccgatcccgtggcgtaacaccagctttacctatctgccgtggtggatctttgatatcatcgtggctgcgaatgctgcaagcgaagactggcgtgattatgccgaagaaaaatacgcgaaagaattcgacacactgaaacaagcgtatattgattacaccgatgttgatttcatcgaatctcgtaacggttatctgtataagctgagtgattttactcctgctgatcctgtcgtaacaattacaccaaaaaccgctcctgctgatttcaaagtaggtgatgcggatctggctgcaactgatctgtttaccatcgatccttctggtacagaaatgactctgagtgttgactcttccggtcatggttctatcgttggtggtaaacttcatgcggttagtgaaggtgatgttgttgtaacagcaacctctggatctgttactgcaactctgacggtaaacgttaaacctgcaccataataacaactaagaaggtaaaaatgctactatttgaattcaatgatgtattcgcaaaattcagcgacgcaatcgaagccaaatttggcaaacgcccacaaaacatgacagatgcagaatatgaagctgctgtatcgtccctggttcgtacagatttctatgaaaaactggcgatcgaggtgttgggttgggatatgatgaaatggggcatgacctatcgcgatcgcgaagtcggttttattctcgtcaacgaagcaaaaagcccgtcctgggtgaatagtcaaaaaatcgcgtacatggataaagtatgcgcacagatgggtattgtacgtttagacttctggacttgtcgggatctgaacgaactgaaagcccacgcttaccgttgccctctgatctcccgcaatgataagcatcgtcaagcatgggatagcgcagggaaatatcgtagtgttttcctgaacgacgatatgaacatcactattcaggatgtgaaccgctcctttgcggattacacaccataaacaaaaaagggaaccgcaatggttccctttcttttatgcaatttttctgatttctttcaatgcttcttctttgctaccaacgaagagaatcgctttacctccggcttttctgaatggcaacacagcttttgccctgtcatcaatcagtatacctttgtccgcatatgctgctttctctccgctgcttttggtgtagtggaattcaggcagataaccgaacaccttcatcaacgcttttcttttttgttctgctaccgcatcggaattgtatttccctacgctggttaagatcgcaacctgacctaaagttctcaaatgacagaacaggtcgatgccctcttgtaatggttccagattttcgtagaagtcagtttttgatatttcctgttttgcttttttcaattcttcttccggcattctcgccgggtcaccgtacatcggaataaaagaaccttcccagtcaaacagtacaccatccatatcaaagaaaaatttcatatcagttcctcggtttgtgtgtgcataatattcatatatgttcccattgtcaaccccatgtatcagttttcggtgcgtatgctgcaactttagccactaactctttatcaagctgatcaatggatttctgcggcttgccttttgccttaacttttatgtagttagacttaacaacaaacataccgcctttgtcagatttcttgatttcgctgtcaatgcctactttgttgaaactgatccagatatcgccgtccatgtactgtttcagagagtcgcccatattcaggatcttcgccatagtgagcgctgccccttcgtgggtatccatgaggatttctttaggcacaacacgatcgcgtttaaggttctgttgcatcgcaatatgaacatcgttcataacccaaacgatatggatgttttctttctgataacccagcgcttcaacatcacgggcgatacttgccagcttgctcatgctttttagggttacgtcaaagatcaggtttggtttacggtcttccggtgctgctgcgatacccgcgtacacacgcgcctggtttttgttggatacgttgaacacgtctgcgatcacatgatgcagtgttgctacgttgtccgggtttttcaggttcattgttttgacatcgtgaccagttttcgctttgatctctgctgccagtttggtactacccatgaccaattttttgagtgcgtcaacgtccagggtgatcccttcgatacctaacagcttttcgagggtgaaccctttaccagaacccgcaccgccagccaggatgactacctgaccaaatttaggataagccttaccgccgaaggtgatcagcgcttcatcaaggctcgtaaagtctttgaatgatttcatcttagaactccaggtgtttatttaaaagtatttattgacacggtttatgagtgcgtttatagtgcaattgttcgacggataagccggaagaactttaaccataaggtaacaattatgaaaaatgaactgcatgaattcatcaacgccgctgctcttggcgaccagtcaaaatataaatcccgtcgcgataccctgattgacgatttctgtaatctcttggggttcaagcgctggcataccccgtctatgcgtccagattgtgatccaaaatgggattacttcaaatggagtgatcgcgatcgtggttacgtcgataacgtccgcgtaatgtctttcaaccacttatacgcaaattcaacaattgctgttgctaaacgcaacgattcgacttatccgaacgggtggagtgttgctaaagtcatagaaacacttcttcaactgcgtcgcgaatataaatcagcataccgtgtcaatcccaatcctatctataatgaatggcaaatcgtcgcgaaatacctgctgaacatcacctattctattttctgtcgcttcgggacaaaagagattggatttggctctcatgatataattgcagaagcacgtcaccgcatgatccatgcaatcctgaaaattcaaaactctggtgggcttgttcttgctgcgttctgtgatgaaattgtttactacggagaacaggtcgaagttgatgatgttcaccacgaaaaattcaaaagatttgtattcgggcaatataacagctattcatatggaaacgatattcgtgtgatgaggcacccgcgcattatgttggatatggaagggtgggaaccaggtcacggaattggtgatgccgaaagccaacgtgaacgccatgttcgttcagttgctaaaactcgcgaattgatgacaggtagccttactgattacctgttcagaacaaaagaagacgttgaaaaagaatttgttgacttgtcgggcgaatagcgataagctgtaatctctgaaaacaaggagataaccatgaataccattcactgccgcaaagagttcgttgagttctatcacggatcatgtactgctgccggaatcgaaagcatgttgttgcctccttgtgattctgatactctgtctgaaaaaggcagaaagaaaaatctggatcgtgttttcttcactgctgatatcgggctggctcgtatctatgctggaagggctgcacgttcaataggtggtgatccggtactgtatcgggttgtgtgtccggtagatgtggtatgcatgaacgatgacaaaggcgcaagcgtttatcatgctgcatgggctttctgtgaggaattatgaaagataaggtgttagcgtatctcgttttcttgctgggatatcgcgttgaagtgatgggtggctattcttctttgtatggggatttaaccgcgatctggatggttgcgttgggggttatgtttacctttatggcgatctgtattgcgaatgaggctgatcaaaatgcttgaattttatcctgctggttgcaagtcaaatccgcctgatgcatcgttccaatcgtggatctatttccatcgtgaactaaacgacatcatcgaaagtcagtggaaagaccatcctgaacgaagtgcccccgatttagtcgatagcgtaacagatgtacgcaccctggaaaaagggctgtatgattgtctggttcagggaatggtgtgtaaattgattttgtggtatgctccgatcggttcagatctaactcgcaaaatcgcccgtggctatatcatgacgaaacgtgagtttgaccagatctggaacgaacccgactgtttcgaacgcgaaaaatacgaaaatgaggttagttgtatatgaaactatttcatgttgtatatggtggaatgaaaaacatcgacatcgccgcgttatctgctgggatgctggacgaactcgaagcacagatcgggaaacgattcaaagccagtatcaccgaaacgcaaactttgtttgtcgatcaccctgcggatatggaaaaccttgtcaacactctggatgatctgttgatcccttgtgctgatggttggaacgaagcatccggtgttcatgtaattgtaacttttgttcttaaaaatgttgacagcagaaatgccgaagtgttagagtttattcgtaaaattgattctactaaaggaaagtaactatgaaaatcgttcagcgtaatatcagcgaagttagccagcaggaaaaagtacagattcatttcaaattcaatgatctgaaactgggctatgcacagatcgcccgtgagcacatgctcgataacggcgatatttacgtaattgttcaggaaattgagcgaattcgtgctttccgcgcagaaaatccaaaagtgaaacatgctctgcgccgtgtgtacatcaataaacatcgtgaagaacagcgtaagcctaagacaaaagctaaacgcgatccgcgtccagataacaaacgtaaagcaatcaacggcgctatggcgctggcgttccaggaagcgggtttggtgtaaggggtttatatgtcttcaatgatgaatcgctggtcgggcgtgataacttcgactatcaaaaaggatttggtgaaggttgagacaaaaccaaagccagtagaatcggaaacggtatccccgaaaaaggttcaaactttggtatccctcgatcctgctgagttagaacaccgccgccgtgcaaaacaaattgaattcgatctgcgtgtcgctcgttcatacaacagtaaaaacgatgatgcgcgtaaccgcaaccttcaatttgctctgacgttaagcgactgggcgaagttaatgagtgaacccgtatgttcttactccggcagaccgtttagcaataaaggcggttgctctgactcccgaacaatggaacgaatcaacgcttctctggggtatacggttgaaaacacgatcgcagtaaccagcgccgcgaatagcgagaaatcaaatctcgatgcgtttatgaagggttctgtgatccttccagaagtaaaactgaaactgttacgcaaagctgcgtatcaaattgaaaaacaactgaaaatcaaaggttaaattatgtttgtgaaatattcttctctgactaaccattatgaaggtaaattcatcaatggtgtgatcatgaatggttttactggttgtgtgtgggttgcgcgtgaaaagatccacggggctaattttagcctgattacctcggacggtatcaaagtcattccggcaaaacgtagcggtgaaattctccctgctgaacagttctacggttgtgaaccagtagttgcaaaatactccgaacctgttcgtaagctgtgggaaattttagcaaatgcctgtgaatataaggaatatgctgatactggttctttggttgttcaggtatacggcgaatttgcggggcgtggtgtccagaaagatgttgactacggcgaaaaagatttctacgtattcgatatccgcgttaatggtgaattcctccctgataacgttgtagccacgtattccgttgctgtaggtctgaaaatggctccactgctggcatacggttcttttgacgagatccgcgcacttcctatcacctttgattcggtggttaacctggcgaactccggtgcgatccctgcaaagaacggcgttgaacctgagttcaaaaacttcatgacgctgaaagatggtgaaggtgagaacatcgcagaaggtttcgtgatgaagcctgttcaacctgctttcatgccgaacggtgaacgcgttgcaatcaaatgcaaaacgacgaagttcacagagaagaagaacaagcaagcgaaccgcttcaatgctccttctgaactgtcagaaacagacaaagcgaagctgaacgaattcacttgcttcctgactgaaaaccgcgtgaaaaacgtcctgtccaaaattgacagcgcgaatctcaccgcgaaagatttcggtcgcgtgatggggctgactgtacaggatgcgctggaagaaatcgaacgtaactacgggcctttcctggaacagttcgaaaacccaacgctggcgaagaaaaccttcactaacgaagcgtcaaatctggttcgtgagaactggggcgcaatcctgaacaatgaattttaaaactgttctcgaaaacgcaaaaacggctacactgatcggtagccgtgaaccccctgaacgtatcgcgagtatagccataaagattggacgtgctttaagtgatcgggggatcttcgcttactctggtggtgctcctggaatggatagccatttcatgtttgactactcaccagaaagacggcgtataatcctccctgagaacggttttaacgggttgtattcgaatggcaaggatatcatcgactatacagaatacgacacgtacaaggccgctgacgaagcgagaaaggtagctggacacttcgacaaccaaaacgaatgggtacagcgccgatatgctcgcaattcaatgcaggtattaaccgaaaacctggacaaacctacagattttgttctattctgggcggtagagaaagatttttgtgttaaaggtggtactgcgatcgctgcaaggcttgccagattgtataaggttccaactttcaatctttggaatcaaaacgttctggatgaagtctgcgatactttagggattaacactaaacctcctactctggattttctctggtgataactcccgaacaatcacgtaattacgaacgcctctcagttgaagaggcattaaaaaaggcgaaacataatggtagaaatcaatggaatcggtgtgaacgcacaggcgggaagcgggacacagtgggtcaaacgcgaaacgcaagatgatccccgctgtggacgtagcccgacactggcggaacgtgcgcgtaaacttgttgatgaaatcaacgcgaaaatggtcgaagcatcccgtaaagacatttccgagtatgtcctgaaatatccgactaaacaagcatatacctttgatatgaaacgttttatcggtaaggttatggatcaggaatgtaccgaaaaagcatatgcggatctgggtgaatggctggcggaagaagggtttactttcgatacccagcgcaaccgacaagctgcgttactcaataccttcgcgggttcgcgtcgtattaccaactttagcgatcctaagcgtgacggatatagcgatctgacttattacatcacctggtgaaaataattcgaaaaacttgttgacgggagttatgagtgtggtaatatagctcccgtagacaagacactaacctaaaaggaaaacatcatggaaatcaaattagtacctacttgcgctggctactgcttggcactgaatggtgtagcacacaacggtaaaggcttacgggctaacgttgaagcaatgctgaacgaactgggtgcggtttatgaatatgatgacgttgcaaccagtgttaaaatcataagccttgaaaaagatggtgttaactgtgcgggttggtgggattgctacatcgactatagcgacaaccgggtcttcttactgaccagcaactaaggatcgactatgtttggaatgaatgagtgttcagaagcggacgcgctcgaagattgggctgactttgatgaccttgatctcgatgatgaagatggagaattcttctgtgttgggcgcggggttgaaagaacgaagcgtgaaattcgaagccgtttagcaatgggaccgactgttggatctggaaagaaacagcaagttaaatattccgatggttcgattcgaactgaaacggttgtcaaagaagtaaacgggcgtgtcattacgtccgagcggcagaaggacatcaaacaattgtacgatgttgcaaaagccgctaaagtaggaaccatgatcacttgtcctacgtgcaaacagttgcacaagaagacgacatatcataaggtgttctgctctaatggtaaaaaatccaggaaagactgcaaaagcaaatactggaacacgatccatccagaacgtttggatcgtatcttttaaatcaaaacgtggagtacgtttaaatgaaaacttttaatgaactgaatagcctgatcacctcaactgattcctacaaagtgtcccactggttgcagtatccacaaggcactgatgcggcgatgttctatattgaatctcgcggtggtaagtttgatgaagtagtaaccgctggcgttaacttcgttgcgcgggttcttgccgaaccaattaccatgaaacaagttgagttggcacgggtactttaccgtaagcactttgggaaagagattttcaactacgaagggtggaagaagatcgcagaactgggttatgtccctgttactttccgtgcgatcccagaaggtacggttgttccggttaaaaatgccgttgcgactgtgtacgccgaacgtgaattctcatggttggctgggtggctggagacaatgacgattcgcggtatctggtatccgtcatctgtagcaacgctatcgcgtgagtgtaaaaaggttctggctcattaccttgatatgacttctgacctgactggtgaagcatataacatcacactgggtacacgtctgcatgatttcggggcgcgtggcgcgacctctgctgaatctgcgggtattggtgggctggcacacctctataacttcatcgggactgataccgttgaaggtatgattatggcaatcagtctgtttgtggactatcaaactctgtttgatgaagttgaaaacgtcgaagcaatcggtgtttcaattccggctcgcgaacattcgactacgatttcctacggtaaagagaacgaagacgaagcatacaaaaacagcatcgaaatgttcggtacagggttctacgcttgtgtgtacgattcctgggactacaaaggcgctgtagatcgcatcgctgaatataaagagcaaatcattgctgcgggtggtactctggttgttcgtcctgattccggtgatatgattgataacatcatgtacaccctgcgtaaactgggcgaaatcttcggttacaccgtaaacagcaaaggttacaaagttctgcataactcagttcgaatcatccagggcgacgagatccacggacctgaaacaatcaaccgtgtgttaagttggatggaagcgaacaagtgggcgagtgagaacatcgcgttcggtatgggcggcggtttgctgcaagaagttacccgcgacactcaaaagtatgctgaaaaactgtgcgctatccgcgtgaatggtgtgtggaaaggcgtttacaaatgcccgaaaggttccgaatggaaacagagtaagaaaggtttgctgatgaccatcactaacggtgtggaattcaaaacaatcgacactctggaaactgagattcctgacgggtggcgtgatgcgatgattacgtattacgacaacggtgtattaaacacctccgatacagtaggggttatccgtgagcgagcaaggatttaatatccgcgccaacgataacggatcagtagtcttctacaacaatcagccccttgtcgctcgcaaggggcttttttgtaagttggtgggctacgggttcaagttggaacaggtggacaacgcgacactaaaagaggttgttcgaattgcttatctgctgaaagataaaaaagatgaacatcgtgctattgcaatgcttgagaaattaggcgaaaatcattgcttcgtggtgaatcgtgggtataagtacgaaacgatcgccttatttgagaaaggactgagtgaactatgagttatttgggtgttattccgtatacaggtaacaagcaatcgctattacctgaactattcaagctgttccccgaaagaagttcatacatgcgtttcattgattgtttttgtggtggccttagtgtgtcgttaaacgtccctaaaccagttctaagcaacgattacgataagacgctgattgatatgtatgaacgtcttaaaacgcttcctgacctgtctccggtgagagaattgattgcctcgaaggggctggggaaagacaagaaagaagagtatctgaaattccgtgatgaatacaaccagaataaagatcctttatggctctatgtcctgatcctgcattcattcagcaacgttaaccggacaaacgacaaaggcgattttaacgctgctgtaggaaaacgaaccctcaactttatgacagaaaaacgtttcgaacatttcaaaaagaatgtgacaggaattgaatttcgttctggttcatactctgatattgaaatcaacgataacgattttgtttattgcgatcctccgtatctgatcactgatgcggtgtataacaaattctggaacgcagatcatgaacgcgagttatatgctttccttgactccctgcatgagcggggtatttggtttggtttgtccaacgtgactcaccacgccggaaaacaaaatgatatcctgattgaatggatgcagaaataccgcgttcataatctggataaaaagtatctgttaggccagcataccgactcttacgagcaaaacaaaacgcaagaagtctacgtgtgcaactaccagaaacgcgacgtaaatacattccctttaacactgaacgatttaatgtaggttaacatgtttaaaatttatggctatatcccttctgtgtataactgcgccccttgcctgaactcaaagcgcttgctggacgcgaaaaaacatccgtatgagttcgtgtctgttgctgattccgtggaagacggtaaacctgtactgaacgaagcggtgattgatgaactcgaatctctggttggtacgcgccggatgactatgccccagattttccatgacgggaaacacgtaggcgggttcgatcaacttcgtgagtacgtccgcaccctgtaataaataatgacaccttactgaatggtgttattatgctgacgaaacgaattaccaaaaaagactacccaactatcaagcaagccctctttgaaaaacaaggtgggcgttgtgctctctgtaaacgtcctcttgagggtgagatcgaaaaacatcacctcgaccatgaccatgctttagacggcgaaaacgccggacgcgtgcgcggcctactgtgtaacctatgtaacggtacagaaggtattgtgaagcacaaattcaaccgatccggtcttgtgtcccgtgatgtagattacatccagtggttagaaaacctgcttgcatatctgaaacaagactattccgaaaaccgtattcatgacaaattcataccagataaggtaaaatggttttcaagacttaccaaacctgatatgattgccgaaatggtttctatgggcttcgagtacgccgacaaagacgaacgcaaagccttaaccgcaaaatatagaaagcaattaatgaaggcaacgaaatgaaatatctaaacgctcgattatcaacgcaacagaagaaaaagctgatgatgttgatatcctccactgacaaaaagatcatatctctgcatgattggatgcttggaaggggtgactctgatttgtgttatgtcaaaccgaaagaccgaacgatgtttgatgatcgcggtcaaacattgactaatttttctcctatcaccgttattgatatgtgggaactccttgagattgtaggaagggatatacctgttgacggggttgaactgatcaaatatcttaacgagattggacacaatttagatattatccataaggcaacgaaatgaaagtagaaaaacgcgacggtaaaaacgtcgatttcgataaagaaaaaattcgcaacgctgtgtataaagctggcgggactatgacggatgctgatgccgcaatcatgctggttcattacaatcagatccgcgatggtagcgcaatgaagatcgcccgtatccaggaactcgttgaagaatccctgatgaaaacgaacccagcggtcgcccgtgcatacatcgagtatcgccacgatcgcgatattgcccgtgaacagaaaagtaaactgttcaaagatatctccggcatggtgaatctgtccaacaaagagatcaccaacgagaacgcgaacaaagacgcaagagtattcccgacacagcgcgatttgctggcgggtatcgtagcgaagcatttcgcccgtaatcatatccttccgaaacatatcgtagaagcgcatgactccggcgacatccactatcacgatctggactatagcccgttcaccccttacactaactgttgtcttgttgacctgaaaggtatgcttgagaacggtttcaaaatgggtaacgcggacatcgaacccccgaaatcaatcggtgttgcgactgctcttatggcacagatcaccgcacagattgcctctcaccagtacggcgggacaacctttgctaacgttgataaagtgctggctccatatgttcaaatgacatatgataagcactttaaagatgccaaaaagtatcaaatccctcgtgatgttcagtatgcaatagataaaactgaaaaggatgttttcgacgcgtttcagtcatatgaatacgaagtaaacaccctgcatactgcgaacggtcaaaccccgtttgttacaattacgttcggtactggtcaatcccgatgtgaacgcatgatccagaaagcgattctgaaaaaccgtattcgcggcctgggtaaagagggtatcactccggtattcccgaaactggttatgttcatggaaaaaggaatcaaccttgatccagaggatcgcaactatgacatcaaacaacttgccctggaatgtgcttctaaacgcatgtacccagatatcattagttcagctaacaaccgtgctattactggttctagcgttcctgtatctcctatgggttgtcgcagtttccttagcgtgtggcatgatgataacggtaatgaaattcttgatggacgtaataacctgggtgtggtgacaatcaacctcccgcgtattgctcttgaagcacaggaagcagacgacgcacacgaggctttttggcgtattcttgatgatcgtctgggtttgtgctttgaagccctgatgactcgaattgatagtctacgtggtgttaaagccagcgttgcgcctatcctgtacacagaaggtgcttttggtgtccgactgaaaccggatgatgaaattctggaactgttcaaaaatgggcgtagttctatcagtctgggttatattggactgcacgaaacgctgttgatgtttggctcaggccagcatccattcgatcgtatcggctcccagaaattaggtcgattgatcattgaatatctccgcgctgcaaccgaagcatggaagaagaaaactggttttggattcagtctgtattcaaccccagcggaatcgctctgccatcgcttctgtaagctggactttgagaagttcggaagcgtcaaggggatcacggataaaggctggtacacaaacagtttccaccttgacgttgatcgcaaggtgacaccgttcgagaaaatcgactatgaagccgattatcattacatcgctactgctggtcatatcagttatgttgaattccctgatatgaaaaacaacctgcaagccctggaaaaagtctgggattatgcgatggaaaaactggactacttcggaactaaccttccggtcgataagtgctttgtatgtggctctgatgacgagttcacgcctacagaagaaggtttccactgtaagcactgcggcaatcacgatccggctaaaatgagcgtcacgcgccgtacatgcggttatttgggtgctcctgctgtccgtggattcaacgacggtaagaacaaagaaatgatgcaccgaactaagcatcaaaattaatcaaaaagccccttgcgaaagtgaggggcttttgttatattgcacataccgaaactatgaggtattgaaaatgatgtactggacaaaagactattttgaatttcgtgacgaagaaagttttgggactgtgtaccgcaatttagctttgcgtggtagtcctctgtcgcctaatcaactatcatctgtcgtgtttcctatcaaggtaacgcactgcaaccggaaaggtgttagtgggatcgttgatgccaatggcacaacatggtattccgaagattcatatctgtttgataacgaggatcgcggattctttaaaaagtttgtcgcgattaaacctgctgttgaaaaagccgacgcgcaacaactgctggattgttctcacctgctgggacgaatttacgtagatggtaagctggtgacgaaaccaggtgatctggaaaaattcttgcgtaaggcgcgggaaactaccctgaaagacaccgaaaaacgttatgatactgcaaccgccaatctacagcgtttgtctggtgaactgaaagttctacggggtgaatgatgtttccattaaaggcgcgagtacgcaacaaaaccggaacacaagaatggatggagtgcttgcgtgaaactaagcactactacatttcacaggctgtaggctatgacggaaagaacatccgttataacaaagtaggcggtaagcgtgtggggatggaacaatatctccaattagaaaccgtccggcctgtgaatgttcctttcgatctgaaactaccaaacggaaagccaacgatatgatcgggaaaatccttgatactctgtttccctcccgtgtacgtgcgcgggtagaacgggaaaaccgactcgaagaaattaggttcaataagttccttgaggacaagaagaagcgcgaagacgagaaacacccaaacgcaaaaatggctgagggtgtatcgaaatgttctgtcgggcggttctgggttgaaaaggattatcttgatctgataggtgcaattgcccctggtgttacgctggaggacttctcccgcgctactggtcgttcgtatactggttgtatcaaccgcttgcgtatgctctctatagtggtgcgtagtgctcatttcggctatcgtgacgttatccgtccggtgatcccagtaagcagattaaaattttacatggtgggtggaaaaagacttgacttgaccaacgaactatgtaaaatcggttatatcagagaggggaaagttgttaaagcccctgaatggttcaccaatcaatttgaaataaaataaggtaaaattatgttcaagaaaatcgtagcatttgtgactggtaaagttgaaactgcaattgaacaaaacacttccccagaagaagcctggcgcagtgctgcacgtatcctgatcaaagagatcgaccgtctgcaacatactcgcgtttctgctgttcaggaaatcgtgaagttgaaaaagaaagtcaaagaacacaaagaccttcacactggcaaagagtcggagatcaaaaaactgctggcagcggggcaggaagtgtccaacagtcattacgtgctggcgctgcaacaccgtaacatctggcagggcttgcagacgaagatcgaagaactggaagggatgaacaaagagatcgatctctctgtcgtcgaactggatcgcaaactggctgatgtcaaaatcaacctggagatcatcgaactgaacaagcaaaccgaaagtctgggtctgactgtaccggaagacgtgatcgccgctgtaggccacacctccgtaagcgtcgataccatcgtgacgaagattgatgtgttgctgggtggcaaaaatgccgcttctgtaacctccgctgacgttagcgcttacatcgactccctgaacgcgaaataagaggaaggggcgaaagccccttttttgctatgtacgattacactattgaacgtgatcgcggtgaagaatggttgatttctcgtgcgagaaacttctatgttaaacttcctaaaaactttcatactttaccgaatgatgatactgatcgcttattgaggattcttgtggatgggaatgttccacagcgcgtttttcaggaaatggttgatcatgcgtgttctgaatgggataaaaagtattgcgaagaactgacgcatgatagtatagtaaacagcaacctaaaagacgcttacgaacgaagaagtgtgtacgacatttacgaaaagagaggaaagaaatgatgttcgaagacggcggtagtgcattcaaaccagcacgtaaaacgtatccagactggcgcaaacagtacgcagaacagttatggcacattgacattcccgaagcgctcatgaaagcgattagccctgctgttgactactattcaggctggaaagatgaatatgagttagaagtcggttcgtttaaggcgcatgtcatcaaagcgaccagaattcttgatttcgttgaagctgttgcgtcatgtgatatcgttgaagatattcgtattccttcaatcaacgtttctcggtatagttctcctggtaacattcgcggggatcgttatgcgaacctggcaagcactacggataagctgaacttccataaaatcaatgaaaaaggatttgatggttgtgttctgatctcaatggtggttgtcacgacacaaggcgagtacaaactgatcattgattgtgacaaagcggctcgtgcaattcccacaatcaaacaatgctttggtgaagatttcaaagtattgatgaaagcccgtgcgatggaaaagttcatccattcgtgcaaaaagaacgtgctggagaagtatgatccggcgctcacatacaccaaaattgataaagatctggtaggtgatttatgctgattaacaaagcgcagtgcaaagcgattaattttctgctacacgaactgattgaaaacggtatcagatttgaattcgttgatccgattaacggtgatgatcgtcatctgctccgctgggtgtctggtagcaatcctctggattcagtctcccaggttgtagagtctgcacttaaacatatgccttgtcgtgttctgttgggtagcgttaacgcctccacatggaatggatctgatgcttattatgtcggattcaaaaaagagttgacggacgacgaatgatgttataatatgcccctgtagacaacaaactataggggctaaatcatgaaaatcaaaaatactgctactgaaaatctttgcaacgaaatcgcggtgacttactggaaagaaggtcacgtaaaagcaatgaaggattttcaacagtggtgtgatacccagaagttagccaactgggaatacgccgtaatcgtggaacggatcaaagaactgatccttgagaagaaaggcactataaaatgattcaactgaaattagacacacaggcgctgaacaacctgttcccaggggcaaaaggctgatgaactttgaccgcatctacaacatggatatggtcaacggtaaaggaatccgtgtagtgttgtttgtcactggctgcaatcataaatgcgaaggttgctataaccgtagtacatggaatccccgcaacggtacaccatacaccgaagagactgaaaacgagttgattaaactcctttcaaatcctcatgtggacgggttgacgcttacaggcggcgatccgttttaccgcaccaactatccagtattgctaaaactgcttgagcgcgtccgtgcgacgtttcctgataaagatgtgtgggtttggacgggatacaccctcgaagccttacagagcgatacagaacgttctaagctattaccattcattgatgttctgatcgatggacggtacgaaaaggatttaccgactaagaaaccgtttcgcggttcggataatcagcgaatgattgagttcaaaaagaattccatcgaaattaaaaatatcgcttgacctggtttgtagttctgttaagatatccacgtagcataaatttaacccaattgagagataatatcatgattctgaatttcaaaacccgtaaagaagcccgtgactattgctggaagtggtcgatcccgctgaaaaacatcaccaaaggaagcggctcacatccgtggacggtgagaacaaaagaaacccgcttcgaaactggcaaagattacaagctggttgatgtcgaaggtttcaccgacaatggcaaaaacattgctaacagtgttcagtcaaaacagatccaccaattgatgaacggtgttgtacacatcgcaagccgtaacggtgatcgctataccttcaatgctccggcaggtgtcgctatgaacacccttcgtgcgtgggaagcgaaatacttcacagaagttgctccggctaaagccccagcgccaaaacgcgctaaaaagccaaaaccagtaggcaaaccgtctgttgctcctgcaccagctaaaccggatctggattctgaactggatggtggcgttaacctcgctccaacaacagaaccagttgcgaaacctgctgcaccacagccagcgctcgtagaagcgatgcctggttgttttgttgccgaccgtccgtatgttctggtagatgaaccaggtttcctgcgctctcacactgcgaacaaacgcattgtgcaacacatcaaaaacaacaacggtgttctggtgttttcgaatgttgacggcgacggtgacgcgacaatcacgcaagatcgtagcctcccgtttgtgatgcaccgtgagcgtaaattcttccgtgaactgggtactggtaatccgataaacactccagcagttcaggcggttgatatttccaaacagcaacacgatcaactggtcatcgctgctgcacaggcagtagaagacgcactggcagaacaccagaaagcgatcgaagttgtagcgcagaaagctcgcgcagttcgcgaagccgctgcaaaacttgcactactggcacgtaagtaatataattcgggggtgcttacgggcatccccttttttatttgaggtaatcatggaattattcgctggaaaaacttacggtttaaccgtatcccctgaaatctttgcagagaaaacctggaaaacaggtatcgcaaacatcattcgtgaaaaaggttacgtgacgattgatcgcacctcgatcggtgagttcgaagaccgcgcgtttatcatggacggtggttacgaatatgaactccctgcatcactatggaaatggttcaaggaagtaacgcaggaagatggtgaattcaccccagaagaaccagaagaagttaatctgggtaaaggtgtagaggctgaaaacgttatgcgtatcgctacaccggaagaggtttccgctggtgtcactggttcggatctgtgcctgatggatatccctaaattcacgtatcgccctgtaaaggaaaatcctctgcgtgatctccgtatcgatccatcattcggggctaacctggaaacgttgagcatcgcaccgatgccagtacgtaaatccgatgcaatgcttcgtttcgccttgcaacatgttttcggtggtggtagcatctatcaaatcaacatggaatctgaactgaaaatgcaggaagaccagattgcaaacctgttcgatctgcacactcagttaaccgctgttgagaatatcgaaaaactgttaggcaaagagaaaaagcgtattttgcaggatctcaaaccatacggaaagaagaatgaaagtcgaaatctacggcattcccgaaagtcttcataactgttacgggtgcatacaagcacaaaagctgttgacagaaaaagggatagaatatacattttatcccgttctgaaagaagcgaaaaacgatctgggctttgaatacgatcgcccacgtatcgaagagttagcaaaacgggtaaggcaacgtagtttagcgtttcaatacccgcgtatttttgtcgataacaaacttatcggcggttatctgcaactgaaacaacttattggtgattaaatgagccgtgaaattttactccctgctgcaaatgctgttcatgctgaaacaatggaatacatggagaaattcgttgaacgcgataacaccgcgatcatcactcctactcacctggacgcgctcgaagatcgtcttcataagcagattaaagatcaattccctgaaaaggttagccgcaacttcattcgtcaggaaatcgttgcaatgatgctgaaacattacggcgttgaaatcttcggtgtcgaaccactgaaaccgaagaaagcacgtcaaatgcctaaacagatcaccgacgaagcaatcaagaaataccagaagaaatacgctaagaataaatgatctttaatacgattgaatgtgttccgtcaagcggtaaaacaaaggcgattctgaaccatatcaatcaaacgggcgaaaaagcaatcatcgcttcgatttccatgatgttatcaaaacagtcttatgactattacatcaaccaggtaaaaggaaaacgggcggtgattgtggacacggatcaccgaaccaaaagaaccaataacgatgcgctgcgtgaagtagtcaatgattacgatgtgattttcatcactcatgcagcactgaaaaacattgatgactttgatttgtataaggatttttccctgtatattgacgaagttcctgatttggttgcgttcgaaagtctgcgatttaatagcaatatcaagcacatacgcgagatttgcttgccgtttagttgcaatgccgatgatatcgttgatttaaaacttgacgaagaaaaacgagaactggttacacgattagcctatgatgggcttcgtaaacgtgatgatatcgcaatgaagatgttcccgctttaccgcgctctgttaggggctattccggtgaagatgcaatgtagcgattcgggatatgtctgttacttcgtagaggatcatgacgtaagccagtggaagttcaaaaatgtaaccattgcttcatccaacatcaaagacacgattacagggaagatcctgcaaacgtttcatgatgtggagttcaaagattcaccgcttcaaaagctggttgactttaagcaatacaaaaacactgggcgcatacatatacatgtgctcgcagagggggattattcgcgttatacgggcgatctctctcaatctgggacgacagtatacactcagattaaaaaacgcgtggaggcgcttttagggggagaacagttcatctattgcaccaacacatacagatcgaagtttagcgaggggcaggaaatcccgtataactcgcacggattgaacttctattcaagttatactaacgtggtggcattattcagttacaacccgttaccctggcttcgtcaaatgttgcgagcggttgcggtgtcctctggacttgaagaggaagaattagttgatgcttatgttgtcagtaaatattacgaaccagcctttcagttatgtgctcgttctgatatccgacacaacaacagcaaacgaaagattaatttatttgtgcctgatatgcggttagcgaaatacatgaaggaaaaatattttcctgatgccattatcgaaaccacagaagcagttcaaacgaaaaggcaacgcaaatcgtttcaatctcttttccaaatgacagcgccggaaataaacgctttcaactggtataagaagaaacacaaacttgattttgcagatcctcttcatcacgcgattgttaaagattggctgaacaattaccgtgagaaaaaggcgacttgatggtcgcctttttgtttataaatatcagtattgaataagataaaggaaaacgataatggtagctaaatcattccgcgccacaagtggccttgatgctgctggcgaaaaagttatcaacgttggtaaagcatcccgctctgtgttgagcgacggcgtgaacgttgacttttttaacgaatttaacacgatccaacaatacgattctacccgtggttatgctgcgtttatggctatcatgtacgcgcgtcgtatttggtacgctcgcgcagatattccatcaccagcgggtgctttcgatgaaacaaaatggatctcaacccgtaacgatccaaaatgggtatataacaacgtaacgagcaatgacggtctccctgttgaatccggtacgtacttaatggctgacggtcgtttctctgaattgacctatattctgccagatgcccctgttgagggtgatattatcactattaaagatggtggcggtcttgcagggatcaacaacctgttagtgcgttcaaacactcgtcagatccgtttacgtgatattcagtcaagctcttatcgactgactcacccatatatgaccgttgcgtttatttttaacggcaacttatggcgtgttgctgaaatgcgtgataaccgtgattcgcagtttgttaatgcgactggtttaaccgctttccaaatgcaagcgggtatggtaacattccgtaatagtggaacgggcaaaattacgttgcagttgcctcgctacgcaaacgatggtgactcaatcacaacttacgatctggatcgccttgcttcggtgaacgttgcgactctgcaagtttatcctggtagcggacacacgatcagctatgacggtatcaataacgtaacctctgtgacttcacagcgttccggttatggtatctttatgttcgatcaggctaataaccgttgggttgtttatgacggtgatcagcgcgttcgtctgcgtcgtatcagtgatgacctgaacatgttgccgaacgattacgtgttcatcactccgattgctggcaacccaccaactgtacgtaatgtaacgctgactcttccgcaagatgttgccgaaggtgatcgcgtatatatcagtatgtacatgatggggaaaacgcagaactgcacgatcaaagttaaagatggttccggtgaaaagatccgcaccaacaaaaacatgatgcagttcccacagcgtaaggattatccgcctgatgactggttcagtgttgactctctgactttcaacgccgatactgactatcttccatatatggaactgtcatatctgaaagcaacgaaagaatgggtagttgcacagtatcgcccgatcattgaacgtgtcgatccaacaaaccgttctcgtctgggtgtgattgcgctggctacacaggcagaagtaaacaagaaccatgaagatacgccgtctgatgaactggcagtaaccccgcgtacactggcgaataaaaccgctactgaaacgcgtcgtggtatcgctcgcctggcaacaactgcggaagttaaccagaacacgacagcaaccttccttgatgacgtaattgttacgcctaaaaagtttaacgaacgtacagcaacagaagatcgccgtggcgttctggaaatcgcaactcaggcagaaacaaacgcgggtactgatgacactaccgcaatcacgcctaaaaagctcgatacgcgtcgtgcgagcgaaaccttagcaggtatcggaaaactcgttacaacgggcgctacgacagcggagggggctttacgtggggatgctggtacgaacgtctacaacttcaataacggtgttgaccttgtcaccccgaaatcattgaacgagaagacggcgaccgaaaagtcaaaaggtctggttgttctggcgactgaaaacgaagtggtaactggtgctgctgcgggatctgcttcaatgccgatcgtagtaactcctgaaatgctgcatcgtaaaacgtctactgaatcgcgcatcggtttgattgagatcgcaacccagacagaaacgaacacgggaaccgatgatctccgtgctgtaacgcctaagaagctgaacgatcgtaaagcgactgaatcacttgatggtattattgccctcgctaccactgcggaagttgcagcaggtacggtaacgaataaggcggttgttccggttaagctgaaagagttcttcgacgttacaagtcatgttgcggttgctaccgatgacggtttaactcagtccggtactatctggacaacgattaacctggggattgcgtctgctactgaaacacagcgcggtactttacgtgttgcgactcagggtgaaactgatgcgggtcttctggataccgtgttcattacgcctaagaaactgcaagcgaagaaagcgacggataccgccgaaggtattattcgttgtgcgactaacgcggaagcgggtgcgggtactgctactaacctggcaattactccggctaccatgcagttcttgaacggtactgatccggcgtggggtgcgacgacaactcgacgcggtgcggtgtttatcactacccaatcaaacactttcatcggtgataatctggttggttctactcaggccgttgacgattatctcgaagatttctatgctgtatcgcctcgcggtctgaactttgctctgcaaaacttcttaccgaaaatggcaacggcacagaatagtttgagtctgggcggtgtggttgctgcaagctggatgcgtcgtgatgcaaaccagacggtaactggaaataacacgtttaacggtacaagcaacttcgttggtaacgtaaccactaacggaacactgacggctaacgctgcggtaacggttaacaacaccgtaaccacgaacaataacattaatcagtctgcgaaagcaaacactgtttatgcaaatactgttctgagtggtgaggctgcgggaaccaaaaacttgcttcgtaccttccgtggtggtgtggcggatacgatctggcatgaaactgttcaggcaagcacgtatcgcctggcgacgggtacaacggatctggttgacgttctgacagtaggtgatgtcggtaacggcacaatggcgtattccggtacgaacattcgtctgaatggtaaagccctggctaacatcaacacggcgggtgatttgtttgttgcaagtacagcaacgcctacggtacaattacgaaccgctgcaactaatggttggaacggtgtaacaatcagtaatgacggcggcacaaccactgcaaccgtgatcaacacccgaaactttacccagcatcttgacagtacctatgtcaacgtagcgggtgatactatgactggtgcgctgtcagttagcgtaaacggtacgggtggacgctttaccagtgtgagcggtacggcacatgttcaggcaggtgatttctctgggaacgtccagaaaatgcgcttaactggcattgacgataaggtattgactgagttcaacatcaatatcaccgattacaacaaagcgatgatcaacggaaacctgatctatcatgcgggtcgtaaaccgactccggcagaaatcggggcggtagcggtagcgggttcaaccgtcgatactctggttgtacgtaactatatcaaaatcggtaacgtgaaaatcttcgcaaacccagcaactaagacttgtgaatttgtgtgggaggaataatttaaatggcgaataacgaatttatggcgttattcggccctgatagtttcacggcgaatgtgttttcagaagcaaacgccgtgaaatatcgccttgttgtccgtggaacgaataacgattctgcggtcaactcggttgaggtatctattaacggggctgatattattaacaggcggacacaagttgctcgcggaattaacctggcagtcattgatggaacaactttagcattattggattacaaatcatttgatatgtatggtgatcctgctacgaacgggaatgcgattaaagactacctgaattcacttccagcgaacagaattgtgtgtttttatactttcgatgcgatcagaagtgatgataactttttagcgacaatgaggaaaattggttctgttgcgtggcccgaaactcggttctttaatatcccgatcaccacaaccaactattctcaccgttcatcctattcagctatctattcatcaacgatgaaaaagatttgcatggaaaactttgtcggtggttctggtacggggttgaaagacaatacaacgagttttgttgaagttgtgtttgatgaatttagtgatatcggggtaactggtattcctgaaagaatgctggatgatcctcaaacgtatagcggtaatggttatccattcaaagcatacggggtttggaacgttgggagtgatgtttctcgtaatgatattttcaaaatcactgcggacatctatatcgatcaggctgcacgtaatgcgggggcagaatgttatctgtatgcctttactcatattgcgtctggacagtggatatcatcaacagttcttagaacaactggacttgctgcggatacatggcattcggtatcgggatattacactattccagataatgctgatataactcgtttgggtgtttctgcttatcattatccgtcaacagttaccacaggtcagtcccgatgccgaaatatccaattctgtaaagtccctcgcgaagaggtgaacagaaacggggcggctatcggtgtcaacggtattaggatgcaaacactttccgaagtcactgatgctggaaccgtaaacccgattgataaattgctttctctgcctgtttcgcctactggggttatcagtgataagaaaatcatttcgcataactttgctgaacttgattatattgtttctgatccggttgaatacacttcgacaaatacagcggagtaccagttcaaagaatggactgttacccagcaagcggcggtaacgaaagcatcactaagcagttatggcttaaaagctggtgatacgatccgtatgcaatgccaaatgaaacgcgatgcaaacgcaatcgccaacaataaagatgcatatatcgtaatgcagttctgggacgcgaataataagtatatttcagggatccatatgcgtgatgttggtacgatcccgaacgtatattcattctataaaaacgaaggggttattcctgctggtgcggttacgtttgatttcggtttatatcgtcatccaaacaacacaaacatcggtacggtatccgctaaagacgttaaactgtcaatcgtgagataaaggggcgaaagcccctttttcataaatacagtcattacaggagaaatttttatggctgatttgaaattaggtacaacgctgggtggtgcgggtatctggagtgcttctaaccttcctctattgccctctggtggacaattaacgtataaaggctggagagtatacaccgaaaacgatcgtccgacagcggaggatataaacgcactatcgacgattaacggcggtactgttgcgaagaatactacgtttagtcaaaacgtgacagtaggcgttttgttgaccgcaaacactattcaatctaaccagtcggtcgggatcactcgaagtgctgctgctccggtggttgttttccgtcgccctgatattacttcggttcctggtgcggaatctgggttgatggacattaacgcatacaacggtatttctggcggacagttagcgggtgcaattaacgtgaacgctcgcacagacggaggtaataaaatatacatccgtgcctttaaaaatggtactcaaaatacgctgttgagtctggattcacaaacccaacaggtaacagttgagcaaggatctttccgtgtaatcgggacttctaacctcggcttaacgaatgctacatcaatggcagttagtggcgcgattactgcgaatacagtaactccgtcaaactgggctaaccatgatgaacgttatatcacgggtattcctcgcggtatgtctggaaacagtttcggggctgctgcggttactgaaaagaacgatgttctgtcggtcggtggtaacgtaacggacggtccatatggaaacacaacatattacggtcaggttgccacatatcgccgtactctgaatagtggtgtttctctggttcagacttactatgatataacatcaacatggattcgtgctgcgacgggttctcctggtgcatggtcttatagtgcgggtgatgctaatggatggagaagaatttatgatacttcgcttcctccgactccggcggaagtaggggcagtcaataaatccggtgatgcgatgactggtgttctaacactggcaaacatatctcaaccacttaaaacacccggcggtggtattctggctaatgacgggaacgtgtatatcaacaaaagcgggttttcaggatggatcgatgcactgttcttgaaaaatacaggaggcacggtaacaggaaccatcaaccaaacaggcggttattttgatgcatcgggggaaggtagaggttcttgggcttctcaaagcactgcaaaagctccgattttccagaatattaacactacatcgacatctgaatactggcctattattaagcaatattattctcatgctggcggtgcgtggtctatgggtacgttggtaaacaccaacaggtttacagtccattaccgtactggatcggtagatcgtcaatggtattttgataactctggtgagtttgtatcttatggtgatattatttccaactcagccaacggattgcgtattgcatacaataaccgtggattctttatccgaaatgacggtggtaacacctatttcatgttaacaaactcaggtgatgcatggggaagttataataacctacgtcctttgtatataaataatgatactggtaatgtctcgatgggacatacgttatcagtcaacggacgtatcagccagtcaagcagttatattgacaatggaaatttaacattaaacggtagcggcaacggacgcgttgaatttattcgcagtggtgcaaaccctcgcgatatgtatatcttccatgctggtgatgctactcgcggaaaccgtatagaactgtcggattcatcgtcatatctggtttattttgaacgcaacccttcatccggcattcaaatgataatgaacggtaatggtagctttaacgatgtgtatattcgttctgatgaaagactgaaaagtaatttcagtaagattgaaaatgcattggataaagttgatttacttgatggtatggtgtacgacaaagcaaatcatatcgggggtgaagaaactacccgtgaggctggtttagtcgcacaacaactgcaagaagtattaccggaagctgttaagaaaggcgttgatggtgaacagaacgagatcttaactgtttcgtcttctgctgttattgccttgcttgtcaacgcgattaaagaactccgcgaggaagtcagggaactcaaatcccgctaattaaaagcccttcggggctttttctttttataaatatcataaaagcatttgaggatcttaataatggcagatttaaaagcgggtactgccgttggcggtaatactatctggagtcaggctaatttgcctttactcccttctggaaacacaatcacatataaaggctttaaagtctacaccgaaaacgataagccaacaaaggcagaaatcggattaggcaacgtaacaaacgatgcacaggtgaagaaagctggtgatacaatgcaaggaactttggaattacaaggttctgcaactgaattgaaattaccatacaggatcgcaatggttagggcaacagaaccttatctcgttgcaactcgcacagacaataacccagtaacaaacgggtttcctagcgcagaaacacgcacatttgttatacattcaaaaaccgcgtcaccaacgtcagatccaaacttgggggcaaaccttgttgatctgatttgtacccaacgccctgcgggtggtggtgcttattatatccgtgcttttggcgcaccaaacacgacaactggtgctgctgggaccattcgcgctgaattgcaaatgctgggtgataatggtcttgttagtttaacagggacgcaattcaacatcgggatgcaaactgttgtaagcggtacgatctttggtacgcaaatgtctatcaaaggcgatggaaacagaaacttatatttccaggatgctggaggtaatgaactgggtttggtctacgttgatacagggaagaacgtttatgttcgtactggtggtggtgcgtatgcaactcgttttgcttctgatggaactttagttctcgctaaccatctaaccgttcctggacaggctacgtttaatggtctgggtgtattcaataaccgtgcttccgttgaaactgattatgctactcaaggaataaacacagcaatacttcgagtaactacaaacggggatggaaacggggttggtgatggtgttacccacttaggctataaagatggtaacggaagatataaccattatttccgtggtactggcgcaacgtatattaacaccaaatcaggtcttaacgtaaacgtaccatcgtattataacgaagttccacagggcacaccagcgcaatatttcttacctactgttggacagggcgggaaaaactatttgcgccagttccgaggcggtaatgcggatacgatctggcatgaaactgttcagggtggcgtatatcgactggcaacaggttcaactgacggacaggaagaattagcaatttctactgcgggttatgctcgattccgtcaagagatacagagtaatacttatggtactggcggacaattccgcgccgtaggaggaaactatggtttcatcattcgaaatgatggtggaagtacatatttcttacttactgcatccggcgatcagtatggaacatggagtggtctacgtccgtttactatcagtaactcgaatggcgttgtttctatagcaaacggtgcaaacatcaacggttctgttaactttggtaacgcggtaaacttcaacggcacggtcgaaacaaacggtctgggttgtggtactgcaaacggattgggtacgactggtatttctctgggtgataacgatacaggtttcaaacaggaaggtgacggtattctcaacgcctatgcaaatagccagcgtattatgcgatggactactggcgcaactgctaactataaacagttacaggttcagggtgttaacggaccagcattacttctgaataacacagcgactaaccaatcatgttatttgctgattactttggcaggtaacaacggcgcatacttcgggtttggtggtgctgatgataacgtatcggtacacaactaccgactgaatacgaccttacagttgcgtgcttcggatctgtatatgaaccgtggtctgtatgttgaaggtaacgtaaacgccaacgatgtgtatattcgttccgatattcgactgaaatctaatttggtcgaattgaaagattcattaagcaagattgaacagcttaaaggttatatctacgataagcaatcaaaagatgctgatgatatcgtatatcatcgtgaatccggtctgatagctcaggatgttgagaaggtattaccggaagcagtgcgcgaagacatcgacactggtatgttaaccatttcaccttcgggaattaacgcgcttctggttaacgcaatcaacgaactgcgtgaacgtctggaagcaatcgaaaacaaattaggggcttaattgcccctctttcatgaggtatttttatggctattgtaggagtccctggctggatcggttcgtctgcggtcacagaaacagggcaacgatggatgtctgctgcgggtaatgcggttcgaatcggaacaccgttttatatgtctcgaatggcgggacaatcggtatataacatcaactttacggtgtatgagcgttactataacaacgcccgttatcgtggtcagtggggggttggttggtattcaccatattcgaaaccttccggttatcctgcggttggtggtagttttaacggcaacgcattcggtactgtagttgcagcacaatcaacacctgatatcagtgtaattactattcaaaacggtcctgctgtcaacctacgtcttactatggatgacggcggtgtattcgattttgacaacaacggacgtatacatgatggatatcgtcaatatcaggttgtttcttctcaggcgaccagttggtatgactatctgaacgcccgtacaggtcagaaccgttctggtttggttacgcaacgttaagtaaattcctaaatatattcgggggtcggcatccccgaacttgaggtttaaacatggcactattacaagataaattggcggtgcttgaacgggtaatatcgttcatcatggcggtcaaaacatggaaacagttattcattaaattggttcttatcgtcactattttcattatgttcgtaacatggtacaagtgggatgacttattttcagtctggaaaacatcttcaagcgttatagacgtgccgacgatggagattgaaaaggcaaaaaagtttgaatccgtatccatcgaacagttaaacatagtgcatttaactacgggtgcggatttttcggcaatctttgggttcagacctaagaatgtcaattattttgttgatataattgcgtatgaagggaagttaccgcaacagattaacccgaaaaatctgggtggctatcctatagacaagacatcggaagagtataatagacatataaacgggctgtactatatctcagatattgccagcccgtatcttccaacaaaagaccttgttccggtagcatatacctttagttgtccttacttcaatctcgaaaactactattcaggatcaattctaatggaatggtatatacagaagcccgaagtcgccgatacgaagttaatgatcgtgtgcaatcaggccgctagaattttaggcaggattcgatgataatttcagtttcaaactactcaaagcccgattgatgaaatcttttactttcgtcatcgggcttttatcgtatatgtcccatacgcgcatgagttcgtaaggtgtcggaacatattcatcgttccagtatccaacattacctatcgtaatgcgccggaaaccagcctctacgctgtgatatacaaagaacccagccttacccacaggggcaaccttaaacccgcgtgtagcggctttcatggcttcgtcgtgtgtcatgatagaatcacttcccctctgtattgattgtgatagatgtacggacgaacacccagtgggtgattatctatgactaagatcaggtcaagttcgtcgtggttatcatcttctgcaactatatcccagtcggtcgctttctgttcttcaacactggcaatgaatacctggttaatctcaaccttgcggtgagaacgtcgaatgattgtatccccttcgcggaacacgatcatatctgggttaattgggcggtacgcggttttacccgcgcacacttcgtttaacatttcttcatacgtcattctaatacctttactcgctgaacgattgtctgtttaacttctttgtattcgttgtgaagtttaggtgtcgctttgaagcgaatcacatcaccctcttcaacaattttgtttccgtagtagataaccacgttaccatctacgttgattttggtcatgaaacgttccacttcggtgtaataagaaacttgggtatatccgagagaaatcactttctcaacaaccccgctcatttccatacgcttaccgatttccccgatgtgctgcgctgctgcgatcttcgcctggcgctctgcttcccattctgcgcggatctcttcacgtttagcgatgtaatccttctccagcgctacgcccatgcagtaagagcaaatagcctgaaatactgggctatcgttgccgttttctttgcactgatcagcccaccacagaatcgtatacatcggcatatcagcaatcacttcacctttacgcttaccgatcggcatgatgccttgttccagcagttccagattttcggtatcttgtacagacagtttgccgcgacgttcgaacagatcgaaatctgcgaagccctggaacaccatctggaaagtatcggtctggttcagacgatccaccatgcgatcgaagtattcacgcgctttcgcttccgctttatctgggtcagtagacaggttgcagatatagttatcagaagtgaatccacctccacgacgctctacacgcagagtgtacatagcgtttttagcgccagaagaaatgaagtatgtcgcggtaactttagtcaggttagtcatggtgaatctccttagtggtttcgtttcgacaaggccaatatagcaaaagccctcaaccgaagtcaagggcttttttatcatgcgttcgaatctttcataactttatgaagatggatatcaaaaattttccagtatgcttttccgcgaggataaatttttgctttatcaatgtcttcgttgcttccccatgtattgtttgggttacgacaacgattttttgcataatccatgtgccagaataagcgttgcaccgatgaatctgtgcctaatggatcttctttgctgaacagaatttgtgaactcataagaagaaacctgttcgaactactaaatcaatctgtttttccggtatcagtggcgctttatcgtcaacgttgcactgataatacatcccgacatactcatgaggaacgttggattcgctcgcccatttcaggttgtcatctgtacgcggccctaacatgaggttaacgatattgacagcgtgatcctgttctggggtattgttgcatccgttcacataatgtccgtgagcggttttgaggatttcaatgatatcttcgtcggcttcaacgagatacagccccgtgttttctgggatttcctcaagaataatcaaagcggttttcatcacacttacctttatgtttctgcttacgttttgcttctttaagtgctcgcttgcgatcgcggtgagtagaagcgcggttgaaatcatgtttcgctaccaggttgttcatcgaggatataatggcacatgatgttgaatactgacttcgccatacagttttacgatagttaagctatcagatcctttaacaattctgtatttttctggaacaacgcggtcgatttcttttttgacaaagttaagcaatccgaagtcatctatatcttttggtgctttggaaatagaagacaacgatactcgttgacgtgaatcatagtacgaagaaattacaaacatatattattttccttattggggcttttcagccccattttagataattaatccagcagtttgcggattttatccgcgatacgtccggcgcgtgttgcgcttgcggtatgatcactttctttggtagccagttcagccagcttgcgctgatgttcttcttccgctgctttgcggtctgctgctacctgttcgacctgcttctgatcatgcgcaatacgcgcttcgagttcggtcagggttttgtcaaaagttgctacgatttcgtctacagaacggattttggaaaacagtttcatattcattatctcaattagtatggttggaattcaaagtcaaacagatcatttagtgcgcggttgtattcagtatagttctcaccatccccgaaccgcatctgaatcgcgctttccgctattgtaccagtaagattcgagaaaccaaagaggtttttaatcttatcgtgtgcaacgaagtacagagaagcactatccagcaaggccaccatcgctgatggttcatgttcgcggcgtttgatgcgtaacagagtacggtttgcgccagtcttacggcgttgatttggggctacgtagaatcgaaatactactttacccgttttatcatcaactaccaggtagaagccgtgttctttcaggtcaaccccttcgaacttggtgaagtcaccgcgcttcatgtcacctatcttaacagcatatttgtggatgtcaagccttgtcagaattcttttcatttttctttaccagtttatttccgaatttggtgtttacaccagttttcatattcattgtcagtaccagcaagaagatagggcatgacaaaatcaagatcgttgcgccgaacactaagcgaactaagcgaatcaacaacgtcccgatccatttcatcggtatctctacccacttctgaaccgttgcgagtaccagcataacataacccagattaaatgcaagggctgttgcgataataccgtaaggttttttgaagtatgtctgttcgccgtcttctgtacgtccagcggtaacgttgcctccgttccagatttctttagcggttttgatggctgtttctgccccgctcaagttctgccagtagtcaggaatgctctgtaggaatttcataatagaatcctccgcgcctgaatcgctccaggcgctgttttggggttagtagtgactgaatcccacagttacatcacgcatcacctgataacggcatacacgcatcttagcgttatcgtaatctgtcgggattgctacaacatcgcgaggattaaccttaacctgaatgactcgcccacgtcctccgccatagtgaggcaggtacgattttgcggcaacatgcaaaccacacgaacaggttcggtttttattctcgtctacctggttacgtggcatttcaaccacaacaccaggggaattatcgaacttaccggaagccagatcgcggaagtcttcacgaacacgtttccacgcgtagaaatctccgtcatctgccagttcgatatcgttatgtaccatgaacccataaagctgatacacagcatcgcgtgaagggttttccatcaacttctcaaagaagttaaccaggtgctcgtaagggcgatcgttgtacatttcgcgaacgatacgttgcgtgataccgctgtcaaacacgatatctttgtacaggactttatgcccgatgattttaatgttgcctttgctgtaaatcttcaacgcttgcgttgtgtccaacagggtagcaactccctcaatgtcgcccttaaccattaaagcatgtgctttttcgaagttagggtgtgacgaatccgctgtgatgatcttgccgtccagtaccagagtaatgaacgattcagaaccaatcattttagatttgacatctgtttgcggaagtggtttcgatgcttccgtattatacttagcgtgttgctcggtaataacgcgcccgatggttcggacgcttacaccaaattgtttagccagtgcggttttgttcgcgctggtcagaaagccctcataaactgctttcttttgtacatcatcaaggatcttaacgtttctcattatttccaccgtataaggttgaccaaatccatcacaattttatcatcattaaacatactgcggaatgtagaataagatgaatgtaacaacatgtaatgaattgatgggttgcgttctgcaaataaatcgtaagcagtatcaacgcgttctttcatatctttccgcattttgtaatacttcgttgacatttcacgaagtaacgggttacgcacaacagtttttgatttgtttttgtgctcgatagtatcgtaggtaaacttaccatcaagataatcgagcaacaaatacaattctggattatagcggtttttaaccatgcgatcaagggttacgcccatagaatcgcgcagggttcggatctcgcttccgtggtttgatgaaatccatgcagggaaccagttaggttttatcttcttcgctgcgtccgcaaaacgttttaccagataatcatcaaggcatttcatgttgctatctggaatgcgactccacagagagtttcgcagaaccatcacttcgttcagccctgtaaccgttaacatggtcatcatactgctggcgatgctacccaacgaatagttcggtgcttctccgtccagtcggctatattcatcaagcccatagaggcgcatagcgtacatttcatccagtttcacaaactgtgctttagtcaggtacagatcgtttttctgtaagttgccctgatcatccaggaagtaatgatatgctgtaggcgtttttggacgcggttctgaatcaccggaagatgattcacgcgttgctttccagcgcttgcgatcttcggtgtacgtttcgaattctttggtcaattcactggttttcagtgtaacgatctcagattcatcgaaatacccagttctgatcaagtcctgaacaggttcactattaatctctttggttacgaaactgatacgatccgaaccattcaacatgcagtaaccgatcagatacgggcggagtgaacgcgcttcattatcgttttcaacgatgaacagtttcttctgtcgccacggttgaatcatgcgcataacgtcctggcgtttggtagtttccgctttgtatgtctcgtgacggcgaccagaacccacacgttcaaatacgcaatctttcccgtcatatgggttagcccagaagcccccgacatattttcctgtcgcggtatcagggtttttgatatgcgtcaggatttcagccagtgattctttacccacacggaaacggttatcgcgggttacgaatgtctgtaacaagccaggcagattgttgaaccatacgagtttatcgcgggttgttttctgtttattgtactgatccatcaactcttcatcgaaacgcttgttgattttgtccagtcgatccgtgatcactttcttcgtgactttatcaaggctcaactcttcacgcgacggcatgaagtccagcgatcccagagggaaatccagaatataagcgtaattgctgttacggtagcagtagaacagcgagttttcgaacatgtccatgtcgattggatagcaaatgttacccatacgcgcgtatacgcctgaatagttgatggacttataacggatgatcccgcgatcgtctgcttcttttggttgccagtttacatcaacctgaacaccgataaagcgaggacggatgcccgtaaacggttcataaacacgcgccgcttcacgttcccattctgcaatatcttccactttaaccggaacggtgatttgaacgccgttaggttcgtctgtttcgatttcgtagatttggtcaacgaaaggttcaccattatccatgtaagccgtgtatgcgcgtttaatgccgtcctggatggattcgatagtgaatgtttcggtgtaacagaacggggatttgctacccagccccagcgccccgatcagttcatcggtgtcggttttggtggattcgaagtaggttgtaaacacctctttaaccatccagtcacttaaccccgtaccataatcacggacgatgaaacgcggatcgagaacagttggcaactgaacatcgaacgggttcatgttacccgctaccagatgtccatcaatggcgttacaggagatctcgcgaatgattgcacggatcttgtatttgtagatggttgatgacaggattttgaacgttttcgcactggtagccattttaaacttcgtgcgttcgcctttatcgaagcccgttgtgtgaatggtttgtggtgctaactgacgtaatttcattgtttatatctcacttggtgttaaagatgatgttatcgcatgaatatttcacaggcttttgatcaagcccatattcaacaggtgtacacatccggtcaaggtattcgtaaacctgttgcttctgacgttcgcggtctttcatatccatgataccgaccacgatagcagttacaaaacatattgcaatagtacacagcacagctattgtaatatattttcccgtttttggtgcatcatatggtttcattgaatcgcctctgcatattgttctggtgtcaatttacgcgctactaagcgccctttggttgctcttttgtttcctgaaatgtagatgttcgcaaggttgcgtttaccttcctggatctcattgtacatcttttcaggcatattgcactgataaacttcgccgttcggagttttcaggaacaaagcatacatatcctttttgctttcccgaatcactgattgctcgcgaacacggcttttggttggcgtaggctgtgcgcccaactcgatagctttacgctgccatacgatcccgtgtccagccccttcggtcagagcatgtgcaatttcgtgcatgagagtatctaaaacgttctcgtagatatcttccttaacgtgagaacggctcaattcaattgacttgcgactgtaattgcattgtcccagagtacgcttgaaacgtccgttgattttgaaagaccaatgagataagccatgcttcgccatgatgcttttggcccagatggttatttccatatcgctacgagttttgaacattttatatcctccccaatcagtgaggacactataacaaaaaagcctcccgcaatgcaagaggctttttgtaaattatttcaatttcttcgaaagttctttcaaatcattgagatattcagttttcggggtcgtttcttcccagtatttcagttgcttacgcagttcgttcgcttcgtcttccagcttttgacgttcatccgtggttagatgatagatgttcatcgcaaccaggatttcggcgtggttctcgcaacccgtccacgtagagacaagtttaaccgcttcgctgcgactaagccccttcaatgcgtcaggctgtgcgatcatctggtcgatgaagtcaaccttcgccagcgctttatctaacgcttccttagtctcctggatgcgtttatcaatacgctgttggtaaacaccaatacggatatcaacgaagtctttcagcaacgtttcaggacgctcgtatgaatgcagtttcccgttaaagataacgttgatgtttgggtttgagttctcaatcaatccgaaatctttcaggatcttctcaggggtaagcccgtttgcatactcgcgtttgagggtgatctcgtagcggaaatcttctttcgatagatccttatagcttacgatataccctttctcttccagcttatccagaatagaaatatatttcacgcgatcatacttgaccggaatctctgtgatcaccagtttagttttaccctggagttcatacttgccatacatcgtaccgttttcaatgtcacctttgaaatgcgggtatttcagatccagtgtgaaatctttcccgttcaggtaactaacacatccattcagaaccgaaatcggatcgtgtggtggaatgttggtagcgtatgctttcgcgatcccgctgaacccgttaaccagtaccatcggaatgattggcaggtaataggctggcggtacgtgttcaggatcttcatgcgggattgtcaaatcttcatccatgtagatagccttgaacagcggagacagcttacatttaatgtaacgcggtgcgcctggctttttaaccagacgggaaccaaagaacccatcgcggtcaaaaagcgggatgttattgcaccagtgcgccgccataagagacaatgcctcttcaacggatgtttccccgtggtgataaccatacattgcaacaccgccagcgatagaggctactttctggaagcctgtaccgcctttcgctgcggaatgcacgaagaaacggtgaacgggtttgaacccgtctaccaggtgcgggatcgcacgagaataaattgtgtaaagggcaaacgtaagcccttctacctgtacaacgtctttaatacttctttccatcatttcaccgaaaatttatgttttccgttcacccagtctttacgcggatcggattcatcaccgaaacacagttccagaacgtctttgtattcgtcgcccagtacgattgtatcgtattttaactggtcgcccaacacccgatcgtaatcttctttgcgtaaagaacccagccctttgatatatcgtacctctttcgctttatcgcggaacggtgcgaaatcttcaagggagtagaaccatttttcatctttaccgactttcgcaatgataatcggtgtgcggatataacggatctttttcttctcgaacaactcaggccagcgactaaagaacgcaatcagtagggtgagaatatcgcccccgtcaacgtccgcatcgaccatgatcccgatgttgtcgtaagtcatttcggaagagtcgcctggatggagattcaggatcgccatgagttcagacaattctttgtttttgagcacttctaagttactcattccccaggtgttcaacggtttgccacgtagcggaaatgcgccttgtgtctcttcgtttctgcactcgataaactgccctacagcggaatcgccctcggtcagaaacaaagtggtttctaccccgtcagtgtcgatccctgatgccggaacatgttttgcaaccttcgcctttttcgctttcttcttcgctttggtaatggctgcggcttctgctgcctgtttgcgaatcagagcggactcaatgatcggagtgattatttcagaagtatccataatctgtttcgcgatctttttgtagttcagtccggcgtggttgttgaactccccagcggtgttagtcagtttttctttcgtctgactatcaaaagctggtgcattgaagttatgcaaaaacacaaccaaagtcaagcattcttttacacgggctttcgggatctcgatagcgtgtgttttcttgatcatcggttcgagttcggaatagataccgtcgatcatggtgtcaacatgaacaccgccgtttttcgtatccaatccgttaacgaaggatttctgtttgaaaccgtcttctgtgctcgccaggatgaaactgattttgttgtttgtctgggtaatcgttttatcaccgtacatcgcgccatacatcgcgaatttgttcgggaggatatcaccgttatatgtgaatttaacggcagggaaagccactgcaagcgccataaggcgatctttgatgacttcctttgtctcttcgtcgataccgtccacaccgaaaatagagaagtcaggggtaaacttaacggttgtcccttgctccttcgtcgggctggtgcggtaatccatgttctgcgctccgtccgtacagttgatcgtgactttgcgtttaccgttggatgtctcaccgataaagattgcgctgtaacagtttgtcaggaaagaaccaacaccgttcatccccattgttacacggttttcgtcatcgaagttagaaccggatttagccattgtccaggctgcaacaggtttaggaacaatcttcccttctggcgttctcacgtcatcttgtggaataccgcgcccgttgtccgaaatagtaaccagattgtgatcaatcttgacttcgattttgttcgcaaatttgaaatcagttcggatcgcttcgtcgatggagttatccaggatttcgttgatgattttcaccaacccttcaacgtattccactttgcggaatttacccatgataaaacgttcatgggcttctttgttcactgaacccacgtacatgttcggacgtttgcgaatgtgatcgcgatcgctcaagcagaatgattcatccaccttagcgccctttgtcggggcttctggtgctttctgcggctcgttatcgtccattaagaaatctaaactcatattcacctctttattagttctcaggcattatatagggttctatgaaaaagaaaacccctttcggggtttacttgttgtacgggaaaccgtctttcaccatctgcggtttatcaaccgttcgtttcgcctcgcccccgcaatcacaatctttcggttcgtcacggctcgcgatgctggacatcttcgggaattctttttcgcacttggtgcatttataggtatatgttggcattaataaatctctgacaatggaataaaacggatcggggttgcggctttgctgaaaacacattgtttgttccctgcaaacatgagatcagtttcgtacaccatacagatatatccctgattctccaaaatttgccgctcccagctatcgaaccatttagacaacttctgcaatgaagagaagccgaaaatatagctacgataatttttaccatgttttttgaggttacgcattaaacgaaggtcttcgcatggtgcggggtgacgagtctcggagataccgaagtttaaaccgaactcgattccatgaatatcaagatactcatagagatcgtcttcatcaccaacacaacccgtgtacgggcctaattgcttacaccatccatcatatttggataatatagacgctttcaattcaacgcgataaaccaacatgatccgatcctcgtaattgattaactacaagtagagtaccacttatctaatttcttatcaagcagtttattgatcacttgcgcgatttctgttgtcccgtgggtagtacccagtttcaggtaaatcacatccaacgcacacacgatcgcatcaacgctttcttcgacgatatcaccgccgcgttgaggctgaacgagacattcggagatctccccaacctctgcggacaggtggtgaaccacgtcgctaacggttcgttttttgacgctatgagcggtcttgaaaaacttatccagaactacagcggaattttcgcgcggtacttcctcacctttattgacgtggttgatttcagtttccggttctggtgcaatccataccggattgaaaagccctttcatatcgttgaacttgataggaacgggaataccttcaagataaagaatccctgtttcttcatacaccatactgatccggcgtggtgaattgaagtccatcggattcttacgcaacgcgtcatacatacgacgaatcgggtcggcttcggatgccatttgacacacagccattaacatagatttcggggcgtacatatcaccaattttatacttgctcatttacaatacctttatgataaccaacaataaaacagttcacttctggacgttcgccgggaaaatgcacacattgcatgacgcgttcagccatgagttcttcgcccaaataaacagaggttgtttcttcgttgtaatgacaacagtaagaagttttaacactcataccaggcaatccggcgatatgcataaactttgagtttgtgcatggtttaccctcaatgctctttccgtttacatcaaacgttgcaaacatttcggttttgctgttctttgggcgtctgctcatttattcacaacctcattatatgttttcaggttccattcatgcacttccggcactttggagtaatgatccaggaatactaactggacttgcataacactagcacgatccatattgaaaaggaagcgttgcggggaagtaatacacagaaaatcttcggtacttcctctgcttgcgctaaactcttttgtttctccgccgtcaaatttagcatatacaggcgtagaaaaatacggggcgaatagttcgcgtttggaatcgtccgtaatcgcactgaaacacacgtctacgagttttccggttccttcccgtgtgatggtgagcattgttcctttcgtgcgccctaagacgtttacagagcgcgtggtgacatcaccaaaagcgtttgtgtaactcacagtctccacaaagcccatatcacgacgctgttgtagcattgcttcgtgttgtgcttctgcatcctgttctactactcgttgtgcggcttcatacgccgctttgttcggatctcttgattgccatgcgaagaataaaacccctgcggctatcagtccgaagattgaccaactggcggttgctgatagtttcattttaatttccaaagggaccgaagccccgtattagcgaagatagcgaacgtaaccactctggtcgatcgcgttctctgggttgttgaagatgttaccacgaatacccttagcaggtgctttccagccagcggctttcaagatattgccgtcattgtcgatgaagccagcaactgaacgctgattgaacatttcaccagtttctttgttgcgggtatcctgcacgatacggtgatacttacggcctttttccagaacgaacacagtttcagtgtaatcgctgaaccacatgccagtgttacggcctttatgcatcgcgtccagtaaaggctgtgctgcggctttcaattcgtcaaaagtatacatggtaaaatctcctaattgtgtttcgtttcgatgggataactatatcaaagctatcccattaagtctttagcaaaaagtgctatttgttaaacccgtttcccttgataccatttcgggaaaataaccctctcgataaaagttctccccaggttgaaactatcaccaaacaggaggacaccaaacaaaggatcgcgcttgatatcgtttttcccgacagtcttcattttcccttcgtggatcacggtgtcaccaaccgtgatatccttgatgcttacttttacatgatgcatacaatcacctctgcgagtttagcaggttttgcttctggtctaactttcaacgcatcattcagattcttttcaaccatcgctactgcgtctttttcattgaacccgttcttaaccaggactttaactactttggcttctaagtttttcatgatgcgttccttttgtctgtttcgtttcgatgtgtgtaatatacaaaaaagcctcctgcattgcaagaggctagtttaacaaaaagtgctattttaatgatttaagtgttctacggattcccccgttttgggtgatatcgtaaagctcttttgctttggaaagagataccgtgatgtcataatcggttcccttctgtgagaatgagaatctaacctggtttagctccgtgtatacgtgggtacacactgcttccattcgaaaatgttttataaacgctttcttcgtgtagtagtcgctaaaccattctcttgctatggattggtcgattgctttgaagatgacaaacagcacaaccaacacaaaaattactataagtggaattgctgtgctcattatttgcccctgttcacagattgacggtgtaacgcacggttaacgcgtggcgcttgataaggtttcattttgtacggtgttggatcagagtattcgatccggttaggtaatgaatacagttcaacgcttggttgaatccagcggattgagtcgattaacccttgagttaacgcacgaccgaaacctacaccaactaaacataaacgcataatatccccttactgtgccagaatgtgaagccattcgcccaaccacacgatcgcctgataagacaaccacaccgcaccggacacacaagcaatcacaccaatgatcgcgaatccgattaaaatgttcaaaccttctttcaaatcaccaaacatgttttatcctcttttgtttcagtccctacaaaataacaaagcccttgcacgaatgcaagggctttttatcataattcgactaactgaggcaatttcagaaccatccccggaaggatatagcttgcattgctaacggttttgcggttcaacttagcgatagactgccagcgctcaccacaaccgtataatttttcagcgattgaatacatgctatcgccaggctgaacaacatattcatcgtattcgactttaacgaacgcggggttcatgagaatgtcaaacatctgcgctttcgcttcgttcagtgtttttgcatgtacagttttacctacaaatgataatttaatcatcttttcctcggcagactcaatggatcggtttcttcttcacttgggggttcttccagccccagcgcatatctcaatgaatagactatcatcaaaacatctttcgcgcaatcgtgaattgaattatgcatcacaaaaccatcaagcaaccctttccgaagaggacaggtcgaagcatcacgcgttaacaggcggttttcgatacatgtacgcacatcgcgactattccagaacacggtcggcatatcttcgaagatgtcgatcttaccaaccatcttacgcacgatatcaaccaggataccgcgatcgaattcaggaccacgaacataatcgagtgattgccaacggctcacaccgtccgctttcaggtcttcaaagaattgtctgtgtcctgcatacagttccagatcttccggcgacggtttcaggatttgacgggcttcttcgctttgttgtttccaccaggcgattgttccctgatcagcaatacgatcaggctggttgcgcaaatcaaatttgtacttgcgcccccgtgcaaccagttccgcgaacgttggcgggttgtggggatcgtcaacaaatggaacgtatgagagttcgatcaccttcccattcggggaagggccaaccgtttcataatcccatacgtaatctacgggtaaatgactcatgaagttctccgcttataatcttccatgaagtacgccagcgtaagcgcaacttctgggttgatatcaaaagtttcaaactctttgctttgcaaagtcatcataccgaactgacgcagaccggaatgataaattgccttttccagacggttcgcgttttcaacagcttctgtgaattcgtccaacacatcgcgatcgatgaaatgcggaagttcttgaacaggggttttgaaaattagatctgcaatcgcttccgcgtggaggcgtgggatctggatagatatatcttttttcatgatattaatgtccatatgtctttatcttcacgaatgtttcgtgccattcgaaggatcagcacgataacgccatattcatcataagtcagttcaatttcttttgcaataggactccatgaataacttggcccgttcggagaatacagaacatcgttagatttttcaatgaagcgcaaacggtgaataacttcttgcggatctgctgcgctatacatcccgaacacattgaccgcatgtggatctttttctcgaattttatcgagtgcttcaagaattcggggaatgtcttttacaaggatagtcaatttcataataacctcaaaaggggcaaagccccttatacataatcaacggtgtaacgtgcgcgggttacgcccacatagattaactgcttacacagatcgtaatctgcgaacgcatacgcatcgcgcgtgtacatatacgcatggtcatacgtgctcccctgcgatttgtggtacgtgcaaaccggaagaggcttaacatcctggaacttgtttttaatcgcccagaacgaatgccacggggctttatagcctgtttgttgcttgatgcgcttataagtgctcgcaacgtaggccagatagttacccagacggtctttcatcaccggatcaacaacaacctgaatctgtgcttcggtttcctcttcgagcgataccgttttcagaagatagaattcaagttcgatcttctcgtcgcacttctccgccttgataacttcccgacgcgggatgatttctaagactcggattttttcgttgttgttataaacaatctcggtgaagatttgcccgttcaaccgcatttcctgaactaacggttcctgcatcacgatcacttcatcgagaatgaaaggttctgttgttttgtacaggtgtttacggatcgttgcgttcagcttgtccacgttgtcgttagtgtaagcgaacatgcggttctcgatcaagtcatccggcgttttgacacggcggaaatactgacggaggaagtcaacagcgttagcatgttggaacacacccagatcaccgacagacatcggtttcagcatcttaccatcacgtacagcccgtgaaacctgaataatcgggttcccttctgcctgacgcatgattttatccatacggataacatcaaagatttcttcatcaaagaacggggagagttcaacacgtccatcggcgtttaccggacggatctgatctttatcacccagtcccagaataacagcgttgcttggaatactgcgccggatgattcggaacagatccatatcaaccatcgagacttcttcaacaacgaacacgcgacaggtagacagatcaggcgctttcttgcctttctgctgttcgaacacacgcagttcttcgttagtcacagggctaatcttcaatgcagaatgaatcgttgttgcgtccattccggtagccgctgctaacacgtttttcgcctggtgtgttggggcagttaaccaaataccgctaatccccaaccctttcagagtgttaaagacaaacttaaccagtgttgttttaccaacaccagggccacccgtaatagttgtatgaatggcgttctggatgttgtggataacgcgatcatgcgcggacttctgatcgtcactcagatcatcaaatgttaactcgctcataatttgagtaataccccttgaattttcgaattctcaataaaccaacgcatctcttttttctgttcttcggttgctggtagttgctcggttttgcggaagaaactgaaacgcggttcatccggcgtgtagttcagtttggtttcgtagcacttgcggataaaatctaatttatcttttgcaagttgcggtgatgcaaacagttccggcgttttcccgttttcaacgtatggaatagtaaagccgtctttgtctttcgtaacaatgatatagtatttgtcaatcattttcgcccctcatagatgacgtagaaaaaacctataaaccatagcaatgataatactatcaaagcggcttttctgtcaacaccgttaacgtggaaaacgcaccaaccgaagagatacgttatcaccgcgcagacgatataagacaaagcaaatacggcatgtagcgcggtgatttccattagtagttgttagcccaacgacgcaggttttccgcctgtttcagagcatacagcttgtagatggtttccgcatccagtcccaacgcgaggaacttacacatgaagaagtgccactggtcaatcagttcaaacaagatttccagtttgtcttcttctttcatttctgcgaatacctgattgcgcagttcctggtgatttgctttccacggtttccagacaccggaagcaggttttgcgccgcgagacataccgcccagagcggtgtaaagttcgcgggtttcatctgcaatcgcatcatcttgcagtttcagccagtccaagatatcaccgcacgttttcaggttatcagggcgcggaacccatgaaagggtatcagacaggctttgttgtgcgtggttttgcagatccagcattgattgcagaggatcgccgttacgtgccagaaccttttgatattcggtatcaacaaattccagatcagcagggttaaccaggtgcgcacagctattaaaaacaggagttttatcagtcatttatttgtctcttcattatgaaaattgccgaaaatctcttttgcggcatcattgtaagcggcttgtgcttcttcaacagttgcaaaagaacccaaatgttttcgtttgcccttatattgaatacttgcagaaaatcggtttccgcgagggtatacaccaatggaaccgcttgtgttgtttttacgtttgttaatgtgatttgcattgttttccgctgtacttgctggacgcaagttatcaggaaagtcaccaacatcaacgcctttgatatggtcaatcatatcagggagatacccaaaacgcgagtaaaatataacacgatgacgcatatatttcacaccttttgtttcgatgcgggtatatccctttttggtttttgtcccagcttccataccatttttaagccagtaaacctttccggtattgtaatctattctaaccttagtcagaagatcctttataccatctatttctttttcggacttcgatcccattggttgaatctcaactttgcagttaaaccggacactgtattttctttcagatacttagcaatgtctgctttggtagcaccatcacttttaatcatttcgttgatatcttttgacggccaggggcatttatcccataaaacgaccttttctccagcatcaatcaatttttttaaccttgcggtagtatctggatgatgtcgttcattgtcaagcacccaaacacgcatatttttatacggaacatcggacagcgccatttgtccgcccgtaatcgcaccagcattatctacaaacaggctatccaatggcccttcaagcaggtagacaggtttcaacggatcgatggtatcttgaccatacactttcgttgagtgttcacatgctttgattgtcatgtattttgcgttggcattgtcacgcaaggcgcgtccctggaatgactcgattttacccttttcatcaaagatagggatcaccaaacgtggttcatccttcggtaaagggtatgcgtccgcattcacagagttaaccaggtgttgccattgacgcgtaaaccagaggcgatcatatttgtctttaggtatgtgacgacctgcaacatacttaacgatagggtgattttctggcaacgtgtccagacgttcacagaactgcaattcaggaatatatttcttttcttccttcggcggttcttcgtgcgtctgttttaaatctttacgatccttgaaagattccatcaaatacgccgtgtaatcatccgggtaataatctttcagaaacacagaaaacggcttgctgtagttgcagttaaaacaaccacacatcatgtgtgtgcctcgttttgatggaaagatccaaaaacgttttttgtgcttatccttcatggagtcgccacaaatcggacaacgggaatggatactgaattccccaccccgtcgaacgatttcgctttgtggtaatgatcccatgatacgagttgcgaactctatatcaagatacatgtttacctctatcggctaacttctttctctgtgccgtctaaagtgattttccattcatagaatatcttataaaacggataaggtctaggaatatcaacacccgatgatgtttttctttcgttcgtgtacacgatcgctgtgtcgctcatgtacttgatacggataggaaaccaggtgtaattgttcgcagtaacccagatccgataattcaatggcggtaatgttttcattcttcactcttcatgattttacgtttgcgtttatgcggacgtgtagaacccagaaccttcggccctttgttcgtgattgcgcctgtagtcacacccgaagcaatattatccacgcttccgcctgaatcacctgcaaccatttcttcattgagtctttcgcgaagttctgggaggttcatcatgatctcttcgtgctcttgctcggtcaggttccagcggttccgtaatgagtcatacgcgctcgtaaggttcatgaacccagacatataaggaaccgcgtttaaacggcgcttgatatgccttacagagcgatggaacggggaatatgcttccagttcttccttcgtcttcgggtttttcaatacttccccttgaccgtcgatgatacccagcttgtacgccgtccattcagtccagggctttttcagtaggcgaatcattcgcacactgtaggttaaatccatgtttttgattaattgatcgctcatagtctttactctattgtgaaagtgaaaaggttttgcgcgggtttggtttctggttcggggaattccatacagacaacttcacacatcggtttcacgcctttccattcttccagatagtatccggtatcaataccgcaacctggttgcatttcaaggccagtttcatcaagaaactttttacattttgatgatgtggttgattcgtcttgtcggaaatatcgttctccagagtaacggaaattcgcggacatctgcgggagaatgaacgtacccatacgggcaatctgtgaagcacgttcaatcactttgtattcaaattccgcgcccgtatacttacccttaaaatcggatgtctttatcttgccgaaaggtggattgctgatcgccatatcaaacagagtatcaaactccgtcgttaacgcgtctgcgttaatccaggtcgcttccggtacgatacgcttacccaacttatagtatgtatggtttaactccacacagacgatttcacgcggtttggcgtacatcatatgaagcatcgcgaaggatagcccaccgatacccgcgcacaggtcaacaacgcttccactggtacaagcatcaatcgtgaaatcgcgagcaagtccgatcggggtaaagaatgcacccagttcagagttattcgtaaatgcaccttcatggaagttttcgataatgaataatttttcgtcgtaggttagcgccttgtcagactccaccagatccattatctgattgtgtttcttcgtttccgcttttgttaacttcgccattgtcccaactatacaataatgttgattcgtttggatagaattcccacccgtctacatatccggtttcccagtcagtagtttggtcaaaaccacaaattcattcatacacaccaggcggcatttcaacggaatcaggaagcccgatatcttccgcactgcgtccacattcaaagaatgaatcatgtatgtttggtcgagataataccgtaacataaccttcgtcgtcaatagccacaatccatttcgaactgtgaggactatcgaaaactggttcttctgcatcagggattgcttgtatttccgtgattccccagtcaaaattgttcatttcactaaaccctctttaacgccctctttcatggctttcagaacaccgataaaagcgtctttgccaccgatagcgccgatgataagcatcaggacaccaacacaacccgctaaaccgattctgaacaggttccaggcaaaagggatagccagaagcaccaaccacgggaacggaaagcccataagtgcatttagaaccagtaagataaaagcgattgcaagtttcatgatgtcctcctttgtttgtttagaataaggtatcacctttcgagaaggattgcaatacctacagatacaaaaaagcccctttcggggcttaatttttatgctttgttgattagataccgaagaacgtttttggcctgaacttcgttacagcagagtttgaattctgggtcgattgggaggaagccccagaggaaatcaacgctaccttcaacatctgctttcccacttttcagcatttcaaccagcaaacctctgtttactacgctgttcactactgcatcgaaataacccgcgctgaaatccagttctgggttcatcacttcgtcgtatgggttgttcagtaagttcatttggtatctcctaatccgttttgttgtctacgggagtcatattatcacaaccagaactcccgtcaacaagtttttcgaattattttaggttttttgcaacccaaagtgtaaatttagggaaagtgtttgccattgctacgatgatgaacacccacaccgccagcttaatcacaccgatcacgatcagaggtgcaaacacaagccaccaggaagcatttgccataaccccgattgctgccagtttcagagacaggaggatcaggaacacaataacgagaatctttttcatttcactatacctttggagggggccgaagccccgttaaaattgaatgtctgtgctgtttgctacttcggctaacttactgcttcggttagtttcagcttgttttaccatagcaccttgtgcttcttcaagcgttttcggcatctgacgacctttataatcagatttgaacccgatatcgctgttgtcggtatccatccagcgttgattacccttacgcacttcgagtttgaagtggttaaagtggttcttatcgccgtaacgggatttgatctgcttgaacaactgcaagccctgatcagctaactcgtcggtctcaatcacagctaacataaagtcagcagtagccggaagaccagcagattcggcaacgtcgcccatgctgatatcagaagcatcccacgcggcgcgggtagtctgcgcaccagtccacattacagtatttgtttcaacagccaaaccgcgaagttcttcggcaatcgctttaaccaggatgtatgtgttttccgccccgcgtacacgggtagaagcacagatccccaggtagtcaacaataataacatcaggcacgaagtttttcttcaatttaagctctttaatcagcgctttgaagtggttcgcgttcgcccctgctgttgggtattgcttaacgattaaacgcccgaccttcgactgtttgaggcgctccatacggttcttatagtccgcataggtaatgttcccgttgtcgatatcgtccattgcaacatcaagcaggttagcatcaatacgtttagaacaaacgtgttcagccatttccatactgatatacaggacgtttttacctgattgcaggtaatcagcagcgagagaacaaagccccagagatttaccaacgttaacaccagccattaagatgttcaatgttccacgttctgcgccgcctttggtaatggcgttcaggatcgggatattgaacgggatcttcatcgctttggactggtaaagcatccagcgtttttcatagtcttcgaagtaatcatgaccgaccgaactatcgaagctaatcgctaacgcttccgccatgatgtcagggattgccccaacgtcagggattttgttgttgcgttcgccagcaggtttttcagcattcgcctggatctcaattgcacgggacagagcgcgatacattgccttgtcacgacaataggtttccgtttctttcatcaaccagtccagatcctccggcgcgttcttcatgctgcggatcatctttttggtgtcttcgtagactacatcactcaggctctttttgtccagagctacttctaaagcagtttgtgaaggaatgctgttgaattcctgtacgtgcttatccaccaaatcaaagagaacttgcgcgttcccttcgaaatattcacggcgtaaatggggccacgcctgaacaaaatacgtaccattaaaaaccagatttgaaaatattgtttcgacgatcattgttacctcttaaaccagattagcgaacatctgaaagaaattatacagctttactttcaacgccgcccataaggtcttttcaggctttgggagattaggcttgatctgcgcgtagattgcatcgtgaaccagcggaatcagtttttctttatcttcgtccggcgtactgaattcgactttcaagccgttatcccaatacaccttatggatgtacactaagtgtgcaacatcgttttcatcgttgatcaacagttcttgaataacgtcctgcattgcttcatcaagaatgttctttgttttttgttcaatgtccatgattcacctattaaaagggggcaaagcccccagttgtttattactcttctgacatatccacatcatcagggatatcgtcatcgagatcaaatttatttgacggttctactacatcgtcggaataaagatcttcgagtgctgccccgtcagtgatctctttatcaggaatacggtatttttcctgaatcgcatcaaggaatggctggtgagtgaacagaggtttccagaactcgatcgagttggtttccgtttcacgccatttcttatcttcaacttcgagttcgccagtctcggtattcaggaaagcacggttgcgccagcctttcgttacggtctgaacgaagttcatttccatagccagatccagaagaccagagaacatactgataccgccctcataggtaacatgaagcgggaatttggatttctctttcacgaagcgagatttctcgatgttcatgatgaagtcataaccgacaacttccgtaccttctttcacctgttgtttgcccaggatgatcgcggtatctgcggaatacatcagaccagtaccaccggaaatgactttcttactgtacatttcttgtgtgtcgtatgtgtgacagatacacaccatcggaatatccagatccgccaggtaaggcgtaaccatacggaacatacctttaagtgctttagcacgggtcatgtcctgtttgtcgttgtcagacagggcatcagccagttcttttttactcgcggtgttgcctacagagtccacgaaaatgatcactttgtcgccacgttccagcgcgttaagctggctcacaacgtcatttcgaagttgctcaactgtcgtgatacgagtatacaccacacgatcggggtcaacgcccattgatttcaggtaagacttagttacgcctttctccgaatcgtagaacagacacacagcatcctcattcgctttgaggtacgccgcaaccgtcaccagccccagattcgatttaaagtgttttgacgggccagcaaacagagttaagccggaagtcagaccaccatcgaaagcgccggacagcgccaggttcaggatcggtacacgggttcgagttttggtgatgttattgaaaacatcgctttcagacagaattgacgcagattgactattcgagtttttgatcagttttttcaggagtgctttattagacatttatttttccggtttatatacacgcataatatattcctcacaaatttatataaatggggcatttctgccccgtcaggtcttaccagtcatcaccgaacagagtgttcagggatgcgcgtttttcgtaatcaattttacatgcttccgtgatgttttgcaacgggctaaccacatgtttttcaaataatccgccatagtctacccacttcaaaatatcttcttcgatctcagttggtaaacgcgtaccggattgccatgcgatgcaatcagcttgccacgggtttttatctcgcaacggcagaaccatcaccttttcaccttccatgatcggggtgattccttgaatacccttcgtatggcggttaaagaacagaacgcctttgatgtggtttggtgtccctttgattgggaagccagcaccatcattatattttgagatattgttagcagatgatacaccagctatttctcggtagtcaagcgccttatactcttcttcaaatactttgaagtgttcgtgtaaggattcttcaccttcttgcaggatgcgacggatcgcttccttcaagaactttttaaccgctgtcggtgtactgcttcgctgggtttccattcccatgatctttaatttaggcttctcgtagcgggttccttcggagtcccatacgttagccgcatatcgtttcttagccgtccagaaactacccagacctttcgatcccagaggtggtccagaaatgatttcgcgatccataaacatcaggtgttcgacgttgttcatgtactcgcacagttcgcggtagcccttatcaatgataggttccatgcgttctttactgaacttatccaggaagtcaacccaatggttgttatccctgaacttactttcaccgccgactttcgcgatcacgttgtccatacaaacataaatggagtcggtgtcacagtaacgcacgtatgcgtaatccgtggtgttgcacagttcgttaaggtattcgttaaccttacgctcaatccactgaatagccaactgcccgaacatggtgatcgcactggcgtttcgaatatcgaagtaacggaaatgttcgttacccaacgcaccataaagggagttgatactgattttacggttaagctgtgcggtgttcgcctgtgcgattttcttctcacacactttcttcacggctttaagcatttgcttagacagcgttttcagtacagcttttgattcatcaccgaaatcttcgtagaactcgaaatcagggttgatcatttggttgtgcgcgtctgtcaggtgttcgagttcgtgcttaatcagttcgagatttcgctcacccgccatcattcgttttttccacgccttacgctgatcaaatactttcttgatctcgaccggaatcacgcctttaacatcgcgtcggaacatccacccgttaggagagcagctaaattcgtcgctaggacgcggcgcagtcttattgatgtattcatgcatcggacgcactgcaaagctgttagcgattgtctcagggcttatattcacctgtcggatgatagatggatacaggctggtcaagtcgaacgatacaatgtaacggtatggagcgacaaccggatctttaacgtatgcaccatcatacggcgttttagtatggcgtttgttttctgggattactttcttctcttcacgcagagagttgtaaatgattgcgtcccacgttttaagcggcgacataaccccagggaagttgattttcgcgtagtatgctacagacagaaccagttcgataaagttgcgtttaccgtcgatatccaacacgcggataacgtcaacgatgttatacgtgatgtatttctggtgatccgcttgacgcagttcagacagcgaaccttcataatcaactttgtttttacctgtttcgaactcagcgatcgcacccagagagtaagacggttgcggggtgaaactgaatttcttatagagatccattccatccatttgagcaacgccgtaaatctcatagcccagttgttcgttcccgtaatggtcggttgttgtcttcgcagtcactttcccgaacgggctgaaatgacgaacaacgttttgcccgaagatgttcaggtaacgggtgatgatatacgcaatatcgaacttgtttgagttccagcccgtaacaataacaggtgtccgctctttccagtctttgatataagccgacaacagcgacttttcggtctggaatgaacggtaaacaattttcttcaagtcttcttcgctgatctcgttttcggtatcaactttcgacgctacccattcatctaacccgccctcgaccagatcgtacacaaagaatttatcttcaacgctgtcatagtgtgtgattgcgtcgatagcatattttgcttcgcggggatcagggaattcaggcgcggtaacttcgatatcaagtgaagcaatgcggatcttgtcgcggtcgtattcgatttcctttctgtaggcatcggatatatacgccagcctgaaatcatccatgcctagcgcttccatgcctacatctttcattcgctgcatccagttttttgcttctttgatgctttcgaagttctttttgatgcaggtcttgccgtaaatgtcgcgatatggcgagtctacacccgccatagcgtgttgaaacattgtaggcgcatattttgttttgcgaacctgttcgcgtccctcagagtcaatgaagcgctcgtagatgtgatcgcccatttgctcaacggatagataaaattcattcattacggttttctttctccgtgtttaatcgtgacaggaatgataccccagccagcttggtcagatcaagcgagcgttgcgctaatttgtgatagcgttgggtgtcaggccgatttagttgttcaactagcacggtatattcttccatgatgcgagtatagaacttagggaagtgatcccgcgcgtatgcgtaggtgcgcagatcagagagattgcaagtaagagacagtttgatgtcttcgctatgcagacggttgatcaagtgatcgccggattcaatagctttgatgatttcttcaatacgaattttcataatttagtcctcacaagtggtgtacaaccaatataacaaagcccctgcatttctgcaagggcttttgattaatgaccgatccggtacttgtatttcaaagtccattcagctttttgtgcgtgagtcagtacgcggaagttgttctcttcggagaatttcagatccggcgtaaggatggaaaccataccccactcttccagaagtcgcgcaatgttattgcggcgcagttcgtcatcttcggtcatgtcaacctggcgaccgtccagcttcaacagttctttgaagtgtacgataaaataacgcccttgtttctgtaggatgtggcaagactgccacagcattttctttttgttgtttgcgatcccgatacgggtcagcgtttcgcgaattttcaggaaactgtcatcgctggacagtttaatttcgagcatgttcatacatcaccatttctttattagttgttcaacctttttctggtcggttttatttttcacaacatcagccaacacagataaagcaactttcatatttttccgcttccactcgtccagtttttcaagctgtttgagttcttcgtaatattccattgctatacgtgtatttacaccgtatcgtttttggagaacatgaaggataactttcatttcgttatcttcggtgagtttagcccacgccccgaaccgcttacctttgcgcaccgtatgcaggtaataatcaaagtgcgcctggtctggtaaaccggaaccgatcatattcatcgtgtatgcaggaatcagcgtttcgatatgctggctcattgcattgtcgatgaaaaacttatcgtatgaatcaagggcagagatccgtaatggtgtcttcccgttgttcagttcttcgagcaccataaacaaggtgttttccttgtctttggtgtactctttcacaagttcttcgatcttgtcccagtctttagaacgccaggccgcttcatgttcgttcagttcttcttcatcgagaaaagcagccagtgacatttttaagcctcccacgcgagggtaagcattaagcccatgaacaggtattgcaggtgaatctctttgttcactgccagcccgtactgtgcgttgttttcgcctactgcctgaatgagtgcaaccttagattcgttggtgacgatcgggtataccgcatccagaagtttagccaggaaagtttcatactcaggcgcgtacttgattgcttcggctcgcagtgctttgaagttcttcgctttaagcccctcaattactggtgtgatatccgaaccaacaatctcagacagaataccagcatcaattttgccgcgcttagaatagaacccaagagctttaacgatggatcgcgcgtctgggtagtgcttcttaacgaatccggcgatcacctgctggtcatattcgattttctcgatttcgaggataccgaaacagcgtttgatcatttgcttcatcagttcaacgcgttcttccttcgacggggaaccgaacttgactaccggacagcgggagatcagcgcagggtgaatcccgttgatgttgttcgcggtgatcataacagtaacgttcttgctgtacgcttcgataaagctacgcatgtgcttctgtgcttctaccatgcctgggcgatcgaattcgtcaatcagaatgattttaccgcctttcttctgcgtcatagaggacgcgtaacgatccagttcgttacggatgaagttcacaccacaatcggaaccgttgacaaacatcacttccgcatcaacttcgttagccagaaccagcgccagcgttgttttacccgtacctggggaatcagaaaccagagtcatgttgtcgattcgtccagacttgatgaagccgcgcatcgtcgctttatcagcagcagggagaatgcattcatcgatcgtcgtcgggcgatagcgctgatcccatgcgaattcttcgggagactgggagattttgccgtatttggtttcgattaactgtacgttttcactaagttccataatattaccttcaattgattatcaaaaaggggcttaacgccccttgtgtactgctttgtttatcttacttgaactgactggttgcttcaagtaccactacatacgcaacgccgttttcggacgagaatttcgcagcgccgcgagaagagatttcaactttgtaatcgctgttgatgaactgcatgttgtcaatcttcatatcgaagttgaacatgttatcaccttcgtaatcgcccacttctacagagaaggttgactggctttctttacttttcgcggtgattaccagcttgccgttgattggctcaacagacaggtcggttagtttcatcatgcgtgacgctttgatcagtttttcgaaatcgttcgcgctaatctggaaaatcagatccgcaactggcatttccagacgctttttaggctgtacgattgtggttggatcgcttgaacgctcaacgattttcattttctcgccacggataacgatttcaccagtggacagatcgtgagttacttcggcatcagtgcctacaacgttcagcatgttcaggaatgagttcagatcgtagatacctacatcttcgtcaattacgtcagaaatcgttgcttctgcgtaaactacgctgttgatggatttcgtcataatgaacgaaccctttttcagcattacagacgggttgatctgggagaagtttttcaggatatcgatcgtttgtttagagaatttcatattcaacctatagttttcaattaggcaaaagtgccgttaatcagggattctacaatgatcttcgatgcattgtcaaggaattctttgcttttggattctgtcattttcgtacccgcctcgcgagcgtcgtaaatgaatccggtatgtactgcgcttactgcttcgtcgatccgtttgtaatgctcaaagcgttcagcttgaggcatcgcacggaaaatctctttgatgttttccggcactttacctacccaggatttgcgaacgttgttcagatgcgctacatatacgttttgttctaaattcatatctacctcaaactttcaaattgggggcttgcgcccccgtaagcattacagatccagcagtttatccaggtcgtcatcaccggaaccaccttccagatcaaacggaggggtatcatcttccggtacgcttccgcctacgttcagttgacttacgccaccagattctttagcaccgttggactggttgccattatcgaagtttttcagttcgttgtcaaatgagttcagttctgaatccagatccgcaccagcgcttgcgccagcacccattgcagcaccaccgaatactttggtgaacttcgcggtcagttccgcagttggtttgaactggtctggtgcagtgattggacgcagatcgctcataccttcgaagatttctttctgacgcgcttcgtcttcgatacctttgattgggccaggaataccgaacttgctatcgtcatagttaggccagtcgccttgtttcttcgcagtcagggtgaagttagcaccaccaaacggacaggttacagcgatgcctggttcatccagatctgggttccccgcgatagccgcagtgattttatccatgatctttttaccgaagcggtatttgaacaccttaccttcgttttccggcgctttcggatctttgatgaccagaatgttagcccagaacgattgtttacgtccgatcagtcccagagttttatcggcttcgctgcctttcactttggctttttcgaacagatcgttgtcagagatatactgacacacagggcaaccatcgtaatcgccgtgggtagacgggcagttttcgataaaccactgattaccttttttgaaggaatggctaacgatacgcacgaacgccagttcatcatcagagcggttaggcaggaagcgaatagtcgcagaaccgtttttttgcggatcgagagtcagtttccactctttttcatctttctggaagccggaggaacctttcagagcggcgacttgttcttgcagtttggttggatcttgacgtttaaagaatgacatatgttatttctcgtttaagttaattaaggtttgtttcattaagtttcggtattttacgatttcttcgttactgatttcaactaattttctgtatgcgtttagttttttgctaaattcattccagacgaaatccgttgcgatttcatcgtgtttatttatgatgtctaaaaacgagtcgaggatcaagaatgattcataagaaatcaccccagactgtacgagtttgcttatatacgaggttgatgatttgacgctatactgaaacaccgttgagaggggaatacctttcatgcgggaaaattcatacaggttttttacatcgtccacgaaaatattattaattcgcctcaacttgcctatgtattgacgataaaacacgatcgtatcttcgtctacatccccgacccagaagtcggggttagctaccatgttggagagaagtataagatatatttctttgaatgtaaacctttcggctaactttttgaaaaaatacttatctcttctcttttcgaacgccttttcagtgatctttatttcccatttgtacttgatcgcgtcatacttcccagcaaagtgatttttcatcaccagatacagtttgtataccgcgatcggtttcaaacgggaattagcgtctgaactgtcaaacggggttttaaatttcacatgaaatcatccagtgtttgcgtcgtcgcgtggtctttagccacagaaggacgcagcagattgtttttaatggcttcgtcgctaatcttgtcgatgatcgctttcggtactgttttggacagcatagcataatcaatgctgttttcgtccatccattgtaacgtagcttccatgtaggttgccccctcagaggcaaccagattttcgatatacaagccgacttcggttttgtttccgatttcgctcatattacgccttatcaatcacatcgtacagttcgataagttcgttgttctgttcttcgaacgcggtacgtgcctgttcgtgatacagtttgaacagtttgccgaaggttttgccgtcgataccgtaatccgtttttgctttggatttgatgtctttgaaagaaccctggaagtgttcgatctgggttttcacgtttgacgcttctttgatcagttctttaaccgctttagcgatgtctgggttttcttgcagtaattctacactcattttgttacctcaaaagtcacttagtttttcatacatacgggtgagtttgcattccatgaagtatttctccatttttgctttgttcccgatttttggagcattgtacgcttcttcgattgccgttgcaacatctttcggaataaaatcaaagtcgcgaagttcttcgttttctctgtagcggatcgcccattcttcgggcatacccacggtcggatcgtccgcttccagccaggcttcgagttcagcagccctgatttgtggggcgcgttctccttcaaccttcgtaacaatatagtcatttcgcattttaatgcaagcgatactatcttttttatcgcccttaatgatcttcatgcgcaaatcgttacgaggcgaaccatatttcggtgtaacccatttcttttgggttggtgaccattggcgcacaccctgatatttttgaagggctgcaaagtcaccatcagcagaaacgatcagaacacgtttaccttcggataccgctttacgcgtcaccacaccgatcacgtcatcggcttctgcgaagtcaacacggatacctttgtacggtagattagcacggatttcatcgtatgtcgggtgaaggaaaccattcaggcgatcccagtcccaatcagatgcttcttgttccatttttcgtttctttttgtagtaccaggctttacttctgcgccaatacttgttatcatcaaaggctagaacaatttcagggtactcgcctttgaatttaaccacattgtgacgaatggtgtcaagcactatgtgacgaacaatttgttggttgatgtcattctggtctttcggcttgaagttgttcatcaacgttgctaccgaaaggtttgaaatatctatacacatcacatcaacaggatcatcgtcattgctcattaagctgttcaggttgaacatacttgcaaatgaagacatttcaatacctcgttgttgttgaatgaaactgattatagtgatcactttttcaaagtcaatagatcatttcaaaaatctgagcgaagcgaaggacacgaacgaagtgagtgtctaactacataactacacttttaaatttttatattttatatatagagaaaaatgtagtttttcgtttactttttaaccgatttagctatccgtttcgcttcgctcacggaagcgcttcgcgctgattttattaaataatatagattggaagtaggtttgaaacacctgattcaatcggctataatgaatgtattcaatttggagaatataatgactacaaagatttatgcagataatgataagctgtatccagtaatgtgtaagtggaaacagcaaatccgtgaaactggtgatcgcaagatgccggatgaactcggtattgcgattatgaacattgctcacggtttggcccgtcgatacaacttcaaccgttattccgaagactggaaaatggatatgatcgatgatggaatttcagcaacgatttccggccttcataactttgacgaaaccaaatatacaaacgtctacggttacatcaataaggcttgctggcaagcgtttgtaactcgcatcctctacgagaagaaagagaacgcgaagaaatacaaatacttcctggaacatgtctatgacagcgatgatactgatatgaccacgatagccgatgaaactttcattcaggatatccatgacaaacttaatcagtatgaagagtccgcgaaaaaacccaaagataaaatcgaggttgtggacgaatcgccaacattggaaatgtttctatgaaaattaaaattgacctgaacaaaattttagcagatgctaacgacgaaattgatctgcttccttaccttgtgaaattagagttgcagaacgtcggggttccgattatcatcgaccctacagatgtacgagatccagacttccagatagcagaaggtcgcctggactatgtaataaacgccgaaacaatgatcatggagatcacttactatgaacgtgcagcatgaagtaatcgacgaagtacaccaaaaatcagcgctagatcttcgtgaagaagaactggactctatcaagggtacacgcattgaacaggaagccctacgcaaagcgcaaaagttcatgcggaagaacaaagcggaatggaagcgactgcataaacacgcagagaacgcactcttcgaaggtaacaaagagcaatatgtatacgcgatcaaaaagatgcgtgatatgctcaaacaaccatacaatgatgaactgattgaaacgatgtggatcacttcgaaccagcagttgaaagacctgttcatcatggcttctgaaaaatacggcaaataaaccccttcgggggttttgaggtttatatgaactatgttttaattggggatacccatgccggacttcgccaggataacccctggaacgaagaaaacctgtatgcggtattcaaacagatcgtagagtattgcaaagaacacgggatcacgcgcggctttcatgctggcgacttcttcgacgttagaaaagcaaccacacaaaccacgatgaatttcgttcgtgaaaaactggttcctctcctgattgaagcggggatcactctggatgttctggtcggcaaccacgattgccaatttaaggacaaaatccggcccaacgcgccacgcgagatactaagccagtacgaatgctttaatgtcatcgacgaaccgaccacggttgatttaggtggcggaaattcgattgacctgattccgtggatttgtcaggaaaacagccagcgtatttttgactacatcaaacaatcgaaagctaacttttgtttgggacacttcgaactgtctggttactatttctacaagaacagcaaagccgatcatgggctggaacctgatttcttgaagaagtacgatcgtgtttactctggacactatcaccacgctaacgagggtgacaacgtgttttatatcggtacgcctctgactatgagcgcgaacgacgaagacgaaacacgcggtttctatgtgtttacgggcaagcctgaattgactttcatcgctaaccctgtgtgccaccatcgccggatcatgtatccagcacagaaagatgttgatcttgaacagttccgcaactgcgcggtgcgtctgattgttagtgaaattgatcaggggcttgcaaagttccaaaccaaaatcgaagaaattgcctatgaaatcaacatcatagacaaagttaaaacagattcagatgtcgataccgactttgaaatcaaaaccgttcgtgggcttatcactgagtatatcgccaacatgcagatcaccgacgatgaaaaagaggaagtgaataagctgatcagcgaactctacgcggaggtgtcaagtgcatagccgttatgatgaatatttcggggcgaatccccgatattctcacctgttgcgtatgttgggaatgaaacacatcatttccacatccgacgaagcaggggaaaccagcgcagtttgtttgaccatcatgaagggtgcatggcattcatcacgaacatggtcaatattcatgcttgatacactggacgacgatactctatcatatagtattgattcatcagttgttcaaatgatcactgaattatgtgaacggattttaaatgaaactaaactttaagaaaatcacgtatcaaaacattttgtcggtcgggaacaccccgatcgaactgaattttgatacggcaaagaaaactctgatcacggggaaaaacggtggcggtaaatcgacactgatcgaggcgttaacctatgccctgttcggtaagtcattccgcgatctaaaagtcgggcagttggtgaacagcgtcaacaaaaagaaatgcctggttgaactggaaatcgaatacgggaaagactcgtacaaagttgtgcgcggacaaaagccgaaggtgttcgagatctggaagaacggcgagaagttgccggaagactccgcagcaggtgattatcaggcacagcttgaatctatgctgaacatcaaccttgtgggcttcaaacaggttatcgttctgggtacagcgggttacaccccattcatggaactgaaaaccccagaacgccggaaactggttgaagatttgctgtctctgtccgtcatcagtgaaatggataagctgaacaagtcatacattcgcggtgttaatcagcagttggatacactctcaatgcagggtaatcacatccagcagcagatcgcaacacatcagcgcttcattgacgaacagcgagcgaaagcgaaccagaacaacgcccgatacaaagagatctacgatagtcacgtagaaaccgcaaagaacatcaaagcacagcttatgcagttgcaagcggagattgcggaatcggtgatcactggagaagaccggacggaagatatcaacaaactccgtgacggttattcgcggctctcaatgactgtagagcagtttaaaaagctggaggtgatgtatcagaaaggcggtgagtgtccggcctgtaagcaagcgattaaacccactcctgagcgtatggcggagatcgcagagaacatcaaagcgggtacacagcgtttaaccctgatcaaaaccaaacaagacgagttacaagggatcatgaatgacttgcttcaacagcaacgcgcactcaatgccctgaaaaccaaatatgaagccctgaaaggtacactgcaaaacgaagttgccaacgctaaacgagcacaggcgatcatggaacaggcaagcgcggaagtagtcattgatgaagaacccgtgaagcagttgcaacagcaggaagcagaactgaacgaaaaacgacaaggctacgtcaaggaaaaatacattcgtggtattgttactgatatgttgaaagattccggcgttaaggccagcattgttaagcgctatattccgtacttcaacaaacagatagcatattatctggatctgttgggtgcggattatcagttcactttagatgacgagttcaacgaatcgatcaaatcactggggcgcgatgatttcagttatgcgtcattcagtcaaggcgaacgcgctcgcatcaacttgtctattctgttcacatggcgtgacgtgacaagtaaagtctccggcgtggatctgtctctgctggtacttgatgaatgtttcgacggcccccttgacaaagacggctcttttgctgtaaaaggattgcttgatggtgttaacgggaatttgattgtgataagtcatcaggatttagatccagaagattttgaccgacacatcgttatgtcgaaggtcggtcgattctcgaagatggaaatcaagaagtcttaaacttgcagttgtcaaaatgccatcgtttcatattggtggcatcaccaactttagcgcaatgggggcaagttaattgctcccttttcttttgtgtttttctgtctgggttctgagtacaatatggaatatgactgttcaagtaatgcactgtcgattctgtaccgcaatgaggacaagaaccgcgctccgatactacgttgctgtttttatgtgctcgcatgactcctgcaaatgcattcactttcccttcattgcctggcttgtgcttgcagttttcgaagtgccagcggttcatattacctactaagccggacgtattgcaatgaggacacgtaaccctgttctgttgaagtttggcctgtctcatgcgtaagcgtgtctcttcgctgaactctttttgtttctgggcttcaagtgctttctctttcaaccatccatagcgacggtttgctgtacgcgcagacgatcgagaagtgccaactgtaagcatgttagcagcataaattagtttatggttgcctggatacatcttgaccaatagcaggtgtgctatgaagtgttgacgtgctgacagttcaaccagattttcgggatcgtccgatcctcccatgcattttggaacgatgtgatgtttctctgtatactctgcatccgttccgatagtcatgagttgttcgtaaatcttatgataattcatgatgataaatcctgtttgatagtccgttagatacccctatttaggaacatgattatgatagaaagagagtttgaactgataacaagccccgaagtggagaggttttatctccataatgaactattggaagaaaaacatgtagttacaatggcagatgttgaggaagcattcaaagataaccccattgaattgacacgcatcaagaataataaatcttcggtgtggttcctcgaaaaaatctattgacagcaaaacataaataccttaaagttgcccgtgtactgagttacatgggcttttattttgaggaacggaaaatgattaacgaacaaatgtcacacagcgaagcattgaagattttgggcgctactggcgacgaatctaaagctgaactgtcaaagctctttaaacgtgcttctctgcgcaatcaccccgaccgtggtggtagcactgaactcatgcagaaaatcaaccaggcgtatgacgttgtaaccaaaacaaacagcgctggtaaaacttacagtgatgttcgcgcagaacacgcagcaaacaaaaaagcatgggaagaaaaatttgcagcgtatttcgtggttgcgaaaaactatttcagcacgaaattcaacgcgcaagagttcgcggaatacttcacgaaattcaccggacaaccaacaacctatactcagtcaatcagcgaagttcgcggtcatactgttcacgcgacatatcgtttcacctctggtgatgcgttctttgacttctctttctcttgtcaaccgccgaacggtcaaggtttagcagcgccggacgcgtccgcactgggtaacgtatcagttaatactctggttctggttggtacgaagaaacacaaaatggcaagccgtgattaccaatggggcaagaacccagacaaaatcacgccggaaagcctgttccctactaagaaactggaatccatctttagcccgactaagaaggatctcaagttcaaacgcgcggactacatgacatcctttgcccgtatcctgggtgcgaaggttagcggtaacgatgttattgttgatgttggacactataaagttcacttctaccgtcacgtattcatgcgtaaaggcgcgtatgtgttccagtatgttgttgacccaactgtgaacaaattcaaacctgctgaacgtctgaaaggtactatgctggaagatgaagacggtgcatgtctggatatgatcatcgacactttcaaagaaatgcagaaagtgaaaccagacgcaagcggcatcgcagcggtaatcgaccggatgaacgcagagtttgcagcggggcatcgttcagcatcttttgttaaacgtaccgcacagcaagcagcagcaccagcgccggaagagaaaccaaaacgcaccgttaaccgcatcaataaagatgactatttcaacgcactgaaacaggcgggggcaacattccgcagtaactacggtgagtttgataacggcgcgggtttgactttccacttcaaacgcgagatcagcaaccgtaaaggtttctggagtttcagcagctttgatttcatgcactccggtcagaaacatgttgaatggttgaaagatatcgacattgacgaggatagcaaaggcgcaagtatcggtttgctggttgataccctgaaacaacttcgtggtgttgctgactggtacacagcccgtaagatcctagaaggtatgcgtgataacttcaaggctggtaaattctccgcacctcatgtgaagaaagaagccgaacagaaacgcactgaaacgcaagctaaggacgagttaggcgcacagcctacgaaaccacaggcagcgaagaaagaagccccagcggttgataaggcgcatcaggcacagatggatcgtgagaagtcacagatgaatgcaaccattcgttctatgctctctgccctggttaaagccggacgcaaagacacgccggaagaaattaaaaaagcagttgatgaagcaatcgctctttggcgcttgaaatactaaatcactgtgttatactgggaactgttgaaaagcagttcctttttttatgaggaaaatactatgagttgtccaacatgggcgcactttgaaaacctgaaagaaggtacgcaaaaacgcgtgtttatcaatctgggatggttcgcacctacagattttgacattgctgaaattctggttaatgccagtaaagagatcagcgatacttacgaatgggactgtgtgagaatgccagttctaccagggcagtttattgatcgcgagaagttcgaagcaatgcggatcgccgtcgaaggtatcaattcgctgcatcccccaagtttgggtatgcattaccgccagcgttttaccttgaaaaccgcatggactaaagataaagaatgggtgaaagtatgattattcaggtatcggttcagggaaataccctgacagtaacaaattccattatgaccgctatggctgcgtgtcgtgatcatgtgatgtcaaaccctccggtaacggaaattctggaaattgatgtatgggaagacggtgtgatcgaagaatcctttggtttcactccgttagaggaagatttacgtaaaatggaacaatggctatggcaaactgtaccccaatgaaactaccaaagcacacaaccctgttaacccgcgaaaaacttcattctgttgagtggagtccgttagatgtgatggtgttcgatctggaatccaaaatcattaacgctcatgttaacggattgagtatcttttctgttgaatttgaaaagattcgcgggtacaatgaagcctgtaaagacaaattgcgcgtcatggttgaagctatgggctacatcgtgactattgaagacaacaaaatgtggatcgcgctatgagcaaagtaaaagcagttttcgccgttggtcatgatatgtacgaaatggactatgctttcggttatgaacagggtttaccgtggggacactgcaaagaggatttacagaacttcaaagcagaaaccgcagatagcgtcctgatcatgggtgcgaacacttttacttctctgcctggtaaattgcaagggcgaatccattgtgttctgtctggttctggtagtttcctcaaaaccaaaaaaggcgatattgctgattatgtcatccacggcggcgggttgtctgctgcaatcgacgtgatgaaagcaacgcatccagatcgtgatgtgtgtctcattggcggtaaggggttgcttctggaagcaatcaataatacactggttgacgaagtggttgtgacgcacatttacggacatcacactttcaatgcaccagcttttaaacgtgatgtttcgttcacggttcctgaattctgtgaagcggttctgaaatatgaactgactgatttcaaaattcagcagatcgaatcaaacgaacgcgtcagaaaaattatcgtcgatcgacatacgaaaaaggcataaaatgaaacaatatcttgatatcgtcaacaccgttctaacacacggtacggaatcaaccgatcgtactggtgttggtacactgcgcatcttcgggatgcaagcacgttggaacctcgcagaaggtttcccagcgactaccagcaaacagctattcttcaaaccgtgtaagcatgaattacaatggttcctgtccggttctaccaacgtggaaacactgcgtaaaatgacgtggggcgaagatagcgataagcggacgatctgggacgataactacgaaaatcaggctaaagcgctgggttatacgaatggttatctggggccgatctacgggcatcaatggcgctcgtttggtgaagaaggtttttacactggtgtcgatcagattgcaaaaatcatcgaacaactgaaaaccacaccagacgatcgcgggatcatcgtttctgcctggaaccctgttgatctggatgatatggctttgcgtccgtgtcactgtttcttccagttcgtcgtaatcaacggcaaactgtctctacagtggtatcagcgttcagttgatgtcttcttagggttgccgttcaatatcgcctcctacgctctcctgacgcatattatcgctgatatttgcgggtatgaagtgggcgatctggtttggactggcggtgatgtccatatctacaaaaacgcagtagaacaagcgaaagagttgttgaagccggaacgcgcaccgcttccacttccgacgctcgtaatgccgaaggtaaatagcttacttgatttggatcaagaattctttgactccatccatttgaaagactataatcaccacggctcgctaaaagcagctatggcagtataaacaaagggggcgaaagcccctttcttaacaaggtaagataatgagtgatattaaaacagtagtgaagtcttctggcgtaagtcaaacgttcgaaaaagaaaaactgttcaaagtccttaattgggcgagtattggaagaaatattgatgttaacgcattccttgaaagtgtcgttgacctgcttcgtgatggtatgactaccaaacagatccaggctgtagcgatcaagtatgcagcggatcgaatctccgcaaaagaacctgactggcagtatgtagcggctaacctcgaaatgttcgcccttcgtaaaaccgtttacggacagtttgacccgattccgttctacgaccacatcgctaatctggttctcgctgggaaatacgataaagaaatcctggcaaaatggactccagcggagattgattatctggaatcgaaaatcaatcacgataaagattttgaattttcgtatgctggcgttcagcagttgatcgggaaatatctgttgcaggatcgcacgtccggcgacatctacgaaacaccacagtatgcattcatgctgatcgcgatgtgtctgcatcaggacgaaaaacacgctgataaaatcagtcatgtggttgacttctataacgcgatttcggatcgtaaactgtcattgcctacgcctattatggcgggtgtgcgtactcctacgcgtcagttctccagttgtgttgtaatcgaatctggtgattctctgggttctctgaacgctgttacgtccgcgatcgtgaaatatatctctcaacgtgcgggtatcggtgtcaacgccggacacattcgcgctatgggttcaaaaatccgtggtggtgaagcagtccatacaggcgttatcccgttctggaaacacattcagacggcggttaaatcttgttcccagggcggtgttcgtggtggtgcagcaaccctgtattatccgatctggcatcttgaagttgaaaacctgctggttctgaaaaataaccgtggcgttgaagaaaaccgtattcgtcacctggattatggcgtacagcttaacgatttgatgtataagcgtttaatcaataacgattacatcactctgttcagccctgacgttgcgaacgaccgcctgtatgacgcgttctatcaagcggatcagagtgagttcgaagaactgtataccagtctggaaaaagacccaacggtacgcaagaaacgcatcaaagcggtagatctgttccagttgcttgttcaggaacgcgcacagaccggacgcaaatacattttcaacagtcatcacgtaaaccagcagggtagtttctctgttccggttcgtatgtcgaacctgtgttgtgaaatcgcgatcccaacttcaccactggacgacgatgataaactggctggcgaaattggactgtgtacgcttatggcgatcgttctcgataatgccgatataagcgaattcccagcccttacacgcatcgcagtacgcgcactggataacctgttggattaccagaactaccctgttgcagcggctctgaaagccaaacagcgtcgttctctgggtgtgggtatcaccaactatgcatcctggctggcaagcaactattgcgactactccgaagcatacgccggaaacgttcatgagttgatggaagcgtttcaatttaacctgctggttgcctcgatggaactcgcacaggaacgcggtgcatgtggactgttccatgaaacgaaatatgcacaagggctgttgcctattgactggtactgcaaaaacgttgatgaactggcatcacctgtgtataactgcgattgggaatggttacgcggtgaaatcaaaaaacatggcttgcgtaactcaacgctttctgctttaatgccttgtgaaagtagctcgcaggtaagtaactcaaccaacgggattgaacccccacgcggccctgtgagtgtgaaatcttcgaaagaaggttcattcaatcaggtagtaccaaaccagaataatcagattgacttctatgattatctctggacaatggcaaaacgtggaaacaaaggttatctgtcgcacgtagcggttatgcagaagtttgttgatcaggctatctctgcaaacaccaactatgatccggctaacttcccagatggtaaagtgaaatctgaaatcatccttgaagatctgctgtatgcaaactatttcggcatcaaaacgctgtactaccacaacacccgcgacggtgcaggtgaggaagaagcggaagattgcgaaggttgcaaaatttgattcaatgccccttcgggggctttttataaggtaaatccatgttaactgtaatgaacacaaacccagatcacaaacacttagaacagcctatgttctttggtgaggatacgggcgtagcacgatacgaagaacagaaacaccgtgtattcgaaaccctgactgaaaaacaactgtcattcttctggcgaccggaagaagtggatctgtcgatcgaccgtatgcagtacgcgaaaatgccggaacacgaaaaaatcattttcgattcgaacctgcaatatcaaaccctgttggataccattcaggggcgcggccctaacctggctttcctccctatcgcttccgatgtctcgatggaaacgtggatcgaaacatgggcgttcagtgaaacaatccatagccgcagttatacgcacattcagcgcaacctacacatcgacccgtcaaaagagttcgataaaattctgcgcaacgaagcgatcatgaaacgttcggcttccatgacaaaatactacgatgacctgatcgcagaatgtcacgaactgaaaaacattgtgctcaaaatcgaaatgttaacgtcccacggatacccagacgaatcgatcgcagagtacgaaaagaaacgcaaagagcaaatgcgtaaatgcaaggttgctctgtatctgtgtatgcacgctgtcaatgctctggaagcgatccgcttctacgtgtcgtttaccttcacgttcaactttgccgaacaaggcaagatggaaggtaacgcgaagatcatgcgtctgattgcccgtgatgaagcacttcaccagaaaggcactcaaagcaagatccgactctggcagatgggtaaagatgacccagaaatggcggaaatcgcttaccagtacgaagaagaagcgacaaagattttcctggaagtgtacgaacaggaaaaagaatgggctgaacacctgttctctatcggtgatgtagacggcgtatccctgaaaagtacgattgcctatatcgaacacctgacagatcagcgtatgcgcgcggttggcttgcagtctccatttaaaccaacgccgaacccgtatccgtggatgaacaaatggttgaagtctgacaacgtacaggtagccccacaggaagtagaagtgagttcttacctggttggcaacctcaacaccgagat

SEQ ID NO: 5 - DNA, 177937 bp, Unknown
  source: /note="Description of Unknown: colon-6 Bacteriophage Sequence"
tatatatagagaaaacagtacatttccgtatactttttaaccaacattcactcactacgttcgttcatgtactcgcttcgctcgtagatttgacttcttgatctaactggttataatgttactttgttttgaggtgatacatggctgaactaaaacttgaagatctacaggctgaacttgaagaggatatgcgtattgatccgttgaagttacaaagcgaatcagcagacattccgaagatttggtcaaaatggcttcgataccattcgaatgctaagaaaaaacttattcaactccaggcgaagaaagaagcgattgtaaaagatcggttactgttctacactggtagacacgaaagcgaaatgaccgatgtcatttacactggttcgggtgaaatcaaaattgctatctccggtgatcctaagaccgttgaagttaacaagctgatccaatacttcgaactgattgcagagtttaccggaaaagcgctggatatcgttaagaacaaaggctactccatcaaaaacatgttggagatccgtaaacttgagagtggtgcataaaatggcagaagaatttgattgcaaatgcgttgtgtgcaaacaaccgatgaactcccgtaatacggcgtttgtcaatgaagctggcccgatctgcggtgtcgtatgtttgcaatatctcaacgaaaggaatgatcgcggtatcaatgaagccgacgatctgaacgaagttcaaatgttgctgtaggtgtgaatatgaaagactattcaaaaatcgactttaacgaagtatttcgtttgctgggattgatggaagaatgtgtgaccagggttcatgcacttcgaatttcgtttgaaagcggttgtatcgaagacgaacgcccagatttatagcagtaaatagatgtgtaccccttgtggggcttgggcttaccgtgtggcgtacccatttgcgccgtccgatagaatttactttcggtggggtgattggtaagataccttcgagtaaaggccagttaattgtaattcagaatagtacagcactgaaataaaataaatgtacgtgtcggaacaaacggtttccgaaattaaaaagccccttcctttcggttggggctttctttttaaaacttctcttcttctccggtttcaagttcggctttcagttcttctcgccgtcccttgatcgcgtcacgcattgaaatgtcatcggatgctgcaacctcgacttctttcacgcgggtgttgtaatacttttcaagttctttcaaaccttctagtgtccggcacgaagcaaccttattcatgaaatcatcaatcgctgcttcgtttacgaatgtagtaaaacttttcattttggcctcttaaatttctacctgtttgatcgcgtagtcgaatcgttcttcattgtagatccgcacacgttccatagcatgtttcataccgtagtttgtcgcactgtatttatttttggctgtcttagactttgacagcgtagccaggttatcaacgatatcccatacagtagcgagcgctttcgatccgtgcttacgaagtacacgaccgatagactgtttcaccacaacagcagatttgcaagggtgcgcaaaaatgatgtggtgtaggttcttgattgagatacccgtactcagtaccccgatcgaaccgatgacgattaaacctttcgtcgattccgcgattttcttcatttcgttacgatcgtcaatgtctgtatcaccattgaccaacaccacgttatcgtaaaccttgctcaactgctcgtacagccattttccgtgctctttgtaccggaacatcacaaaggcgttttcgttcttctcacgggctaatttgagcgctaattttagaatccacgcgttgcgccgtgtgtggctggttacgtacttgatttccgtctggtagtccgcacccttcaattttttgacctcttcttctttgtatcgaaggaagatcgtgttaattttcaggttggtgacttgtccatcatccatcaaacgacgcgtatcaactggtttaaagactttgccgaacgcaccgatgtattgcatcatgttcgttttcccttctttcagggaaccggataaacccagtttgaagatacattgatccatcgtgtcgataatctttttgatgctcatgcctgttgagaggtggcattcatcaaccatcaaacacatgaactgttggaaccattcggcaggcattttaaccgctgattgccaggtagaaacgtaaatcagtgcattactgtttttcgctgtaccggaacggatacccagcattgccgatttcgggaacaaacgatagtttgcaatgtcctcgatcatttggtcaacaagtgcggtagtcggaacgatgatcaacaccttcccgctgtaatgttccagacaccaacgagagataagcccctgaatcagagatttacctgctgatgttggcaggttcagaacaccgcgacggttcttgataccgtggaacacggattcgcgttgataccagtacggatcgatctgtttgtcgccgtcataaaccggatgttcgctaacccacttgttaaaatcttcttgcgtgatatcctcggtttcgtggatctttggatcaacccagattgaatacccgcgtgattctgcgaatttggataccagataggctaacccatacgggagtttcccgttgtagtccatcaagtaaatgtaaccgttccatccaccatatttgtatttggcctgatactgatagcctgggggctggaagctgaaatagtcacgcagttcatagacaatgtttggttctgcctgaatctgtacgtggcttgtgtttaaaaatttgacttcaatatccactatgattaccctatgtacaaagtatatacgtatttatgtcataaatattggataaacacttggagataccaatgaacattgattacgaaaaagttgatgggttccgtaccctcgacgcaaaagaacagaaaggcgctttagccgattacgctatgactgtgtttgcggttaagctgaacaaacaaaaatccttcgataacatgctggcggatctggttgctgctttaccggaagatgaagaaaagccggaactgctgatcgattcaccagaaccggaaatcgtcgcatataaaggtgaggtgactatgggtgaacctgtcatcgaagccccgaacgttcccgatgtggttattgatgcttctgcggattttatggagtacgttaaagaggtcgcgccggaagtagccgatcaaatccaattagtacctgatgtcgtagaagctcctgtaagcgcttctgacgagtccaaaggcgaactggtatggttggaagggtttagcccgacaatcttcatgatggggcgctctgcgagttctaacgggtattatacctgtccgtggtggatctatgactggattaaacaaaccccagactggtacaaagatcctgatagctgtccacatgcaagcgcaatcgacacaatcaaatcacttgcgttctatatcgtgcgcgatggcgaagttcgtgttcgcgaaaccagaaatagccgattcgaaacatttaagttttagcactttttgctaaaaaacttgttgacgcataccctcgtttaaagtatatttgtactcgaaggcgggggaatggctctcgcagtgaagaaggaaagcaaaatgaaaaacgaaatgatgaaaaatgcttactacccagttctgtttgtttgggctgatggtaaagtgaagaaagtagtcaattcaaatgctccttactatactgttgaagaagcactgcgtcacgcttacgaagctgattatcctgtccctgctgaacctggttatgctcgttggaacggttcaaaatgggttgctgatacctgggacaactacgaagaagcaaaaatggaatgcgatcctgattatgtttctcgccaaatggaagcgcacatgattgcagaccgtcgcctggataacgaagctcgcggtttctattaaaattcaaaggggggcgtagccccctttttgtaggtaaaatatgactgaattaaatcacgaatgcctgaaagacttatcagaaggtaaagagatcggaaacgtcatcttccttgatatcgacggcgttctaaataatatgcggtgcatgaaatttggtgagcatatggacattgaatgtgctcgacacctgcgccggatcgtaaatcatgcgaactgtgatattgtcatttcctctacatggaggatcggcaacacaacccatactctacgggaaatcttctatccgtggggattgtatcgcatcattgggaaaacctgtacgaatctaacagaccgacaagcaggacgcggtgatgaaatcaaagcatggatcgacaccttcggatgtaagaattaccttatccttgatgacgataccgatatgctgccggaacagagtgaacatttcatcaataccgatgggttcgtagggctgacagaagaacaatccacttacgcgatccgtaatgtgttcggtgtaacaaacccgttctgtcctgaatgcaacggctatgggcgcgtgaaccaatatgataaatgtccgtcttgtgacggcaaaattttacttctctaaatagagaaaaactaagaggttttgaaaatggctacagaaaaatggactacggtacacccgatcccgtggcgtaacaccagctttacctatctgccgtggtggatctttgatatcatcgtggctgcgaatgctgcaagcgaagactggcgtgattatgccgaagaaaaatacgcgaaagaattcgacacactgaaacaggcgtatattgattacaccgatgttgatttcatcgaatcccgtaacggttatctgtataagctgagtgattttactcctgctgatcctgtcgtaacaattacaccaaaaaccgctcctgctgatttcaaagtaggtgatgcggatctggctgcaactgatctgtttaccatcgatccttctggtacagaaatgactctgagtgttgactcttccggtcatggttctatcgttggtggtaaacttcatgcggttagtgaaggtgatgttgtcgtaacagcaacctctggatctgttactgcaactctgacggtaaacgttaaacctgcaccataataacaactaagaaggtaaaaatgctactatttgaattcaatgatgtattcgcaaaattcagcgacgcaatcgaagccaaatttggcaaacgcccacaaaacatgacagatgcagaatatgaagctgctgtatcgtccctggttcgtacagatttctatgaaaaactggcgatcgaggtgttgggttgggatatgatgaaatggggcatgacctatcgcgatcgcgaagtcggttttattctcgtcaacgaagcaaaaagcccgtcctgggtgaatagtcaaaaaatcgcgtacatggataaagtatgcgcacagatgggtattgtacgtttagacttctggacttgtcgggatctgaacgaactgaaagcccacgcttaccgttgccctctgatctcccgcaatgataagcatcgtcaagcatgggatagcgcagggaaatatcgtagtgttttcctgaacgacgatatgaacatcactattcaggatgttaaccgctcctttgcggattacacaccataaacaaaaaagggaaccgcaatggttccctttcttttatgcaatttttctgatttctttcaatgcttcttctttgctaccaacgaagagaatcgctttacctccggcttttctgaatggcaacacagcttttgccctgtcatcaatcagtatacctttgtccgcatatgctgctttctctccgctgcttttggtgtagtggaattcaggcagataaccgaacaccttcatcaacgcttttcttttttgttctgctaccgcatcggaattgtatttccctacgctggttaagatcgcaacctgacctaaagttctcaaatgacagaacaggtcgatgccctcttgtaatggttccagattttcgtagaagtcagtttgtgatatagcctgtttcgcttttttcaattcttcttccggcattctcgccgggtcaccgtacatcggaacaaaagaaccttcccagttgaacagtacaccatccatatcgaacaaaaactttttcatatcaattcctcggtttgtgtgtgcatcatattcatatatgttcctattgtcaaccccatgtatcagttttcggtgcgtatgctgcaactttcgccactaactctttatcaagctgatcaatggatttctgcggctttccttttgccttaactttgatgtagttagacttaacgacaaacataccgcctttgtcagatttcttgatttcgctgtcaatgcctactttgttgaagctgatccagatatcgccgtccatgtactgtttcagagagtcgcccatattcaggatcttcgccatagtgagcgctgccccttcgtgggtatccatgaggatttctttaggcactacacgatcgcgtttaaggttctgctgcatagcaatatgaacatcgttcataacccaaacgatatggatattttctttctgataacccagcgtttcaacatcacgggcgatacttgccagcttgctcatgctttttagggttacgtcaaagatcagatttggtttacggtcttccggtgctgctgcgatacccgcgtacacacgcgcctggtttttgttggatacgttgaacacgtccgcgatcacatgatgcagtgttgctacgttgtctgggtttttcaggttcatggttttgacatcgtgaccagttttcgctttgatctctgctgccagtttggtactacccatgaccaattttttgagtgcgtcaacgtccagtgtgataccttcgatgcctaacagcttttcgagggtgaaccctttaccagaacccgcaccgccagccaggatgactacctgaccaaatttaggataagccttaccgccgaaggtgatcagcgcttcatcaaggctcgtaaagtctttgaatgatttcatcttagaactccaggtgtttatttaaaagtatttattgacacggtttatgagtgcgtttatagtgcaattgttcgacggataagccggaagaactttaaccataaggtaacaattatgaaaaatgaactgcatgaattcatcaacgccgctgttcttggcgaccagtcaaaatataaagcccgtcgcgataccctgattgacgatttctgtaatttcctggggttcaagcgctggcataccccgtctatgcgtccagattgtgatccaaaatgggattacttcaaatggagtgatcgcgatcgtggttacgtcgataacgtccgcgtaatgtctttcaaccacttatacgcaaattcaacaattgctgttgctaaacgcaacgattcgacttatccgaacgggtggagtgttgctaaagtcatagaaacacttcttcaactgcgtcgcgaatataaatcagcataccgtgtcaatcccaatcctatctataatgaatggcaaatcgtcgcgaaatacctgctgaacatcacctattctattttctgtcgcttcgggacaaaagagattggatttggctctcatgatataattgcagaagcacgtcaccgcatgatccatgcaatcctgaaaattcaaaactctggtgggcttgttcttgctgcgttctgtgatgaaattgtttactacggagaacaggtcgaagttgatgatgttcaccacgaaaaattcaaaagatttgtattcgggcaatataacagctattcatatggaaacgatattcgtgtgatgaggcacccgcgcattatgttggatatggaagggtgggaaccaggtcacggaattggtgatgccgaaagccaacgtgaacgccgtgttcgttcagttgctaaaactcgcgaattgatgacaggtagccttactgattacctgttcagaacaaaagaagacgttgaaaaagaatttgttgacttgtcgggcgaatagcgataagctgtaatctctgaaaacaaggagataaccatgaataccattcactgccgcaaagagttcgttgagttctatcacggatcatgtactgctgccggaatcgaaagcatgttgttgcctccttgtgattctgatattctgtctgaaaaaggcagaaagaaaaatctggatcgtgttttcttcactgctgatatcgggctggctcgtatctatgctggaagggctgcacgttcaataggtggtgatccggtactttatcgggttgtgtgtccggtagatgtggtatgcatgaacgatgacaaaggcgcaagcgtttatcatgctgcatgggctttctgtgaggaattatgaaagataaggtgttagcgtatctcgttttcttgctgggatatcgcgttgaagtgatgggtggttattcttctttgtatggggatttaaccgcgatctggatggttgcgttgggggttatgtttacctttatggcgatctgtattgcgaatgaggctgatcaaaatgcttgaattttatcctgctggttgcaagtcaaatccgcctgatgcatcgttccaatcgtggatttattttcacagggaactaaacgacatcatcgaaagtcagtggaaagaccatcctgaacgaagtgcccccgatttagtcgatagcgtaacagatgtacgcaccctggaaaaagggctgtatgattgtctggttcagggaatggtgtgtaaattgattttgtggtatgctccgatcggttcagatctaactcgcaaaatcgcccgtggctatatcatgacgaaacgtgagtttgaccagatctggaacgaacccgactgtttcgaacgcgaaaaatacgaaaatgaggttagttgtatatgaaactatttcatgttgtatatggtggaatgaaaaacatcgacatcgccgcgttatctgctgggatgctggacgaactcgaagcacagatcgggaaacgattcaaagccagtatcaccgaaacgcaaactttgtttgtcgatcaccctgcggatatggaaaaccttgtcaacactctggatgatctgatgatcccgtgtgctgatggttggaacgaagcatccggtgttcatgtagttgtaacttttgttcttaaaaatgttgacagcagaaatgccgaagtgttagagtttattcgtaaaattgattctactaaaggaaagtaactatgaaaatcgttcagcgtaatatcagcgaagttagccagcaggaaaaagtacagattcatttcaaattcaatgatctgaaactgggctatgcacagatcgcccgtgagcacatgctcgataacggcgacatttacgtgattgttcaggaaattgagcgaattcgtgctttccgcgcagaaaatccaaaagtgaaacatgttctgcgtcgtgtgtacatcaataaacatcgtgaagaacagcgcaagcctaaactcaaagctaaacgcgatccgcgtccagataacaaacgtaaagcaatcaacggcgctatggcgctggcgttccaggaagcgggtttggtgtaaggggtttatatgtcttcaatgatgaatcgctggtcgggcgtgataacttcgactatcaaaaaggatttggtgaaggttgaagcaaaaccaaagccagtagaaccggaaaaagttcaaactttggtatcactcgatcctgctgagttagaacaccgccgccgtgcaaaccagattgaattcgatctgcgtgtcgctcgttcatacaacagtaaaaacgatgatgcgcgtaaccgcaaccttcaatttgctctgacgttaagcgactgggcgaagctaatgagtgaaccagtatgttcttactccggcagaccatttagcaacaaaggcggttgctctgactcccgaacaatggaacgaatcaacgcttctctgggatacacggttgaaaacacgatcgcagtaaccagcgccgcgaatagcgagaaatcaaatctcgatgcgtttatgaagggttctgtgatccttccagaagtaaaactgaaactgttacgcaaagctgcgtatcaaattgaaaaacaactgaaaatcaaaggttaaattatgtttgtgaaatattcttctctgactaaccattatgaaggtaaattcatcaatggtgtgatcatgaatggttttactggttgtgtgtgggttgcgcgtgaaaagatccacggggctaattttagcctgatcacttcggacggtatcaaagtcattccggcaaaacgtagcggtgaaattctccctgctgaacagttctacggttgtgaaccagtagttgcaaaatactccgaacctgttcgtaagctgtgggaaattttagcaaatgcctgtgaatataaggaatatgctgatactggttctttggttgttcaggtatacggcgaatttgcggggcgtggtgtccagaaagatgttgactacggcgaaaaagatttctacgtattcgatatccgcgttaatggtgaattcctccctgataacgttgtagccacgtattccgttgctgtaggtctgaaaatggctccactgctggcatacggttcttttgacgagatccgcgcacttcctatcacctttgattcggtggttaacctggcgaactccggtgcgatccctgcaaagaacggcgttgaacctgagttcaaaaacttcatgacgctgaaagatggtgaaggtgagaacatcgcagaaggtttcgtgatgaagcctgttcaacctgctttcatgccgaacggtgaacgcgttgcaatcaaatgcaaaacgacgaagttcacagagaagaagaacaagcaagcgaaccgcttcaatgctccttctgaactgtcagaaacagacaaagcgaagctgaacgaattcacttgcttcctgactgaaaaccgcgtgaaaaacgtcctgtccaaaattgacagcgcgaatctcaccgcgaaagatttcggtcgcgtgatggggctgactgtacaggatgcgctggaagaaatcgaacgtaactacgggcctttcctggaacagttcgaaaacccaacgctggcgaagaaaaccttcactaacgaagcgtcaaatctggttcgtgagaactggggcgcaatcctgaacaatgaattttaaaactgttctcgaaaacgcaaaaacggctacactgatcggtagccgtgaaccccctgaacgtatcgcgagtatagccataaagattggacgtgctttaagtgatcgggggatcttcgcttactctggtggtgctcctggaatggatagccatttcatgtttgactactcaccagaaagacggcgtataatcctccctgagaacggttttaacgggttgtattcgaatggcaaggatatcatcgactatacagaatacgacacgtacaaagccgctgacgaagcgagaaaggtagctggacacttcgacaaccaaaacgaatgggtacagcgccgatatgctcgcaattcaatgcaggtattaaccgaaaacctggacaaacctacagattttgttctattctgggcggtagagaaagatttttgtgttaaaggtggtactgcgatcgctgcaaggcttgccagattgtataaggttccaacgttcaatctttggaatcaaaacgttctggatgaagtctgcgatactttagggattaacactaaacctcctactctggattttctctggtgataactcccgaacaatcacgtaattacgaacgcctctcagttgaagaggcattaaaaaaggcgaaacataatggtagaaatcaatggaatcggtgtgaacgcacaggcgggaagcgggacacagtgggtcaaacgcgaaacgcaagatgatccccgctgtggacgtagcccgacactggcggaacgtgcgcgtaaacttgttgacgaaatcaacgcgaaaatggtcgaagcatcccgcaaagacatttccgagtatgtcctgaaatatccgactaaacaatcatatacctttgatatgaaacgttttatcggtaaggttatggatcaggaatgtaccgaaaaagcatatgcggatctgggtgaatggctggcggaagaagggtttactttcgatacacagcgcaaccgacaagctgcgttactcaataccttcgcgggttcgcgtcgtattaccaactttagcgatcctaagcgtgacggatatagcgatctgacttattacatcacctggtgaaaataattcgaaaaacttgttgacgggagttatgagtgtggtaatatagctcccgtagacaagacactaacctaaaaggaaaacatcatggaaatcaaattagtacctacttgcgctggctactgcttggcactgaatggtgtagcacacaacggtaaaggcttacgggctaacgttgaagcaatgctgaacgaactgggtgcggtttatgaatatgatgacgttgcaaccagcgttaaaatcataagccttgaaaaagatggtgttaactgtgcgggttggtgggattgctacatcgactatagcgacaaccgggtcttcttactgaccagcaactaaggatcgactatgtttggaatgaatgagtgttcagaagcggacgcgctagaagactgggctgactttgatgaccttgatctcgatgatgaagatggagaattcttctgtgttgggcgcggggttgaaagaacgaagcgtgaacttcgaagccgtttagcaatggggcttactgttggatctggaaagaaacagcaagttaaatattccgatggttctattcgaactgaaacggttgtcaaagaagtaaacgggcgtgtcattacgtccgagcggcagaaggacatcaaacaattgtacgatgttgcaaaagccgctaaagtaggaaccatgatcacttgtcctacgtgcaaacagttgcacaagaagacgacatatcataaggtgttctgctctaatggtaaaaaatccaggaaagactgtaagagtaaatactggaacacgatccatccagaacgtttggatcgtatcttttaaatcaaaacgtggagtacgtttaaatgaaaacttttaatgaactgaatagcctgatcacctcaactgattcctacaaagtgtcccactggttgcagtatccacaaggcactgatgcagcgatgttctatattgaatctcgcggtggtaagtttgatgaagtagtaaccgctggcgttaacttcgttgcgcgggttcttgctgaaccaattaccatgaaacaagttgagttggcacgggtactttaccgtaagcactttgggaaagagattttcaactacgaagggtggaagaagatcgcagaactgggttatgtccctgttactttccgtgcgatcccagaaggtacggttgttccggttaaaaatgccgttgcgactgtgtacgccgaacgtgaattctcatggttggctgggtggctggagacaatgacgattcgcggtatctggtatccgtcatctgtagcaacgctatcgcgtgagtgtaaaaaggttctggctcattaccttgatatgacttctgacctgactggcgaagcatataacatcacactgggtacacgtctgcatgatttcggggcgcgtggcgcgacctctgctgaatctgcgggtattggtgggctggcacacctctataacttcatcgggactgataccgttgaaggtatgattatggcaatcagtctgtttgcggactatcaaactctgtttgatgaagttgaaaacgtcgaagcaatcggtgtttcaattccggctcgcgaacattcgactacgatttcctacggtaaagagaacgaagacgaagcatataaaaacagcatcgaaatgttcggggatagtttctacgcttgtgtgtacgattcctgggactacaaaggcgctgtagatcgcattgctgaatataaagagcaaatcattgctgcgggtggtactctggttgttcgtcctgattccggtgatatgattgataacatcatgtacaccctgcgtaaactgggcgaaatcttcggatacaccgtaaacagcaaaggttacaaagttctgcataattcagttcgaatcatccagggcgacgagatccacgggcctgaaacaatcaaccgtgtgttaagttggatggaagcgaacaagtgggcgagtgagaacatcgcgttcggtatgggcggcggtttgctgcaagaagttacccgcgacactcaaaagtatgctgaaaaactgtgcgctatccgcgtgaatggtgtgtggaaaggcgtttacaaatgcccgaaaggttccgaatggaaacagagtaagaaaggtttgctgatgaccatcactaacggtgtggaattcaaaacaatcgacactctggaaactgagattcctgacgggtggcgtgatgcgatgattacgtattacgagaacggtgtattaaacacctccgatacagtaggggttatccgtgagcgagcaaggatttaatatccgcgccaacgataacggatcagtagtcttctacaacaatcagccccttgtcgctcgcaaggggcttttttgtaagttggtgggctacgggttcaagttggaacaggtggacaacgcgacactaaaagaggttgttcggattgcttatctgttgaaagataaaaaagatgaacaccgtgctattgcaatgcttgagaaattaggcgaaaattattgcttcgtggtgaatcgtgggtataagtacgaaacgatcgccttatttgagaaaggactgagtgaactatgagttatttgggtgttattccgtatacaggtaacaagcaatcgctattacctgaactattcaagctgttccccgaaagaagttcatacatgcgtttcattgattgtttttgtggtggccttagtgtgtcgttaaacgtccctaaaccagttctaagcaacgattacgataagacgctgattgatatgtatgaacgtcttaaaacgcttcctgacctgtctccggtgagagaattgattgcatcgaaggggctggggaaagacaagaaagaagagtatctgaaattccgtgatgaatacaaccagaataaagatcctttatggctctatgtcctgatcctgcattcattcagcaacgttaaccggacaaacgacaaaggcgattttaacgctgctgtaggaaaacgaaccctcaactttatgacagaaaaacgtttcgaacatttcaaaaagaatgtgacaggaattgaatttcgttctggttcatactctgatattgaaatcaacgataacgattttgtttattgcgatcctccgtatctgatcactgatgcggtgtataacaaattctggaacgcagatcacgaacgcgagttatatgctttccttgactccctgcatgaacggggtatttggtttggtttgtccaacgtgactcaccatgccggaaaacaaaatgatatcctgattgaatggatgcagaaataccgcgttcataatctggataaaaagtatctgttaggccagcataccgactcttacgagcaaaacaaaacgcaagaagtctacgtgtgcaactaccagaaacgcgacgtaaatacattccctttaacactgaacgatttaatgtaggttaacatgtttaaaatttatggctatatcccttctgtgtataactgcgccccttgcctgaactcaaagcgcttgctggacgcgaaaaaacatccgtatgagttcgtgtctgttgctgattccgtggaagacggtaaacctgtactgaacgaagcggtgattgatgaactcgaatctctggttggtacgcgccggatgaccatgcctcagattttccatgacgggaaacacgtaggcggattcgaccaacttcgtgagtacgtccgcaccctgtaataaataatgacaccttactgaatggtgttattatgctgacgaaacgaattaccaaaaaagactacccaactatcaagcaagccctctttgaaaaacaaggtgggcattgtgctatatgtaaacgtcctcttgagggagagatcgagaaacatcaccttgaccatgaccatgctttagacggcgaaaacgccggacgtgtgcgcggcctcctgtgtaacctgtgtaacggtacagaaggtattgtgaagcacaaattcaacagatccggtcttgtgtcccgtgatgtcgattacatccagtggttagagaacttgcttgcatatctgaaacaagactattccgaaaaccgtattcatgacaaattcataccagataaggtaaaatggttttcaagacttaccaaacctgatatgattgccgaaatggtttctatgggcttcgagtacgccgacaaagacgaacgcaaagccttaaccgcgaaatatagaaagcaattaatgaaggcaacgaaatgaatgaaaaatatacggaacttgatgaacttctcaagtgtgtaagtgtagacatttttagcggtgttgttacgtggattaagccaacaaaccgaaaaatttgtataggtcaatctgctggtgttgttgataaaaacgggtatactgttattgggttcaaagggaagaaattcttccgacaccgcgttatatggtatgcgattcatggtacactaccagaaaaaccttatgttattgatcatgttcacggagttgaacgtggtgatgggctttcgaacctacaaaagattacacaacaacaaaacatcatgaagaaaaaggttcagagaaataataaatctggacataaaggcgtacattggtgcaacacatacaacaaatgggttgcgaaaataaagttcaatggaaaatcaatttatatcggagagtatgacgatttggatgatgctatcaacgcaagaattcgcaaatctcaagaactctttggtgagtttggagaaatataatgcttgtagaaaaacgcgacggcaaaaccgtcgatttcgatcaagaaaaaattcgcaatgctgtgtataaagctggcgggactatgacggatgctgatgccgcaatcatgctggttcagtacaatcagatccgtgattttagttcaatgaagatcgcccgtatccaggaactcgttgaagaatccctgatgaaaacgaacccagcggtcgcccgtgcatacatcgaatatcgccacgatcgcgatattgcccgtgaacagaaaagtaagctgttcaaagatatctccggcatggtgaatctgtccaacaaagagatcaccaacgagaacgcaaacaaagacgcacgggtattcccgacacagcgtgatttgctggcgggtattgtagcgaagcatttcgcccgtaatcatatccttccgaaacatatcgtagaagcgcatgactccggcgacatccattatcacgatctggactatagcccgttcaccccttacactaactgctgtctggttgacctgaaaggtatgcttgagaacggtttcaagatgggtaacgcggacattgaaccgcctaaatcgatcggtgttgctaccgctctcatggcgcagatcaccgcacagattgcctctcaccagtacggcgggacaacctttgcgaacgttgataaagtgctggctccatacgtagaaatgacattcttcaaacatctgcgcgatgctgaacattacggtatcgaacactataatgattatgtgtatgcgattgaaaagactgaaaaagatgtgtatgatgcgttccagtcctatgagtatgaagtaaacaccctgcatactgccaacggacaaaccccgtttgttaccatcactttcggtactggtacgagcgattatgagcgcatgattcagaaagcaattctgaaaaatcgtattcgtggactgggtaaagagggtatcactccggtattccctaaactggttatgttcatggaaaaaggaatcaaccttgatccagaggatcaaaactatgacatcaaacaacttgccctggaatgtgcttctaaacgcatgtacccagatatcattagttcagctaacaaccgtgttattactggttctagcgttcctgtatctcctatgggttgtcgcagtttccttagcgtgtggcatgatgataacggtaatgaaattcttgatggacgtaataacctgggtgtggtgacaatcaacctcccacgcatcgccattgaagcggaagcgcaggaagaagaagacgcacacgacgcattctggcgcatccttgatgaacgtctggaactgtgttttgaagccctgatgactcgtatcgaaagcctacgcggtgttaaagccagtgttgcgccgatcctatacacagaaggtgcttttggtgtccgactgaaaccggatgatgaaattctggaactgttcaaaaatgggcgtagctctatcagtctgggttatatcgggctgcatgaaacgctgttgatgtttggctccggtctgcatccatttgatcgcatcggctcccagaaattaggcagattgatcattgaatatctccgcgctgcaaccgaagcatggaagaagaaaacagggtttggattcagtctgtattcaaccccagcggaatcgctttgccatcgcttctgtaagctggactttgagaagtttggaagcgtcaaggggatcacggataaaggctggtacacaaacagtttccacctggacgttgatcgcaaggtaacaccgttcgagaaaatcgactatgaagccgattatcattacatcgctactgctggtcatatcagttacgttgaattccctgatatgaaaaacaacctgcaagccctggaaaaagtctgggattatgcgatggataaactggattacttcggaactaaccttccggtcgataagtgctttgtatgtggctctgatgacgagttcacgcctacagaagaaggtttccactgtaagcactgcggtaatcacgatccggctaaaatgaatgtaactcgtcgtacttgcggatatctgggcgctgctgaacgtccgatgaacaaaggtaaacaaaacgaaatcattcaccgtgtgaaacataactaagaacacctagtattagcgccttcaataaataaagaaaaattgagggcgctaatatgttttacacaatctacaaaataaccaacactatcaatgggcgtgaatatatcggcgctcataaaactgataatctcgatgatcgatacatgggttctggaaagaacatcaaacatgctattgatttctatggcattgaatctttcgtaaaggaaatattgtatgtttttgatacggaagaggaaatgtatctaaaagaagctgaactcgtaacagacgagtatatttcgcttcctcacacatacaacatcaaacccggtggtaaaggcggaacggcctacgaacaaagcgaagaacatcgacgcaaaaacagtaatgcgctaaaaggaagagaaatcactccattacatcgcgatcggatctcccgtgcattgaaaaatcatgtccgtagtgaagaacatcaacggaaactgagtgaagcatcaaagattgctgttagtacacccgaacataaagaaaagatgtctgctcattttacagaactgtataaatctcgtcctgaattgaaacagcaaatatcatcttctgtcaaagcacattatgctaatgaaacagaagaagagaaaaatcaacgtcgattgcgtcatacagggaaggttcggtcggaagaaaccaaacaaaaactatccattgctcataaaggaaaacatacaggagagaaaaatcctatgttcggcaaacctgcatcgaatcgccgtatggtttctggtgatggtgttgtgtatggttccgtcaaagaagctgcggaaacactggggttgtcgcaaggaacaatcgttgctcgatgcaaatcacagaaaaatgtaaattggttctatgtaggtgttgacttgccgaatcaaatcgattagtattttctacatcgaagcaaatcaatttgaaatcaaataaggtaaaattatgttcaagaaaatcgtagcattcgtgactggtaaagttgaaactgcaattgaacaaaacacttccccagaagaagcctggcgcagtgctgcacgtatcctgatcaaagagatcgaccgtctgcaacatactcgcgtttctgctgttcaggaaatcgtgaagttgaaaaagaaagtcaaagaacacaaagaccttcacactggcaaagagtcggagatcaaaaaactgctggcggcggggcaggaagtgtccaacagtcattacgtgctggcgctgcaacaccgtaacatctggcagggcttacagacgaagatcgaagaactggaagggatgaacaaagagattgatctctctgtcgtcgaactggatcgcaaactggctgatgtcaaaatcaacctggagatcatcgaactgaacaagcaaaccgaaagtctgggtctgactgtaccggaagacgtgatcgccgctgtaggccacacctccgtaagcgtcgataccatcgtgacgaagattgatgtgttgctgggtggcaaaaatgccgcttccgtaacctccgctgacgttagcgcttacatcgactccctgaacgcgaaataagaggaaggggcgaaagccccttttttgctatgtacgattacactattgaacgtgatcgcggtgaagaatggttgatttctcgtgcgagaaacttctatgttaaacttcctaaaaactttcatactttaccgaatgatgatactgatcgcttattgagaattctcgtagatgggaatgttccacagcgagtttttcaggaaatggttgatcatgcgtgttctgaatgggataaaaagtattgcgaagaactgacgcatgatagtatagtaaacagcaaccttaaagacgcttacgaacgaagaagtgtatatgacatttacgaaaaagagaggaaagaaatgatgttcgaagacggcaacagtgcatttaaaccagcacgtaaaacgtatccagactggcgcaaacagtacgcagaacagttatggcacattgacattcccgaagcgctcatgaaagcgattagccctgcggttgactactattcaggctggaaagatgaatatgagttagaagtcggttcgtttaaggcgcacgtcatcaaagcgaccagaattcttgatttcgttgaagctgttgcgtcgtgtgatatcgttgaagatattcgtattccgtcaatcaacgtttcgcggtatagttctcctggtaacattcgcggggatcgttatgcgaacctggcaagcactacggataagctgaactttcacaaaatcaatgaaaaaggatttgatggttgtgttctgatctcaatggtggttgtcacgacgcaaggcgaatacaagctgatcattgattgtgacaaagcggctcgtgcaattcccacaatcaaacaatgctttggtgaagatttcaaagtattgatgaaagcccgtgcgatggaaaagttcatccattcgtgcaaaaagaacgtgctggagaagtatgatccggcgctcacatacaccaaaattgataaagatctggtaggtgatttatgctgattaacaaagcgcagtgcaaagcgattaactttctgctgcacgaactgattgaaaacggtatcagatttgaattcgttgatccgattaacggtgatgatcgtcatctgctccgctgggtgtctggtagcaatccgctggattcagtctcccaggttgtagagtctgcgcataacaatatgccttgtcgtgttctgttgggtagcgttaacgcctcaacatggaatggatctgatgcttattatgtcggattcaaaaaagagttgacggaagacgaatgatgttataatatgcccctgtagacaacaaactataggggctaaatcatgaaaatcaaaaatactgctactgaaaatctttgtaacgaaatcgcggtgacttactggaaagaaggtcacgtaaaagcaatgaaggattttcaacagtggtgtgatacccagaagttagccaactgggaatacgccgtaatcgtggaacggatcaaagaactgatccttgagaagaaaggcactataaaatgattcaactgaaattagacacacaggcgctgaacaacctgttcccagaaggaacacaagcgcgaatggatctgcaagccgctgtcatcaagaacgttgttgacagcgttatcggtaagcgcgtaaccgaagaaatcgaaaacatggtgatcaagcacgtcaatttgatgatgccagccaatcacgaaatcgaaaagattgtgcataaagagtttgctgattacattcagaaacgttacgcatacagcaatgttttcgatatcaattcaggcggtatccgccagatcaaagaactgatcacgacaaacgttaaaaaacagtgcgccgacctgctggattcaatcaagctggaagcaatcaacgatgcaaccaaaaacctcaaagcggacgaagaagcgtttatggctcgtgtaaccaaaaacctcgaagtaacggttcgtcaggaaatcgttaagcgcgtgaataatgaattcccgcaaattatcgacgaagcgatcaaagcccgtttgttcccagaggcgaaaggctgatgaactttgaccgcatctataacatggatgtggttaacggtaaaggaatccgtgtagtgttgtttgtgactggatgcaatcataaatgcgaaggttgctacaacaaatcaacatggaatccccgcaacggtacaccatacaccgaagagactgaaaacgagttgattaaactcctttcaaatccccatgtggacgggttgacgcttacaggcggcgatccgttttaccgcaccaatcatccaacgctcttaaaactgcttgagcgcgtccgtgcgacgtttcctgataaagacgtgtgggtttggacgggatacaccctcgaagccttacagagcgatacagaacgttctaagctgttaccattcattgatgttctgattgatggacggtacgaaaaggatcaaccgactaagaaaccgtttcgcggttcggataatcagcgaatgattgagttcaaaaagaattccatcgaaattaaaaatatcgcttgacctggttggtggttctgttaagatatccacatcgaaacaaacttgaggacgagaaaatgaaaaacgcaatcatcaaagaaatctgtgaactggttgatgtgtatggttggagtttaggcgctgctaaagcagaagccaaatctcgtctgcaagttgtaatcaaagcccgtagcaaagatgaatttgttactaaattgcaagccctctatgagagataatatcatgattctgaatttcaaaacccgtaaagaagcccgtgactattgctggaagtggtcgatcccgctgaaaaacatcaccaaaggaagcggttcacatccgtggacggtgagaaccaaagaaacccgcttcgaaactggtaaagattacaagctggttgatgtcgaaggtttcactgacaacggcaaaaacattgcgaaccgtgttcaatcaaaacagatccaccaattactgaacggtgttgtaaacatcgcaagccgtaacggtgatcgctacaccttcaatgctccagcaggtgtcgctatgaacacccttcgtgcatgggaagcgaaatacttcacagaagttgctccggctaaagccccagcgccaaaacgcgctaaaaagccaaaaccagtaggcaaaccgtctgttgcacctgcaccagcgaaaccggatctggattctgaactggatggtggtgttaacctcgctccggcagtaaccgaaccgtctgttgctaaacctgctgcaccacagccagcgctcgtagaagcgatgcctggttgttttgttgccgaccgtccgtatgttctggtagatgaaccaggtttcctgcgctctcacaccgcgaacaaacgcattgtgcaacacatcaaaaacaacaacggtgttctggtgttttcgaatgttgacggcgacggtgacgcgacaatcacgcaagatcgtagcctcccgtttgtgatgcaccgtgagcgtaaattcttccgtgaactgggtactggtaatccggcaaacactccagcagttcaggcggttgatatttccaaacagcaacacgatcaactggtcatcgctgctgcacaggcagtagaagacgcactggcagaacaccagaaagcgatcgaagttgtagcgcagaaagctcgcgcagttcgcgaagccgccgcaaaacttgcactgctggcaaataagtaatataattcgggggtgcttacggcatcccctttttatttgaggtaatcatggaattattcgctggaaaaacttacggtttaaccgtatcccctgaaatctttgcagagaaaacctggaaaacaggtatcgcaaacatcattcgtgaaaaaggttacgtgacgattgatcgcacctcgatcggtgagttcgaagaccgcgcgtttatcatggacggtggttacgaatatgaactccctgcatcactatggaaatggttcaaggaagtaacgccggaagagggtgaattcaccccagaagaacctgaagaggttaatctcggtaacggggtcgagactgaaaatggtatgcgtatcgcaacgccggaagaggtttccgctggtgtcactggttcggatctgtgcctgatggatatccctaaattcacgtatcgccctgtacaggaaaatcctttgcgtgatctccgcatcgatccatcatttggggctaacctggaaacgttgagcatcgcaccgatgccagtacgtaaatctgatgcaatgcttcgtttcgccttgcaacatgttttcagtggtggtagcatctatcaaatcaacatggaatctgaactgaaaatgcaggaagaccagattgcaaacctgttcgatctgcacactcaattaaccgctgttgaaaatatcgaaaaactgttaggcaaagagaaaaagcgtattttgcaggatctcaaaccatacgggaagaagaatgaaagtcgaaatatacggaatccccgaaagtcttcataactgttacgggtgtatacaagcacaaaagctgttgacagaaaaagggatagaatatacattttatcccgttctgaaagaagcgaaaaacgatctgggctttgaatacgatcgcccacgtatcgaagagttagcaaaacgggtaaggcaacgcagtttagcgtttcaatacccgcgtatttttgtcgataacaaacttatcggcggttatctgcaattgaaacaacttattggtgattaaatgagccgtgaaattttactccctgctgcaaatgctgttcatgctgaaacaatggaatacatggagaaattcgttgaacgcgataacaccgcgatcatcactcctactcacctggacgcgctcgaagatcgtcttcataagcagattaaagatcaatttcccgaaaaggttagccgcaacttcattcgtcaggaaatcgttgcaatgatgctgaaacattacggcgttgaaatcttcggtgtcgaaccactgaaaccgaagaaagcacgtcaaatgcctaaacagatcaccgacgaagcaatcaagaaataccagaagaaatacgctaagaataaatgatctttaatacgattgaatgtgttccgtcaagcggtaaaacaaaggcgattctgaaccatatcaatcaaacgggcgaaaaagcaatcatcgcttcgatttccatgatgttatcaaaacagtcttatgactattacatcaaccaggtaaaaggaaaacgggcggtgattgtggacacggatcaccgaaccaaaagaaccaataacgatgcgctgcgtgaagtagtcaatgattacgatgtgattttcatcactcatgcagcactgaaaaacattgatgactttgatttgtataaggatttttccctgtatattgacgaagttcctgatttggttgcgttcgaaagtctgcgatttaatagcaatatcaagcacatacgcgagatttgcttgccgtttagttgcaatgccgatgatatcgttgatttaaaacttgacgaagaaaaacgagaactggttacacgattagcctatgatggtcttcgtaaacgtgatgatatcgcaatgaagatgttcccgctttaccgtgctctgttaggggctattccggtgaagatgcaatgtagcgattcgggatatgtctgttacttcgtagaggatcatgacgtaagccagtggaagttcaaaaatgtaaccattgcttcatccaacatcaaagacacaattacagggaagatcctgcaaacgtttcatgatgttgagttcaaagattcaccgcttcaaacgctggttgactttaagcaatataaaaacacgaagcgcattaaaatacatgtgctcgcagagggggattattcgcgttatacgggcgatctctctcaatctgggacgacaatatacacccagattaaaaaacgcgtggaggcgcttttagggggcgaacagttcatctattgcaccaacacatacagatcgaagtttagcgaggggcaggaaatcccgtataactcgcacggattgaacttctattcaagttatactaacgtggtggcattattcagttacaacccgttaccctggcttcgtcaaatgttgcgagcggttgcggtgtcctctgggcttgaagaggaagaattagttgatgcttatgttgtcagtaaatattacgaaccagcctttcagttatgcgctcgttctgatatccgacacaacaacagcaaaagaaagattaatttatttgtgcctgatatgcggttagcgaaatacatgaaggaaaaatattttcccgatgccattatcgaaaccacagaagcagttcaaacgaaaaggcaacgcaaatcatttcaaacccttttccaaatgacggacaaagagaaaaacgcttttacgccatacaagaaaagaaacaaattagattatgcgaatcctcttcatcacgcgattgttaaagattggctgaacaattaccgtgagaaaaaggcgacttgatggtcgccttttttgtttataaatatcagtattgaataagataaaggaaaacgataatggtagctaaatcattccgcgccacaagtggccttgatgctgctggcgaaaaagttatcaacgttggtaaagcatcacgctctgtgttgagcgacggcgtgaacgttgacttttttaacgaatttaacacgatccaacaatacgattctacccgtggttatgctgcgtttatggctatcatgtacgcgcgtcgtatttggtacgctcgcgcagatattccatcaccagcgggtgctttcgatgaaacaaaatggatctcaacccgtaacgatccaaaatgggtatataacaacgtaacgagcaatgacggtctccctgttgaatccggtacgtacttaatggctgacggtcgtttctctgaattgacctatattctgccagatgcccctgttgagggtgatattatcactattaaagatggtggcggtcttgcagggatcaacaacctgttagtgcgttcaaacactcgtcagatccgtttacgtgatattcagtcaagctcttatcgactgactcacccatatatgaccgttgcgtttatttttaacggcaacttatggcgtgttgctgaaatgcgtgataaccgtgattcgcagtttgttaatgcgactggtttaaccgctttccaaatgcaagcgggtatggtaacattccgtaacagtggaacgggtaaaattacgttgcagttgcctcgctacgcaaacgatggtgactcaatcacaacttacgatctggatcgccttgcttcggtgaacgttgcgactctgcaagtttatcctggtagcggacacacgatcagctatgacggtatcaataacgtaacctctgtgacttcacagcgttccggttatggtatcttcatgttcgatcaggctaataaccgttgggttgtttatgacggtgatcagcgcgttcgtctgcgtcgtatcagtgatgacctgaacatgttgccgaacgattacgtgttcatcactcctgttgctggcagtcctccagttgtacgtaacgtaacgctgactcttccgcaagatgttgccgaaggtgatcgcgtgtatatcagtatgtacatgatggggaaaacgcagaactgtacgatcaaagttaaagatggttccggtgaaaagatccgcaccaacaaaaacatgatgcagttcccacagcgtaaggattatccgcctgatgactggttcagtgttgactctctgactttcaacgccgatactgactatcttccatatatggaactgtcatatctgaaagcaacgaaagaatgggtagttgcacagtatcgcccgatcattgaacgtgtcgatccaacaaaccgttctcgtctgggtgtgattgcgctggctacacaggcagaagtaaacaagaaccatgaagatacgccgtctgatgaactggcagtaaccccgcgtacactggcgaataaaaccgctactgaaacgcgtcgtggtatcgctcgcctggcaacaactgcggaagttaaccagaacacgacagcaaccttcctcgatgacgtgatcgtgacgcctaaaaagctgaacgaacgatcagcaacagaagatcgtcgtggggtgctggaaatcgcaactcaggcagaaacaaacgctggtactgatgacactaccgcaatcacgcctaaaaagctcgacacacgccgcgcgaccgaaaccttagcaggtatcggaaaactcgttacaacgggcgctacgacagcggagggggctttacgtggggatgctggtacgaacgtctacaacttcaataacggtgttgaccttgtcaccccgaaatcattgaacgagaagacggcgaccgaaaagtcaaaaggtctggttgttctggcgactgaaaacgaagtggtaactggtgctgctgctggatctgcttcaatgccgatcgtagtaactcctgaaatgctgcatcgtaaaacgtctactgaatcgcgtatcggattgattgagatcgcaacccagacagaaacaaacacgggaactgatgatctccgtgctgtaacgcctaagaaactgaacgatcgcaaggctactgaatcgcttgatggtattattgccctcgctaccactgcggaagtttcagcaggtacggtaacgaataaggcagttgttccggttaagctgaaagagttcttcgacgttacgagtcatgttgcggttgcaactgctgatggtttaactcagtccggcactatctggacaacggttaacctggggattgcgtctgcgactgaaacacagcgtggtactttacgcgttgcgactcagggcgaaactgatgcaggtcttctggataccgtgttcattacgcctaaaaaactgcaagcgaagaaagcgacggataccgccgaaggtattattcgttgtgcgactaacgcggaagcgggtgcgggtactgctactaacctggcaattactccggctaccatgcagtttttgaacggtactgatccggcgtggggtgcaacaacaactcgacgtggtgcggtgtttatcactaccaaagcaaacactttcatcggtgataatgtggttggttctactcagcctgtagatagttatctggaagatttctacgctgtatcgcctcgcggtctgaactttgctctgcaaaacttcttaccgttgaacgcaacagcacagaatagcctgaaactgggtggtgtggtagctgcaagctggatgcgtcgtgatgcagatcaaaccgtaacgggcaacaacacgttcaacggtacaagcaacttcgttggtaacgtaaccactaacgggactctgacggctaacgctgcggtaactgttaacaacaccgtaaccacgaacaataacattaaccagtctgcgaaagcaaacacggtttatgctaatactgttttgagtacagcaaccgctggaactaaaaacttgcttcgtactttccgtggtggtgtgacggatactacatggcatgaaactgttcagggaactacgtatcgcttggcaactggcacaaccgacacgaccgacgttctgactgttggtgatgtatctaacggtacaatggcgtactccggtactactctgcgcctgaatggtaaagcactggctaatacgaacgcaacaggtgatgtgactattgcaagtgatgcaagtcctacggtacaattacgaaccgctgcaactaacggttggaacggtgtaacaatcagtaatgataacggcgtgactactgcaaccgtaataaacaccagaaactttacccagcatcttgacagtacctatgtcaatacagcgggtgatactatgactggtgcgctgtcagttagcgtaaacggcacgggtggacgctttaccagtgtgagcggtacggcacatgttcaggcgggtgatttctctggtaacgtccagaagatgcgcttaactggcattgacgataaggtattgactgaattcaatatcaatatcaccgattacaacaaagcgatgatcaacggaaacctgatctatcatgcaggtcgtaaaccaactccggcagaaattggggcggttgcggttgcgggttcaactgtagatactctggttgttcgtgattacatcaaaatcggaaacgtaaaaatcttcgcaaatccaacaactaagacttgtgaatttgtgtgggaggaataatttaaatggcgaataacgaatttatggcgttattcggccctgatagtttcacggcgaatgtgttttcagaagcaaacgccgtgaaatatcgccttgttgtccgtggaacgaataacgattctgcggtcaactcggttgaggtatctattaacggggctgatattataaacagacgaacacaagttgctcgcggaattaacctggctgtcattgatggaacaactttagcattattggattacaaggcattcgatatgtatggtgatcctgctacgaacgggaatgcgattaaagactacctgaattcacttccagcgaacagaattgtgtgtttttatactttcgatgctatcaaaagtgatgacaactttttagcaacaatgaggaaaataggttctgttgcgtggcctgaaactcggttctttaatatcccgatcaccacaaccaattattctcaccgttcatcctattcagctatctattcatctacgatgaaaaagatttgcatggaaaactttgtcggtggtgctggtagcttgaaagataacacaacgagttttgttgaagttgtttttgatgaattcagtgatatcggggtaacgggtattccagaaagaatggttgatgatgtccagacataccagaacagcggggatctgtacggctttcatctttacgggttgtggggtatcggtagcgatgtttaccagggagacatcttcaagtttactggggaactgtattgctcacaagaacttcgcgatgctggcggtgaagtgcatctgtatatgtggactgaaaacagtattggacaatggacaagttcatctattcttagaacaactggactcgcccccgatcagtggcattctctatcaggatatttcactatcccaaatgatgcagtaaacgttcgtatgggttcgcaggtatatcattatccgtcaaccgttaaagtcgggctggcacaatgtcgcaacgtacagatcacgaaagtaccgcgcgaagaaataaaccgtaatggtgctgctgttggtgtgaacggtgttcgaatgcagacactttccgaagtggacgcaagcggaaatgagaacccgattgataaattgctttctctacccgtttcgcctactggtgttgcaagtgataagaaaatcatttcgcataactttgctgaacttgattatattgtttctgatccggttgaatatacttcgacaaacacagcggagtaccagttcaaagaatggactgctacacggcaagcggaggtaacgaaagcatcactaagcagttatggattaaaagcgggtgatacgatccgtatgcaatgccaaatgaaacgcgatgcaaacgcaatcgccaacaataaaggcgcatatatcgtaatgcagttctgggacgcgaataatacgtatatcacagggatcaacatgcttgatgttggcacgatcccgaacgtatattcattctacaaaaacgaaggggttattcctgctggtgctgttacgtttgatttcggtttatatcgttatccaagcaacacaaacatcggcactgtatccgctaaagatgttaaactgtcaatcgtgagataaaggggcgaaagcccctttttcataaatacagtcattacaggagaaatttttatggctgatttgaaattaggcacaacgctgggtggtgcgggtatctggagtgcgtcaaacctccctctgttgccctctggcgacagattgacgtataaagggtggagagtatacaccgaaaacgatcgtccaacagcggaggatataaacgccctctcgacgatcaacggcggtactgttgcgaagaatactacattcagtcagaacgtgaatgtagggcaggtgttgacagcaaatgatattctttctaatactcgcgtacaaattgcaagaacaggcggtgcgggtgcaaacttaacatttcgtcgttatgacgttaccggaaccccttcttcggaaattggtatcatggatatcaacgtacacaacggttcaggtcagtttgttggtgcatttaacgttaacgcacgtccagacggcggtaataaaatatacttccgtgcatacaaagacggaacacagaatacattattaactctggattctcaaacccaacaggtaacagttgagcaaggttctttccgtgtaatcgggacttctaacctcggcttaacgaatgctacatcaatggcagttagtggcgcggttactgcgaatacagtaactccgtcaaactgggctaaccatgatgaacgttatatcacgggtattcctcgcggtatgtctggaaacagtttcggggctgctgcggttactgaaaagaacgatgttctgtcggtaggtggtaacgtaacggacggtccatatggaaacacaacatattacggtcaggttgccacatatcgccgtactctgaatagtggtgtttctctggttcagacttactatgatataacatcaacatggattcgtgctgcgacgggttctcctggtgcatggtcttatagtgcgggtgatgctaatggatggagaagaatttatgatacttcgcttcctccgactccggcggaagtaggggcagtcaataaatccggtgatgcgatgactggtgttctaacactggcaaacatatctcaaccacttaaaacacccggcggtggtgttctggctaatgacgggaacgtgtatatcaacaaaagcgggtttgcaggatggattgatgctttattcttgaaaaatacaggtggtactgtaacaggaacaatcaaccagacaggcgggtattttgatacatctgccgaagggagaggttcatgggcttcacaaaacaccgcaaaagctccaattttccaaaccattaacacaacagcaacttccgaatactggcctattgttaaacagtattacacacaagctggtggtgcttggtctatgggtacgttggtaaacactaaccgatttaccgttcattaccgcacgagttcggtagatcggcagtggtattttgacaattcaggtgaatttgtatcatctggtgatattattaccacctcggcaaacggatttcgtatcgcatatggcaacaccggatcatttattcgtagtgacggaaacaacacgtatttcctactgacaaatagcggtgatgtttatggtggatataacaatttgcgtccgatttattacagcaacaccacgggtgctgttacaatgggacatacgttatccgttaatggtcgtattagtcaatctagtagttatattgacaatggaaatttaacattaaacggtagcggcaacggacgcgttgaatttattcgcagtggtgcaaaccctcgcgatatgtatatgttccatgctggtgatgcttctcgtggaaaccgtattgaaatctctgatagtgcatcatatctggtttattttgaacgcaacccttcatccggcattcagttggtaatgaacggtaacggtagctttagcgatgtgtatattcgttctgatgaaagactgaaaagcaatttcagtaagattgaaaatgcattggataaagttgatttgcttgatggtatggtgtacgacaaagcaaatcatatcgggggtgaagaaactacccgtgaggctggtttagtcgcacaacaactgcaagaagtattaccggaagccgttaagaaaggtgttgatggtgaacagaacgagatcttaactgtttcttcttctgctgttatcgccttgctggttaacgcggtaaaagaactccgtgaggaagtcagggaacttaaatcccgctaattaaaagcccttcggggctttttctttttataaatatcataaaagcatttgaggatctaataatggcagatttaaaagcgggtactaccgttggcggtaatactatctggagtcaggcgaacttgcctttgctcccttctggaaacacaatcacatataaaggctttaaaatctacaccgaaaacgataagccaacaaaggcagaaatcggattaggcaacgtaacgaacgatgcacaggtgaagaaagctggcgacgatatgaccggatctctgaaccttacaggaccggatagtcaattaactgttccgtatcgcctcctgatgaaacgagcggcaaatggcgatccctatgtgttgtttgtacgtccagacaacaacccaacaacggtcggttatccatcaaacacacttcgtgtaatgactatcactgctcgtgccgcaactacagcagatccggtttctggtgctcaattggctaacgtattagcagatcagacagcacagggtaacggatcactaacattgcaagcatttgcagccccaaatacaaccacaggcgcaagcggtgcgcgaacagcagagatttacctaaacggcaacgggcaagtatctatgacgggttccggtttaacgataggaatgcagactgttgttagtggtactatttttggtacacaaatggctattaaaggcgattcgaaccgaaacctatacttccaggatgctggcggtaatgagcttggtttgatctatgctgatacaggaaagaacttatatgttcgtactggcggtggtgcatatgcaactcgttttgcatctgatggaactttagttctcgctaaccatctaaccgttcctggtcaggctacatttaatggtctgggtgtgttcaataaccgtgcttctgtaggcgtagattatgattcgcaaggaataaactcagcgattcttcgtgttgaaacaaacggtgatggaaacggggttggtgatggtgttacccacttaggctataaagacggcaacggacgatataaccattatttccgtggtactggttcgacttctatcaacaccaaattggggcttaacgtaaacgtaccatcgtattataacgacgttccacagggcacaccagcgcaatatttcttacctactgttggacagggcgggaaaaactatttgcgtcagttccgaggcggtaacgcggacacaatctggcatgaaactgttcagggtggtgtgtggagactggcaacaggttctacagacggacaggaagaattgcagatttctactgcgggttatgctcgattccgtaacgaagttcaaagcgctacgtctggttctggtggacagttccgcgcggtacaaggaaactacggggtaatacaccgaaatgatggtggtaactactataccttgatcaccaactccggcgatccttatggaacatggaacagtttacgcccgattactatcagcttgactactggtattgtttctataggaaacggcgcgaacattaacggttctgttaactttggcaacgcggtaaacttcaacggaacggtcgaaacaaacggtattggttgtggtacgccaaacggattgggtacgactggtatttctctgggtgataacgatacaggtttcaaacaggaaggtgacggtattctcaacgcctatgcaaatagccagcgtattatgcgatggactactggtgcaactgctaactataaacagttacaggttcagggtgttaacgggccagcattacttctgaataacacagcgactaaccaatcatgttatttgctgattactttggcaggtaacaacggcgcatacttcgggtttggtggtgctgatgataacgtatcggtacacaactaccgactgaatacgaccttacagttgcgtacttcggatctgtatatgaaccgtggtctgtatgttgaaggtaacgtaaacgccaacgatgtgtatattcgttccgatattcgactgaaatctaatttggttgaattgaaagattcattaagcaagattgaacagcttaaaggttatatctacgataagcaatcaaaagatgctgatgatatcgtataccatcgcgaatccggtctgatagctcaggatgttgagaaggtattaccggaagcagtgcgcgaagacatcgacactggtatgttaaccatttcaccttcgggaattaacgcgcttctggttaacgcaatcaacgaactgcgtgaacgtctggaagcaatcgaaaacaaattaggggcttaattgcccctctttcatgaggtatttttatggctattgtaggagtccctggctggatcggttcgtctgcggtcacagaaacagggcaacgatggatgtctgctgcgggtaatgcggttcgaatcggaacaccgttttatatgtctcgaatggcgggacaatcggtatataacatcaactttacggtgtatgagcgttactataacaacgcccgttatcgtggtcagtggggggttggttggtattcaccatattcaaaaccttctggctatcctgcggtcggtggtagttttaatggtaatgcgttcggtactgtagttgctgcacaatcaagccctgatatcagtgtaatcactattcaaaacggtcctgctgttaacttacggcttactatggatgacggaggtgtattcgattttgacaacaacggacgtatacatgatggatatcgtcaatatcaggttgtttcttctcaggcgaccagatggtatgactatctaaacgcccgtgtaggtcaaaaccgttctggtttggttactcaacgttaagtaaattcctaaatatgttcggggtcggcatcccccgaacttgaggtttaaacatggcactattacaagataaattggcggtgcttgaacgggtaatatcgttcatcatggcggtcaaaacatggaaacagttattcattaaattggttcttatcgtcactattttcattatgttcgtaacatggtacaagtgggatgacttattttcagtctggaaaacatcttcaagcgttatagacgtgccgacgatggagattgaaaaggcaaaaaagtttgaatccgcatccatcgaacagttaaacatagtgcattcaactacgggtgcggatttttcggcaatctttggtttcagacctaagaatgtcaattattttgttgatataattgcgtatgaagggaagttaccgcaacagatagatccgaaaaatctgggtggctatcctatagacaagacatcggaagagtataatagacatataaacgggctgtactatatctcagatattgcaagcccgtatcttccaacaaaagaccttgttccggtagcatatacctttagttgtccttatttcaatctcgaaaactactattctggatcgattctaatggaatggtatatacagaagcccgaagtcaccgatacgaagttaatgatcgtgtgcaatcaggccgcaagaattttaggcaggattcgatgataatttcagtttcaaactactcaaagcccgattgatgaaatcttttactttcgtcatcgggcttttatcgtatatgtcccatacgcgcataagttcatatggtgtaggtacatattcatcgttccagtatccaatgttccctatcgtaatgcgccggaaaccagcctctacgctgtgatatacaaagaacccagccttacccacaggggcgactttaaaaccgcgtgtagcggctttcatggcttcgtcgtgtgtcatgatagaatcacttcgcctctgtattgattgtggtagatgtatggacgaacacccagcgggtgattatctatgactaagatcaggtcaagcccgtcatgatgatcttcttctgcaacaatatcccaatcagtcgctttctgttcttctacgctcgcaatgaatacctggttaatctcaaccttgcggtgagaacgtcgaatgatcgtatccccttcacgaaacacgatcatatctgggttaattggacggtacgcggttttacccgcgcacacttcattaagcatttcttcgtatgtcattataatacctttactcgctgaacaatggtttgtttaacttctttgtattcgttgtgaagtttaggtgtcgctttgaaacgaatcacatcaccctcttcaacaattttgtttccgtagtagataaccacgttaccatctacgttgattttggtcatgaaacgttccacttcggtgtaataagaaacttgggtatatccgagagaaatcactttctcaacaaccccgctcatttccatacgcttaccgatttccccgatgtgttgcgctgctgcgatcttcgcctggcgctctgcttcccattctgcgcggatctcttcacgtttagcgatataatccttctccagcgctacgcccatgcagtaagagcaaatagcctgaaatactgggctatcgttgccgttttctttgcactgatcagcccaccacagaatagtatacatcggcatatcagcaatcacttcacctttacgcttaccgatcggcatgatgccttgttccagcagttccagattttcggtatcttgtacagacagtttgccgcgacgttcgaacagatcgaaatctgcgaagccctggaacaccatctggaaagtatcggtctggttcagacgatccaccatgcgatcgaagtattcacgcgctttcgcttccgctttatctgggtcagtagacaggttgcagatatagttatcagaagtgaatccacctccacgacgctctacacgcagagtgtacatagcgtttttagcgccagaagaaatgaagtatgtcgcggtaactttagtcaggttagtcatggtgaatctccttagtggtttcgtttcgacaaggccaatatagcaaaagccctcaaccgaagtcaagggcttttttatcatgcgttcgaatctttcataactttatgaagatggatatcaaaaattttccagtatgcttttccgcgaggataaatttttgctttatcaatgtcttcgttgcttccccatgtattgtttgggttacgacaacgattttttgcataatccatgtgccagaataagcgttgcaccgatgaatctgtgcctaatggatcttctttgctgaacagaatttgtgaactcataagaagaaacctgttcgaactactaaatcaatctgtttttccggtatcagtggcgctttatcgtcaacgttgcactgataatacatcccgacatactcatgaggaacgttggattcgctcgcccatttcaggttgtcgtctgtacgcggccctaacatgaggttaacgatattgacagcgtgatcctgttctggggtgttgttgcatccgttcacataatgcccgtgagcggttttgaggatttcaatgatatcttcgtcggcttcaacgagatacagccccgtgttttctgggatttcctcaagaataatcaaagcggttttcatcacacttacctttatgtttctgcttacgttttgcttctttaagtgctcgcttgcgatcgcggtgagtagaagcgcggttgaaatcatgttttgctaccagattgttcatttaaagcccctcaaaaagaaatatttaaggggctttcgcccctcgaattaatccagcagtttgcggatcttatccgcgatacgtccggcgcgggttgcgcttgcggtgtgatcgctttctttggtagccagttcagccagcttacgctgatgttcttcttccgctgctttgcggtctgctgctacctgttcgacctgcttctgatcatgcgcaatacgcgcttcgagttcggtcagggttttgtcaaaagttgctacgatttcgtctacagaacggattttggaaaacagtttcatattcattatctcaattagtatggttggaattcaaagtcaaacagatcatttagtgcgcggttgtattcagtatagttctcaccatccccgaaccgcatctgaatcgcgctttccgctattgtaccagtaagattcgagaaaccaaagaggtttttaatcttatcgtgtgcaacgaagtacagagaagcactatccagcaaggccaccatcgctgatggttcatgttcgcggcgtttgatgcgtaacagagtacggtttgcgccagtcttacggcgttgatttggggctacgtagaatcgaaatactaccttacccgttttatcatcaactaccaggtagaagccgtgttctttcaggtcaaccccttcgaacttggtgaagtcaccgcgcttcatgtcacctatcttaacagcatatttgtggatgtcaagccttgtcagaattcttttcatttttcttcaccagtttatttcctaatttggtgtttacaccagttttcatattcattgtcagtaccagcaagaagatagggcatgacaaaatcaagatcgttgcgccgaacactaagcgaactaagcgaatcaacaacgtcccgatccatttcatcggtatctctacccacttctgaaccgttgcgagtaccagcataacataacccagattaaatgcaagggctgttgcgataataccgtaaggttttttgaagtatgtctgttctccgtcttctgtacgtccagcggtaacgttgcctccgttccagatttctttagcggttttgatggctgtttctgccccgctcaagttctgccagtagtcaggaatgctctgtaggaatttcataatcgaatcctccgcgcctgaatcgctccaggcgctgttttggggttagtagtgactgaatcccacagttacatcacgcatcacttgataacggcatacacgcatcttagcgttatcgtaatctgtcgggattgctacaacgtcgcgaggattaaccttaacctgaatgactcgcccacgtcctccgccatagtgaggcaggtacgattttgcggcaacatgcaaaccgcatgaacaggctcggtttttattctcgtctacctggttacgtggcatttcaaccacaacaccaggggaattatcgaacttaccggaagccagatcgcggaagtcttcacgaacacgtttccacgcgtagaaatctccatcatctgccagttcgatatcgttatgcaccatgaacccgtaaagctgatacacagcatcgcgtgaagggttttccatcaacttctcgaagaagttcaccaggtgctcgtaagggcgatcgttgtacatttcgcgaacgatacgttgtgtgataccgctgtcaaacacgatatctttgtacaggactttatgcccgatgattttaatgttgcctttgctgtaaatcttcaacgcttgcgttgtgtccaacagggtagcaactccctcgatgtcgcccttaaccattaaagcatgtgctttttcgaagttagggtgtgacgaatccgctgtgatgatcttgccgtccagtaccagagtaatgaacgattcagaaccaatcattttagatttgacatctgtttgtggaagtggtttcgacgcttccgtattatacttagaatgctgttcggtaataacgcgcccgatggttcggacgcttacaccaaattgtttagccagtgcggttttgtttgcgctggtcagaaagccctcataaactgctttcttttgtacatcatcaaggatcttaacgtttctcattatttccaccgtataagtttgaccaaatccatcacaattttatcatcattaaacatactgcggaatgtagaataagatgaatgtaacaacatgtaatgaattgatgggttgcgttctgcaaataaatcgtaagcagtatcaacgcgttctttcatatctttccgcattttgtaatacttcgttgacatttcacgaagtaacaggttacgcaccacagtttttgatttgtttttgccctcgataacatcataggtaaacttaccatcaagataatcgagcaacagatacaattctggattatagcggtttttaaccatgcgatcaagggttacgcccatagaatcgcgcagggttcggatctcgcttccgtggtttgatgaaatccatgcagggaaccagttaggttttatcttcttcgctgcgtccgcaaaacgttttaccagataatcatcaaggcatttcatgttgctatctggaatgcgactccacagagagtttcgcagaaccatcacttcgttcagccctgtaaccgttaacatggtcatcatactgctggcgatgctacccaacgaatagttctgtgcttctccgtccagtcggctatattcatcaacaccataaaggcgcatagcgtacatttcatccagtttcacaaactgtgctttagtcaggtacagatcgtttttctgtaagttgccctgatcatccaggaagtaatgatatgctgtaggcgtttttggacgcggttctgaatcaccagaagatgattcacgcgttgctttccagcgcttacgatcttcggtatacgtttcgaattctttggtcatttcactggttttcagtgtaacgatctcagattcatcgaaatacccagttctgatcaagtcctgaacaggttcactattaatctctttggttacgaaactgatacgatccgaaccattcaacatgcagtaaccgatcagatacgggcggagtgaacgcgcttcattatcgttttcaacgataaacagtttcttctgtcgccacggttgaatcatgcgcataacgtcctggcgtttggtagtttccgctttgtatgtctcatagcggcgaccagaacccacacgttcgaatacgcaatctttcccgtcatatgggttagcccagaaaccccagatatattttccggttgcagtctcagagcttttaagatgcgtcaggatttcagccagcgaatctttacccacacggaaacgcttatcgcggcttacaaaagcctgtaacatgctaggcagattgttgaaccatatgattttatcacgggttgttttctgcttgccgaactccgcaactaactcttcgtcatagcgtttgttgatcttttccagtcgatccaggattacttttttggtgactttatcaaggctcaactcttcacgcgacggcatgaagtccagcgatcccagagggaaatccagaatatacgcgtaattgctgttgcggtagcagtagaacagcgagttttcgaacatgtccatgtcgattggatagcaaatgttacccatacgcgcgtatacgcctgaatagttgatggacttataacggatgatcccgcgatcgtctgcttctttcggttgccagtttacatcaacctgaacaccgataaagcgcggacggatacccgtaaacggttcgtaaacacgcgccgcttcacgttcccattctgcgatatcttcgactttaaccggaacggtgatttgaacgccgttaggttcgtctgtttcgatttcgtagattgggtcaacgaaaggttcaccattatccatgtaagccgtgtacgcgcgtttaatgccgtcctggatggattcgatagtgaatgtttcagtgtagcagaacggggatttgctacccagtcccagcgccccgatcagttcgtcggtgtcggttttggtggattcgaaataggttgcaaacacctctttaaccatccagtcacttaaccctgtgccgtaatcacggacgatgaaacgcggatcgagaacagttggtaactgaacatcgaacgggttcatgttacccgctaccatatgaccatcaatggcgttactggagatttcgcgaatgattgcgcggatcttgtatttgtagatggttgatgacatgattttgtatgttttcgcactggtagccattttaaacttcgtgcgttcgcctttatcgaagcccgtagtgtgaatggtttgtggtgctaactgacgcaatttcattgtttatatctcacttggtgttgaagatgatgttatcacatgaatatttcataggcttttgatcaagcccatactcaacaggtgtacacatccggtcaaggtattcgtaaacctgttgcttctgacgttcgcggtctttcatatccatgataccgaccacgatagcagttacaaaacatattgcaatagtacacagcacagctattgtaatatattttcccgtttttggtgcatcatatggtttcattgaatcgcctctgcatattgttctggtgtcaatttacgcgctactaagcgccctttggttgctcgtttgtttcttgaaatgtagatgtttgcaatgttgcgtttaccttcctggatctcattgtacatcttttcggtcatattgcactgataaacttcaccgttcggagttttcaggaaaaacgcgtatatgtctttttcgctttcctgaattactgatttctcacggatacggcttttgcatggtgtaggctgtgcgcccaactcgatagctttacgctgccatacgatcccgtgtccagccccttcggtcagagcatgtgcaatttcgtgcatgagagtatctaaaacgttctcgtagatatcttccttaacgtgagaacggctcaattcaattgacttgcgactgtaattgcattgtcccagagtacgcttgaaacgtccgttgattttgaaagaccaatgagataagccatgcttcgccatgatgcttttggcccagatggttatttccatatcgctacgagttttgaacattttatatcctccccaaatcagtgaggacactataacaaaaaagcctcccgcgatgcaagaggctttttgtaaattatttcaatttcttcgaaagttctttcaaatcattgagatattcagttttcggggttgtttcttcccagtatttcagttgcttacgcagttcgttcgcttcgtcttccagcttttgacgttcatccgtggttagatgatagatgttcatcgcaaccaggatttcggcgtggttctcgcaacccgtccacgtagagacaagtttaaccgcttcgctgcgactaagccccttcaatgcgtcaggctgtgcgatcatctggtcaatgaagtccaccttcgccagcgccttatctaacgcttccttagtctcctggatgcgcttatcaatacgctgttggtaaacaccaatacggatatcaacgaagtctttcagcaacgtttcaggacgctcgtatgaatgcagtttcccgttaaagataacgttgatgttcgggtttgagttctcaatcaatccgaaatctttcaggatcttctcacgggtaagcccgtttgcgtactcacgtttaagggtgatttcgtagcggaaatcttctttcgatagatccttatagcttacgatataccctttttcttccagcttatccagaatagagatatatttcacgcgatcatacttgaccggaatctctgtgatcaccagtttggttttaccctggagttcgtacttgccgtacatcgtaccgttttcaatgtcgcctttgaaatgcgggtatttcagatccagcgtgaaatctttcccgttcaggtaactaacacatccattcagaaccgaaatcggatcgtgtggtggaatgttggtagcgtatgctttcgcgatcccgctgaacccgttaaccagtaccatcggaatgattggcaggtaataggctggcggtacgtgttcaggatcttcatgcgggattgttaaatcttcatccatgtagatagccttgaacagcggagacagcttacatttaatgtaacgcggtgcgcctggctttttaaccagacgggaaccaaagaacccatcgcggtcaaaaagcgggatgttattgcaccagtgcgccgccataagagacaatgcctcttcaacggatgtttccccgtggtgataaccatacattgcaacaccgccagcgatagaggctactttctggaagcctgtaccgcctttcgctgcggaatgcacgaagaaacggtgaactggtttgaacccgtctaccaggtgcgggatcgcacgagaataaattgtgtaaagagcaaatgtaagcccctccacctgtacaacgtctttaatacttctttccatcatttcaccgaaaatttatgttttccgttcacccagtctttacgcggatcggattcatcaccgaaacacagttccagaacgtctttgtattcgtcgcccagtacgattgtatcgtattttaactggtcgcccaacacccgatcgtaatcttctttacgtaaagaacccagccctttgatatatcgtacctctttcgccttatcgcggaacggtgcgaaatcttcaagggagtagaaccatttttcatctttaccgactttcgcaatgataatcggtgtgcggatataacggatctttttcttctcgaacaactcaggccagcggctaaagaacgcaatcagtagggtgagaatatcgcccccgtcaacgtccgcatcgaccatgatcccgatgttgtcgtaagtcatttcggaagagtcgcctggatggagattcaggatcgccatgagttcagacaattctttgtttttgagcacttctaagttactcattccccaggtgttcaacggtttgccacgtagcggaaatgcgccttgtgtctcttcgtttctgcactcgataaactgccccacagcggaatcaccctcggtcagaaacaaagtggtttctaccccgtcagtgtcgatccctgatgccggaacatgttttgcaaccttcgcctttttcgctttcttcttcgctttggtaatggctgctgcttctgctgcctgtttgcgaatcagagcggactcaatgatcggagtgattatttcagaagtatccataatctgtttcgcgatctttttgtagttcagtccggcgtggttgttgaactccccagcggtgttagtcagtttttctttcgtctgactatcaaaagctggtgcattgaagttatgcaaaaacacaaccaaagtcaagcattcttttacacgggctttcgggatctcgatagcgtgtgttttcttgatcatcggttcgagttcagaatagataccgtcgatcatggtgtcaacatgaacaccgccgtttttcgtatccagaccattaacgaaggatttctgtttgaaaccgtcttctgtgctcgccaggatgaaactgattttgttgtttgtctgggtaatcgttttatcaccgtacatcgcgccatacatcgcgaatttgttcgggaggatatcgccgttatatgtgaatttaacggcagggaaagccactgcaagcgccataaggcggtctttgatgacttcctttgtctcttcgtcgataccgtccacaccgaagatagagaagtcaggggtaaacttaacggttgtcccttgctccttcgtcgggctggtgcggtaatccatgttctgcgctccgtccgtacaattgatcgtgactttgcgtttaccgttggatgtctcaccgataaagattgcgctgtaacagtttgtcaggaaagaacctacaccgttcatccccattgttacgcggttttcgtcatcgaagttagaaccggatttagccattgtccaggctgcaacaggtttaggaacaatcttcccttccggcgttctcacgtcatcttgtggaataccgcgcccgttgtccgaaatcgttaccagattgtgatcaatcttcacttcgattttgttcgcatatttgaaatcagttcggatcgcttcgtcgatggagttatccaggatttcgttgatgattttcaccaacccttccacgtattccactttgcggaattgccccatgataaaacgttcatgggcttctttgttcactgaacccacgtacatattcggacgtttgcgaatgtgatcgcgatcgctcaagcagaatgattcatccaccttagcgccctttgctggggcttctggtgctttctgcggctcgttatcgtccattaagaaatctaaactcatattcacctcgttattagttctcaggcattatatagggttctatgaaaaagaaaacccctttcggggttttacttgttgtacgggaatccgtctttcaccatctgcggcttatcaaccgttcgtatcgcctcgcccccgcaatcacaatctttcggttcgtcgcggcttgcgatgctggacattttcggaaattctttttcgcacttggtgcatttataggtatatgttggcattaataaatctctgacaatggaataaaacggatcggggttgcggctttgctgaaaacacattgcttgttccctgcaaacatgagatcagtttcgtacaccatacaaatatatccctgattctccaaaatttgccgctcccagctatcgaaccatttagacaacttctgcaatgaagagaagccgaaaatatagctacgataatttttaccatgttttttgaggttacgcattaaacgaaggtcttcgcatggtgcggggtgacgagtctcggagataccgaagtttaaaccgaactcgattccatgaatatcgagatactcatagagatcgtcttcatcaccgacacaacccgtatacgggcctaattgcttacaccatccatcatatttggataatatagacgctttcaattcaacgcgataaaccaacatgatccgatcctcgtaattgattaactacaagtagagtaccacttatctaatttcttatcaagcagtttattgatcacttgcgcgatttctgtcgtcccgtgggttgtactcagtttcaggtaaatcacatccagggcacacacgatcgcatcaacgctttcttcgacgatatcaccgccgcgttgaggctgaacgagacattcggagatctccccaacctctgcggacaggtggtgaaccacgtcgctaacggttcgttttttgacgctatgagcggtcttgaaaaacttatccagaactacagcggaattttcgcgcggtacttcctcacctttattgacgtggatcgtaatttcagtttccggttctggtgcaacccataccggattgaaaagccctttcatatcgttgaactttacaggaacgggaataccttcaagataaagaatccctgtttcttcatacaccatactgatccggcgtggtgaattgaagtccatcggattcttacgcaacgcgtcatacatacgacgaatcggatcggcttctgatgccatttgacacacagccattaaaatagatttcggggcgtacatatcgccaactttatacttgctcatttacaatacctttatgataaccaataataaaacagttcacttctggacgttcgccagggaaatgcacacactgcatgacgcgttcagccatgagttcttcgcccaaataaacagaggtggtttcttcgttgtaatgacaatcatacgaagtcttaacactcataccaggcaatccggcgatatgcataaactttgagttcgtgcatggtttaccctcaatgttctttccgtttacatcaaacgttgcaaacatttcggttttgctgttctttgggcgtctgctcatttcttcacaacctcattatatgttgacaggttccattcatgcacttccggcactttggagtaatgatccaggaatactaactggacttgcataacattagcacgatccatattgaaaaggaaacgttgcggggaagtaatacacaggaaatcttcggtacttcctctgcttgcgctaaactcttttgtttctccgccgtcaaatttagcatagactggcgtagaaaaatacggggcgaatagttcgcgtttggaatcgtccgtaatcgcgctgaaacacacgtctacgagctttccggttccttcccgtctgatggtgagcattgtccctttcgtgcgccctaagacgtttacagagcgcgtggtgacatcaccaaaagcgtttgtgtaactcacagtctccacaaagcccatatcacgacgttgttttaacattgcttcgtgttgcgcttctgcatcctgttctactactcgttgtgcggcttcatacgccgctttgttcggatctcttgattgccatgcgaagaataaaacccctgcggctatcagtccgaagattgaccaacttgcggtcgctgatagtttcattttaatattccaaaggggccgaagccccgattttagcgaagatagcgaacgtaaccgctacggtcgatcgcgttctctgggttgttgaagatattaccgcgaatacccttagcaggtgctttccatcctgcggctttcaggatattgccgtcattgtccaggaaaccagcaactgaacgctgatcgaacatttcaccagtctgtttgttgcgagtatcctgcacaatacgatgatacttacggcctttttccagaacgaaaacagtttcaaagaattcgttttcgaatgcgccaccgttacgggctttgaacatcgcatccagtaaaggctgtgctgcggctttcagttcgtcaaaagtatacatggcaatctcctaaagtctgtttcgtttcgatgggataactatatcaaagctatcccgtgaagtctttagcaaaaagtgctatttgttaaacccgtttcccttgataccatttcgggaaaataacccggtcaataaaagttctccccaagttgaaactatcaccgaacaggagaacaccaaacaaagggtcgtgcttgatatcgtttttcccgacagtcttcattttcccttcgtggatcacggtgtcacccaccgtgatatccttgatgcttacttttacatgatgcatacaatcacctctgcgagtttagcaggttttgcttctggtctaactttcaacgcatcattcagattcttttcaaccattgctaccgcgtcgttttcgttgaaaccgttcttaaccaggactttaactactttggcttctaagtttttcatgatgcgttccttttgtctgtttcgtttcgatgtgtgtaatatactgcatatcgaaatttgggtcaatacccaaatcaaagaaaatcgtatttttcttttaatttttcgtaatacgtatcccatgcggcttcgtcgttgatgatctcagtaccgaaccgataagcacgtttgcgcagttcgaaacgttcacgaatgcgctcaacattgattttcactgattccggcgttggttgccaatctgcgcacaaatgacgatgaaacagggagtttgacagcggactaagatcgaaatcttcgtatgcaccgtccatgtattctttaccattacgcgcgaggtattcagcacgtaatgcagcatgacgatcgcgaaggtatcccagcttattgtaaaagaaggttacgtgtccggttcccagcgtatacacagcagggatttttgacaggttgatttttgccttaccggataaaacggcattgggaatgcgagggagttcgcgcagttctgcaatcaggtgttcgttcagaagaagagaaggatcgattgtgttaatacgtgtcatagttgcctccgtttggtatgtgcgcaatatacaaaaaagccccttgcaatgcaagaggctattaaaattattttgaaagaggtataagcatctttcgcataccgccgttttgtgtggcatcatacacgcgtttagcatccataagggagagttcaacatggtatgatttccctttcccgtcaaaatcaaacgttaccgtaccgcttgctacgcttacatgagtaaagatgaactcacccgcgaaatgctttcgaaacgctttgtcgtgatccaggaaccattcaaacgcttccccgtgctggtacagtctgacgataatcattgaaactatgacgaaaatcagaactgctgcgacgatcgtaagttctttcatcacttacccctgtttacagattgacggtgcagcacacggttaacgcgtggcgcttgatacggtttcattttgtacggtgttggatcagagtattcgatccggttcggcattgcgtacagttcaacgcgtggttgaatccagcggattgagtcgattaacccttgagttaacgcacgaccgaaacctacaccaactaaacataaacgcataatatccccttactgtgccagaatgtgaagccattcacctaaccacacgatcgcctgataagacaaccacaccgcaccggatacacacgcaatcacaccaatgatcgcaaatccgattaaaatgttcaaaccttctttcaaatcaccaaacatgtttcatcctcttttgtttcagtccctacaaaataacaaagcccctgcacgaatgcaagggctttttatcataattcgactaactgaggcaatttcagaaccatccccggaaggatatagcttgcattactaacggttttacggttcaacttagcgatagactgccagcgctcaccacaaccgtataatttttcagcgattgaatacatgctatcgccaggctgaacaacatattcatcgtattcgactttaacgaacgcggggttcatgagaatgtcaaacatctgcgcttttgcttcgttcagtgtttttgcatgtacagttttacccacaaatgataatttaatcatcttttcctcggcagactcaatggatcggtttcttcttcacttgggggttcttccagccccagcgcatatctcaatgaatagactatcatcaaaacatctttcgcgcaatcgtgaattgaattatgcatcacaaaaccatcaagcaaccctttccgaagaggacaggtcgaagcatcacgcgttaacaggcggttttcgatacatgtacgcacatcgcgactattccagaacacggtcggcatatcttcgaagatgtcgatcttaccaaccatcttacgcacgatatcaaccaggataccgcgatcgaattcagggccacgaacataatcgagtgattgccaacggctcacaccgtccgctttcaggtcttcaaagaattgtctgtgtcctgcatacagttccagatcttccggcgacggtttcaggatttgacgggcttcttcgctttgctgtttccaccaatcgatcgttgatttgtcagcaatgcgatccggttgctttttcaaatcgaacttatattttctcccccgcgaaaccagttccgcgaatgttggcgggttgtgggggtcgtcgataaacggaacgtaagacagttcaacgagtttaccgtttggtgacgggcctacagtttcatagtcccatacgtaatcaactggaagatgtgacattacgaatcctcttatattcttccatgaaaccagccagcgcaagggctactctgggagtgatatcaaactcactgatttcttcgttactcagcatctgcataccgaattgacgcaaaccacagttatatatcgactgttcgagtcgctttgtattttcaacagcttccacgaattcacacagatagtcataatcaacgtgtaacgggatttgctcgcggggtgtctttaaaatcaggtcagcaatcagatccgcatgaagacgagggaatttcatagagatatctgttttcatggtaagtaccacaggtctttgttttcgcgtaagttacgcatgacacgaagaatcatagtaacaacaccatattcttcatatgtaagttcaactgtaagggcgacgttaccccatgaataacttggcccattagggcaatacagatttttattgtagctgtcaatgtatttcagcttacggatcacatcagcaggatcgatagtgctgtacattgcaaacatggaatttgcatgagggtctttttcgcgaatcttttcgactgcgttcagaatctgctggatgtcggtaactttgatactcaatttcataataacctcataggggccgtagccccttatacatagtcaacggtgtaacgtgcgcgggttacgcccacatagattaactgcttacacagatcgtaatctgcgaacgcatacgcatcgcgcgtgtacatgtacgcatggtcatacgtgctcccctgcgatttgtggtacgtgcaaaccggaagaggcttaacatcctggaacttgtttttaatcgcccagaacgaatgccacggggctttatagcctgtttgttgcttgatgcgcttataagtgctcgcaacgtaagccagataattacccaaacggtctttcatcaccggatcaacaacaacctgaatctgtgcttcggtttcctcttcgagcgataccgttttcaggagatagaattcaagttcgatcttctcgtcgcacttctccgccttgataacttcccgacgcgggatgatttctaagactcggattttttcgttgttgttataaacaatctcagtgaagatctgcccgttcaaccgcatttcctgaactaacggttcctgcatcacgatcacttcatcgagaatgaaaggttctgttgttttgtacaggtgtttgcggatcgttgcgttcagcttgtccacgttgtcgttagtgtacgcgaacatgcggttctcgatcaagtcatccggcgttttaacacggcggaaatactgacggaggaagtcaacagcgttagcatgttggaacacacccagatcaccgacagacatcggtttcagcatcttaccatcacgtacagcccgtgaaacctgaataatcgggttcccttctgcctgacgcatgattttatccatacggataacatcaaagatttcttcatcaaagaacggggagagttcaacacgtccatcggcgtttaccggacggatctgatctttatcacccagtcccagaataacagcgttgcttggaatactgcgccggatgattcggaacagatccatatcaaccatcgagacttcttcaacaacgaacacgcgacaggtagacagatcaggcgctttcttgcctttctgctgttcgaacacacgcagttcttcgttagtcacagggctaatcttcaatgcagaatgaatcgttgttgcgtccattccggtagccgctgctaacacgtttttagcctggtgtgttggggcagttaaccaaataccgctaatccccaaccctttcagagtgttaaagacaaacttaaccagtgttgttttaccaacaccagggccacccgtaatagttgtatgaatggcgttctggatgttgtggataacgcgatcatgcgcggacttctgatcgtcactcagatcatcaaatgttaactcgctcataatttgagtaataccccttgaattttcgaattctcaataaaccaacgcatctcttttttctgttcttcggttgctggtagttgctcggttttgcggaagaaactgaaacgcggttcatccggcgtgtagttcagtttggtttcgtagcacttgcggataaaatctaatttatcttttgcaagttgcggtgatgcaaacagttccggcgttttcccgttttcaacgtatggaatagtaaagccgtctttgtctttcgtaacaatgatatagtatttgtcaatcattttcgcccctcatagatgacgtagaaaaaacctataaaccatagcaatgataatactatcaaagcggcttttctgtcaacaccgttaacgtggaaaacgcaccaaccgaagaggtacgttatcaccgcgcagacgatataagacaaagcaaatacggcatgtagcgcggtgatttccattagtagttgttagcccaacgacgcaggttttccgcctgtttcagagcatacagcttgtagatggtttccgcatccagtcccaacgcgaggaacttacacatgaagaagtgccactggtcaatcagttcaaacaagatttccagtttgtcttcttctttcatttctgcgaatacctgattgcgcagttcctggtgatttgctttccacggtttccagacaccggaagcaggttttgcgccgcgagacataccgcccagagcggtgtaaagttcgcgggtttcatctgcaatcgcatcatcttgcagtttcagccagtccaagatatcaccgcacgttttcaggttatcagggcgcggaacccatgaaagggtatcagacaggctttgttgtgcgtggttttgcagatccagcattgattgcagaggatcgccgttacgtgccagaaccttttgatattcggtatcaacaaattccagatcagcagggttaaccaggtgcgcacagctattaaacacaggagttttatcagtcatttatttgtctcttcattatgaaaattgccgaaaatctcttttgcggcatcattgtaagcggcttgtgcttcttcaacagttgcaaaagaacccaaatgttttcgtttgcccttatattgaatacttgcagaaaatcggtttccgcgagggtatacaccaatggaaccgcttgtgttgtttttacgtttgttaatgtgatttgcattgttttccgctgtacttgctggacgcaagttatcaggaaagtcaccaacatcaacgcctttgatatggtcaatcatatcagggagatacccaaaacgcgagtaaaatataacacgatgacgcatatatttcacaccttttgtttcgatgcgggtatatccctttttggtttttgtcccagcttccataccatttttaagccagtaaacctttccggtattgtaatctattctaaccttagtcagaagatcctttataccatctatttctttttcggacttcgatcccattggttgaatctcaactttgcagttaaaccggacactgtattttctttcagatacttagcaatgtctgctttggtagcaccatcacttttaatcatttcgttgatatcttttgacggccaggggcatttatcccataaaacgaccttttctccagcatcaatcaatttttttaaccttgcggtagtatctggatgatgtcgttcattgtcaagcacccaaacacgcatatttttatacggaacatcggacagcgccatttgtccgcccgtaatcgccccagcattatctacaaacaggctatccagcggcccttcaaggaaataaacagtcttcaacggatcgatggtatcttgaccatacactttcgttgagtgttcacatgctttgattgtcatgtattttgcgttggcattgtcacgcaaggcgcgtccctggaatgactcgattttacccttttcatcaaagatagggatcaccaaacgtggttcatccttcggtaaagggtatgcgtccgcattcacagagttaaccaggtgttgccattgacgcgtaaaccagaggcgatcatatttgtctttaggtatgtgacgacctgcaacatacttaacgatagggtgattttctggcaacgtgtccagacgttcgcagaactgcaattcaggaatatatttcttttcttccttcggcggttcttcgtgcgtctgttttaaatctttacgatccttgaaagattccatcaaatacgccgtataatcatccgggtaatagtctttcagaaacacagaaaacggcttgctgtagttgcagttaaaacaaccacacatcatatgtgtgcctcgttttgacggaaatatccagaaacgttttttgtgcttatccttcatggagtcgccacaaatcggacaacgggaatggatactgaattctccaccccgtcgaacgatttcgctttgtggtaatgatcccatgatacgagttgcgaactctatatcaagatacatgtttacctctatcggctaacttctttctctgtgccgtctaaagtgattttccattcatagaatatcttataaaacggataaggtctaggaatatcgacacccgatgaagtttttctttcgttcgtgtacacgatcgcggtgtcgctcatgtacttgatacggatcggaaaccaggtgtaattgttcgcagtaacccagatccggtaattcaaaggcggtaatggtttcattcttcactcttcatgattttacgtttgcgtttatatggacgcgtagaacccagaacctttggccctttgttcgtgatcgcgcctgtagtcacacccgaagcaatgttatccacgcttccgcctgaatcacctgcaaccatttcttcgttgagtctttcgcgaagttctgggaggttcatcatgatctcttcgtgttcttgctcggtcagattccaacggttccgtagagagtcatacgcgcttgtaaggttcatgaacccagacatataaggaaccgcgtttaaacggcgcttgatatgtcttacagagcgatggaacggggaatatgcttccagttcttccttcgtcttcgggtttttcaatacttccccttgaccgtcgatgatacccagcttgtaagccgtccattcagtccagggctttttcagtaggcgaatcattcgcacactgtaggttaaatccatgtttttgattaattgatcgctcatagtctttactctattgtgaaagtgaaaaggttttgcgcgggttctggttccggttcagggaattccatacagacaacttcacacatcggtttcacgcctttccattcttccagatagtatccggtatcaatgccacaacctggttgcatttcaaggccagtttcatcaagaaactttttgcatttcgatgttgtcgttgattcgtcctgttggaaataacgccgtccagagtaacggaaattcgcggacatctgcgggagaatgaacgtacccgcacgggcaatctgtgaagcacgttcaatcactttatattcaaattccgcgcccgtatacttacccttaaaatcggatgtctttatcttgccgaaaggcggattgctgatcgccatatcaaacatagtatcaaactccgtcgttaacgcgtctgcgttaatccaggtcgcttccggtacgatacgcttacccaacttatagtatgtatggtttaactccacacagacgatttcacgcggtttggcgtacatcatcatatgaagcatcgcgaaggatagcccaccgatacccgcgcacaggtcaacaacgcttccactggtacaagcatcaatggtgaaatcgcgagcaagtccgatcggggtaaagaatgcacccagttcagagttattcgtaaatgcaccttcatggaagttttcgataatgaataatttttcgtcgtaggttagcgccttgtcagactccaccagatccattatcttgttgtgttgtttggtttccgctttcgttaacttcgccattgaccttttccggtaataagaacagaggggtagattctaccacatcaaagccccagtcatcaacaatattgctttcccagtcgcgggtttcccacgggctgcaaatccacttatacaccccagcaggatcttcaacctgttcaggcatacccagcatttccgcattgataccttcgtccagatagccaggatgaatattaggccagcgcatgatatcgacatagcctttatcatcaaccgatacgatccattcggaacgatacggactatcgaactccggttcttcgtctggaagtatcatatctaataaatcactcatttcactaaaccttctttaacgccctctttcatggctttcagaacaccgataaaagcgtctttgccaccgatagcgccgatgataagcatcaggacaccaacacaacccgctaaaccgattctgaacaggttccatgcaaacgggatagccagaagcaccaaccacgggaacggaaatcccataagtgcgtttagaaccagtaagataaaagcgattgcaagtttcatgatgtcctcctttgtttgtttagaataaggtatcacctttcgtgaaggattgcaatacctatagatacaaaaaagcccctttcggggcttaattttatgctttgttgattagataccgaagaacgtttttggcctgaacttcgttacagcagagtttgaattctgggtcgattgggaggaagccccagaggaaatcaacgctaccttcaacatctgctttcccacttttcagcatttcaaccagcaaacctctgtttactacgctgttcactactgcatcgaaataacccgcgctgaaatccagttctgggttcatcacttcgtcgtatgggttgttcagtaagttcatttggtatctcctttaatccgtttcgttgtctacgggagtcatattatcacaatcataactcccgtcaacccctaatcaggattattttgcgttttttgcaatccagagagtcagtttagggaatacatttgccattgccaccacaaacagcacccagaaagccagcttaatcacaccgatcacgatcagaggtgcaaacacaagccaccatgaagcatttgccataaccccgattgctgccagtttcagagacaggaggatcaggaacacaataacgagaatctttttcatttcactatacctttggagggggccgaagccccgttaaaattgaatgtctgtactgtttgctacttcggctaacttactgcttcggttagtctcggcttgttttaccatagcaccttgtgcttcttcaagcgttttcggcatctgacgacctttataatcagattggaacccgatatcgctgttgtcggtatccatccagcgttgattacccttgcgcacttcgagtttgaagtggttaaagtggttcttatcgccgtaacgggatttgatctgcttgaacaactgcaatccctgatcagctaactcgtcggtctcaatcacagctaacataaagtcagcggtagctggaagaccagcagattcggcaacgtcgcccatgctgatatcagaagcatcccacgcggcgcgggtagtctgcgcaccagtccacattacggtattcgtttcaacagccaaaccgcgaagttcttcggcaatcgctttaaccaggatgtatgtgttttccgccccgcgtacacgggtagaagcacagatccccaggtagtcaacaataatcacatcaggtacgaaactcttcttcaatttaagctctttaatcagcgctttgaagtggttcgcgttcgcccctgctgttgggtattgcttaacgattaaacgcccgaccttcgactgtttgaggcgttccatacggttcttatagtccgcataggtgatgtttccgttgtcgatatcgtccatcgcaacatcaagcaggttagcgtcaatacgtttagaacaaacgtgttcagccatttccatactgatatacaggacgtttttacctgattgcaggtaatcagcagcgagagaacaaagccccagagatttaccaacgttaacaccagccattaagatgttcaatgttccacgttctgcgccgcctttagtaatggcgttcaggatcgggatattgaaagcaatcttcatcgctttggactggtaaagcatccagcgtttttcatagtcttcgaagtaatcatgaccgaccgaactatcgaagctaatcgctaacgcttccgccatgatgtcagggattgccccaacgtcagggattttgttgttgcgttcgccagcaggtttttcagcattcgcctggatctcaattgcacgggacagagcgcgatacattgccttgtcacgacaataggtttccgtttctttcatcaaccattccagatcttccggcgcatttttcatgctgcggatcatctttttggtatcttcgtagactacatcactcaggctctttttgtccagagctacttctaaagcagtttgtgaaggaatgctgttgaattcctgtacgtgcttatccatcaaatcaaagagaatctgcgcgttcccttcgaaatattcacggcgtaaatggggccacgcctgaacaaaatacgtaccattaaaaaccagatttgaaaatattgtttcgacgatcattattacctcttaaaccagattagcgaacatctgaaagaaattatacagctttactttcaacgccgcccataaggtcttttcaggctttgggagattgggcttgatctgcgcgtagattgcatcgtgaaccagcggaatcagtttttctttgtcttcgtccggcgtactaaattcgactttcaggccgttatcccaatacaccttatggatgtacactaagtgtgcaacatcgttttcatcgttgatcaacagttcttgaataacgtcctgcattgcttcatcaagaatgttttttgttttttgttcaatgtccatgattcacctattaaaagggggcaaagcccccagttgtttattactcttctgacatatccacatcatcagggatatcgtcatcgagatcaaatttatttgacggttctacttcatcgtcagaataaagatcttcgagtgctgccccgtcagtgatctctttgtcaggaatacggtacttatcctgaatagcatcaaggaatggttggtgagtgaacagaggtttccagaactcaatagagttggtttccgattcacgccatttcttttcttccagttcaagttcgcctgtttccgtgttcaggaacgcacgaccgcgccagcctttcgttggagtctgaacgaagttcatttccatagccagatccagaagaccagagaacatactgataccgccctcataggtaacatgaagcgggaatttggatttctctttcacgaaacgagatttctcgatgttcatgatgaagtcataaccgacaacttccgtaccttctttcacctgctgtttgcccaggatgatcgcggtgtctgcggaatacatcagaccagtaccaccggaaatgactttcttgctgtacatttcttgtgtgtcgtatgtgtgacagatacacaccattggaatatccagatccgccaggtaaggcgtaaccatacggaacatacctttaagtgctttagcgcgggtcatgtcctgtttgtcgttgtcagacagggcatcagccagttcttttttactcgcggtgttgcctacagagtccacgaaaatgatcactttgtcgccacgttccagcgcgttaagctggctcacaacgtcatttcgaagttgctcaactgtcgtgatacgagtatacaccacacgatcggggtcaacgcccattgatttcaggtaagacttagttacgcctttctctgaatcgtagaacagacacacagcatcctcattcgctttgaggtacgccgcaaccgtcaccagccccagattcgatttaaagtgttttgacgggccagcaaacagagttaagccggaagtcagaccaccatcgaaagcgccggacagcgccaggttcaggatcggtacacgggttcgagttttggtgatgttattgaaaacatcgctttcagacagaattgacgcagattgactattcgagtttttgatcagttttttcaggagtgctttattagacatttatttttccggtttatatacacgcataatatattcctcacaaatttatataaatggggcatttctgccccgtcaggtcttaccagtcatcaccgaacagagtgttcagggatgcgcgtttttcgtaatcaattttacatgcttccgtgatgttttgcaacgggctaatcacatgtttttcaaataatccgttgtagtcaacccagttgagaatatcactttcgatctcaacaggtaaacgcgtaccggattgccatgcgatgcaatcggattgccacgggtttttatctcgcaacggcagaaccataaccttctcaccttccataatcggggtaattccttgaaaacccttcgtatatcggttaaagaacagaacgcctttgatgtggtttggtgtccctttgattgggtatccaaaatcatcacgatattttgagatattgttagcagatgatacaccagctatttcgcggtagtcaagcgccttatactcttcttcaaatactttgaagtgttcgtgtaaggattcttcaccttcttgcaggatgcgacggatcgcttctttcaagaactttttaaccgctgtcggtgtactacttcgctgggtttccattcccatgatctttaatttaggtttctcgtagcgggttccttcggagtcccatacgttagccgcatatcgtttcttagccgtccagaaactacccagacctttcgatcccagaggtggaccagaaatgatttcgcgatccataaacatcaggtgttcgacgttgttcatgtactcgcacagttcgcggtagcccttatcaatgataggttccatgcgttctttactgaacttatccaggaagtcaacccaatggttgttatccctgaacttactttcaccgccgactttcgcgatcacgttgtccatacaaacataaatggagtcggtgtcacagtaacgcacgtatgcgtaatccgtggtgttgcacagttcgttaaggtattcgttaaccttacgctcaatccactgaatagccaactgcccgaacatggtgatcgcgctggcgtttcgaatatcgaagtaacggaaatgttcgttacccaacgcaccataaagggagttgatactgattttacggttaagctgtgcggtgttcgcctgtgcgattttcttctcacacactttcttcacggctttaagcatttgcttagacagagttttcagtacagcttttgattcatcaccgaaatcttcatagaactcgaaatcagggttgatcatttggctgtgtgcgtctgtcaggtgttcgagttcgtgcttaatcagttcgagatttcgctcacccgccatcattctttttttccacgccttacgctgatcaaatactttcttgatctcgaccggaatcacgcctttaacatcgcgtcggaacatccacccgttaggagagcagctaaattcatcgctaggacgcggcgcagtcttattgatgtattcatgcatcggacgcactgcaaagctgttagcgattgtctcagggcttatattcacctgtcggatgatagatggatacagactggtcaagtcgaacgatacaatgtaacggtatggagcgacaacaggatctttaacgtatgcaccatcatacggcgttttagtatggcgtttgttttctgggattactttcttctcttcacgcagagagttgtaaatgattgcgtcccacgttttaagcggtgacataaccccagggaaattgattttcgcgtagtatgctacagacagaaccagttcgataaagttgcgtttaccgtcgatatccaacacgcggataacgtcaacgatgttatacgtgatgtatttctggtgatccgcttgacgcagttcagacagcgaaccttcgtaatcaactttgcttttacctgtttcgaactcagcgatcgcgcccagagcgtaagttggttgcggggtgaaactgaatttcttatagagatccattccatccatttgagcaacgccgtaaatctcatagcccagttgttcgttcccgtaatggtcggttgttgtcttcgcagtcactttcccgaacgggctgaaatgacgaacaacgttttgcccgaagatattcaggtaacgggtgatgatatacgcgatatcgaacttgtttgagttccagcctgtaacaataacaggtgtccgctctttccagtctttgatataagccgacatcagcgacttttcggtctggaatgaacggtaaacaattttcttcaaatcttcttcgctgatctcgttttcggtatcaacttttgacgctacccactcgtctaaaccaccctcgacaagatcgtacacaaagaatttatcttcaacgctgtcataatgggtgattgcgtcgatagcatattttgcttcgcgtggatcagggaattcaggcgcggtaacttcgatatcaagtgaagcaatgcggatcttttcgcgatcgtattcgatttcctttctgtaggcatcggagatatacgccagcctgaaatcatccatgcctagcgcttccatgcctacatctttcattcgctgcatccagttttttgcttctttaatgctttcgaagttctttttgatgcaggtcttgccgtaaatgtcgcgatatggcgagtctacacccgccatagcgtgttgaaacattgtaggcgcatattttgttttgcgaacctgttcgcgtccctcagagtcaatgaagcgctcgtagatgtgatcgcccatttgctcaacggatagataaaattcattcattacggttttctttctccgtgtttaatcgtgacaggaatgataccccagccagcttgatcagatcaagcgagcgttgcgctaatttgtgatagcgttgggtgtcaggccgatttagttgttcaaccagcacggtatattcttccatgatgcgggtatagaacttagggaagtgatcccgcgcgtatgcgtaggtgcgcagatcagagagattgcaagtaagagacagtttgatgtcttcgctatgcagacggttgatcaagtgatcaccggattcaatagctttgatgatttcttcaatacgaattttcataatttagtcctcacaagtggtgtacaaccaatataacaaagcccctgcatttctgcaagggcttttgattaatgtccgatccggtacttgtatttcaaagtccattcagctttttgtgcgtgagtcaatacgcggaagttgttctcttcggagaatttcagatccggcgtaaggatggaaaccataccccactcttccagaagtcgcgcaatgttattgcggcgcagttcgtcatcttcggtcatgtcaacctggcgaccgtccagcttcaacagttctttgaagtgtacgataaaataacgcccttgtttctgtaggatgtggcaagactgccacagcattttctttttgttatttgcgatcccgatacgggtcagcgtttcgcgaattttcaggaaactgtcatcgctggacagtttaatttcgagcatgttcatacatcaccatttctttattagttgttcaacctttttctggtcggttttatttttcacaacatcagccaacacagataaagcaactttcatatttttccgcttccactcgtccagtttttcaagctgtttgagttcttcgtaatattccattgctatacgtgtatttacaccgtatcgtttttggagaacatgaaggataactttcatttcgttatcttcggtgagtttagcccacgccccgaaccgcttacctttgcgcaccgtatgcaggtaataatcaaagtgcgcctggtctggtaaaccggaaccgatcatattcatcgtgtatgcagggatcagcgtttcgatatgctggctcattgcattgtcgatgaaaaacttatcgtatgaatcaagggcagagatccgtaatggtgtcttcccgttgttcagttcttcgagcaccataaacaaggtgttttccttgtctttggtgtactctttcacaagttcttcgatcttgtcccagtctttagaacgccaggccgcttcatgttcgttcagttcttcttcatcgagaaaagcagccagtgacatttttaagcctcccacgcgagggtaagcattaagcccatgaacaggtattgcaggtgaatctctttgttcactgccagcccgtactgtgcgttgttttcgcctactgcctgaatgagtgcaaccttagattcgttggtgacgatcgggtataccgcatccagaagtttagccaggaaagtttcatactcaggcgcgtacttgattgcttcggctcgcagtgctttgaagttcttcgctttaagcccctcaatcactggtgtgatgtccgaaccaacaatctcagacagaataccagcatcaattttgccacgcttagaatagaacccaagagctttaacgatggatcgcgcgtctgggtagtgcttcttaacgaatccggcgatcacctgctggtcatattcgattttctcgatttcgaggataccgaaacaacgtttgatcatttgcttcatcagttcaacgcgttcttccttcgacggggaaccgaacttgactaccggacagcgggagatcagcgcagggtgaatcccgttgatgttgttcgcggtaatgataacagtaacgttcttgctgtacgcttcgataaagctacgcatgtgcttctgtgcttctgccatgccagggcgatcgaattcgtcaatcagaatgattttaccgcctttcttctgcgtcatagaggacgcgtaacgatccagttcgttacggatgaagttcacaccacaatcggaaccgttgacaaacatcacttccgcatcaacttcgttagccagaaccagcgccagcgttgttttacccgtacctggggaatcagaaaccagagtcatgttgtcgatgcgtccagacttgatgaagccgcgcatcgtcgctttatcagcagcagggagaatgcattcatcgatcgtcgtcgggcgatagcgctgatcccatgcgaattcttcgggagactgggagattttgccgtatttggtttcgattaactgtacgttttcactaagttccataatattaccttcaattgattatcaaaaaggggcttaacgccccttgtgtactactttgtttatcttacttgaactggctggttgcttcaagtaccactacatacgcaacgccgttttcggacgagaatttcgcagcgccgcgagaagagatttcaactttgtaatcgctgttgatgaactgcatgttgtcaatcttcatatcgaagttgaacatgttatcaccttcgtaatcgcccacttctacagagaaggttgactggctttctttacttttcgcggtgattaccagcttgccgttgattggctcaacagacaggtcggtcagtttcatcatgcgtgacgctttgatcagtttttcgaaatcgttcgcgctaatctggaaaatcagatccgcaactggcatttccagacgcttcttaggctgtacgattgtggttggatcgcttgaacgctcaacgattttcattttctcaccacgaatgacgatttcgccagtggacagatcgtgagttacttcggcatcagtgcctacaacgttcagcatgttcaggaatgagttcagatcgtagatacctacatcttcgtcaattacgtcagaaattgttgcttctgcgtaaactacgctgttgatggatttcgtcataatgaacgaaccctttttcagcattacagacgggttgatctgggagaagtttttcaggatgtcgatcgtttgtttagagaatttcatattcaacctatagttttcaattaggcaaaagtgccgttaatcagggattctacaacgcgatccgccgcattgtcaaggaattctttgcttttggactcgttgattttcgtacccgcttcgcgagcgtcgtgaatcagtccggtatgtactgcgcttactgcttcgtcgatccgtttgtaatgctcaaagcgttcagcttgaggcatcgcacggaaaatctctttgatgttttccggcactttacctacccaggatttgcgaacgttgttcagatgcgctacatatacgttttgttctaaattcatatctacctcaaactttcaaaattgggggctttcgcccccgtaagcattacagatccagcagtttatccaggtcgtcatcaccggaaccaccttccaggtcaaacggaggtgtattatcatcttccggtacgcttccgcctacgttcagttgacttacgccaccagattctttagcaccgttggaatggttgccattatcgaagtttttcagttcgttgtcaaatgagttcagttctgaatccagatccgcaccagcgcttgcgccagcacccattgcagcaccaccgaatactttggtgaacttcgcggtcagttccgcagttggtttgaactggtctggagcagtgattggacgcagatcgctcataccttcgaagatttctttctgacgcgcttcgtcttcgatgcctttgattgggccaggaacaccaaatttgctgtcgtcgtagttaggccagtcgcctactttcttcgcggtcagggtgaagttagcgccaccaaacggacaggttacagcaacacctggttcatccagatctgggttccccgcgatagccgcagtgattttatccatgatctttttaccgaagcggaacttaaacaccttaccttcgttttctgggtgcattggatctttaaccaccagaatgttcgcccagaacgattgtttacgtccgatcatacccagtgttttttcggcttcgctgcctttcactttcgctttttcgaacagatcgttttcagagatatactgacacacagggcaagcatcgtaatcgccgtgggtagacgggcagttttcgatgaaccactggttattctttttgaatgaatggttgacgatacgcacgaacgccagttcatcatcagatcggttaggcaggaagcggatcaccgcagaaccgtttttctgtgcatcgacaccgagtttccactctttttcatctttctggaagccggatgaacctttcagagcggcgacttgttcttgcagtttggttggatcttgacgtttaaagaatgacatatgttatttctcgtttaagttaattaaggtttgtttcattaagtttcggtattttacgatttcttcgttactgatttcaactaattttctgtatgcgtttagttttttgctaaattcattccagacgaaatccgttgcgatttcatcgtgtttatttatgatgtctaaaaacgagtcgaggatcaagaatgattcataagaaatcaccccagaaagtacgagcttgctgatatacgaggttgatgatttgacgctatactgaaacaccgttgagaggggaatacctttcatgcgggaaaattcatacaggttttttacatcgtccacgaaaatattatcaattcgcctcaacttgcctatgtattgacgataaaacacgatcgtatcttcgtctacatccccgacccagaagtcggggttagctaccatgttggagagaagtataagatatatttctttgaatgtaaacctttcggctaactttttgaaaaaatacttatctcttctcttttcgaacgctttttcagtgatctttatttcccatttgtacttgatcgcgtcatacttcccagcaaagtgatttttcatcaccagatacagtttgtataccgcgatcggtttcaaacgggaattagcgtctgaactgtcaaacggggttttaaatttcacatgaaatcatccagtgtttgcgtcgtcgcgtggtctttagccacagaaggacgcagcagattgtttttaatggcttcgtcgctaatcttgtcgatgatcgctttcggtactgttttggacagcatagcataatcaatgctgttttcgtccatccattgtaacgtagcttccatgtaggttgccccctcagaggcaaccagattttcgatatacaagccgacttcggttttgtttccgatttcgctcatattacgccttatcgatcacatcgtacagttcgataagttcgttgttctgttcttcgaacgcggtacgtgcctgttcgtgatacagtttgaacagcttgccgaaggttttaccgtcgataccataatccgttttcgctttggatttgatgtctttgaaagaaccctggaagtgttcgatctgggttttcacgttcgacgcttctttgatcagttctttaaccgctttagcgatgtctgggttttcttgcagtaattctacactcattttgttacctcaaaagtcacttagtttttcatacatacgggtaagtttgcattccatgaagtatttctccatttttgctttgttcccgatttttggagcattgtacgcttcttcgattgccgttgcaacatctttcggaataaaatcaaagtcgcgaagttcttcgttttctctgtaacggatcgcccactcttcgggcatacccacggtcggatcgtccgcttccagccaggcttcgagttcagcagccctgatttgtggggcgcgttctccttcaaccttcgtaacaatatagtcatttcgcattttaatgcaagcgatactatcttttttatcgcccttgatgatcttcatgcgcaaatcgttacgaggtgaaccatatttcggtgtaacccatttcttttgggttggcgaccactgacgcacaccctgatatttttgaagggctgcaaagtcaccatcagcagaaacgatcaggacacgtttaccttcggataccgctttacgcgtcaccacaccgatcacgtcatcggcttctgcgaagtcaacacggatacctttgtacggtagattagcacggatttcatcgtatgtcgggtgaaggaaaccattcaggcgatcccagtcccaatccgatgcttcttgttccatttttcgtttctttttgtagtaccaggctttacttctgcgccaatacttgttatcatcaaaggctagaacaatttcagggtactcgcctttgaatttaaccacattgtgacgaatggtgtcaagcactatgtgacgaacaatttgttggttgatgtcattctggtctttcggcttgaagttgttcatcaacgttgctaccgaaaggtttgaaatatctatacacatcacatcaacaggatcatcgtcattgctcattaagctgttcaggttgaacatacttgcaaatgaagacatttcaatacctcgttgttgttgaatgaaactgattatagtgatcactttttcaaagtcaatagatcatttcaaaaatctgagcgaagcgaaggacacgaacgtagtgagtgtctatgtactgaatgtacgttttaatatttttatattttatatatagagaaaacagtacatttccgtatactttttaaccaatttaactatccgtttcgcttcgctcacggaagcgcttcgcgctgattttattaaataatatagattggaagtaggtttgaaacacctgattcaatcggctataatgaatgtattcaatttggagaatataatgactacaaagatttatgcagataatgataagctgtatccagttatgtgtaagtggaaacagcaaatccgtgaaactggtgatcgtaagatgccggatgaactcggtattgcgattatgaacattgctcacggtttggcacgtcgatacaacttcaaccgttattccgaagactggaaaatggatatgatcgacgatggaatttcggcaacgatttccggccttcataactttgatgaaaccaaatatacaaacgtctacggttacatcaacaaggcttgctggcaagcgtttgtaactcgtattctctacgagaagaaagagaacgcgaagaaatacaaatacttcctggaacatgtctatgacagcgatgatactgatatgaccacgatagccgatgaaactttcattcaggatatccatgacaaacttaatcagtatgaagagtccgcgaaaaaacccaaagataaaatcgaggttgtggacgaatcgccaacattggaaatgtttctatgaaaattaaaattgacctgaacaaaattttagcagatgctaacgacgaaattgatctgcttccttaccttgtgaaattagagttgcagaacgtcggggttccgattatcatcgaccctacagatgtacgagatccagacttccagatagcagaaggtcgtctggactatgtaataaacgccgaaacaatgatcatggagatcacctactatgaacgtgcagcatgaagtaatcgacgaagtacaccaaaaatcagcgctggatcttcgtgaagaagaactggaatccatcaagggtacacgcattgaacaggaagccctacgcaaagcacaaaagttcatgcggaagaacaaagcggaatggaagcgactgcataaacacgcagagaacgcactcttcgaaggtaacaaagagcagtacgtatacgcgatcaaaaagatgcgtgatatgctcaagcaaccatacaacgatgaactgattgaaacgatgtggatcacttcgaaccagcagttgaaagacctgttcatcatggcttctgaaaaatacggcaaataaaccccttcgggggttttgaggtttatatgaactatgttttaattggggatacccatgccggacttcgccaggataacccctggaacgaagaaaacctgtatacggtattcaaacagatcgtagagtattgcaaagaacacgggatcacgcgcggcttccatgctggcgacttcttcgacgttcgaaaagcaaccacacaaacgacaatgaattttgttcgtgaaaagctggttcctcttctgattgaggcggggatcactctggatgttcttgtcggcaaccacgattgtcaatttaaggacaaaatacgccccaacgcgccacgcgagatactaagtcaatacgaatgctttaatgtcatcgacgaaccgaccacggttgatttaggtggcggaaattcgattgacctgatcccgtggatttgtcaggaaaacagccagcgtatttttgactacatcaaacaatcgaaagctaacttttgtttgggacacttcgaactgtctggttactatttctacaagaacagcaaagccgatcatgggctggaacctgatttcttgaagaagtacgatcgtgtttactctggacactatcaccacgctaacgagggtgataacgtgttttatatcggtacgcctctgactatgagcgcaaacgacgaagacgaaacacgcggattctatgtgttcacgggcaagcctgaattgactttcatcgctaaccctgtgtgtcaccatcgccggatcatgtatccagcacagaaagatgttgatctcgaacagttccgcaactgcgcggtgcgtctgattgtcagtgaaattgatcaggggcttgcaaagttccaaaccaaaattgaagaaattgcctatgaaatcaatatcatagacaaagttcaaacagattcggatgtcgataccgactttgaaatcaaaaccgttcgtggccttatcactgagtatatcgccaacatgcagatcaccgacgatgaaaaagaggaagtgaataagctgatcagcgaactatacgcggaggtgtcaagtgcatagccgttatgatgaatatttcggggaaaatccccgatattctcacctgttgcgtatgttgggaatgaaacacatcatttccacatccgacgaagcaggggaaaccagcgcagtttgtttgaccatcatgaagggtgcatggcattcatcacgaacatggtcaatattcatgcttgatacactggacgacgatactctatcatatagtattgattcatcagttgttcaaatgatcactgaattatgtgaacggattttaaatgaaactaaacttcaaaaaaattaagtatcaaaatattctgtcggttgggaacaccccgatcgaactggaatttgatacggcaaagaaaaccctgatcacggggaaaaacggtggcggtaaatcgacactgatcgaggcgttaacctatgccctgttcggtaagtcattccgcgatctaaaagtcgggcagttggtgaacagcgtcaacaaaaagaaatgcctggttgaactggaaatcgaatacgggaaagactcgtacaaagtggtgcgcggacaaaagccgaaggtattcgagatctggaagaacggcgagaagttgccggaagactccgcagcgggtgattatcaggcacagcttgaatctatgctgaacatcaaccttgtgggcttcaaacaggttatcgttctgggtacagcgggttacactccattcatggaactgaaaacccccgaacgccggaaactggttgaagatttgctgtctctgtccgtcatcagtgaaatggacaagttaaacaagtcatacattcgcggtgttaatcagcagttggatacactctcaatgcagggtaatcacatccagcagcagatcgcaacacaccagcgcttcattgacgaacagcgagcgaaagcaaaccagaacaacgcccgatacaaagagatctacgatagccacgtagaaaccgcaaagaacatcaaagcacagcttatgcagttgcaagcggagattgcggaatcggtgatcactggagaagaccggacggaagatatcaacaaactccgtgacggttattctcggctctcaatgactgtagaacagtttaaaaagctggaggtgatgtatcagaaaggcggtgagtgtccggcctgtaagcaagcgattaaacccactcctgagcgtatggcggagatcgcagagaacatcaaagcgggtacacaacgtttaaccctgatcaaaaccaaacaggacgagttacaagggatcatgaatgacttgctgcaacagcaacgcgcactcaatgccctgaaaaccaaatatgaagccctgaaaggtactctgcaaaacgaagttgccaacgctaaacgcgcacaggcgatcatggaacaggcaagcgcggaagtagtcattgatgaagaacccgtgaagcagttgcaacagcaggaagcagaactgaacgaaaaacgacaaggctacgtcaaggaaaaatatattcgtggtattgttacggatatgttgaaagattccggcgttaaagcgagtatcgttaagcgttatattccgtacttcaacaaacagatagcatattatctggatctgttgggtgctgattatcagttcactttagatgacgagttcaacgaatcgatcaaatcactggggcgcgatgatttcagttatgcgtcattcagtcaaggcgaacgcgctcgcatcaacttgtctattctgttcacatggcgtgacgtgacaagtaaagtatcaggcgtggatctgtctctgctggtacttgatgaagtgtttgatgggccacttgataaagagggttcattcgcgattaaatccctgctggattctgtagatggtaacgttattgtaatcagtcaccaggatcttgatccgcaggacttcgaccgccacatcatcatgtctaaggttggacggttcacaaaaccatcaatcaaagatatggcgatctcatgttagaacgtgaatttgatttaaagacctctcccgaagtggagaggttttatctccataatgaactattggaagaaaaacatgtagttacaatggcagatgttgaggaagcattcaaagataaccccattgaattgacccgcatcaagaataataaatcttcggtgtggttcctcgaaaaaatctattgacagtaaaacataaataccttaaagtcgcccgtgtactgagttgcacgggtttttattttgaggaacggaaaaatgattaacgaacaaatgtcacacagcgaagcattgaagattttgggcgctactggcgacgaatctaaagctgaactgtcaaaactctttaaacgtgcttctctgcgcaatcaccccgaccgtggtggtagcactgaactcatgcagaaaatcaaccaggcgtatgacgttgtaaccaaaacaaacagcgctggtaaaactttcagtgatgttcgcgcagaacacgcagcaaacaaaaaagcatgggaagaaaaatttgcagcgtatttcgtgctggcgaaaaactatttcagcactaaattcaacgcgcaagaatttgcggaatatttcacgaaattcaccggacaaccaacaacctatacccagacaatcagcgaagttcgcggtcacactgttcacgcaacctatcgtttcacttctggtgatgcgttctttgacttctctttctcttgtcaaccgcctaacggtcaaggtttagcagcgccggacgcgtccgcactgggtagcgtatcagttaatactctggttctggttggtacgaagaaacacaaaatggcaagccgcgattaccaatggggcaagaacccagacaaaatcacgccggaaagcctgttccctactaagaaactggaatccatctttagcccgactaagaaggatctcaagttcaaacgcgcggactacatgacatcctttgcccgtatcctgggtgcgaaggttagcggtaacgatgttattgttgatgttggacactataaagttcacttctaccgtcacgtattcatgcgtaaaggcgcgtatgtgttccagtatgttgttgacccaacggtgaacaaattcaaacctgctgaacgtctgaaaggtactatgctggaagatgaagacggtgcatgtctggatatgatcatcgacactttcaaagaaatgcagaaagtgaaaccagacgcaagcggcatcgcagcggtaatcgaccggatgaacgcagagtttgcagcggggcatcgttcagcatcttttgttaaacgtaccgcacagcaagcagcagctccagcgccggaagagaaaccaaaacgcaccgttaaccgcatcaataaagatgactatttcaacgcactgaaacaagcgggggcaaccttccgcagtaactacggtgagtttgataacggcgcgggtttgactttccacttcaaacgcgagatcagcaaccgtaaaggtttctggagtttcagcagctttgatttcatgcactccggtcagaaacatgtggaatggttgaaagatatcgacattgacgaggatagcaaaggcgcaagtatcggtttgctggttgataccctgaaacaacttcgtggtgttgctgactggtacacagcccgtaagatcctggaaggtatgcgtgataacttcaaggctggtaaattctccgcacctcatgtgaagaaagaagccgaacagaaacgcactgaaacgcaagctaaggacgagttaggcgcacagcctacgaaaccacaggcagcgaagaaagaatccccagcggttgataaggcgcatcaggcacagatggatcgtgagaagtcacagatgaatgcaaccattcgttctatgctctctgccctggttaaagccggacgcaaagacacaccggaagaaatcaaaaaagcagttgatgaagcaatcgctctttggcgcttgaaacactaactggttatgctataatgggaactgttgaaaagcagttcccttttttatgaggtgagtatgattattcaggtatcggttcagggcaacactctgacagtaacaaattccattatgaccgctatggctgcatgtcgtgatcatgtgatgtcaaaccctccggtaacggaaattctggaaattgatgtatgggaagacggtgtgatcgaagaatcctttggtttcactccgttagaggaagatttacgcaaaatggaacaatggctatggcaaactgtaccccaatgaaactaccaaaacacacaaccctgttaacccgcgaaaaacttcattctgttgaatggagtccgttagatgtgatggtgttcgatctggaatccaaaatcattaacgcgcatgttaacggattgagtatcttttctgttgaatttgaaaagattcgcgggtataatgaagcctgtaaagacaaattgcgtgtcatggttgaagctatgggctacatcgtgactattgaagacaacaaaatgtggattgcgctatgagcaaagtaaaagcagttttcgccgttggtcatgatatgtacgaagtggactatgctttcggttatgaacagggtttgccgtggggccactgcaaagaggatttgcagaacttcaaagcagaaaccgcaaatagcgtcctgatcatgggtgcgaacacttttacttctctgcctggtaaattgccagggcgagttcattgcgttctgtctgcatccggtcaacgtttggtaacgaagaacgggaataccgctgattacatcattcacggcggcgggttgtctgctgcaatcgacgtgatgaaagcaacgcatccagatcgtgatgtgtgtctcattggtggtaagtggttgcttctgcaagcaatcaataatacactggttgatgaagtggttgtgacccacatttacggacatcatgcatataatgcaccagcttttaaacgtgatgtttcgttcacggttcctgaattctgcgaagcggttctgaaatatgaactgactgatttcaaaattcaacagatcgaatcaaacgaacgagtcagaaaaattatcgtcgatcgacatacgaaaaaggcataaaatgaaacaatatcttgatatcgtcaacaccgttctaacacacggtactgaatcaaccgatcgtactggtgttggtacactgcgcatcttcgggatgcaagcacgttggaacctcgcagaaggtttcccagctactaccagcaaacagctattcttcaaaccgtgtaagcatgaattacaatggttcctcgaaggttctaccaacgtggaaacactgcgtaaaatgacgtggggtgaagatagcgataagcggacgatctgggacgataactacgaaaatcaggctaaagcgctgggttatacgcatggttatctgggaccgatctacgggcatcaatggcgctcatttggtgcggaaggttcttattatggtgttgaccagattaagaaagtcatcgaacaattgaaaaccaaaccagacgatcgcgggatcatcgtttctgcctggaacccgatggatctggatgatatggctttgcgtccgtgtcactgtttcttccagttcgtcgtaatcaacggtaaactgtctctacagtggtatcagcgttcagttgatgtcttcttagggttgccgttcaatatcgcctcatacgctctcctgacgcatattatcgctgatatttgcgggtatgaagtgggtgatctggtttggactggcggtgatgtccatatctacaaaaacgcagtagaacaagcgaaagagttgttgaagccggaacgcgcaccgcttccacttccgaccctttatatgccgaaggtaaatagcttacttgatttggatcaagaattctttgactccatccatttgaaagactataatcaccacggctcgctaaaagcagctatggcagtataaacaagggggcgaaagcccctttcttaacaaggtaagataatgagtgatattaaaacagtagtgaagtcttctggcgtaagtcaaacgttcgaaaaagaaaaactgttcaaagtccttaattgggcgagtattggaagaaatattgatgttaacgcattccttgaaagtgtcgttgacctgcttcgtgatggtatgactaccaaacagatccaggctgtagcgatcaagtatgcagcggatcgaatctccgcaaaagaacctgactggcagtatgtagcggctaacctcgaaatgttcgcccttcgtaaaaccgtttacgggcagtttgacccgatcccgttctacgaacacatcactaagctggttgaggctggaaaatacgataaagaaatcctgacaaaatggactcctgttgagattgattatctggaatcaaaaatcaatcacgataaagattttgaattctcgtatgctggcgttcagcagttgatcgggaaatatctgttgcaggatcgcacgtccggcgacatctacgaaacaccacagtatgcattcatgctgatcgcgatgtgtctgcatcaggacgaaaaacacgctgataaaatcagtcatgttgttgacttctataacgcgatttcggatcgtaaactgtcattgcctacgcctattatggcgggtgtgcgtactcctacgcgtcagttctccagttgtgttgtaatcgaatcgggtgattctctgggttctctgaacgctgttacgtccgcgatcgtgaagtatatctctcaacgtgcgggtattggtgtcaacgccggacacattcgcgctatgggttcaaaaatccgtggtggtgaagcagtacatacaggcgttatcccgttctggaaacacattcagacggcggttaaatcctgttcccagggcggtgttcgtggtggtgcagcaaccctgtattatccgatctggcatcttgaagttgaaaacctgctggttctgaaaaataaccgtggcgttgaagaaaaccgtattcgtcacctggattatggcgtacagcttaacgatttgatgtataagcgtttaatcaataacgattacatcactctgttcagccctgacgttgcgaacgatcgcctgtatgacgcgttctatcaagcggatcagactgagtttgaagaactgtataccagtctggaaaaagacccaacggtacgcaagaaacgcatcaaagcggtagatctgttccagttgcttgttcaggaacgcgcacagaccggacgcaaatacattttcaacagtcatcacgtaaaccagcagggtagtttctctgttccggttcgtatgtcgaacctgtgctgtgaaatcgcgatcccaacttcaccgctggatgacgatgataaactggctggcgaaattggactgtgtacgcttatggcgatcgttctcgataatgctgatataagcgaattcccagcccttacacgcatcgcagtacgcgcactggataacttgcttgattaccagaactaccctgttgcagcggctctgaaagccaaacagcgtcgttctctgggtgtgggtatcaccaactatgcatcctggctggcaagcaactattgcgactactccgaagcatacgccggaaacgttcatgagttgatggaagcgtttcaatttaacctgctggttgcctctatggaactcgcacaggaacgcggtgcatgtggactgttccacgaaacgaaatatgcacaagggctgttgcctattgactggtactgcaaaaacgttgatgaactggcatcacctgtgtataactgcgattgggaatggttacgcggtgaaatcaaaaaacatggcttgcgtaactcaacgctttctgctttaatgccttgtgaaagtagctcgcaggtaagtaactcaaccaacgggattgaacctccgcgcggccctgtgagtgtgaaatcttcgaaagaaggttcattcaatcaggtagtaccaaaccagaataatcagattgacttctatgattatctctggacaatggcaaaacgtggaaacaaaggttatctgtcgcacgtagcggttatgcagaagtttgttgatcaggctatctctgcaaacaccaactatgatccggctaacttcccagatggtaaagtgaaatctgaaatcatccttgaagatctgctgtatgcaaactatttcggcatcaaaacgctgtactaccacaacacccgcgacggtgcaggtgaggaagaagcggaagattgcgaaggttgcaaaatttgattcaatgccccttcgggggctttttataaggtaaatccatgttaactgtaatgaacacaaacccagatcacaaacacttagaacagcctatgttctttggtgaggatacgggcgtagcacgatacgaagaacagaaacaccgtgtattcgaaaccctgactgaaaaacaactgtcattcttctggcgaccggaagaagtggatctgtcgatcgaccgtatgcagtacgcgaaaatgccggaacacgaaaaaatcattttcgattcgaacctgcaatatcaaaccctgttggataccattcaggggcgcggccctaacctggctttcctccctatcgcttccgatgtctcgatggaaacgtggatcgaaacatgggcgttcagtgaaacaatccatagccgcagttatacgcacattcagcgcaacctacacatcgacccgtcaaaagagttcgataaaattctgcgcaacgaagcgatcatgaaacgttcggcttccatgacaaaatactacgatgacctgatcgcagaatgtcacgaactgaaaaacattgtgctcaaaatcgaaatgttaacgtcccacggatacccagacgaatcgatcgcagagtacgaaaagaaacgcaaagagcaaatgcgtaaatgcaaaatcgctctgtatctgtgtatgcacgctgtcaacgctctggaagcgatccgcttctatgtgtcgtttaccttcacgttcaactttgccgaacaaggtaagatggaaggtaacgcgaagatcatgcgtctgattgcccgtgatgaagcacttcatcagaaaggcactcaaagcaagatccgactctggcagatgggtaaagatgacccagaaatggcggaaatcgcttaccagtatgaagaagaagcgacaaagattttcctggaagtgtacgaacaggaaaaagaatgggctgaacacctgttctctatcggtgatgtagacggcgtatccctgaaaagtacgatcgcttatatcgaacacctgacggatcagcgtatgcgcgcggttggcttgcagtctccatttaaaccaacgccgaacccgtatccgtggatgaacaaatggttgaagtctgacaacgtacaggtagccccacaagaagtagaagtgagttcttacctggttggcaacctcaacaccgagatcagcgacgaagcctatgcaaaatggcgacaaaaatacgcttgattgtcgcgtcgtaaacaagtataaaggtagttgggatgtcgatattcagagaggtacgaaattcggcaatcccttctacaagggaacacgggctgaaaacatcatgaacttcatcccgtatttccaaaacttgattcgaactggcgtgatcacaatcgacgaactgaaagcattggacgggaagcggttaggatgtacatgcaaacctctaccgtgccacggtgattatattgctcactgcgtcaatgtgttgaccggaaaggtgaataagttggatatataatggacgatgtaacatttggtgtaatatttcctttgcgtctgggttcagacaagaggatagaccggagtttcgttaaatgtggcgaattccggcattgtgtgtattttattgaaatcgacggtcggatagtgtatgttggaaaatgtcgtgatttgtggaagcggttagacacataccgcaattcgaaatactggcgggaagcaaaccccagtaatattttgaaaaccgcacgtctggaaatggcaatcaaaaaacgtaagcgtgtaaatcttatcgtgacaacacacgatgaagacacatatcatgattttgaaataaacatgatccgaaaaatcaatcctgaatggaacaaacagcactatgacaaagctaaccaaaaatcagaaaaccctattcaaccagctaatgacgctgtgtaacgaaagcgaatgcttctacttcattgatcaaaaaactgtgatgcaaaccagtgttcgcatctttaactatcgcatggcgagctattccgactggttaaaacctggtgcgctggaatgtcgcggtatcatgtttgcgatggatggggaaacccccgtaaaactcgtcagtcgccctatggagaagtttttcaactatgccgaggtaaaggcatgggaagcactgaaagcctctcctgtgacgattggtgaaaccgtagtggatgtgatgattaaggaagatggttccctgatctctaccttctgcgattccggctatctgggcgttaagtctaaagcatccgttcaatctgaacaggctatggacgctatgagcgtgatccagactaaccgcgcattgttcgatcgtctgaccgaactggttcgcgatggtttcaccgtcaacatggaatacgtcgcaccaacaaaccgtatcgtaattggctatcaggaaccagcagtggtgatcctgaacatccgtaataacgacacgggcgaatatgttgattatcaggatatcttcgcagatggtgtattacgtccgttcctggttgagcgcgagaaaatcgaagtcaccgatctggatgcattcattaccgaagcctactcgaaagaaggtttcgagggttacgtaatcaaaactgataaaggttttgtgaaagcgaaaaccaactggtatgtaaacctccaccgcacgaaggatagcatcaacaataacaaagatctgttcttaaatattgttgaaaataccgtcgatgacctgaaacaaatgttcctcgatgatatgtacgcactcaagaaaattgacgcattcgaaacgttattccttgatagtctcaatcgtctgactgcaaaagcattccaggcaatcgaagacacgaaaggcaaatcacgcaaagactacgcgatcgcactgagtgctgacttaacccctgacggtcgtattatctttgggcctatgatgcgttatttcgatgataccgataagcaaaagctggtcgataacatcgttgcattaatggcgaagaactacgaacagtttataccggaagaatataaatgacaaagtgctttggcgctggaagcacaacgttagaagaagagaaagcagggatcgattccctgcttctttacgttgacgttttcccagaaaccggaaaaattttttggaataacaatgcagcaaaacagaatcagggaaaagaagctggttctattatgagcaaatcaaaaccttacgtgagaattcggcacggcgatagaaaatatttaagacatcgcataattttctattactgtaatggttatctgcctttgcttattgatcataagcatgggttggaagctggggatggtatagaaaatctacaggaatcagatccgcttcataatatgctgaaaagaaaagctaaatcaacacctaaaacggttaaatccaaaggtgttgattacagggcttcgcgtggaaaatatcgagcacagataaagatagacgggaagcaaaaacacatcggttactatgataccgaggaacaagcatcaatagcttacgaggaagcgttatatgaatatcaaaaacgtattgggtacgtttaatataagttcgtggatatggcctgtaatagttgctggttcgttagcagggcttttgtacatgacaatcacactgaaaagtgaaaatgaccaattggctaaagatatcaaagagttacaggctgatatcaaaaaagtcaaagagacaaacaacaccaatacggtgatctatgtcgaacaaaaaggcaaggatcagcagttggtcaaggatgccggacgtaaagacctgctgttcaagaaaccaggactgatcgaaatcaagatcaataaatccttcgaagagtatatggcggagtacgacaaatgaaaattgcaacgttagcccttgttctgggcgttctgttggttgggtgtgcggagaagcccccagaaaagattttgcctacactccccgctaaggtgaatcctgttaatgtgaaatggaaagtggttgcagaagtccgagagattgacggtaaaaaataccttgtcatgccttatgacggaaacccatacgttgccctttcatatcccgattcgttaatcttccgtagctggatgaatgacgttaagcgtcagaaagaccagacggataacattctgtgtaccgtgggataccctgagaaatgcaaaaaatcaaaataagaataaccgaagttgatttctttagtgacttaaccgttggaaaggtgtatgatgctacaaggatcaaagatcaactttggatctgtagtgattggtctattttcttagatttacacacttatgccaatcgagcactaattgaatatgagattgtgaaatgaatctgtttattactgtaggcgtaccaggtagcgggaaaactacatgggcgaaagaaaaagcacgtcaactgggaaacactttgactgtttcccgcgacgatatccgcaaaaccctttattgtgctggcggtgatctcactggctaccgcttcaccgaagagaaagaactgtttgtttgccgagtgcaagaagatacagttcgtaatgcactggcaagcgggaagaatgttatcgttcacaacacccatttgcaccaaaaagatcatgatggttggcgagagatcgcgaaagagttcaatgctgatttccatatcgaatggattgatgccgatatcgtagaactcctgaaacgcaaccataaacgcggtgtgaatgctctacctgtttcccgtgtctgggcgatgttcgaacagtaccgtaaactccgtggctgggttccggctatgagctatgcagatccaagcaaaccgaaatgtgttatcttcgacgttgacgggacattaaccaaagtcggacaacgtagcccgtatgactttacgaaggtgatcaacgatccgcctaaccctcctgttcaagaactgttcaggatgtataaggccgctggctatgcctgtgttgttgtgtctgggcgtgagggtactgtacagtgcgcacatgataccgctgcaagcctgattgggtatggtgttgacctgagcgatggtatctacatgcgcgaagaaggtgatcatcgtcacgatattcacgtaaaagagcaaatacttgttgaaaagattctcgataagtattatcctgttcttgcagtggacgacagggatacaccagtcgggatgtggcgaatgaacggtatcccatgtttccaggttgattacggcgacttctaaaaaacagttgacagtgagtgcgggtgtgataagatacccgcacaaacaaaggagaatattatggttattcgtgaaaatgaaaatgtgatggttgaactgggtaatcgtgttaaagttgagaatcctgttgaacttcaactgaaactcaaccagttaggccagcgcattgctgataaaattcctgctggttatacagtgaagattgtccgcgatggtcagttctccttccttctgggtattttgagtcaacgtaacatcgttgaacagcagttcgggattcagtggaatccggtaactaaattcgtaacatgggcgggagtattatgagcgacaaaatcagaaagattcatcaggcatggttctgtactgaaccaacgatgcttcgttatggttgtgtgtttgggttggttgataatgatcctcaacaggacattgcaacaagtccggttgttgaatacgcaattccggcgaacaaatcgtttgttgaagtggtgacacgttcaggtactacgtatcacatcgtcaaccctgataacgatttcatcaaagacattctgaaatatatggatgaccgatgaaactacttcacatgatccgtgctattcaacacagccaggcttctcgatgcatatcgacccgtgttggtgcggttatagtaatgaacgggcgtgtggtttcgcagggttcgaataatacggttgattctgattgccgttgtgctgatcataacgagcatatgctgaatgacgaaggtaaactgaaatcggttcaccgtcctgagcattcagcatggtcaaacgataacgagatccacgctgaaatgaaagcgttgctaagtgcgcatactaatggtatcatgcttaacaacgcagaattgtacacaaccgcttcgccgtgtccaaactgcgcaaaacatatcgaatggtatgctgcaataggcgctatcaaagcggtgtattacctcgataaatacgatcgtggtaatggtgaatggatttcacgcttacagaaatatggctgtatcgtggaacaaattaaacgggaagagttagaacctcatgttaacttttccagattagtgtttaacaacaatgagtaaagaaatgtctgaactgaaagtaaaagcatccggcgaatatgtgatcatcgaagctactgcgcgtccgcagggttccgaaatcaaatctgaatctggtatcgtggttggtgtacgccagcacggggaacaacctttttatggtaaagttgtttctgtaggcgtagacgttccagcagaagcggcagaacgaatcctgggtaaatatatcccactgccaagcgctcacatggcgaatgttcctgaccctgatctggttgcgggttacatttccgaaaaagaagcaaaagagaaggaaacaaaatacgtttccgcacattacaaagcaatccaggcaatctacgagatctaaaaatggctaaatctattcaagcaattatcgctgataccgtcagcaaatccaaaaagctgttcgacaaaggcgaaattctggaagccccagcgcgtattgacgtaatgacagcaatgatcattgatgcgcatcagggtaaacttaaatcccgtgccgatgaagtcatggcgtacatcgtccagttcgaagacgtatgtaagtacgcgaaagatgttgatccgctggttcgcgaaatctatcgcaaacagttctaaaaattccggccctttagcttaattggttagagcgggtgactcataatcgcgcggttgttggttcgaatccagcaggggccaccaaatacgcaggtgtagttcaattggtagaatatctggtttccatccagattgttgagggttcgagtcccttcacctgctccaattcgggtgcgtagcgcaatgccgttaaatggttcggaatatgcaaccttatcgtatgcgataggctctgttggtatccggtaataggttccccggaatgcggggtgaagtaaagaaacttccagcccacaaatttaaaagagaaaaatatgaaaggtctccaaaagctgtttgagttaaccccaaaaattcgcgaaatcactacttctggcgatgaaatcaataatgcattgatgaagtttttcaccgaagaaattgatgattttgaaactctgttccgtcacgcgttagaagcgtattccgtgaacgggttctttgcatcaccacaggtgaacagcaagaaacaatgccatcgtcgattcttcgactggtcgatcgtaaacgtggttcgccgtactgacatcgaaccaacaaatcaccagttgatatctgttgattctgctgtgtttatcatccagtatcttatcagcggcggtttcaaatcgaacgatattccgttcacaaatgaagctcttatggaagagtttgcagaagcccataagtacatcaaagcagttcgttaatcaacaggctatcttcggatagccttttttctggagaagcacatgcgctttttaaaatacgcaagctggtttgtactggttccccttgatattctttctggtgttctggctattctgctggctccttttgtggttccgttctacagtgaagaaaccggacacttacctaaagggttccgttggatggaaacattcgataacccgatcgatggtgatggtggacatatccggcgttgggctaacatccggtatcacttaggcgatctgggtgtgtatgcgcaacgtgtaggctggttgtggcgtaacaaagcgtacaacttcgcttatcacgtcttagggcgtgaagcacagtcagacttcgcctggaagggcaacccgaaaacagaaggtggttccgatccttcgcgtcacggttatctgttgatgtggaatgattcggcatgggggctttatgtcttcaaaccgtggcttaaagtcggaaaggttcagttctgcttacgcgtgtattgcgggtggaaactgaaacaggaagtaactgaccctaacgggctggatcgtgcaatgctggcgttccatatcaacccgttacgttattatgtcgtagaaaggtaatacaatgaaagcatatcagattttagaaggtttacacactggtacaatctacctggaagaaggtaatgatgttcgtgtggtggtatccaaaaccctcgaaatggattcagtgatcggtaaagctcgcgttgctccattcgcaaaacgtgaagttgatattgaatttcaacccactgttaaagtggaaggtggacaacacttaaacgtaaacgtgttgcgccgcgaaactctggaagatgctgtgaagcatccagaaaaatacccacagttaacgatccgtgtgtccggctatgcagtgcgtttcaattcactgactcctgaacaacagcgcgacgttatcgcccgaacctttacagagagtctataatggcgattgaagacgtacagggctataagccccattcgaaagaaaagatcgacaaagtaaaccgcatcaaggccgcagaagttgccctgggcgaaatcttcaaagaactggatgaagagtattcaagtgattacgcggtatcagataccgattcattcactacagaagaactcgatgcgatgcttgaacgtatccatcaaatccaaaaggcgaaagaccgactgaaagaagcctctatgtgggcgtgtcgtgcggtgttccagcccgaagaaaagtattaaaaatcaagccgttgccgaaaggtagcggcttttttgtttttatgcaaaataatgcttgcgctgaatcgtgagtgtggtaaagtacacacatcgaaacgaaactgaggatgacattatgaaaacttacaacatgaaagaactggtttgcttcaacactcgtcgtgaagcccgtgcgtatgttctggctgctggtaagaatacctctgctgtaatcgacctgggtactgataaagctgttggcgcacgttgggctgctgttgtggttatcgctgctcctgtgactcctgttaaaactctggttctgggtgcgcgtaaagccgaaactctgaaaaccagcacttgcggggcgggtggtgttcataatgttacggtcattcgaaaaagatcttttaatcgagtcggtgtatgaaggtatacggggaaaacagaaagaacaatctccgaagagattgatgtaatcaatgaatttctatgtagaccatacgttaagagagttattatgaatattggtagtggtgattcatacccatcatgcgcattgagcaacttcgccccgcatccgtttacgtttgacggggtagaatgtgcatcaatggagggctttttacaaagtctgaaattcagcaatccagatatgcaagcgcatgtgtgtacgctggttggtaaagccgccaagttcaaaggcaagaaaaagaaatggtatcgcgatcagaccctatactggaagggtatgccgattcaccgtgaatcagaagcgtatcaaatcctgattgaaaacgcgtacaatgctcttttcctgaatgacgggttccgccgtgcgctggctgcaaccggaaaaagtaccttgactcattcaatgggaaagaataagatgaatgaaacggtactcactgaacgtgagtttgtacgcaacttaaccagattaagggatctgttatgataggttataaagattatgatgaaagagtagaatgcgcgttcctgttcaaaggcgcgattaacccgctggcattactccacgcacagggcgctttgagttctaccctgattatgggtgttatctacaaagcgggtgtgtattacgttaccatcggagcgaacaacattaacgtgatcaacagctacgttgaaaaatgtaagctgaaagatattgtgttcgataaagtcgaaatggatgttccgggcttcgacgctgtttatatgtacaagggttgataatgagttacgtaatttatttcgactgttcggatctcgatcctttcgttctgcaacaggcaaagaaatatcatcaagatatcactggtatcagtgtcacgaacgatgatatgctgtgcatcgaatttgattattatcgtacatttgagcgtgacaaattccttgcggatattgaagcgtttaaaagtacccttttctttgatcgttatgaggttaaatcttgaaaccagttattcttaccgacattgacgggatcgccgtgaagtggcaaagcggcctcccgttctttttgtcaaaacacaatatgccgaccgatattgccctggatatggttacagatgaaaaattccgtgatatgaccgaaatcttcgggtgtgatcaccaactggcgaaaattctcatggaagaatacaacaacagttcgtttattcgctatctaagcgcgtatgacgatgcgttgattgtgatcaaccgtctgaaagccaaatatgatttcgtggctgtcacggcgctgggaaccactcctacagcaagccttaaccgtattgcaaacctgaacacgctgttcccttccgcattcaaagaagtgatggttgttgggcatggtgaaaccaaagtacaccgctacctggaagcgaaagccaaatatggtaatcgtctggtttgcttcgttgatgatcttgcagtaaacttaaacgaatgtcataacgtcatcagccagttgccgttattccatatgttgcgtggtgaacgtgaaaccccgtggtcgcctcaccagtcagttaaatcatggtttgaaatcgaagagaaattacatgatcttacagattctaaatgaactcgcttcgactctgaaaatttcagagaaggaagcgatcctgaaacgtaatgcaggtaatgatctgctgaaagagattttccgcattacgtacacgaaacagattatgtttcacattaagaagtttccgcaggtggacggcaagccaggcacaaccccgctatcgaatgctatcgcggatttgatgtctgatttggcaacgcgaaaatatacgggcaatgcagcccgtgatcgtctgctggatatcgtatcatcagtgaacgagaatgatcgcgaagtgcttcgccgtatcattaaccgcgatctggaatgtggtgctggtacaacgttaccaaaccgcgtatggaagaaactcattccagaacagcctcaatgcctcgctacgccgtttagtgagaaagccttaaaacgtattcgcttccctgcttactcgcagcttaaagccgatggtgcgcgttgtatgtccgatctgttagagaatcagatccgcaaagcaacccgcgcgggaaatgagtatgaaggtttggtgaatctggacaaggatctgaaaaagattcgtgattatctgggttatgatgttgtacttgatggagaactgatttatgtccctgctgaaaaaactgctgtcgttccttcgaacagcgttccatttagtcttgctgggtttatgggcgatgacgacgattctgtttctgaccttgtggcagatgttaggcgggaagctaccgagaacgagacacaagcggaagcgaaacgcgaagagggcaacgggattgtaaacaaatccctgaaaggtactatcagtgacgaagaacagcgcaatatcgtttatgttgtctgggatatcgtaccgtatgaagtatactatggtgatgctccgagtgttcaaccatattgcgatcgtttctctatcctggaaggtgcgctggctggctctggtgtaacatcggttaagttgatcccttctatcctggtgcagaactacgcggaagcgaaaaaggattacaacaattaccgcaatgacggtaaagagggttcaatcctgaaaaacgttgatttcaaatggaaggattcacgcgttgcggatcaggtgaagttgaagaacaaaaccccgatcgaactgcgaatcatcgacgtgtacgaacacaccaaagaacctcataaggttggcgggttcgtggttgaggacttatcaggagaagccagaacaaacacaggttccggtctgactgatacggattaccgatacgatgaagacggtattaaccgcgtgtacatcccgttagaagaacgtggtgaactggatcgcgaatacatcatggcgaacaaagatgactatatcggcgctatcgtcgaaatggaagttgacggactccagaagtctaaaacgcgtaagaagggcgaacctgagttcagtttcttcctgccaatcatcaagaagattcgacgcgataagaccgaaccggacgacattcacgttatcttcgctgatctgttttaaatagcactttttgctaaagaagccccttgcatatgtgaggggctttttgtatattacacacatcgaaacgaaacagacaaaaggaacatcccatgcaaatcactaaagaactcgaaggcaaagtaatcgttctggtaaatgaagaccgtttggcacaactgggtaacggtggtgaaaaactgccagcggacgcactcgaaagcctttctaaaatgcgcgtgatgcgtgttactgacggttgggttacttgtctgcctctgaacgacgaagacaaagccgtatacgatgcacaagcggattcatgggatatcgaagtacctctggtaaacatcgaagttgaagagtgctacgaaatcgaaaaataatgcttgcttactgggtaatgtagtggtacattacccatatcgaaacgaaaggagaaacatcatgaaaattatgcacactgcaaatcaacttcaaaacggcaactacgctatccacgatgctatcggtgcgctggttggggtttatcttcatggtatcaaactccttgaagtaagtgggaataccttttatggtgttgaaaacatcgaagcagcgatggaaattatcggtgacctgaaatgagtaagaaactcgaaatattcgaaactatcagcgaagaccctaatcatcgctggtgctgtgcgaaaactggttttgatgctgcatggggtgatactccagaacaggcgcgtaaaaactgggaacaccaacaattgttttttgcctgtcgggttcctaccaattatgaggggagtcaattgttagcatgaaaaataaagaatatgacccaatagaagttaaagagcggttatcggtagcaagaagattccttgaatctatcgaccctgataaacttggaaaatgccctgatacgatttgccttaattgtgggcgatccgtaatggttggaaagtgctgtgataatcagaatatcgttatcatggacaggaaagaagtttcaccggaagtgtgggatcagattcaagagatcattaaaaacccacctgaaccgacgaaacgtttacgcgaacttatgagcaggaaaaccacgttatgaaaaatgaaccaagtaagactgtgcgccttatccgttgggaaggacaagaaatccgttatgaagatcaggatcgtgaattcgttcatgaaatgcttgcgcataatctgggattcaaaaacgccgcactggtgatgatgcagcaaaccagtgatgaagacacctggcaatgcgtcattctcgatctggacaaaaacaaggattacaccgaagatgaactgtttgcgctcacagagaacgctacagcgcgtcagaagtgcttcatgattgatatgcctcgcgagaactacgagaatatcaagaaagcccgtaaacagaacaagaacaacgtgttcgacctgttcatgggctatcatgaagaaactacggcctaagcctcacttgttttgctggtgtcgttagtagccgctgccacctgtacacattctaatgtttgcaggtggaaatcttttgatacgtcgcggatacattcaacgatcagatacttccctgaatattcatcccctaacacctcaatcaatgcccccactttaacatccattcgaccctgattgatatcaaacttaatccttttctcatagctggataacagttgacacttcactgcctggaacggttgtccctgtttgtctgggttctggaagttgttctcatataccgcgttccggttcatggtgatccatgcgttttcaatatcggtactcgccaggatatcactatacagctttttatccgtcattgagaaactaaagaaacttgcatccactaacagggtagtgttatccttatgggtaatgtattctgctttagtgaataccaaagcgtcacctaaaaacgggttacttacgttgaacttgtaagcctttaacggggtttgtgcgaggatctccgtattgcttttcataaagataccggaaccatcttcccacagataacagaagtcagacgaatctacgctctgcccgttgtcacggatgtaatcaaacacggtttcatacgtcccgctcaggcaagccggaggaatacgcacgtttgatgcgtcgataggtggtgtgatcaacttcatatcattatacagtgccgtcatgcactctgtaatcgtctgtacggcgttgttactgaacgaacgggaaaacttacgacgaaacaccgtatgcaccggagaaaggtttaggcgcagtatagagcggttcatatcatcggtttcgacgtttgaatacagaacaccgtagtaatgctgttctaacgtttcgttatactggaaggatacctgaataatcggtttctctgtcaactgatagattaactggttatcatagatctgcatcaatgtttcagaagtaccgttaatgatggttttctcactcattgagacaagggcaggtaacaattcaagatagacgttatcagcgaacttttcatatgttggatataatttaaccgacacgacgcggtttataactttactggacattagacatcctccctttatattctatttactaaatagtaaatatcgggatacttgaggcgatcatgaaagagaagaaaaacacacttgataaatttatggttacgcgtttaaacatcaagaacagcaaaaataaagtagtcacgttgcctactggtgaacaggttacgatcccccgtctgggctatcgtcatttcacccagattaaagcaatgaaagacccaatgcagttgcttgagtatatcatcaaagagattcaaccgcgcgaattaaccgcagcagaaaccgaattccttttgattcacctgcattatcataatgacgataaagcaatggcgatactgaaagagatcggtattaatctggatgatatgaaaatcagcgaagctaagtatgaacatacttttgataaccttcgattggtcttcaacaaaccgaccctaatgctggatgatctggcattactgcttaaagaagcgtatgacaacgggaagccgatcgaactgacggacgaaaaccgtattcaattaattaactgcctgtatcgttatgaatatgacgatgtaaaacgtggcgtactccaggaagtctatattgtgcatgaggggaaaaccattaaagggcttaacatcatcggtgaatgataatggctagcaatccatattttaacgaagaacaacgtcgtcggatgcagaatccaccaaaaccacaggcgcaaccaactgttcggaagatccaggcaacgttagataaagattcgatgcgcgagttaaaggatatcaatgataacacccttgaaaccgcgctgaatacactggacatcaaagacagtgtgaaatcctttgaggatcgtttcaaagagaaattcgctggcttccaggaacaatacgaacaggatcaacaaccacttgctgaacagttgcccgattttgttgggccagcgcgtccaccatcattaacagacaacagcacaaccagtgttgataactccgtcagtgtatcgaaccagcataacccatttgcgaaaatcgaaacatacaccggaacgattgcagaagcaatcaccaagtttatcgaactcgctgaaaagaaaccagcccccgcgccggaacctgaaccagtaccggaagaggaaccggaggtcgatcgggacaagaagaagatccgcgataaggataaagacgagaagaaattcagtaagcgcgttcttgcgttgctgggttcaatcaaggataatacatctggtcttctgtctcgctttatcggatactctctcgaagcgctggcgaagtttgccaaatggactttgattatcggtagtatcgtattcgctatcgacgttctgagcaaggttattcagaagtggttccaggatattctcgcagagggtgaagcctcgaaagagttatttggatcatacttcggaaatattaaagcccttgcagaaaaaatcaatgaagggctgcaaaacttcaatatgaaggatttgggcggatcattgaaaaacttgttcctcgaaccgtttaaaattctgggcgataccattaaaaccgcaatcacggaaggtatcggtaatctaatctatgctctgggcgaatataccggatcagaaacgattactaacgccggacgcgggatgaaggtatcagcgctacgcgataaacagaaatacggtcttgagattgataaagatgatttggttctgttgaaacagcaagagatccaggatcagaacgataaagttgttgaacagcgttctaagctcgtcgatcaggttaaggctacgcagggtacattctcatatagtttcgggcaacagacagaagcacagaaagcacaatccaagcatcttgaagaacttcgcaatcaggtagaactcgaagagaagatcaccgaagagaagaagaaagaactgaaagcattgcaggaaaaccccaaactgttacaggctgaggttgacaaagagaataccgcgaaccgtcaacgtgtagatgaaaccaaacagatcgaagcagcgcaagagaaagcgaaacctaaagcagataatgaattcgatcagggcgatgaaatcctgaacaaagacaatctgacgggcaacgataaaaaggtaatggaaaaactcatagaatcgcttgaagagaaaaacaattcgaacaagctgaatgaggacgataaagaccgatatcgtgatatgatctcccgctggcaggaaaaaatcaccgcagtaccggaaacgagtgcaagtattgacaagcaaccggaagcagtgaaagcgcctgttcagcctacaacgcctaacagcgttcaggtcaacaacaaaacagtaaacaacacggttcagcattcagtccaacgaactgaccgtaaaccattgattgcattagcttaaaggaaatttaaatgaaaattacagtattgcaagacactgtacaatcatttgctgaaatcaaaaatgctggcatcccctctgggggtgctgcaacaactaaaaacgcgttgactcaaccgatcgtaacagcggaatttccttcccaacgtgcagcaggtattgataacgcgtacaacgcatcaagcctttataataacggcttgctgttcacagcatatgatttcagtggtggacttgcaccaggaagcaaagataactatcgctcattgcgtcaggccgcacagaacgcgcaacagatccttagtgccaacactgggaacgttcgatacaaacaggttttgaatacccgtactatgggtacacttaacccaatttgtcaaatacttttaccgcgaagcctgaacgataacgaagtgaactcacaccgctatcaggacgcgaccgatagtattgttgctaaaggtctatcccgtgcagtatcaaacgttatctggggcgctgtagaatccgtttctggtggtattctggcagaccgtagggaagcaatcgacatcggtacgaaagcagcgtttcaaggctctgataagcgcacaaagatgtattacaatacattcgttatcgaaagccgttatgacctgctggaactgattaaaatctattacctgttcacggtgttgggttatggtactacttcgggtggtactccagcagaattagccggactggttaagcaagcgtataattccagcgcttcgaaggttgcaaacgtttttgcaccatcaacaaaccagacgacagcaagcgatttcaacggcagtatcggggatcagattgttgacttcgtatcgaacgttgaagttattaaatcgcctcctgtgtggtttattcgtgacttccagacaggtgacagtttgcggttccctcattctacatttgggccagcaggtattaccagcgttcgtttcgggcgtacaatggacaacattgtaaatacgttgagagaatcaccgaacaccccgatcgcagttgaaatcgaaattcagtttatggaactgatcgatatgcgtcaggattcgatttttgatacgcagtattaagggggaacaatgttctatagcgtagatgaatttttgtcaggaatggcaaatagagactttcagcgaagcaacctgtttagtgttgtattcgcaactagtccagcatcacgcattctcgacagcacgatcgggagtatccgcgatactttaatagatggtagtatgagttccattaacgcgaataacccgaacgagttcatgaacgctattacagggggcgtaagcaagctattcagctatacggttgataaagctattatgtccctgaacaaaacaggtttcagtaaaatcatgggggcgttaagccctcgtttaattacttccctgtttggtgatagtgtttacggacagatgctaacagaattccgtgacaaaatgatgtataatatggggttgagcatcgttggtgttcagttgcctggtaaaacactgggttatgaatacgtgtataatggcggtgtaccccagatccgattcacccgaccggagaatggtgaattatcgctaacgttccgtgtggattcagaagcgcgtaacctgaaagtattcaacgaatggttatcagctattcgtgatgatgtatcaggccagttcgcattcattgatgaagtatcaagcgcgatccaggtaaacttacacaatcgcgatggtgtcccgcacagcacgtatgtattccagaagtgtttgcctgttaaagtcagcaacccagaactgagttatgaaagcaataacgaaatctggacattcactgttgactttgcttataaaacaggctggcttgttgaagcagataaagaaggttgggacggattcaaacaatcacttatcgaaggtgcagcaattgccgttcgtggtgtggttacaggacaataaggggcgaaagccccttttgaggttaaaatgattgatataatccgcgtaaaactccctggtggagtgaagcgattccctatgtttaccgtgcgcgatcaattgagtttcttactcacaagcgcggacatggaagggaagacgctcacagaacagcaagaaatgctggatgaaattttagatattctgtatccgggttattcccgcaccgaacaggaaaacattttcactaaggtgtattgtgtatcgttcggtaagaacgcaatcaagatccgaatcaaaggcagcagcggacaatcagaagcattcatgcacgtaactgattatgttctgcaaaatgaatatgcccttgatgattcgcttactctgggattcaaattcccgaaacatcgtaacaacagtgaacaattattccttgaatgtatccagtatgtcaagcaggacggcgaaagatacgaatggaatgcattagacgaggatacaaagaacgcgatcctggatctggtgtctattgaagatatggaaaatatcgttaaactgttacgcaagtcctgtcatgttaccgtgcgtgatattgagttcagcgacttattgacactgtacaaaatcctattcaacaaatcagaactgaatgagttcttcaaaaccaactatttgttaaataagaataccgtacagattgaacctataatgaatggaagcccgatggaacgttcaatttacgttgcattgctggcggaagacttgaaacgaaaagagaatgcaaatgcgtaaacatacaccccgacatatcccaaaatataatgtgacttatcgcccgttaaccattggcgatcttgatgacacggataacttcattattgaaggtgatgtgttcaagcatcagcgcgattatgtttacattatggctctgttcgacagtatcaacaaagagactgtagatctccaaatcaaatgccctgaatgtggggaactgattaagtttgtgctcaatcgtcatcatatcatggtggacgaatacgaagaaaagctgtacggcaatgagatcaagatttcagtcgaaccacaccgcaccggaaaggaagagttacccgaactgattaagtttgtagtcatcgacggtgaacaaatcttatgggatgactgtaaagagtcagagaaagaagccgttctggatagtatcgactatccggtctttaaatcaataaatagcgctctggataagccagcaatcgttgcaaacattccggtaaggtgttcgtgtggctacgaacatatcgttgcactgagaggcttagaggcgtttctaaaggtggttggataaaatgggtgttaaccttcgcttactgtatagcgatatcgatcccaacttaacaaaagactggaacaatgacgtaaccgcctcgaaaggggcggcagcggtaaagaatagtctgatcggtatcgtaacaacacaaaaaggcacacggcctttcgatagcaactttggttgtgagatcggggaacagattttcgagaacatgaacccgctaacagcggaagcagtaaggacttcgattgtctccgcgatccgcgcatacgaaccccgtgtttacaatctggatgttgaagtgattccgcagtatgacgagaacgcgatcaccgtaacgatttactacagcatcattgatgaaccggaagaaatagaaagaatcaaactccagctatcatcctcataacaaaaaagccccgaaaggggcttttcttattccatcacgatccagcccattagctgttgatatcgcaattcgaacggagtgatgaaagagcggttattgacaaccttcgtcccgttataggacttaatcacttcctcaccacgaagcacatattcgtatacttcatccatcgtatcataacgcacttcttcgacttcgaagcagaagttggaatattcaatcattccgatcttgttcgcgtaacggcgttcgatgcagccctgtttttcaatctgagtgatcgcagtatcaatgaactgcgcaagtgcttgcatgaaattaccacattcgacttcacgacccccgcttgagatagccaggtaaacgcggctcaatccatcattgccgatgtaaccgatacagtcaccgccaatatagacagaccagactttacccatcggccccatacccatacgattctcactacgagaaacacctttcagtaacagtgccatgataccgccgcgaacgtaattcattttcatgataagccccttattttttcaggttgattaaccaagatggttgggtttctaaactaaccgctttccaagcatatgcaacactataaccggaatacgtctgacatacaacagcattttcatttaaatatttcactttttgatctgcctcttgttcattcagggcagcacacacgatattcttttcatacactccgccgtttggctggataatggtttcttcaatcagataaacgctgttcatgctaattccttctcgattgcttcgatgatgtggagaacgtaaccgttcagttcttttgctttatcagcggcttcaaccataccgtaacgaggaacttctaaaacgttcgcaccttcgagcaggttgctttcgatgtctacgattacatagctctcaccgattgccgcgccttttctccagtcttttacgaacttcatcattttagctttcatgttctcgttccttttggctgttccgtttcgatatgtgtaatataacaaagccctcacgcgaacgcaagggctttttgggttaactgaatttattatagagagtgaaattaatccctatagaattcaatgctttacatgttgcatcaagatctgttggttcgatttcgatgatgtatttcaacgctgtgtttactggaatggtttctggttcttcgaaagatgccagggttggcgctttcaccgtttctggttcagcaagcgcggttttctttacgtcaaacgcttctttgaacttgttgaccctttttagcagatcatcaatcaattcgatgtttgctccgtcgaattgtttggtttgttccagcatactcgtaatctttccgtatgtagtgcgtctggtttgttccgtgtaatttcctacttcataacggtcgatcctgtcgatgattgcccgaatatgtccaagattcgcgcgatcgaaatacgcaatcaacttagattttctgaacacgaacatatatggagcattaccgacaatgtaatgagttgccgttagaccaaaactaggatcgatcagaattttaaccgtgttgaaatacgggattaaatttatttcacgttcaggtaaacggaaaacttcatctttaaagttcttcccaatccggtcgatctcttccagagttttacccatcatcgacgaaattatttcaatttttttagatacataagccatttttcaattctcatttaattaatgcataaaagatttgacgtacttcacgatttcttcacgacacatatcgaccggagtatcctcagcaatagcagcatgacagaagatttcaccatccagccagaacgatagcatgtactgaatatcccgaccttcgttttctttctggtgtttcttgatgcgatcaaatgcatcatccatactttcggtagctgtaagcatttcagattcacccgctacagcagccatttccccagcttcatcactgaattcgctttccagttcttcccagtatactatcgttatcatggattaccccaaacagattttacatttacagagaggacattccgcctctttaacgcgcaagcgctttgttgctgttcgcttcgctgtgttgtgatcatacacatgcaaacagcgataacagatcaccaatcgtttagccgtcataaccaccaccgcaacgaacatcaccttcaatgaacatttcgcggttatctctcaggagattgtatttcttttcgagttccggcccgaatgcgtccgcgtcgtcataccagtcatagttataacttccggtttcatcgtcgtattccggttcgccgccgcgctcattgaagtgaacgattttaacatcatccagattcagttctttcaacttgtcccagatgcgggttatttctacgctattacatccgaacgcttccagtgtgattgtgccgtcatcgtgtatttgaggtaaatcccagcgaggacgagtatcatcaaacatatccatcagagattcaacgtttgactcaccgtaaatctttgcaacttcctgttctttaccagggcggacaagtcctatcccgataatgaaactactgcttgagctattgctcacgaacccagaacgaatcttcatcgtcttgcctcatatttcgcgttctccgcgattttctcatgatacaggttgtatgacaacaccagcgggatacaagctactataagcccgatgatagccagttgatattcgcgtttatcgaacgccatgaatgcaatcgtagcgcccagaataaacacacctaacgcaatgatgaagaataatgtcattttggcagggtatccatttcacgagattttgctttcaggatgtcaatcacagtagtcatcgcctgttctacatcaccatcatagtgaatcaggaatgttttgtgaagtcccatgatcagacgattgatgatataagccatttctgacggtaacagtttaccattctggcgatcgtactttccaaacaagcggtagagttctgcgctgttgcctggcttctcaatgctgaaattatgcatcccagacagaataccatccagatacagaacagttttgttatcactgcgcaggtgtccaccgaccttgtagtagttgctgaacacatacggcttttcgcggatatcttcgatatcgaaatcaccatgatcttcaatgttgccaacatgggcgaagaaatgatgatcttccagttcgagaaggattgcgccctttttgtaagggaatccgactaaatcaatctgccagccattttcaccgacaaatacatcatcaacaaccacgaaatccggcagcataggcgcgtatgcgtggttcttttcgttgttttcacgataggcttgtggttcggacaggtacaggatatcgccttttacaacttcaccccagaatacgttacgtgacatagtattttcctcaatatgccccctttcgggggcggacattgttagattttgacttctttttcttccaggacaatttcacattcgaatgatgtggtttcccagactttccagaaatcggacggaatattatcttctttcggaagaatatcttttgcagcgatagaaactttggtttcttcgaagtccagatccgcgaaccatgcatgtgctactacaacaccgtacattacgcgacttaaacgggcattcagtttacggacttcctgaatcgttgcctttgtctgcttatcaagatactcgactacctgatctttgtcaagcgcatccagttcagatttcacctgatcgtaagcccacaggataatcaggtcgccgttgttcagtttcttcttaccttcttcacgcttcgcgacggtagccgctacagcaggaagggaggaaacacccttgattttcacgttcagttctttcgacatgtaaacatcagtcgattctgtgcgctcaaccttcggagagaacccgtaatcacgaataccctgttcagacagccattcacccgcagcctcaccaaagcgctgtttcagcccttctgcgttgcgcagtccgatcgcgttgtcacggaagaacttcataaccttctgacggcctttcaggatttccaggcgcacgttatcagtcacgaactctttaccgcttaacccgcgagtcatgccacggttaaccagaggcagagaggtaaagtctaccagaacagacatacgatcatcaccgattttttccagcggcttgatagtcagaccagaagcacgaaggtttttcagtgtcggaatatcggtttccagcggcagaactttaacgttcacgataccatctttaacgatggtgaagttacgcacctgcttagtttcgactttttccggcagaccgaattctttctgtttgctttctgggatagtcacatacccttccagatccgtgttgatggaaatgttcggacgggaactgttacccaccagatgtttaaccgatactttggttgtggtttgggtaaatttcggtgtccagacttcatgcgctaccatttgcgccgccagtgctttacgttcttctggggttgcagcgtttgcgatctgttcggtcagttgatccagtgtatcatcttctttctgtacagtctgacggcctgtgcggttatacgcccagtgctcagaagacaggtcgatcactgtgtcagtttgtgccagcagttcaagcgcatcaaccagagtgaacgcgttttcgtctggaaccatgttgtaatcaataccatcaacgaaacgctgtgatggatctacaacagcctgtgcaatcaggtctttcgcgttggagtagtcctgcttagtaaagcagttgtcatacgctttgatcagacggacatcacccagcttttgaagcactttccatgccagatcagggttcattgtgtgtagtgcatgataaagcacgacatacagaacttgctgttcgctggcgatgttcggatcgaatccgtcaacatcattaatcgcgttttcacccagcgcccagatatttttgatgtgttctggaaccagtacaacaccgtttgcagcgttcaggacatacacgcgcccttcgtccaggtagatcgcatgggtagcatcagcaaccgcaacttcgatacgtgcggaagtctgcgcggtgatgatttcgttaaatgctggttcgtatgcgtcgaaaccttcaacgaatttgtgcaatgcgttggttgcttctgccattttttccagcagaggacggtttacataataaccgtattccaggaacgcgatactgttgaaagtcagtggcagaaccgcacacgctttcagaatatcatcggtacgccagcagttatcataaccgtctgtcaggaagatcaggctgttcaggttgccgttttcagattgcagatcggtagcgatttccgcagccagattcaacggctcaacaaagccagtacaacccgtaggtttcaggtaacggtcgatagccgcgcagatgttagacaggtcagagacattgctaaccttctcaccacggaacaccgtaccgtaatcgcctttgctggagaagtacaggatcgaaacggtgtcatcctgtttaaccagactcgccaggtttgctttcaggtgtttacggatcttaggcagttcgttgtacattgaaccggatacgtcacacacgaaaacatggtttgtcggggttggcttcgatacagcgtttttgaattcgatatttgtgattgacatttaaattttctcgtatttgaatttttctaaaatttcgttaactttattgcttactgcttcgactgtacgatcacacccgaacttatgcgccaggagttcaacgtattcatccatcgttgtgagtttggattctgcaacgtcaaacgcaagcgcatacattaccggattccatactcgaacgatttggagagtatactcgttcagttcaaaacgttcaagatattttcgcaaagaaaatacatcaaacggtgcgggacgatcctggctaaaggggatcgactcccctaacgcatagcgaggcataacaacgcaaacttctgtttttagcttatccatcagtgatgactctttgatgtgtgttcaaggttacggaagatgtttccatgttccagttgagttccgatcgggccgcattcatcggagtacgtgaattcatagataaacacgccgtcctgattaccgaacttcgtgttgtactcttcgtacaaccacattttgatcagagcgtctttctcttctgtgtccagatcgtaccagtctcgcccgtcatacgcaagcgcgatttgagggtttgaacggtagcgggtttctgcgctttcttcggtttcccagtcatagcgcttatcgtcgtagaacgattcaaagctattacccagatgaccgcctaagtcacgatgaacgtgattgaccacttcttccgctgtcaacggcggatcgtagtaaccacaatcagggacgcaatcgcccatcatttcgcgcaggttgtcgatattagtcggatctttcgggaaccggacgatgaaactacttgatgaactgttgctcacaaaaccagaacggattttcattttacatcctcaaattgtaagttttctttggttgcgttcgcaatggctttttcgttgttcagtgttactatgcgcagacgttcgccagtaaagccgtcgcattcagtgatactcacccagtcaaaagatttagccatttcaatcgcacgttccagcgatacggtagaaccgaccaaatcactaaatgtatagtaatcttcgcttaaactttcaacagtataaattttcatgatactttaccctttgtttcggatttcaggacgatgttactgtaaggatcttttgctaccagttcccacaggtcgccaggatgttccccgctacggtagacggatgaacggatgatttcgttaaacttgctcagggcttcgtctatgtcgtcatacccgcatttgagaggcttacggttgcaacgaatgaagaacatttcgttggtattctcccagcgttcggcgtttttaaccttcataccgcctccattttaccaatgacttcttcgtatgtcacagggttaggttcatagccgttagcgcctattgtatcgcctactctgtttcctactaaagaagcaaccgcaactttcttaccgtctttccacgcagtgaaatgcagattatccgcaacatacgggaaggtttcgtgattgttcaccgcgtcgatgcagtccataacggtatcagacgcgcagatcagattaccaggttcataatcaaccaaacattcaacagtgtaaatcataataatttcctcacgaaaaagcccctttcggggcttgattaatcagtgtccgaacacaccacgaatagactctgcgaacgcgtacagttcagggtttttcgctttcactgtttcgatttgttccaggatgtaatctggtttgtatttcgcaccgaaccagcagtaagagaaagaacgatcccacatgaacacgttgtagtattcaccgttacgcacttcaaccatcacgtaacctggattagaacccagcgggtaatctttcagtagattaaatttcgcaccagcgccagtacatccgttaaacaggtcattaaaagtcatggtatgttccttttcagtttcgtttcgttaaagctaatgtatcactatcctggtcagtatgcaatgtttaattttgcaaatttaccaaaatgttttatcgcttcccgatcgtatgcttttgcagcctcgtattcgtcacgataggaaccgatatgtttaaccttaccatcaaccattatctgcgcgatgtaacgtattccggttggttgattgcgcacacatacacccttgaatcgactggttccttcctttcgtcgtttcctgttctgggagttacgggattgatccgcttcacgcaagttatcaatcccgtcgccagcctcaacaccatttttatgatcaatcacatcaggcagttttccggttgcaacgtagtagatgattcgatgacgtagatatcctttgcttttgaaataaacgcgggtatatcctcctttaatcttcgaacctacttcctttccgatcaagtcagaacgtttgtgtgacgttcgtataattgtccccgtttgtatatcaacagaaacagttttaaggaattcgtcaattcctttctgttcttcttcgattgttcttagtccgttgtgtgacataacaccttcttgatttgttttgctatagcctcgatgactggtattgaaacagaattacctgcttgtttatacgcttgcatcttgcttttgttgataataaacgaatctgggaaaccctgcaaacgaaaacactcacggggagtaagtcttcgggggttctttccttcctgcaataccagacattgaacaccatctttatagtaatttgcagtgatagtcccagtgtgcgcagaatcgcttgtgacggcctgataaccgaaacccttaccgtttgccttatttcgttccttacgctctctaaagcctttccatgcgttatctgagagggtgaatgaatcatcagcatcttcgaggatgtcgcctacgcgtgtaggtgtacgcgggggaacaggaaatgaaaagaatacatcatccaggaagcagacaataaacacgcgttcccgtctttggggtagtccgaaatcctttgtgttcaggcgttgatagaatacgttatatccttcggcctccagaagcccgtaaatcgttttaaacgtcttccccttgtcatgggttagcagttcaggcacgttctcaaagaacagcacacggggctttttggcgcgtataatgcggaggatttcgaagaacaccgtaccgcgtacatcatcgaagcccagtttcaatccagctttactgaacgcctgacacgggaaccccgccagcaggatatcatgatccggcactttgttttcatcaatggcgaatagatcaccctgtaggttatcatcgccccagttttcgatatatgtttgctgtgcgaacttgtcgatttcagacgttaaaaggcattcgacaccgccgaacgccttatcaaatcctaatcgaaccccgcccacacccgcgcagaggtcaattattttcatacgtcaaaatcaatctcgtcaattttgtatgagttttcgtcaatgtccgcccagagggttacattaacatgtttgctatcttcgtacaactgacgaccatcaattccgcccgtgtaattgctttcggtacgttcagtaacttccaggcggaggctatcgcgcatgatctgaacaacagcctgttccagtgtaaccgcgtctgggtttttggtatcgcccagtacaacatctttaacgttcaaaataatatcagtcattagtaaaacttcccgtaggtgttgaaatttacatgtgttgggcttgcttcgttgatactgatttcataatcgtaatcctcatttgttacggaacgatcatgtttgataacatcaacgacatatacccgaaagaatgcatgatacagagcatcgcggatcttttcagcaagcaccggaggctcactgtacaggttaatcatatcggaaacaatatcctctacgcgaggaatatcacgtttctcaatgtaacctacatacaaacttacgtctttgaccattagtgccactccgttttaataccgtgtcggtatgcgtcaatccccagtggggtaatcagcaaccatgctttcgaattatcgtgataacccgttactcttcgagcgtaacctttttgaatcagggcatcacgccctgatttgctgggtacgtcatcgaaatctaagtctagcactttagttgcgtatccgtaaagtttatacagaacatcaatttcagcgccggacaatttaggatacatcatttgtaataccccacaacatgatcgctgtatatgcgttcgatgaaatcgttccagaattcgcgatcaacttctttcggatatgttgaaatcgctgcaaggcgttcgacttcacccatgacttcttccagcttttcctgtacggttgcgaacggtacaccgccagctttaaccagtttcaggaatgcgctatcaggcagaggataaacgatatcaccatctttgtaaatctggatcaactgcataccaccgcgtaaagcgtgacttaaagccttccagtcgatgccgttgttggcttctgcttgtcgtgcgcgttctccgtattcatcccagagtttatacacagacttgcgcatttcatcggctttgatcgtgaactggaatttacgccccagcacttcatagaagtcctgacaaccagatttcattgttgtgtcggtaacgaatcgacagaactcgtttgtagggaaacgatccttgatgtcagacactttcacttcacgcgtatagcgtttcatatctggcgtgaattcctgaataccaccgatcgtttcggtttctttcagtacatcgacaacttcgcgcagtgcagccagtcgggaacccttcacaccatatttcgcggcttgcttacgaacataaccgaacaggccagttagttcagtggtgtaaaaacgccagcggttagcgcggatatactgccagatttcagagttagcgatcagcttgtcatccgaagcgtgaagcatatcgagcgctacggtatcaccatcacacgcaagactaatgaacttagtcagactatacaactgacggtcaacgtcgtctacggtgtttttagagcttttatcgcctgtgctggtgtcaatagtcttcggggctttccccaggagaatatcgcgcgggtgcgggagaaagatccctttatagtctttgtcgcttgtcggtgtgttcagtccgtacaggtgagaaccgaacacggtttccattacagttttcaaaattcaacccccagggtttttgcgataccgcgcagttcagcggtagtgatatttggtacacgcgttacatgtccacgaccgaacgcgtctttgattttatcagtaagttcgacacggtacaaatgttctttgtattcgtcttcgctgtgataaccctgtgtatggttattccagtcattagcgctaccagtttttcgatcaagtcgctcaacacggaaatctttaatatcggtgatatttggatcttccgacgcatacaggtattgacgggcaaccttgatcacatacagggtgcgcggtcgtggggtattgtgatgactgtatcgacgaataccaggatcaaacagggtatcacccactttcacatcagttaaatctatcatttcattttccaacgttttgacttttcacagtagaacaccggaagacgtgccagaactggcttcactacgtcttcccatgtgttcgtgttatgaaccacttcgatcgtaagggattgcccttcggacggccttacaatgtcaagttccaggatctcgcgattaccctttgtattgatttccgctacgtagtaatcgtgcccgttgatgtttacgacatcacccataataacgctaattgtgtgaatcatgagtatgcaaacttaattttaacattcagggaatccagcaggatcgcgtcacgtccatcaatgacggttaatcccatgtatttgttatcgtctgtgctcttacgggagtacatgcgacaaaccagagaaccatcttgtgcgatgtattcgacgtggtattcacggcgttctgacgtgaagatatccccaacaacaaccggacgatcgacgggttggcgtttagtcccttcgtaggacagtttgccgttgccgtctggggtacattccacacctttcagcaggatttgtgtcactcgaacagattctacggttcccgcgatcaacattgctggatcagcggttcccattttcaggatcagcgttgaacttgttttgtaccgtgatggttcagtgacgaacacgtaaaccatatcgttcttatcacgggcaacagattgcagcgtgaattgcatttgaccaggcagtccagacatcgcaatgtgaacacgattaccaggttccagcgccatacgagattttacatcagtgataccgctaacagttgctactttcatgatttaattccttcaaagtcttcattagatttccagtacacgttgaagttacggcaatcgtggtcggaagtcaacgtatatttttcttttgttttctcgtcggtgatcaccatcgtttcattctcgatcgagtccacaccatagacgaatactttatcaccgcgtttattcaggaacgcttcacctgtttcaaccaactgccagcagttgacgggtaaaccacccgcacagatcggacggtttacgaggcagtaaggacgtttaatcatttaaattcttccattgcataggaagtaagatctttgaaataccttgcggtgttgccttctgggttgtttgtaatctccatcaggataacagcaccatcaactcctgctttcttagccatgaatgaaatggcttcggtagcaataatcgttgctttcataacatcagctttagaaacgttgatcgtattcatttttcttccttttcattattcatgcggtatgtgtatataatacaaaagccctcacgcgaacgcaagggcttttttaatcttttatcagagtcccgtgaaagccacaacgatttgatagtggtcatcgaagaattccccttgtcgttgtacgacctcatgtaagggcatccagaacgcctctaacgcatcgtcagaaccgcccataatgcggggcagactaccatcattgttaggctctaacttgatgtactgcgccacagtcggttttgagaagtgtacggaacgcttcggatgatcgaacagcatcgaattacggattgaaccacgaataaccttttcaggaaccttgattcgtacctcttcgagcagttcgcggatcgcacaatccaggaacgtttcatttgcgtttttgtgtccgccaggaagggctaacgcgtctttacctggtgcgaacttacgacgaattaccagcaggtgattgttacacacaaccacactatcacccgtacagcagtttagcgcttctgggtatgggtagtttttgaatttctccaattcgctttcccatttctcgtattcgtagtacagtcgccaaaatgtatccgtcatcatccatgaattgatataactcacagtagacgaaggaacataacgagatagtttcttatcccatccattcttatgcaaaaagatggttggtcgcaaatcggtcgcagataaatctttcccgtcaaccttaactggatctaccggaacatgagtccatccaaacgctttcagccagtatgaatcagcatccttttcgtaaccatagatcgcgatgttgtcgcctttggtttcgtcgattgctgtacgaacagaggttttccatttttcttcgttgtaaagataatcaggaatatgagcaaatttaacacgacaaacatcttcgtatttgtattcagtcatcagccacgaaaagatcattctttcgcgttcgttcgctgtcagagggtttaaaacgttagggtaagcatatgctgaacccagaaggatgtaaacggtttttgcttcttctaatgctttacgcaccattgatgcatgaccattatggaagggttggaatctgccaattacgacagctttatcaaattgtttcataacgtgctccacgtttaaagggtaatcataaaacagacgcaataatcaatacaccaagcaaaccgccaataaagccgaagaatagcgaaatgaagatagtaaggatgatctgttttatgttcattatagtattctcgttttaggagtcaagcccccagaacgggggctttaaaaccttatttacgagaatcgaaaatcacttgtccatcgtaacccgcacccattacggtatgtggaacaccgccctggtatttctctgcgcgtttcatctgaacgtcaagttctttccagcgaatcatttctggtgtaatggtacgctgcaacacggcgttcgcttcggcttctttcttagccgcatacagacgggcatcagcatcacgctcgttagcctgtgcagcattgctacgggcttctttatcggcaattgcctgaacaactgcctgttgagcgatttgctctttacgtgccagttctgctttctctgcgttcacctgttcttcacgaattttcgtgttttcaacctgtttcttgatcgcttccggtaagtcgatgtcctgcaagaatacctgtttcacggtgtaaccgtaaggacgggcatactcttcaacttcctgctggatcgcgatctgtagctggctttgaacttctgcgttatacagatcctgtgctttcggtacagatttaccgaactcacggacggtagacagaagtttttcggtcacgtacttatcaagcgcctgatcctgattacccgcgttgatacggttgatcggggctttgttaccatcgaactgcaacatcacggtcatatccacagtggatttgaatttatcctgggacggaacctgcaatttgtcaaacttcattgcgatgtctttggtgttgaacacctcgaaatcagccagtgggtttaccaggtggaagccaggcagaacaggcttcggtgaaactttacccatgaaggtttgagtttttaccgtaccatcctgaacgatagtgtacgagttcggaaccagccacagagcggcgattacgcccagagcgatcagagtggttttcttcgggttgtttacgatagtgtttaagttcatcattatttccattgggtttatgtttcaattcgatagttattctatcatcactttttcgcttgtcaaactctttttaagaaagttttgtcagcttgtaaatcgtttgatagcacaagcctttgatctcgtccaggacgttcttcaatgaactatctactgaatcatagatttcgttggcttcatcggctattttacggagatacgcgaccgtgtcaagcacattttctgtttttaatacgggtttgtatcgaccagtaatgcctatatggatttcggtgaatttatcaaccaaatcctgcatatcttcgtaaaacccttcaaatgctttatgctgtgaatatgaaccagtcgcaaaatgtgcgctgtgcatataggttacagacattaagcaagtgccaataaaggcatcaattttactcgcggtatcgcgttctgttacttcgttaaacgtctgcatcttcatcccttatgaacgatgaatagcggcgaattcacttgcaacccgtagccctaaacgtttacattcgggttcggatttacattgcttctgctgccattttcgttccatgtaattatagaatagttcactggtatttacgctgggagggatggtgtcaagatatacctgtagcgccgcattgatatagtaatcgaactctttggctactactgacctatcatcagcatgtgatgacggagacaagattaacaaaccaaacatcagcgctttagatatgcgtttaatgttcataagcaattctctacgtgcttacggatcaacaatagatccgttcctgtatatatttatagcaaaaaaggggcgattcgccccttatgtaaaattagtctaaaaatacatcaagttatctcataccagcataagctacgctcaaaagcacggatcttatttgcattctcgatattttcatcccatccaatcacaccagctttcatccggcgtaattcctgacgcattttagcgcgtactttcgaatcaatctttttcacagcgattgaaagcatcgcggagatatcacgatgagctttgttaccgtcgcgattcaggttcttatcgaaccggatatatgcgcaacctgatttgtgtttccagttggttgtataccaacgtaaaccatcaggactttccccgtgctgtgcataatactctgaaaatgcttttgtctcttcgatctgttcgatggaggacttatcacggactggaacatatttcttacggtaagtacggctcatagtgttctcctttgtttgtctgaatacaccttaacagttcagaccaacattatcaagaagtttttcgtgataatgtttgcgacagagcgaaacgtatttgtcttcggctccgatctcaacctgcgccccttcggttacgaagttgccttgtgcgtcgatacgtgcaaccgtagttgctttacgcccacagtgacacattccccgcagttctcggatctcgtctgcccaggccagcaaccagtaagaaccctcgaacagattcaactggaaatcagtacgcagaccgtaagccattacagggatttcgagttcatcaacaacgcgacatagatcgaaaacgtttttcttcgaaaggaattgcgcctcgtcaacgaagatgcaagcaattttattccggcgctgaatgtcccagaacagatctatatcaggcgcaatcaattcacacttttcgttcagcccgatacgcgaactcactgtgtttgatgtgcgggtgtcgattgctggcttatagattacaacacacataccgcgttctttgtaattgtgcgcgtccgtcaacagtcgcgcactctttccagcgttcattgatgcatagtgataatacaatttagccaattgtaaaccatcctttacccatgagtttttcattatgtcgcgcaagatgctctttgatttccggcatctggatagcaatatcatactcttctttcgtcatggtatgatttgcacaacccatacacccgcacacctgcgcgttacaccaacggagtgttccgtatgtcgcaatcaccttcattgctttagctttgattttgtcagtcatgattagctcgctccaccgctaccgcatcacgaacagcatcggtgatttcattttcaacgaaatccaggatatccgctgtaatatcgtcgatacaggattgattgtagttacgtgaatcaggatcatcatcttcggcataatcctgatacgcttcgcccagttgtttcagcttgtgttttaacagcttttgttcttgcggtctcatgataaatccgccttatgtggatcaaccgatggatcgaagtgaacaacgatgattggataatcacccgtacactcgtcgataatggcgctaatacgcaaccaatcgccaccagcaagccccgcaccgataagaggggtaatgataggcaatttttcaggaaacgcactggcgcgttctacggcgctcacaaagcatgatcggattgcgtcataatccacttgcgggccagtaccccagaatttaaactgagtgtaggcattgaagacaatctgaccttcttccgtcatgtagatggagttagtgcctaacttacgctggtctcctttcatcgtcaatgcatcaattttgaacgcaccagggattttgtgcttcacttctttagcaatacccgcacccatgttgcaataacagttacacccatgaatcaagtgtacttttcgtttcaggaacaactctacagcgttccctttgatttctttaataatcattttcatcacctgtatagtggcggtaagccagcacagccagccccgcgatcacaacaataacacacattaagatataacctgtgttcatttaaattggtcatcccatctttgccacgcttccaactcgtcatcatatacagggaacgagctttcgtttggctttttaacgtaataccagataatgattgcagcagcaatcacacacccataaaagatcactaatcccaacatcagtataatcctataccagcgttatattcttcaaccaggtaagtacggagtttttcacaacgttccttatttggcgctttggtgcagaggttcatcatcggttcagactgcaaaaactcacgctgtttaaccagcttctgacgcttgaagaggtgcgcattttcttcgccccatacataagccgcgtccagttgttcagcgattacctgttcacataccgcaacgtctttaatgtcacgattattgcagagttcagccagtcgatcatcagcatgagcaaagccagcaaacagagtgagtaacagcgcaagttttttcatcgttttaccttagtatgaatcgttttcgataggggtataataatgggtttcgcagacataagcaagcactgatcgcaaactatcgctttcaaattctggcttttgattgcgtttcagactccaatccgtgaagcacatccagcgttcttctgcaacgtcaaaggctaaccagtacatattgaactgtgaacatgtatgttcgaagatatcgaacagcaatttgccaccgatcggcttcacatatggcttcacgcgttgaagcgatttcaggactgtttcgaggttactgcgatcctcattcatcgcgatacgaagaatatgctgattggtttctgggttatatccatcaatccccaaacccatatcctggaagaacttagtcgaatcatggaaaatctctcgtccgctgttcggtgaattgatgtaaaactccatgcgtttcttcggagtcatagcacggacgcgggaagcggttttgtgatcgatctcttctttgatgtctttgcgagcgttcagaagtttattcagcttttcctggtaaggtttcattaccgccctgatctcgtcgatacgttcatcaacgatcgctaactgctgttccggtgtcagtttagtttccatgttaagcccctacgcgcacaaagcgatcttcaattgcatcattaacacattcgtaaatgctaacgtcattcgggacgtgcttacgaatacccactttcacgatatccatgatctctttgttgctgccccacacgttcaggttgaagtaaacaccgccgctatgaattgtgctgttgccaacatcaagatacgtatcttgactttcgcagataaacagtttgcgtttttcttctccgtatgcgaagtagatactgaacgattccatacgatgacgatcgaccgtgatggtttccactttaacctttggatctttgttcagttcatctaacacaccctgaatgatgtgcagcatgttcggcttgatgatagtcggatgactggtgataactcgatgtgatgtgctcataatttaatcctcaatagttggtacacacataataaaaaagcccctgcgaaaatgcaagggctttttatcagataatgcgtttttcttctaacagcttcgcggtatggttaaccatgcgagcataatcacgggcttctttctttgaatacttgaaccccgcgttgtaactcgccagcgcctttttcaagtcgcctttgtggtaatcaagccagtattccagttcgtgaagtgcgtacttggaaccaccccgaagggtttcgagcttattgattactacgcgtttggaatatgatttatccattcgtgcggacgcgctacgggctgttacttgaaaacaaccataagcatgatgattctttttgcctttccctacgttctcacatgcgcgagactcgatccaggcaatagccgctaaatgatatcccaaacgtttcgatgtttccgattcaactggctttgcagttttgagatcgtattcgttaccgatcctgaaagcgtactccaaaacctttttctgctttggtgtaatatcatccaattccttaacatagctgggggcattggctggcgctttcttcattactgttgcttgttgtagcggtaaagttgacttcacagaagggagtgtttggataaactctcctaacggatcagtcgccgcgttgccagaaaaagagcataagaaaatgctggcagcaaagataattttcttcattgtaatacctatttgtaacaagagagggctatgataccctcgtcttattatttatgcaacgattttacgctgttttgcttcggtcagctttttctcgatgaattcagcaatgttatagtttgaaattgacgcaatcggatcgtacagcgctatgatttcatcaaacgatacccgaaccacatgtttaaagtgaacgctccagctagtcgtaaagatttcgctgttgttgaacccacaatcagggctgaacatggcgcgatattcgtaccctgtgtattctttcaaacggtttgcgctgtgcgcgttgctggtgatcaggaatttcccctggtgagtctcaaccacgaagaaatagcccagacgttctttattgtccagcatcgtttcaaacttacgattgttttcttcgcgatcaacacgggtttcgatcatcttccagacctgttcatattcaggccaatcatgctcgacaacaaccgcttccaggggttctttgtgttgctcttttcggtagcgctcaactttacttagcaccgcagagagaagcagtttatcgctatcacttaacgcggaatcaatatccgcatgtttcatcacgacataacgttcttcacgtttcatactactacatccttatcacagaccggacaccgaatcacacgatacacatcacgaccgccagtgtaatcagttgataccttttctttgacatcctgcgcagtgtatgacagaacagcaccacaacgacaggcagtttgttttggggtaatgcttacaacttgaaccataataacctcacaagaatagtttcacttcgctaccgcatttcgggcagacgatatgttttttcacgatgtaatcagcagcacggaagaaaccgttgtagaacacttcgtttttcttctgtacatcagacagttcatactctaacccacttttgcaattagcgcaaacggtaattagctttggactgataataacgttgatcatgtatacctcacgaaaaaggggccgaagcccccttgatcaaaaattgtcttcaacaaaagctgcaagtcgcccacgatatacggtatccaggatcacatgacttgaatgaccgtactctttaagtttttcaaccgcatacacaaagccgttgttaacagcagtgttgcgcgggttgtcaatctgtttaatgttcccgcatagtatcagaagggtgttctcaccgcaacgggaaatgatggatttgatttcgtgattgctcaagttttgacattcatcaacaatcagaaccgaacctttacccggatcaggatgcccgattgagcgcccacggaagtaatacaggctagggaactggacaacgtttttctccagcagcccttctacgtatttgtcaacttccggttgatccttaaacagaatgttcaggctcgtaatacatggttctacagcaggacgcagtttttcgccaagagtaccaggtaagaatccgatttcgcccgacagagggctatctgccttgacatacatcaggtttgcgaagtgtcccgcgtttaccatgtgcattgcaccagcaacagccagcatggttttacctgaacccgccgcgcccatgatggtcacaacgtcattgtttttgtccagaatagcatcaacgaatgacgcttgcagagcatcgcgaggctggattgttttcatcagcttacgctttaacgcctgttcgtgcttaataggcaacacttcaagctgatactctccagcagccactacacgccctacaagttcaccatccgatagaatgtattggttagggtagaaatccgcgtcaggaagcgatgaatacgttataacggcaacaggcccgacatactccaggacttcaacagtttcccagaacagaggcaggtcgatataacctgaatacaacacatcactatctttcagcgagtcatcgccagtgtattgaagaaccgaacaacctttagacatcgcgatcaacagcatgttaatgtcacgagtcaccagagttgcgccctgctgaatacaagttgcaatgatccgcgcatcctgtttatccagagggaattcttcggtgccgtcataatcgacgattttcagtgttacgctttccggtactgctgggttcgataagtttaacgaaacccctgtttgggtaattgcttcataattttgtcccaggattgctttggacaaaagccggatcgccagtcgtgcttcatgagcggttcgctctttgcttttcaggtgatccagttcttccatcgttgcagcggtgataatgatttcgctgtcaggttcgatgtaagaatagattgaatatgggttactaatcaaaacattggtgtctaatacgtattttgacatacattaaccttatgtggtttcgttaaaaaatgtgccgaaaacctctttcgctttccggtcataaacggcttttgcttcttctggagtggtataataccccaaaaattttctttttccatctatgtttatctgcgctttgtacttcccatttgctttgtgataagaaacacctttcaaccccgtactgctgtttgaattacatttctttttcatcgcgttttgttggttcgtcgctttctgtagatttcttgctgtatctccattttcaacaccatacacatgatctacgataggaggaagataaccattctcaacgtaaaacactattcggtgtcgcaaatacatagaacctttaaaatgaatttgggaatactcgttcttgcttccggcttcacttccaggagacatagtgccgcgctgaattttccaatacacttttcccgtagatgtatcaacatctacataactcagaagagactcaatcccttgaatctcttcctgtatggttcttgatgaataaccatgacttttcattacatacccaaacggataatatggatatatgggaacgggtgaagatgacttgaacgcatacacaaggtcagcgtttttgccagttcaaaccgttcgtcgatcgtcgtgtcacattcatcgaaaatcaggttgattgcctgatacttgatggtctgaccacgaaagattgtccgcaaatcctgttttttggaaaggaggatcacgttatcatccccgcgatcgataccatttccgattgcttcatccatcgccatttgtttcgtacaagcaacgtagatattcagtgtccctttcgactgcttgatgatatcgaaagccgctttggttttacccgacatccggcccatatccagcgcagtttcgaagattgacaccccgccgcattcttgcccccaacgcccatcaatgattcgcgccaggtgcaggttacgtgactgctttacagcgtcaacatagaattgtgaaatcatgttgtcgccttatgcaagttcaacgtgtggtgcgtcgataaatttcgtttcaataggaagatttggatcgttcttccagttgataccgtaacgcagttttacaccctgttcatcagcggcttgtttcactgcattcaggacaggcaaccacactttcgggttagtctgccagccagcagggagaacgctaggatacagatccacagcatcaccagtgatgtgttttgagttcatggtctgggaaacacccttgcggacgttttcgcgctgttgctctacggtgcgcagaccttcgcgtacaccaaaatcaacaggtgagagttccagagcacgttttaccaccttaaccagttccggcttcacgccttgcaggttgttcaggcttttctgactaaatttaaacatacatacctctattatgaaaataccctatatgggctacacagggtatttacggtttaagaggcgcaacgttttacatgtaaccccaaattgcatcttccgcgcgatcgcgtttccagcgaatcgtcatttcaacactttcctgtttgtcatcaggaggaagtttatcattattgatttgttcaatatatgcttgcgcatctgcttcgctacggaacaacgcatggaaattataatggttgcgcccagttacgttacgatcatccagagagaattgacctttattttcccaatcatcatacacagtgattccgttaacaaacagccccagcccacgatgttcacgcgggaagccagtgatgatatgttttcgacccatctgtgccttttcaccagtgatactgattacttcgtacaggattgcgccaggtttgatatctttcaggacagcacgtttttcaaaagcgttcataatgtattcctcacaattagttttcatatacagattaccacaatctgttttgatgtcaacaaggtctatcgtttttatttgggaaagttaactggaacaggcgatcgtgtaatgcttcgatccgctcatacgcttgtttcaggatcgtcttatcttctgggttcgttgtctcgatgcagatcagttcgtccgagtcgatagcgatcacatcatccatcagtgaagcgaatatgttcacgtcagggtgtgtcaattcctttatctccgcttccatcccgtcatgctgggataacagttcgatgatatcgcgctgtaaatctccctggtacgggaatccggtttgaagatgattgataattctttctgctttggtcatatttcacctacaaaaaagcccctttcggggctgggattaaatgtctttgcactggcaaacaccgtatttggtgaaaggcttgtcaccgctaaggtaagaccagaaatcgcaagcctgttcagcggtttcgaagattgcagcatcatagaagccgtgttcttcgttaccatctttattgaggaacacaggaagccagctttgcggtttgaagcagtcagtaacaactacccaaccttctttcgctttcattgcttctttgttcgcttcaaccatttccagcatttcgttcagtaagttcattttaatccccttgtttatctgtttcgttgtctacgagagagattatcacaacggggattagtgtcaacagttattcgaaacgaattgtgctatttttgaaaaacattccagagcacacagatcctttgatctgcttgccgttcacaccagttgcttcgaatccggttgagtatgtgtctttttcagaacatgcaaaccacttgtaacccgtgaactggatgttcgtataaccctgtgcttccaggatacgctgtgcctctttctcgtcagtacagcttgactgcaagaacacaacaacgacaaccatcaaaatacacacaacaattttccacataatttatactcttttaaggttagttttgctggcttcgatccagcttacttggttagatccaatatcacccagacatacagttgtatgactaaatgtgttcggtaaagaaacaccatcaggagataacaacaaatcatgtacacttacgctggttgcatacaaataaccaccggacgtatacagtgtttttatgaaatcatatgaatcgttgggccacttgaaacggtatttctggttccagagttcaacttcatgcacatcatattcatcgaacaggggatcgttgccctttgtcgcttcgtaaagcgcaccgcgccattcaactaaatccgcttcgatatcacttacacaaaactcttcttttgcgctaagtttatcaagcatcatttcaatagtgcgaatagccatgcttaattcacgatcgagtttcatacaataccctcttcttcgagcacttcccagatcaggcgatccaggtgcatcaggttccacataacggagtcatacgaacccagcgagcgggagtaaatcactccccatgaacgataagccttttggaatgattcagcactgttttcatcgtgcggcatatcgtcacccgaagcgatcagcagtttcagaaccatcaggctattgagcgcctttggcgtgaattcctgttcgcttaacttcatcgcgtaccgttcgatgatcgcgattgacttcggatctttaatacgcccatctgtacggcgcgttttaaacgcgctcattaattcatcgactacggcgatacacttcatatgcttcatccttttcctgtgcagacatccgattatagcggatctcttcgcgctgttcaacttctctcacggcttcggctttcttctcagcagtgagtatgtgatgaactacagcgtttcggattccccagagatattcaatcatctgcatatcttcaacggtgtgataacctttcgcatcacattcaaatacaatttcatcgcgttctgtcattgctaactgtgcagtagaaggacaaataaccattccagagtatttttcaatcaacgattccagtgtacgcggttttgctggaatgtcaatagataccggaaccattcgcatcgttgaatcgttatgggattgataaatcatcagtaagtaatctccgcaaactgcattctacgctcaatcgcatggatagcgttatcacgctgttctttgttttcatatccagcccaggtaatcggggttgaacagatcaggtgaaaagtgattgctgggtgtctcttcccttcaacaacgattgttgcatcatcttcgatccaggttacgtgatccagattcaccggatagtttcttacggtaacagattcaccaaccaaaggcgacacgtccagaatatcacgatcgcggacatatgatttaatacgagatacgattaacattattttaactccactgcatatacatcggtttcaggggctttgtgtacgcgcatatctttaccacataccgcataagccggacagttacgacaaccgttatgatccttgttgccagtcagttctttacggaactgttttgttttcggatgttcccagatatccttcacaaaatcttcggcttccagaacatccagaccttcttcccagccaccttcaacccagcgttcggtaaacgagcaagggaagaactgaccacgttcgttgatgtaagagctaaacatcgtcgcttcacagtcttcggcgtattgcttgtactgttcgaagttagggtgtccctccatcgcttcaacgaaagcgggggctgaacagctatcgaatccaaatcctacaccagaatcgaggcaatattcaacaagttttttatattgttcgcgggtaacggtgtcccagttcttaccgcgtcctttttgtttcagtcccaggaacacgatcgcgttgacttctttaaggcgcggatcattcttcacggcatcaaccacgttaaacgcgtcatcataggttttcgagctaaccatgaaatgcaggttgatttgctgttgtccggcttctgtcaggttcgctaccgagtcgaaagcgacatcaaagccagcgtgtttataaaccgataccgcaacagccccagcaaccgccgctaaacgcgctgcaacgtcttttgatacatcagcaatggtaaggttcggcacaatgcctttagaacgcgcataggccatcatatcgaacatatcagggtttgtttgcccctgtgcatcagcaccgagtgcgcattgagtaagccagggcattttgtcgatgatttttttgaagttggcaagatccatgttgaacccgttcgggttattggacttgtagcagaacccgcagagtttacccgctggcccgttgcatttggtagtgatctcgatatcgagaatttcggggaatggtgcgtattctggatcgtgggaatatgttgcaccccagcgagcgaattcaccagtatcaacgttgaaattatagttgtagaacttcgagcgagcgaagcgcatattgccgtgttgatagatgaacagggacggcgctttgatgctggtaacgatatcgacagttttcataatataattctcaaaatttaacatgggattggaagacagcgcgagcaaggctttcattgtcgaacggtatcgactggtgtttctctttgctgtcaatgttaacgcgccagaactcactcgaaccgtttttggtggagtaatgcatcagcgttaccgttttattcttttccaggaaagtacgtttgtcaatctctgttttgatttcgtgctgcatcattttacactccgtttcagtttacgttcgtcagccagttcttttttgtacagtttaatgtacttcccgttaagggtgcgaagctgttggaaaaccttgttgcacaaagcacgtttcgctttgtattccggtgtattacggattgattcgatcgtcatacccatttcgtttttagggtaagcgcttaactccgctccgatctctctgtaccagttgcttaactgatcacgctgtgctttgtactcttcaaaagttaacattataactgatctccgtaatctttcgctgcatcttcgggggttgcatccagtcggtaaagctcaacggctaacggactgggtttgatttcgcggttcaggatctcactgataccgcgaaggaattcgatataaggacggaatctcatttgatacgtaccgcgttaaaagcctggttgcgcagttcataagcctgttcaagctgttcagtagtgaaaagagggctatcggtattagtggtgaaactgcaaatggttttgttgtcggcattgacttcttcaacaacgatttcataaccccatgccccactgtactcacatttcacgttccggtacttgatgtaaactgctacaacatcttcttttttgtagttccggcttttgtagatgatttccatgatttcctccttcgtttcgatgtgtgtacaataacagatcagggttatggagttttagcaattcgtgctaattatgccattttcttagcgattttccatgcggctttgaacgctggaacatcttcaacatcaacccagaaaccagaaccgaaaccatcgttgtagcaagggcaaccgtcgcagtagttttcccaggtcatcactttaccaccaacagaagcaccagtttccatcgcacgtaatgcatcttcaactttttccagtttttctgcattgtcgtcataaatgatgaagtaccatttgccgttgtattcgttacccagtttgattgcttcgcgaacaagtttcatgatgttttcctttctctgtttcgtttcgatgtgtgtaatataacaaaagcccctggcggttgcaaggggctttttaaacaaaaagtgctattttgtttcttcgaggattcgaaggatttcggcgcgggtgattggatgttttgccagctcacggatcgcgtggtcaacgtgtatcttacacatcaaaaacttctccccgcacttgtcgcatgttgcatacatatcgccatgtatacgcccgattgcatcagtcacccaataacgcatccatgcataaggagttccccgcatccatccggtagcaacatgattgcatttacgtttaccgaacatattaccacccgttaggattgcggaaatgtgtttgccagtagcgcagttgttcgcggttcatgttttggttatcaatcaccataccctgaatcatctgcaacatcatgcgggtttgattgacatcctccaggctcgctatacgctgttttaaggctttgttttcctcttctaactcaaccatacggttgtatgcgttgacgcgctccagaggcatatcagggcgctctttgaggacacgggcgcgggatacttcgcattcgtgatttgctttccagtgcgcggcttctgattctgctttttgcttgtctcgaagcgcgagtgacagatcgctaaccagatccagaaccgtttgcggatctacggtttccagatattttccgagaccctcttcccagcttttaatctgtgtcgggctatcgccataaggaacaccgtatgagaacgcgcgtttatactctttacccctgaaaccatattcctgatttccctggatgctcatattttcaacgagagtccacttactacccatcatagaagaaatcgaacgggctgatttttcaatttcttcaagtttttcacttgttactttcattttgtactccacaaatcatattgtgcgcgaaggatagcgtaaaggctaccgatattgattgaatcgaccggacactggaacatatcagagcgcatcatattgaactcgatactgttctgttcaacgaagttaccgatcattgatgtccagcccatcaccaggttatatccgtcttcggataacccgtaagccaggttaaccctgatacaacgcttatcagccagttctacgctgatacagttacttgaatgcatggaattgcatggaaatttgttaggaaacttacggaacatctgggtaaggagtttagccgtttcaatgttgatcgcgcgttcctgatccctttgcgcctggttgtcatgacggcgattcagatacttttccatttttgggttgagattcacatgttgcataatatattcctcacaggtttaaagcgttcttttccggttccattacatgaactgcatttcggagatcggtcgctatcatatcgccccgatccgttacatgcaacacatttccgtaatttccagccatacacgaaccgcatgtaataatcggttcgtgcggccttgcgttcgtggaagttcatactttgttgtaaacctgaaccagccacatttcgatgttcggcgcgtaagtaacgtttaccatcggcatagtgcggtatttgtaagcggctttgtacgcatcgagttcagtcggaacacagaaagagaaaccgttgtcataacgttctgcattagaaacttcacaaccaactacagcggcaatgtttttgttcatgttcatgatgttttcctttctctgtttcgtttcgatgtgtgtaatataacaaagcccctgcattgctgcaagggcttttttcactttaatcgaatttttctggcaactggtctacaattacctgagtttgatggatttcttcactcaatttatcacgataatgaaccaattcgcgggttctggatgctgaatagctaatgattttatcagcgttagccatgtaaccgtaaccagcacacgcgatttccagttttgcgttatcgccgttaggtacgcggatatgagcatacgccagcaagtttttaaccgcttgcaacagttcatgatcttctttgccgatgataaactggtttggttctgctgaatccatatacagttcttcgtctttgttcattttgcagccttatacatttcaaggacgcggttcatatgctcttgtgattgaggcacacccgcgaagttcagtttgatgaagaattccagacgatcctttttggtgcattcatccagccccagggcaggtaatgaaatgttttcaaaggctcgctgttcgtgtcgtggcatttcgtcccagaacaaacgggaaccgtccggcataggaatcccaatttcaccttcgtagactttgataatcgtcgtcaggcgttgtttgccgtcgatcacttctacccagtgagtttcgttgaactggctatcaaccgcgatcgcgatgataccgcaagggaaaccactgatcagggtagtcagaaacgcatcttgctctttctgcgtccacacataggggcgctgataagatggattcagatccagatctttattcttccaccaatgcagataactcccaaccatgatcgcgtgatcgcgactgcgaaaagttaactgatcgcggatacggttatgaaccggaatatcatctttagacatgattcaccacccaacccaacaaaccagtattgatagccgcaacggtaaggcaaatcaccgcatacacccgcgcgttgtgaactttggttttcagttctgcgatctcctgatccttttcactttcgaactcttcgcgggttccatagtaaccaggatcagcagcggttgcgggacgaactgcatctttttcaacgatggttgcataaccactcgttacttgcgttgcaccgtaccagtcaccgcgatcggtgttgatgatcaagtgatcacccttcgcgttagctttatgcttcgacttgccaatgacaattacacgttcaccattcataatataatcactctttcacgttttgttgtaagaactctaacagctttccttcggcctgtaaagcataaagtttattcagctttgctatgttctcaaagtctgatttttcgctgaacgaccagacaccatcatcggaaaccagcgcaccaaccgatacgccagtttcaggatcacgcgtcaacgccagccccaggggatgtaggatatctttattgattttccagatcaaccccaattgagataaggtgttgaaatcaacgtgactcattaggcatcgcaccgaatgacagcagccccatacgatgatcgttatctgattcaccagtgctgaattcaaattcttcaccgctgatactgatagcacggaaaccatctttcaggtacggcaacagatacagagggatcagcatcatttttgaatcgtcatcccacttacggaagcccaggtttttcatttcttccagagtcaggtcatttggatcgactggttcgaaatcaggggaagcgtaaaggcgtcctggaagatcgcgaatatttttcacggtgaatgaatcaccccatgacttatacgcgataggttcagcggcgcgggttgcggtagccagaaggatcatttggcagatttggaaagtagttgctttttgtttcatgatgtatatcccacaagtttagtcagtaaattccccatagtcttacgcgcatgatcgcggatctggctatacggaacatatttgaagtcatccatttcagtaatggttcgaccgtttttaacgaaggttgaagcgcaaacacatttttctgcttcggggtaattattacccacatatacgaataacacaagctcttttttactcgtataatcaatcagacccaggctcaacagttcgtgttgttcaactacaacgcccgtttcctcgaagcattcacggatagcagcattgatcggggattcgcctttttcgatatgcccctttgggatgtcccaatgaggcgtttcggttgcgtgacccattaaaacgctgccgttattcagaaagagaataccagcagaccgttccattactgtgctccgaacttgcgatcgtatgctgccagcgctttatctgctgcatcaactgcctgagtgtgtttgttagcggatttctcgctgaacacttcgcggtaaatggcaacccagagggatcggcgggtctgttcgctttcttcattgacgcgagaagccgcaaaagcgttatgttctttgatcagttgtgcgaattcagcatcatgatcaatggtttgttgttgaatagctgtagaagtcataattcacctatttctttcagttcagttttgagtttttcgagggttgattggtactgaatgccgttcacaatgtcgttgcgtcgggcataatacagcgtaccagttttgtttatctctgccaacacttctttatcgagtttatcaggttcattgctaaatgcaatcctgaacatttcttcggcgttcggcgcgaatccgttacagaacgtgataccgagtttcggatcgaagaatatcagggatactttattcactttttccataatgttcttcgtaatcctcgcattctgggagataggtttcgcagaacatacacagcgtgaagaatgtaggctggcgaattccgatattatcgggtaagtacatccagaacgtgttagcaaacacgatgaacgttttcaggttttcaacggttacggtactgataccgtcataaccggattgagtaattgcgcgttccaggggaacagggtattgctcgcagtagttggcgtaatgttcgcttgtcaccagcgcattagccgcttttacgagatcggtaattttcattcaatatatccccaacgaatttttacgttatcttctgacgccggacttgtaggagtcgggtacggatagctttgcgcttcccacagataaacaacagcatgttttgtcaattcttcgataacttcatcgaaagtaccgacactggtttgtaaaggcaacgagaaaggtttatcgttggtttctacttgagctattggcccatctaccaagataacacgaaccgttgtgtgctcagacatatgagcatagattttgtttttcatgcgggtacatattccactttgacaggttttgcgataaggcgatctgtagtgaagccttgcccgttacagatatcacaagtaacattgaagtcttccatctgatcaacccagccagaatccggtaagccagaaggatacgtgttaacacgtttgacttcgaaccctttaccctcgcatttcgggcatttgtgtgggtactgggatttaaccatactcagcagttgccccagcgttgttgaacgatcgaagcgttcgaccagtgccattacatcagcaatacgaatcgaaccagcatcaataacggtatacaggtttttcggtacatttgagcgcatagtatatttctcacttaaaaaattttttgatgaaagagaggaacaatccaccaccgaacatgatccagtatcccgcgccgtcaccgttaaacaggacatacacagcgacaccatagcaaaagatttccgcgatattcagtaagtttctcataactccctcctttgtctacaccaggtattttaccagaaagtagattactgtcaacaacaaagttttatcaacccacttatcaccagtcattagtaatcccctacaggttgagaagatgcaacgctcaggatacggaaagagcattcattccatttgcaataagttttcgcacagtgaacagtgcctttcattacaaacccgtttgagaacaccagccagtaaagtttcatgattgcctcctttgtttcgacacccctaatataacaaaagcccctgcacgaatgcaagggcttttttcaaatatttttcaacatgtgtagttgaggcggacaatcttttgaagcaatcaggcgatccaggcgtgacataacgcgtctgtagccgtcatactcgaacttgattttaggtgcgatgtaattaacatggatcgcgtttcgcgtgttcaggctcaacgtgtactcagggataacggttcggaatcgtaaagcaatcactggcttttcgtgagcaaccgaatcatccatgttttcgaacatctggacggtgaacgcacaggcaaacactttgccattaatccggcgatatgcaatgacttcctgcataccttcgtttttcgctttcaccgcgtaatacagaacgttacacgaataatgattagcgagactattaagaatttcactgtagatcgcaaagtcttttttgactgacgcggaacgatccaggaatcggtctgcgatgtgatccgtagtcattgaaacctttgtcacgtaccattcacttaacgctttactgaaattttggttaacttctctgcgtaagttattgataacatacattaatcgtgctctgttcataaatcacccattatgtttaaagtattcgatctgacgcagacgtttttccgctgcctctttcgaatcatattcaccaagttcttttgtgcgatcgtggttcagcacaacccacttatcgccgcgatgttcgatgtgctccgtgatgtcttcgactttcttatccagatccagcggttcagcatcttcccggatgatagtcaaatctacgggcaatgtcaacagtcttttaactccgctgatatcttcgatgcgggaatcatacgcgagggttacatgtggtttgtaatcgtcataatcgtatgttgctccagcatccattgcatctttgaagcggctatggagataatcagactccagaactcccacgatcgtattaccgtatttcgtttcccacttctccacgtcaaccagtcgggcaggttcagagataccggaggcagggaacagatcaaccgtcttacggctatacacaatcgttgtatgcagttttgcagcggaaacaggattctctacacccagaagtttttgcaccttcgcgagcgcttcacaggaagcctgatcgaacttcgcacacatatagatccccggatcaactacgggtttcgctacttcaataaaacttttcatgtgtactccaaatgaaaaaggggctttcgcccccagtggttaaacgcctaagcgttaattatgcttttgatgcatcaatcgcttcattatcaccagcgatttctactgttgctggcagaagtgctttgatcgcgccgatcagggcatcaggggatacaccctgcgaaccgtcgatttccagaagaccgcaaatctggcctacgagttgacggtgatttgccagttcttgttctttaccctgaatgatttcgttcaggtcgaatacacgggctttcaggatcaggacatcgttttgaagctgttgggtttggttttgttcagtcattgtttacactcttaaaagattgaatacattaagcacgttgcgtttcaaatcgtctaacgtaccattatttaggattgtataatcactcaagccaggtgtcaaacctttctccgttgaatgattatcttcaataccagtttcacgttcaaggaacacaaagcgagtcccgaacttgctcaggtatttatattcgtgcggttgacgcacatcggtaatgataaagtgatccgcgtaggatttcaacattttttgaagcgcaattgaagtccagatagacggatctactttacaaacaatatcagtcccgaacacctgcatcaaacggcgaatcgtccagggctgggtgttttcttcgcaaattttatgagcgataacatctgcgttactcatgaagaacccgcgagaacttaattttttgataccgctagaaaacagcgtgtatgcatcgttattggacatcaccagcggggcttcacgatcaccctcatagaatgggttcttcgctgccagcgctcgcaattgcgtgttatcgtgatgttccatagaacgtttcaggatagctttgatttcgtcggctaacgcgataacttcaacattgcggaagttatgcacaaccatttgagcaacggtatctttacccgttcgctttttaccacaaataccataaatcatttttgcgttttccgtggagtaggcacgatcacccgtccgtcgatctcaatttccatgtgagcgaagttgaacatcgtcatacaggatacggcttcatccgaatcattggtatacataagctcaagctctccgaggttggagggccaagcgccatagaagcgaaatgtcgctacagtttttgactgcgagttatccaggatatgcaaagccattgcctgttgtggttcactccaacgcacggaatcgaaggtgttaaaatcgacagtaccgagcatccaaaggtaaaccccaagatacgatcgcagttcttcatcaacagcaaaacgaatagtcagtggatcgaactccattgcagatcctgggatcttccctcgaatcattgggttcagtgggacatccgtaattggaatgttgatagcaggtagtgtaacaccctgaacttgtagtttcaacccttttacataatcattgtcaggaatatctaacatgaagttagtaggtgaaatctggttcaggatcatagcagttgtattcatgatgatctccattttatagatatttagatcaagaccgtgagcgaagcgaacacacgaacgaagtgagtgttatgtacgatgtactgtttataatatttatattttatatatagagaaaacagtacatttccgtatactttttatacaatcgttaactatccgtcttcgcttcgcttgacggaactcgcttcgctcgcgatctaatttttagttgatctattcaataaataggtatactatacctatactttcaaaagagattgaaaacatgaaatcattcaaagaactactttctgaatctgttcagaacaaaaaatttgctaagaccgttgatctggttgaccgtggtaacgctgcaaaaggtcagatcggtttcctgcattttgcacatggtgctgattacgatgtgtatgcgccagactcccacgatctcgcttacttcggtaaaggtgttgtccgcctgaaaggtaaaaccactggcaagactcaggcagcgtatattgactgggcgaaaggcactgtttcattctacagcggtgatcctgctgatgacctgaaatttgacaagccactgaaattcaaaggcgcttccctgtacaaagaagccgaagaaaacctggatctgtacaatcagttggcggaagatttcgagattgatctgcctctggatgaagcattggtgaaaggaaaggtgtacaagctcccaagtaacgatatgtgcttgctgtataccggacgtaccaaaaccaaagctacaggcgaatacgccgtgtttacggttgtagatgcctctggtaagcctcgtctggtatcgggtaaacgctttacccaggaatacaaaggtgatgttctgtctaaactggttctagctgaatcagaagatttgaacgaagccgctaaaggtattcgcgaaaaagttattgctgtgttggtgaaacgtgggtttaacgaaaaagaagcagaaaagatggttgataaaaacctgaaagatgcgatgaaggttcgacctggcgcaacccctggcaaactcgcggaaatcgtgagtatcctgtaaaaataaagccccttcctttcggttggggctttattgttaatatctgttccaaactttcttcgcgctgtatggttttcctttggactggaaagcctgtgtaggcaaccaaactgctttcgcccaatcttttggggcgatctctgcaagtggtgaacgtagatgggctggcagataggctttgatcatttgatcagccccgcgcattcccttcacgttgttccagttgattttcagtctggttttgttagaaagtcgatctgttgatccgtagccacgtttcaggagttcttctaaaaactcttgacgtgctcgcggtggcgcatagtgcaagttcagcccgtaaagaaccaagttacccgctttcgaacgtcctgaacccaggaaaatgatcagcgggaaccgatcccagtatggcagggtgtctttgtatttcgcatcgtagatgaacgtatacaagcgacccgttgctggtttcgcaaccctgtgcgtcttaatgctggttttgatgaaatcaccaaaccaatcggtcgaatccttctgacgtttcgcagcggttacaccaacagtcattttcttcaaactgtttcggaaatcgtttacgatatcaaccgcgtgttttttgcgatagtcgttacgtttgcgtcgggcttcggtttctgctgtacggcgttcgatttcatcatcaatctgctgcttgtagcggtgcatagactttgtgaacgttgcgtatgcaatcccgttttcgtccgcgaactttttggctgtcatgccttttaattttgcgcgtcggaatttgataccaagttcaacccattcacccagctttcgcttcggtggcggttttggcttgtcttcttctgcgatgatctcgaactcaaaaataaagctcataattccctccgtttagggtatttattgccctttccatccgaacacacgtttcaacgtgtcctctgtgatgatcttgaactcccagcccttttgttttgctgctgcattcgcggctttccatttgtcaatgtttacagcataagtatacaacgcatcaacaaatttctttttgttgtgaacgttgttgttcgctggcttaggtgggggcaacgtttctttcatcggtttgacttcccaaaggtaggtcacaccgttatccatttcaacatagaaatccatgaagtagcgccgtcgctttccgtctgcgttgctgaaataagggatcacaacctcttcactgttccagcgtttcacatgcgggtttctgtcaagccagttcataatatatttttcccagcttgaacgatacgttatctttcgcggatctcccttatatttctgtatgttctggggcataaaagaccccttgtatgtctgtcttccagccattttagatcctaaatatagtaaacattagataggggaaattacaatgttgttctcattcttcccgcctgttgattacaaaggcacaccaactactgatatctaccgcgattatcgtttttactttaaccgcgtgatcaggaattataagccgcgtacatatcaactgacaggttcattaagacccgaacaattagcggaaacgctatacggaaaccagcaatactactgggttatcctgatgcttaacgataattacgatccgttttacggatggattaccgatcaggaaacggcttatcaatgcgctatccagcgttattcaaaagcaggtggtgaacaggttctttatcatatggatggtaagggcaaccgttattacaatttggttgaagaccctacgaatcccggtcattggtatgacaaaggcgataagaacatgcgttatttgcagtaccagggaacattagtccctgtagatatttatgaagatgcggtgcttcaaaatgaagcaaaacgaaccatcaagattattaacccctctgatattcaatcgtttgtaagtgattatatcaaggaaatggaaaaggcaaacctatgaaatacggtggaaataaatactcccctttctttgagggggtggtcgaagaagtcgatgatcctcgtctattggggcgtgttcaggtgcgtgtattcggtgagcatccggcacagaaacaaaaatctgaaactatcggtattccggttgaggaattgccgtggatgatgcctattcaggatattcgcagcgccgctatttctggtgttggtttttccccgactggtatcacgcgcggtagtttcgttatcggttactggcgcgataaatggcaccaggacggcgttatactgggaacctttgcgggtgagtaccgagagaagccggacacccagaaaggcttctgtgacccgtttggtgagtatcctcgttatgtaggtaacgatgtcaacgtactggctcgcggtggcgcagaggggcgcggttcttcgagcgtgattattcgtgatgctaacagttcgttagctgtcaatccagatgatcgcccacttgacgagatcccagaagataaccgtcctgatactggcgggttcactatcgaaaccatgcttaaacaggatgaaggtatccgcacaaaatggtatattgatagtgaaggttatccgactatcgggatcgggcatttgcttatcatggaaaaaacccgtgatactgcgaagattaacgccgcgatcagtaaagcagttggtcgagaagtaaccaatggaacgatcacagcagaagaagtttcaacgctgtttgctcaggatttggcaaaagtccggcaggggatcagcaacacttcaaacgttcgcgaagtatacgtgacgttaaaccgtcctcgtcaaatggcaatcgaaaacatgtgcttccagatgggtgttggtggtgttgccaaatttactaatgctctggctgctatgaagcgtcaggactggcaaaccgcttacaacgaactgcgaaactcaacatgggctaaccagacaccaggacgttcttcacgcgtatctaaaatcgtgctgacgggcaacctcgaatcatacggtgttcaggttccagatccagaagggcgttcattgagtgctgcatacaatgctgttgtgttggctgcatcaaatccagaagatccttttgttcctggtgatactcgcgtaatgttcgaggaacctaaatccgcatacgctgctgaatatccatacaacatggtattcgaatcccgttctggacacattcaggaattcgacgatacaccaggctttgaacgttacaaccgtgttcacccagcaggatcatacgaagaaattcgccctgatggaacccgtgttgttaaaatcgttggtgatgattatcaaatcgtcatgcaaggccgtaaattaaacgttaagggtaatttgcaggttgttatcgagggtgatgcgttcatttacaatatgggtaacgttcaacagaccgttgatggtaacgtgaccgagttcgttcgcggtaatgtaaatcaaaccgttgaaggtgaatatgtggggctgattaaaggcaacgcagaattaaccgttgaaaaagatgcaaccgtaaacgtgaatcagaatttaatggctaacgttaaacagaatgcaaccgttgccgtaacagaagatgcaacaattaccgcaaaaaatgctctgattgatattgagcaagatttggatattggcgcacgtaatatcaacatgcgagcatcgaataatactttcattgattccggcgcactgactaagatcactggcggaacagtccaggtaggttaatcatgatcatggattatgaaaccatcattgatgggattatgcaaaattttcagcatccttgcgatgctgagatccctgctggatattaccgacgcgttatctggcagggacacacagaaaattaccccgctgttggggtagaatgggcgaccgaaatcatcccgatcggaactcacctgtatacgagttcccctttcgggcagaaaagcgatccgcttccggtggtgaactctccaaacgtacccacaaatccagatggaagccctggagtttctactgacattttggttacgaagattggttattatttcgccactcaagcggatattgatgcctatatcgaatctatcggggctactaagctcgcgggtaatgactggtatggggcggatctgtcaaaagcgaatctgttcaagaaccctggcgaactcgcgatgtacaaggtggaaaactccggtggttatttgctgacttctggcccccgttgcgatcagcgaatccgacaggtatacaatcagactacaggcgcgtttaccagcattgattattactggaatggtaatcgtattgcgtacatgaaacacgacgaatcccccgcgcaccagtgcaaatatacagggatgtcagtaaacacgaacgcagataccagcattcctccggttcctcctgctctcccgtcaacgtatggggcgctaccgagtgaagccagattgttttcttctcgctctggattgggctgtattccggcgaccgtagggttcccgtatacgaatatcagtgatgctatgctgtctgcgtggaacgagactcgtaaaacgttcaagctggcttttgatatgctgacgggtacgattaagaacggtaagggcattgcgacgatgtttgacgggctttcgatcgggatggaagaaatcacagcgggtgctctggcattgtcacagcaagcatggcaaaccgcaatgaaagtattccgacagatcattagctctgcgtttaacatcgtgggcggggcgtgggatttgatcaagaatttcctccctactgttgcgatcatgggtgttgcgatcaacatttacgatctggtgtttggtgatagttcggttcaatccctgaaagattctttccaggctctgattgattccggcgcacaaacgtatgaaagcgtcataaacgcaatctacggggctataggcagttcttacaactatgccgttgaatacgtcaaggctggcgctcgcgaccttgtagacgcgtgtagtgcgttatttgactggtgtttgactatgttccaaaatggttgcgttgctctggtggatttgtacgggcgtatgatgcagatctggtcaatgcctcctgaaacaccaaacccgctttggtctgcggttctggctatccgaaacatcatgcggcagattaaaccgcttgatgtgattctgggcggtaacttcccagggtttacagcaatggatctgtatcagcaagcacaagcgaaagtgaaagcgttcattgatgcatcctatgcgcagatctccgcactgtatgatcagggacaagaattattcaaaaccctgaaagcacagacacaggaaagggattcgattaaacgtaagttcgatcagtacctaaactggatgtgggaacctgtaaaggaagcaacgactgctgcttatcaggctgcacttgatgccgctaacgctgctgtgaatgcgactaaggccgcatatgagggaatcaaagcacagattgctaatctgcaaaatgggatgaaagacacctacagcatggcaatggctgaactcaagaaactgcctgtaatggctcagattaaccagttcttaggttactgtggggttgcattcgatgacctgttaaaaacgtatgagaacgcgctgacgggcgcacaatcgctatataaaaactttgttgacagttcccgctcgtttaaggacacatgcaaggtgatttataaccagatttgtacgcttgctctaagtaaggtaactcaatacgtaaacaaattattgtcattaatcggactcgcgatcacattcggttcaattagtgtttgcgtccctatggttcaatactaaatacccgataacgaggggtaataatggctactacaaagaaacaaattaatcagatccccgatatctttgtcggggctacttttgacgaaatcaaatctgacttaatcaactggctccgtggtcaggacgaattcaaggattatgatttctccggctcacgcatgaacgtacttgtggatctgttatcatactgtacactgtacattcagcaaatgagtaacaccgcactgttcgaatcgtttattcgtaccgctgcattgcgtagttctgttgtccaacaggctcaggatttgggctatatgccggactcccgcaccgctgcaaatactgcgatcctgatcactgcgaagaacccactgaacccgacatcgatccgtattccgcgcggcacgaaattcataggtacagtgaaagaaacaaacagtttcccgttcgtcgtatctgatgacgtggtgatcgttcgtgacaaagacaataactatgtttcgatgctgaacatcgtacaggggcgtttagtccgtacagaagtcatctatgatggttctacgattctggttcgagatccgaacatcgaccgtagccaggttcgcgttactgtcaacggtgctcaatgggatgactggacaaacgaaagtatcgtaaacgcaacaggcgcatcaacaattttttacatgcgtgaaactgtggatggacataccgaagtttactttggtgaaggtgaaaccagccaacaggtcgcaggtggtgctctgactgcggattacatcgggggcttgaaacctgcaaacggttcgactattgtaattgaatatatttcaaccaatggcgaagaagccaatggtgcggaaaactttgtttatgtggatacattgacaaatatcagcattacaagtattgttgaaaacccgactgattcagcggactatgtaggcgctgatggtggtggtgaaccggaagatatcgaacgtattcgtgaactcgcgcctattatgcgtgagacacagcgccgttgtgttactgcatcggattatgaatcgttcctgtctcaccgtttcggttctgttattcaggcggttcagtgctttactgataaagaaaaacctggctatgcgttcatcgctgttaaaccgaaatcagggttgcgcttaacctctgttcaaaaagaggacatgcaaaactatctggcgaagtataacctggcgactattacgccgtcgatccttgacccgaactacctgtatattgtacaaagcgttaaagtaacgtatgatatcagtaagttgatcgagtctgaggaatggttgcgtggtcaagtaatcaatgaaattgacagatactacacagataacgttgaaattttcaacaaatctttcagtaaatccaagatgttgacttatgttgataacgcggacgtgtcgatcattggttcttctgcgactattcagctattgcgtgaactggataactattacagcgccccgatgtctggtattcacttcttaaaccaggtgaaatcacgttctgttgtttcgaatgggttcaagtacacaaatgctgctggtgattcgtatgatgtgcgctatgcgtcaacagatatgaacaccacgaccggactcgcgaaaatggttatcgggccattcaaaaacggtgatatcggtatcgcagcctatacaggaaacgattttgataaatatcctggagtaaccgatcgtgataaatattacgaagtcggctatgtggaacattttaatgatttcattagtttcgatcttggtgtcctgaacgttccatccgagcgattcagcgctgcttacatcgaactgactggtacacctctggaagagaacattttcacccgtgatggttctctgattgtatttgaaaacgatctacgtcctcaatatacaacgttgacgatgaatccaatcagtcaataatttacaacccctgtcatttggcaggggttttttgtttgctaaatatgggatataagtaaaacgcaaatttggagaaacatatgattaaagcgccgtcaattaccagtttgcgcgttgataaactggctgctaacttcgtttatttgaagtgggatagcgtcggcatggatttttactatgtcgtggaaatggcagaaactcgcggggtaggtggtgtaactattccagatgaagatttaacctggttccagttgggttatgcttatgtaaacgaatggttttcttccgatgttcagcccaacaatttttacaagttccgcgtcatggttacgcacaagggctttgaaccgtctgactgggtttatacagatgaactctggacgtttacccttaacgcttacgcatattcaaccatgcgtgaatttacgccaagcgatgcattcataaacgagaaattcgcaaaaaataatcagaactacgttaactttaatacagatgtggtaatggcagcgttgatgaaagaagactttgtgttttctccactttacactgacgtatcccagatcagcgataaaattcttacacaagaaaactatcacgaaatccaggatcatattgaacacgtttgtaatgacattaacagaactttcctggtagcgtcaaacggtttattgtacctgtttgaacgttttcagaacatggcgaaggtgtcaaacgacaaaggacaaacatggcattactacaaggcgtttaacgaccgcgtaggaaaccctgtatcgcgctctgttgcgtaccaaagccgaaacacaacctatgtactgggttacgatcgtatcttctacgggcgcacctcaacggatattcgctggtctgcggacgatgtgcgattctctgctgatgatgttacgtttgccaaactggggaaccagactggccttgatttcgatgtggactcatacaacacatttgctaaactgcctggtaacgtatcgaaatatgcagaagcaatggcatgttccgatgactggctctatgtggttgctaaaaacgttgtgcgtcgtatcgcactgaaacagacaccgatcgacaccgatccgagttctccaacgttcggagaaaagattttcgatactgacagctatacagttgtccctggaaatgataagatcgttgtcaagaaaatggatgtgatggatggtattctctatgcactcgtaacgggtgaagtgaaaaccgctctgcaagatcctacaaaacccgctaacgtggttccgtccgctgctgctggtgtgtatcaatggcaagaaaacacgaaaacctttgtgcgcctgtatgggaacaccgaggaagaacgtttttatatccagcatgaatacaccaatatgtcaacgaacggcacggagatttttatttccgtagcgaactacaaatatccaggcacacttcccgatcctgaattattgatcgagaaccctgcactggttggtgctgtaaaatatgatttgcgtcctggctatactgccagccttgcgattaactttgcgacgattcgcgctcatatcgacgacccgactgtttggaaatttggtgcgcaggaatactacaacgaggcgaactatagctggttcttccgcgactctgtgcgcacatggatcactaatgataaccgtcctctggtggtgtatccgaaaatcacctacagccttgtaaccgatagtgctggcccttcgtcatcgcttcgtgtgaacaaagaggtatgggatcgcggacatgttacgatttacattaacaacattaagtttaccggattcacgaagtatacgaacggtgtgttgttgtataagagttcaggcgaaatcattgggttctttgaattgagttatcgcgcccgtgacagcttaactattttctggaaaccagataacacgttgctgattgccgatctgattcagcaggaacgcgaaaaaccgtatacaccggatctgtcacctggtttgattgacccagatttaagccatatgattacgcgctttgcgcctcaaagctatctggatcagcaatattttgagaagttcggtgaatattatttgcagttcgtttcgctgggtgaaaacacctactataacaaactgctgaacctgatcaggaacaaatatccgcgtgagaagaacagcgtagaatatctgtggtcggaagtaaaccgccgtaatatctacctggataaaacgaagcgcgatcaagtggtacgtttctttgaatctcgttgcagtgatttttactcaacgaaaggcatcgaagcaagctataaattcctgttcaaattgctgtataacgaagatgtaaccgtagaaatcgaaagttcgaacactctggaatatgatattctggttcagtcaacgaatattagtcaggacatcgtaggccggacgatttacacaccaactgcaagagcaaacgtgacgtatatcgaacgccagtatgatgacggtcaattacgctggtcaatgactctgcataacgtgatcgggaacttccttgaagggcaggttgtcaagtctgaaaagactaacttcacgggaactattctgcgcggtgtgcgtggtaagcaaatggcgaacaactcgatcgactatttcaaccgtgggcgttcatactatgtgatgaaaattcgttcgaatctgccagcgtcacgatataaggatgacgttttacgattcgtgcatccggtaggctttggttttatcgggatcaccatgttaacggtgttcattaactccggtttgtctatgacacatagcgaaacgatcattgatattcttcgaaactatcgcttcgatagcggttatccgaagtattggcctgatcgtgtagcccgtctggacggtaacggaaaccagacatttgacctcgtaacaggcgaagcattatacgaaccacaccctaaagcggggcaaccgttcgatgttccaccagaatatgacgttgaagaacaaccgctgaatggtgtattaccttccgcgcgtcgatttgatcaaagtcctctgttcgatagttctgcggttaaatactctcagttccgtaacttagtggaaaaacgattgaaagacgacgcgggtaatcctcgcgatccgaatccaccgactcagagaaaggtagcataatggctcaacaaaacatctaccgtgcggttgtaactggtaagttccgcacggaaaacatgatgaactttcgcgaaatgatcggggatgaccccgatcataactcgatctatatgtcgatcgggcgtactgaacaatgggcggataacgaatccgatcctgaattcgcgcccccttatcctaacgatgatacagatggtatcgttgatatgtggacgcatatgatcgggatgacgaaagtaccaggcgaaatgattgatgcaatcgttccgcgtaaagactggggcgatactcgatatcctaacccaaaaatcttttacattaatgacatcgtggtagtaaactccgctccttataaccgtactgattacggtaaaggatggatggtgtatcgcgttgtggacgttcctgatattggttcttgctcaatctccagtatcacgggtaaagttgaatgtgtgcgcattggtggcatttggacaccgacccacgaatcggtcgaacctccacgcggagaagcgaacggtatcgacatgggtgacggctatatctgggaatatctctacacgatcccgcctgatgtggttattaaccgatgcacgaacgaacatatcgttgttccgttcccgaatgaactcgaagaagatccggttcgctggggttatgacaacgtgatcaagtggtatccagatatgtatgatttggtgttccgaatgaaggttcactcaatgcgattccgtgcgtacatggattccctgttcttcccgcaagcatctttacctggcaaccgtggattccgtcaggttagtgtaattgtaaacccgttactgaaaaaggcgcaaccgaccgatccagaagtaaaagcaacggggcagtattacacgaaagaacagcttgaacttgactcagggcaaatgatctacatggaaaaccgtcaaccgattattcgttctcctgatcagaccgaagaagtcagtattattttcgaattctaaggaaaaccataatggcatatcaaactggtaaaaaattaattgacgtggggcagatcggcaacccgtcaactggtgacccgctgtatgacggcggtgttaaacttaacgaaatcatcaccaacatgtacaacgcgtttggtgatgtgcgtttgttgactgcgaatgatggtgtgggtacaatgctgctccacgcgaccggatatttccagaaactaccacgaacctattattcaggcaacccgatcgaactgggttcattgcatgatatggatacctcaacaggcccgattacggtcgtgcttccatcgggtaaacccggcgaagggttctatttcataaatagtaacggtagcatttctgttgatcgtcctgttgtattccgtccgcaagttggcgatggtatcaaaggggttcaggatcagctttacataacctctccatatactcagattaaaatctggtgtgtgaagaaagaaggttctgtttctacatgggattattctgttgaatcaatgtttggttcaaagacaatgcctgttgatactaccaaactcattttgaaagcatcaccaacggctattcctatgtttggatatagcgaatttagcggcgctaaacttctcgtatacgcggaaaacatgacaggcacagtcaataaaacagcagaaattctgcttgccgtcgatcgtgtggctaagggcgtttattcaaccgaatacgcagttcttaaaaatacagaagatgaaatgtatacgcttaattttactgttggcgctggtgatgttgtttacgcaaacgtgcaatcgaaaaccgaagatcgtattaaattctcgatcaaagcggttgacaccatcaaatcagggatcgcagcatgaaacaagaaattattatcggtaacgtggttgacgatggcgcaggtgattatctgcgccgtggtggtcagaagactaacgccaactttaccgaattgtatgataagctgggtgatgggagtatcccgcatccagcgggtgcgtggaaaacgcataccgcgcctacgctatcccctatctttggtgattcatgggcgctgaacacaagcaacaaccgtattacggtaaaccttcctaaaggcagcgtaagcgattataacaaggttattcgtttacgtgacgtatggggtaagtgggcggcaaacaacgtccgtatcgtccctgcaagcggagataccatcaaaggttcaccgaactacaaagaactgtacaaagatttgatggatgtcgaactggtttattgttctcctggtcgttgggaatatgttgaaaacaaacaggttgacaaaatcacaacttcggatctggctactgtagcgaaagaaacctatatcgcgactcagggacaaactgacttcctgaatgtgtttggccctggtaactcttacaacgtccgcgcactggaagtttactatcgtggtaacttgctgtacatcgacgacaagaacgggtttaatgcatcaaacagcgattacggttcacctggtgcgagcgccggacaactgatcgaactggatggtgtaaacatacgtcttaaaaacccgtgtaacgctggtgatacgcttcaattcgttacctatctggatggtattgccgcatggcgagcgacgtatgaagcgcataccatgcgcgtatataacacgggtgacaccgaacaggtaagtatccctggtgaaatttgggttggcgatctgccgaataaactcacattcaccactgctgaatttggtatcagtccgcgaattctggttaacccgaactcgttcgaactgctgctgaacggtcgacagcttgttaaagcaggtgatgcggatctcccgacatttatttgtgagggcgcagaaggttatgacgaagatagctgtattgcaaactccggtttgtgggttccttctggtcaggattacagtctgatttttgttgattccgaggttactggtattaagtttgctcaacctctggaaactcgcgatgtggtaactattcgctggttcaacaatgatatcggcactgtaatggaatgggacggtgtaggcggtattaaagaacacaccgataagatttatctgaataacgaagaagaagtaacgctggttaatcagattgaatacaccgattataacaacccgactcagaaaaccgcgcgaaaagtcgcagaaccgtttagtggtcgtcttctggatttgcaagcgttctttgacgttattcacccaatcgggacaatctacgaaaacgcgcacaacgatgctaacccaggcgattatatgggctttggtatctggacacgttatgcggaaggaatgttccttgctggatggactaccgacgaagcagatagtgatttcggtttgaacaacaacgatctggatggttcaggtcaaccaactcacacttctggtggtactggtggcgaacgtggttatgaaattaaaccgattaacgttcctgaaatccattcaaccgataaggtgctgattaaggatgacaacgggatcattattatcggtggttgtcaggttgatccagatgcaacagggccaggttacactaaataccgtgaggatgtattaaaagtaaatcagggtaacattaccccagataaactaaaaacgctcccgccgtatattactgttcaccgctggataagggtagcataaatgacacagtttatttccaaaacaagggagggggcgaaagtcccttcccgcgaagcagattttttgcaatatgaaatgggttcgaaattaccgctgattggcggtaaacgtaccattggcggcgcaaacgtcgatcaacttcgaaaaggggtagaatacccaaacgtacaatcagcaattgatgacttatattctctgtctgaacaaatccccattaatggggtagtaacaatggcagaagataattcaccgtctgcggttcagcaggtcgaaagcattacgtttgatggtactgttcagaacccagatccagatcagacgaaagcgactgttcatgtttacgggttcccgtttgtttttgacaacacaacgaacgcatcaaccgtatgcgaaaccgtttataacaaatttactgaatttgtgaacgatgaaaaatatttcgatctggtgactcgaaagggtttaaatggggagatcctagaagttcgttttattgacgcggttccgcatcctgtaacgaacacttccgaaaatgggatcagtatggtaggcacgatcgacgtacaggctaaatctggttatggtacatggtcgaaattaggccaagcagatcttccggttactcctgctgttacggtttactatttcaagcgtattgcataaggacaataaatgaacaacacaattaaccacgtaagcgataaatccgtttacgtgacatttgatcctgctggtacgcaatggcctagcacgtacacgaatgttcagcaagcgcttgcatctatcggatcatgggcgcgtactgatgttggtttgcctaattccgcgcctggtgtgcgtggtattgctgctattgctacacaggaaatgattgatgcaggtacagacacacagacgatcgtaactccggctctgctggaataccgtctgcaaaaccctcatgcatcacaaaccgtatggggttacacccgttacgcaactgatgcagaatcaataaccgtaacgaacgatctggtttcattaacaccgcgttcattgaactatgtgtttaacacccgtcagtcaaaagaaaacgcctggggttctgcaaaactgtcaaccactgcacaggcaacgtctggtactgatgacacgaccgcaatgactccgcttaaagtgaagcaagcaattgctgctatggttccggtacagtcaaacgcaactgaaagcaatttcggtttggtacagttggcaacagttgccgaagtccgcgcaggtactatccgcgacggtttcgcaatttcaccatacacgtttattcgtctgactgcaacagaaaccgatttaggcttactccgtatcgctacacaggaggaagtaaacgcgggtactgataacacaaaagcaatcaccccgcaaaaacttgctgctgtgaagggttctggctctgcatttggtttggttaaattatcaacagatgtcaataccggattagcgaataccgcgttgtctgctggtgctaacgtagttccaagcaacagaaacagtgctatcactggcggtgcgttgtatcagggttctattgttgctgacaataaataccagacacaaagcgacgttgaagtaaatattccgatcggttgtatgatgctatctgcatttaactccgactatggaaatatttttatctgtaacggacgcgcaatgaaccgcaacacatatcctgttctgttttcccgcatcgggtatacatacggcggtgctggggatattttcaacctcccagatatgcgcggtgttgctgctcgcggtttcgatgccggacgtggattagatcctggacgtggtttcggtacttaccaggatgatatgtttaaatcccacgaacaccagttacagatgatctatcgtaacggtggtaatcttccgtcatccgaagcaatatacgaattgaaaaattcagaaaagaacgaccagttaattatgcaactgaatccagcatacactaaagctatggcaactggcggaaatgaaacgcgaatgaaaaaccttgcggtcaactacgtaattcgagtacgataaaggggttaatccatgatttcaaaacttaacccgttaccaaagatcccgtttgttgatggtgtccctgcggacaccacacaaacccagatcaattggattgttaacggcgaaactctcgatggtgcaaaaaccaaaaccactaacgagggttctttaaacagatgcggtgttctggttcaaaagaacgcggtacaattagaagcaaatacaactacccagacatcaaaaatcaacgaagttatcgatcaggttaacctcattactgaaaacctcgcggcgatctctgatgatagtgtgatcgacaaactggataaagttgtcgctgatgttgacgtgctgaaagtagatatgtctgctgtacaggcaactacagcaagcaacaccctgaaaattcaggatatcgaaaaggaaattggtgtatgggatgcgtcaaccgatcctaaacatcgtaccattcgaaaagatattattttcctgaaagatgaactgggtgcatatcctggctttaacgaagatggtgatgttgatccgtcctctactggctccggcgtgaaatacaaggtaatggctaacgctcaggcggtatctatccatgaagcacgtattactaagctggaagatgactgggtaaactcagatgtaggtaatttaaccgatgaagttaccgatctgcgtaacgaaatggggccgaagcatttagccactttcgaatctgtgtatgttcgtctgaatggtatcggtggcgatatcactggtattaataccgaactgtcaaacatcaacacttatatcgggcgtacaggctcaggtggttctggtagtattgattcccgcatggaaactgcggaaacgaacattactactctgcaaacccagatgaatgatccggttgttggggttctgcctcgcgtaatccttttggaaagcgctgttggtaactcacaggttccaggtagtatccgttacgatatcagcacaatgaaacgtagcattagcgatctgaatatgatcgttggtgaaacaagtgatgatggtctgcgcggtgaaatggcacaggttatgaccgatatcggtactgactctcagccaacaagcatcaaaggccgtctgctgaatgtggaaaacacacagcgcgacgaccaccaggcactggttgatattaccgcaattgtgggtaatacgtcaactggactcgttgcggctaatatcgcgatgggtaaagctgtttatggtgacgcaaccagttctgatccattcctcaaagatggtattcagaaaacggctcgcgataacaaaactgcgatcggcgttaatactacaggatcagaaacagggatttataaactgatttccgatctgactgcgcgtgttgctgctctcgaagctggcggtggtggtaacgttgaacaacgtctggacgaactggaacagaataaagcctctcaccaggatgttactgatgctctggttccgtatatcacagaagttgaagcggataacaaatacgaagcgaagaaagttccactgtcatttactcaaaatctggtcggtcgtaacgattatatcgagggtgatgctatttctttatctgttaccgttacaggtggtaaactgccttatgtgtaccagtggaagaaaggaaccgcaaatatcgggactgattcaccgagtgtaattatccagaacaccacaacgagtgattccggcgtatataaagttgtcgtaaccgacgctgaaaataccgtgattacttctgatgaacttgacattgtggtacatacggttcctcagttcgatacaaacttgagtgatatttctgttgttgatggtgatccattgactctggaagtagtgtttagcggtggtaaaactccgtacacttacgtatggcataaagacggatctgtattgagtggtgaaactggttcttctatcgtcaagtctgctgcaaccagcgcagatgcgggtgattactatgtaaccgtaactgacgcgatgaacagtaccaacgattcagcaaccgcgactgtaactgtaacggtagcataattttaacaaggggcgaaagccccttttgaggatcatatgattacgaataatccagaacaattgaaagatgaaattcttcgtcgtctgggcgcaccaatcatcaaaattgaagtcactcaagaccagatttatgactgtattcaacgcgctttagacttatacgcggaatatcattacaacggcacgaacaagagttatattattctgactctgggcgacgataacccgcgcaacgtgttcgacttgagcaaagagcacatcttcgcgatcacgaaggtattgcgcacaaacatgggttcattgaccacaatggacgggacagcggtttatccgtggtttaccgatttcctaatggggcttactggtggttctctgggcggtcgatgtgcatcaagcgtgtacggtatgaacgcatacggtgcggatatgggctactttacccagatgatgtcctatcaacgctcaatgcaagacctgctggccccactgcctgattactggttcaacgatgatactggtcagttctgcgcatgggggcaggtgaacaaaggtgacattatcgttattgaagcgatggttcgttccttcgttgatgtccctagctccgtaggaagcgtcgcaggatacgctacagcgggttctaacgcagtggaagaccaatccatagccgacatctacgaaaacccgtataacagcgttgtgggcggtgtacgagcgggacagggttcaactgttacgggcggaacgtctgcatataacaaccgatgggtaaaagactactctaccgcactggtgaaagagatcaacggacaaattctggctaaattccaggggatgcaattgcctggcggtgttgctcctgatggtacgcgactgatccaggaagcggaaaccaaactgcaaagtctgcgcgatgaactgatttctatgtctgacgcagtaccgatcattatggtgtagggggaataatgcaaaactgggatgaaagtttattcgctcagttgtctacgggggaaggggttgatcgcaacttaaaggatcaggtcactaacccgtatgtaaactggtacaaatacaacccgacacaacagctacacgattcactgacagcagaatcaatccagatgaaatcgcctgatatgtattacgtccggcgtgacttcgtgaatattgataagatcctgggcgaagaccgagaatccaaatttacgaagtcatggaaaattgctgcatatattgaatcgtatgccaactatgaaggacaacgagatttctttagtaaatttggtctgagttcaaacgatgaaatgacgctggtaattaaccctcgtttgttcgcacatcaaactgatggtggtattcctgttctgggggatctggtttattttcctatggacaatagcctgtttgaaattacgtgggtagaagccgatccgttctatcagttcggtgatcgtcctcagcgtaaaatcaacctggcgaaattcatctacactggtgaagaactggctcctgaattgcagcgaaatgaaggaatccatatcgaacctgatgcagaactggatctcgaaccgattcgaaatcttgacgggctggctgatatcaacattgaacagtacgaagaagacaaagaatttgaaagagaaggtgatgaattcatcgaatcttttgatgttgtcaacggacgcggttcaccgtttgcaagtctgccataaatacgttatatgggtataggcggaagtctataccctcttcaaagaggattttatgatatacacaaaacttaaagaatggttgcctcatgatctatacgttgagtatgttgatatcataaaggcttctccaaaaactgaacacacagaaaaacatcatatattaccacgttctttatttcctgaattcgaacacgaaccagaaaatttagtagaacttgatataatgaagcatttgatggcccacaggacattagcaaaaaccaatgatcctaaaatgattcttgcgttcttcatgatgttcacctatgaacacaaacgctattcatcgttatctgaacaagaacagcagttcattcttgaagaaaagacaaaggcgcgaaaggcaatgcgcattgttaaaaaagaacagatgaaaggcaaacatgacggtaaaaacaacccattttacgggaaaaaccataccgacgaattcagaaaaagaattggtgctgttcataaaggaaagaagctatcaccagaacatatagcaagtctcgttgctgctcacaaaggcaaaaaacgagaaaaggtacaatgcccccattgtgggataatgtgcgccgctaatacagcgaagcgctggcactttgataactgtaagtctggacgcgtccagcagggggattagaaaatttttggatactggtataatagctcactacgcaactacattgttcttatgggacaattgtttaaccatgttcaggttaaaagagtacgcggcgatcaagaaaaatacatcaaggttccgatcacctatgcatcgaaagagaagtttctcgcttccatgaacaaacttaactacacgttgagtcaggaaaacgttgctaaaacggaaacaattttaccgcgcatgaacttatcactggtggatctgcaatataacgcaatccgtaaaaccagtatcgcggtcaaccaaaaaatgacacagttagcaaccccacgaaaaacgatcacacagtttaaccctgtgccgtatcgtctgattttcgaactgggtgtgtatacgcgatatgaagatgatatgttccagatcgcagaacagattttgccatattttcaaccgcatttcaactgcaagattaccgaactgcataagaacgaaatcacagttgaccgagacatcaaaatcagtctccagtcggttgcgccggataccacattcgagggcgatgcaaatcaacgccgtcatgttgagtggtcatttatgtttgaattacagggttatctgtacccgcctgtaactgatgtcaagggcgaaatcagaaccgtttacacggatttcttctctaacatgaacccgttagataaagataactttgaatccgtggatagtcaagccgatccggtagatttgcccatgcaggactacacgggcgaagaatatattcagacgtactcgcatgataagccgatcccgtctggtgatgaacctcctaagccgagggaatgaaaatggatgaaaaattagatttgcagcaattgctgaatattgattccctccctggcggcgttgagtctggggaggatgtggttgtttacgagaaacttgaactggttgacgttcaatcacatccagcagaccggaaaccggatctggaagaggattatacgctcgcgcgtaagactgcgcaccatatgaatcagatgatcatggatatggcgcagatcgcattacacaacgcgaagaactccgaatcgcctcgccacgtcgaggtattcacaagcctgatgaatcagttaaacgtttcaaacattggcctgatgaagattcacaaagaaatgcgtgagattacggaagagactacaaaaccaggtgctgaaaaaggcggtggtggtagtgaaatgaatatcgagaatgcaaccgtatttgttggttcccctacggaactgatgcagaaatacggcagtgcatatgaacccaaagagggcttcattaatggtgaagctgtagaggtaaaccctgatggaaatggaaccgacgatcgatccgagtaaggaatcagatcaccctatcggattaatgcatcccaaatatctgaaaaagaaaattgatgaattggggatggagtggacacaaagcgaacacgataaaaaatggtatccgacaacgttcagtgactacctgaaaattaacggcattcaaaaggtcgatattcagtctaaggacagttcgaactttgccacgtacaaaaataaaggcaacaagaaaacccgatataacggcaacccaaacctgaaacgtgcgtatatccagactaaatggacgcaacaaatgttgatggagtgggtgaaatgtcgtgatgatatcgtttattttgctgaaacatattgtgcgatcacccacattgactatggtacaatcaaggttcagttgcgtgactatcagcgcgaaatgctgatcgaaatgcacaaaaaccgtatggttgcctgtaacctgtcgcgtcagttgggtaaaacaaccgttgttgcaatcttcctggctcacttcgtgtgtttcaacgaagataaatatgttggtgtgctggctcacaaagcctcaatgtctgcggaagttctggatcgtaccaaacaggcgatcgaactactgcctgacttcttgcagcctggtattgttgaatggaacaaaggttctattgaacttgacaacaaatgtaaaattggtgcgtttgcatcttctcccgatgcggtgcgtggtaactccttcgcgatgatctacatcgacgaatgcgcgtttatcccgaactttgttgatgcgtggttagcgattcaaccagtaatctcttctggtcgtaaatcgaaaatccttatcacaacgacacctaacgggcttaaccacttctatgatatctggaacgctgctatagaaggaaaatccggcttcgtgccttacacggcgatctggacatcggttaaagagcgattgtatacagacggcgacaacggtacatttgatgacggttattcgtggtctgcgaaaatgatcgctggctccagcaaagaggcattcttgcaggaacactgcgcggaattcatgggaaccagtggaaccctgatcgctggttggaagttgtcaaaactcacatggattgatattgatgaaacggaaacgaacttctatcagtataaacgtccagtagaggggcataaatatgttgcggtacttgatccagcggaaggtcgcggacaggattaccatgcaatgcatatcatcgacattacgacgatgccatttgaacaggttgcggtgtatcactcaaacaaaacgtcgcatcttattttgccggatatcctgttacgttatctgaatatgtataacgaggcatggatttacattgagctaaatagcacagggcattcagttgccaaatctctgttttccgaactggaatatgagaatgttatttgtgacagctacaacgatctgggtatgaaacagactaagcgatcaaaagctatgggatgttcgacgctgaaagacctgatcgagaaagataaattgatcataaataacaaaaagacaatactcgaatttcgtactttctcagaaaaaggcgtttcgtgggctgcggaagaaggatatcacgatgacctcgttatgtcgcttgcttgtttcggttggcttacaactcaaatgaaatttgccgaattctgcgagaaagacgatttaagactagccaatgaagtttttgcacgggaacgcgaacagctatacgaagacgcattatgtccggttatcgttacaagcggtgatgaaacgatttcggttggttctcacggtatttcgtttatataaattagaggaaattctataatggctttacaatctccaggtattgaaaccaaagaaacatcggtacaatctaccgttgttcgaaattcaactggtcgcgctgccattgtcggtaaattttcatgggggccagcttatcagatccgtcagatttctaacgaagtcgaaatggtaaactattttggttccccagacaacttgaccgctgactatttcatgagtgctgttaacttcttgcagtacggtaatgatctccgtgtggttcgcgttgtcgataaagatgccgctaaaaacgcaagcgcaattttcaaccagatcaaaacaactatcgcatcacagggttctaactacactgtaaacgatgtgattaaagtaaagtacaacaacgttgttgtagaagaaaacggtaaagtgtccaaagttgacagtaacggcaagatcctcgcggtaatcatcccaagcgaaaaaatcgttgcccgtgctaaacagattggtacttacccagatatttctactggctggactaccgaaattgtttctcagtcttccggtgtttccgcgtctattacgattgacggcatcgaaagcgattcagggatcactctgttgaacctggatattgcaaaagaaacaattcagggaaccgcattccagactcttacccagaaatatcagatcccgtctgtcgtggctctgtatcctggtgaactgggttcaactgttcaggtggagattatctccaaagctgcttacgattctggcgctatgatttcaggctacccttctggggtttccgttaagaacagcggtcgttctgtaatgacctacgggccacagaccgataaccagtacgcttttgttgtgcgtcgtggtggtattgtacaggaatccttcatcgtgtcaactgagaagaccgataaagatatctacggcgtaaacatcttcatggatgactttttcgctaacggtggctctcagtacgtttacggtacttccctgaactggcctaaaggcttctccggtatccttgagttcggcggtggtttgtcctcaaacgacactgtaggcgctgatgaactgatgactggttgggatatgttcgctgatcgtgaagcgctgcatgtacctctgctgattgctggtgcgtgtgctggtgaaactgtagagatcatgtctaccgtccagaaacacgttatctctatcggtgatgaacgtcaggattgtactgtgtttgtgtcgcctccgcgctctctgatggtgaatattccactggcaacagcggttgataacatcattgaatggcgtactggatataaactcagtggtggtactccggttgacaataacctgaacgtaagttcaagctatggcttcctggatggtaactataaatatcagtatgataaatacaatgacgtgaaccgttgggttccgctggcaggtgatatcgctggcctgtgtgtttacactgatagcgttgctcaaccgtggatgtctccagcaggttacaaccgtggtcagatccgcaactgtatcaaactggctatcgaaccgcgcacagcacatcgtgacgcaatgtatcaggttcagattaacccggtaactggtttcgcgggtggttccggcttcgttctgttcggtgataaaacactgactaacgtaccgagtccatttgaccgtatcaacgttcgtcgcttgttcaacatgatcaagaaagacatcggtgataacgcgaaatacaaactgtttgaaaacaacgacgatttcacccgttcttcgttccgtatggatacaggtcagtacatgactaatattcgtgcgctgggtggctgctacgattaccgtgtaatctgcgacaccacgaacaacacaccggacgtaatcgaccgtaacgagtttgtagcaacgatctacgtgaaaccgcctcgttctatcaactacatcactctgaacttcgtagcaacgtctacgggcgcagatttcgatgaactggtagggccgcaagccgtataacgtcaagggggctgaaaagcccccataaataatccgaggttaaaaatgcttactgacattttacgcgcctttgaatccggtgatttcgcacgtccgaacctgttcgaagtagagatcccgtatctgggcaaaaactttaaattcaagtgtaaagcggcaaccatgccagcggctacagttgaaaaagttccggtaggataccaaaaccgcaaaatcaacgttgctggtgaccgtacctatgatgactggacaatcacgatctataacgatgacgcgcataatacgcgtgacgctctggtagcatggtcaaacatgatgcacggaatgggcgatcagattagtggtgatattccagcgaactacaaaaaaaccgctacggtgaaacagaaaaaccgtaacgatgaaattaccgccgaacataccattcacggtcttttccctactaacgtaggcgaagttaccctggactgggacagcaacaacgaagtgtcaacctttgaggttactttcgcgctggactggtgggaataaaggctataaatacaggggtagcaatacccctatcattatttttcggagttactatgaactttttgggctttggcaatgtacttagctttttcaagaatttcgcccgtgaggacgaattagatcttgaacagcaattaaaaaatgatacaggttcggtcgcgcctcctaaaaataatgatggtgcttatgaaatcgaaactgatctgactaatcagaaatacgcaagcgtattccagcagttttattctggacaagatccggcgattcagaacaaagaacaattaatcaatacatatcgcggcatcatgtcttacccagaagtagaaaacgctgtttctgaaattattgacgatgcgatcgtgaatgaacagggcaaagatatcattactttggatcttgccaaaacagattttagtaaggcaatccaggacaaaatcgtagaagaatttgataacgttctaaatatctatgattttgataacatgggtgcgcgtctgttccgtgattggtatgtggattcccgtatctacttccataaaatcatgcataaagacgaaagcaaaggtatccgcgaactgcgtcaacttgatccgcgttcgatggaactgatccgcgaatctatcactgaaacccttgatggtggcgtgaaagtattccgtggttatcgcgaatttttcgtgtatagcgctcctaaaaatggctatacatacaacgggcagatctaccagcataaccagaaggttaaaatcccgcgctccgctatcgtgtatgcgcattctggactggaagattgcagtaacaacattatcggatatctgcaccgcgcagtcaagccagcaaaccaattgcgtttactggaagatgcgatggtcatttaccgtatcacccgcgcacctgaacgccgtgtattctacatcgacgtagggcagatgggcggtaacaaagcgacacagtacgtaaataacatcgcacaggggcttaaaaaccgcgttgtgtacgatgctaaaacgggtactgttaagaaccagcaaaacaacctgtcaatgacagaagattactggttaatgcgtcgtgacggtaaagctatcaccgaagtagacacgcttccaggcggtgctaacttctctgatatggatgatatcaaatggtttaaccgtaagctctatgaagcactgcgtgtgccattaagccgtatgcctcgcgatgatgggggtatgcaaattggtggtggtggcgaaatcacccgtgatgaactgaaattcagtaagtttatccgcacactgcaaattcagttcagccctgtgctttccgatccgttaaaaactaacctgatcgcgaaaaaaatcatcacagaggaagaatgggaagaaaacgttagcaaaatttccttcattttccagcaagattcatattacgcggaagtgaaagatattgagattatggaacgtcgcctaacgttgatgtcacaggttgaaggtgtagttgggaaatatgtctcccataaatacatcatgaaagagattcttcgaatgtctgatgaagacatcgacgaacaagcgaagctgatcgaagaagaatccaaagaagaacggttcaaaaatcccgaagaggaagaggaaaacttttgatgaaagaatttatcgaagcaatcaaaagcggtgatctggtggaagcgaagaagcaattctattccatcatggaagaccgtaccgaagcccttcgccaagaaatgcgcgttgaactcgcggaagctgtacgcatcgaaggtgaaaccgacgatgacgacaacgatgacgatgacgacgacaaaggcggcgatgataaaggcgacgacaaagacaaaaagccgtctgataaaaaagacgacgataaagacgaataagaggtgtaaataatgcaactcgaactcgaagaaatcagcgtcgaagatctcgaaccccatttaaccgaagcgaaagcccgtgttgatgttctggggatcgatgacggcactgtgaagatcatcgaaaatttggcggtcaatgaacctcatttagccctggctatgatgtccattgtcgagggtttgagtttagatgaagtcattgttaaacacgtagattcgcgcggtaatgtggaacgtaaaaaagaccgtaaaacccgtgaacgtaatgcgtatcaaacaactggtttaactaaatctcaacgtcgccaaattgcgcgtcgtgcgctaaaaacaaaacgtgcaaacccttctattacaacccgcgcacagcgtaagcgtaaaaaagcgctccgtaaacgcgccgcattagggctataaatatgaatgaatcccaactcaatgaaaacggcgatatgctgctaatcgaggaatggggtttaccttgtgcggatatttccgattcgattttagaatcggtcggtgagtcgaaaaaagacggtaaacttcggattgaaggtattttcctccaggccgaaaaagttaaccgcaataagcgactgtatccgaaaaaagtattagaagaagcagtaaacgattatatcagaactcaggttaatacccgtcaagctctgggtgaaatgaatcacccgccgcgaccgaatgtcgatccgcgtaatgcttgcatcctaattgaaaaattatggtggaaaggtaatgacgtttggggtcgcgctgttgttgtcgaaggtgataacggtgatggggataaactcgcggcgttaattcgcgcaggttgggttccaggtgtttcttctcgcggactgggtaaactttccgattctggaaaaggttacggtatcgtacaagaagggtttaaattggcggtaggcgttgatgttgtttgggggccaagcgctccagatgcttacgttaagccgattaccgaatctcagtcaagcaaaacgcttgttgagaataatagtgctgatgatgacgctttcagaaaactctctgaacgtttgaaaagtctatataaataatatcatatcaaacaggaaacttagaaatgcttaaagaacaactgttggcagaagcccagaacctggataccccagttgagttagacagcattttcgaatcagttgaactttctgatgatgcgaaagcaaacttcaccactgtattcgaacaagctgtaaaagcaggtgctgcgaaactcgctgaaacccacatcgcccagatcgcggaacgctccgatgaactggttgaagcccaggttgccgaaaaagctggcgaaatcgaaaataaactgtacgaagatgcgaataaatacttcgaccacatcgcgcaggaatggctctctgaaaacaaagaagctgtgtcccgtgatatcaaggccgatctgttcgaatctctggtaatgggaatgaaagaactgttcgttgaacacaacgtagttatcccagaagcgcaggttgatgttgttgcagaactcgaagatgaactgaccgagaatcagcaggaagttaaacgcctgttcgaagctaatcaggctcaggctaaagagatcgccaacatgaaacgcgataccatcgtttcagaaaaaacaaaagatctgactgaatcgcaaattgaaaaggttcagaacctgatcgaaggtttggaatattccgacaagttcgaatccaaactgaccgcaatcgttgaaatggtagcgactaaagcggaaaaacaggttgaagagagtaccactactcagacaaccactaaagatgactttgttccggtgaatgaaaatacacctccagcagagaaatcgaagatcaataaatatgtacaagcggctaaagccctttcctaatcttataaggtaagaaacaatgtctaagaaaaacgaattgatggaaaaatggaacgatcttctggaatctcaggaaggtttaccggatatcgctaccaaatccaaaaaacaactggttgcagcaattctggaaactcaggaaaaggatgctgatactgatccagtatatcgcgacgaaaaaatcattgaatccttcggcggtttcctggcggaagcagagatcgcgggtgaccacggttacgacgcaaccaacattgcctctggtaaatccagcggtgcaatcaccaacatcggccctgctgtaatcggtatggttcgccgtgcgattcctaacctgatcgcattcgacatttgcggtgttcagcctatgactggccctactggtcaggtgttcgcactccgtgctgtatacggtaaagatcctctggctggcggtactcctgcaaacgttcgtgaagcattccatccgatgttcgctccagacaccatgtattctggtgaaggtgcaaacaccgcgtttgctgctatcgcaactggtgttgctatcgcttccggcgctatcgttaagcacgtattccaggaaactggtgtcgcgtacttccagaacgtaacctccggcaacgtaaccgtaactggtgctgatgctgctgctctggatgctgctgtaatcgcagaaaacgagaaaggcactctggctgaaatttccgaaggtatggctaccagcgtagcagaactccaggaaaacttcaacggttccagcgctaacccgtggaacgaaatggctttccgtatcgacaaacaggttatcgaagctcgtagccgtcaactgaaagcacagtattccgttgaactggcacaggatcttcgcgctgtacacggtatggacgctgacgccgaactgtctgcaatcctggcaactgaaatcatgctggaaatcaaccgcgaaatcgttgacctgatcaactacaccgcgcagattggtaaaactggtttcacccagaccgtaggctctaaagctggtgcgtttgacttccaagatccagtagatattcgcggcgctcgttgggctggtgaaagctataaagctctgctgattcagatcgacaaagaagcgaacgaaatcgcgcgtcaaactggtcgtggtgctggtaacttcatcatcgcttcccgtaacgtggtttccgctctggctcgtatcgacagcggcatcactccggcaggtcagggtctccagaaaactctgaacgtagacaccactaaagcggtattcgctggtgtactgggtggcacttacaaagtgtacatcgaccagtacgctcgccaggattacttcaccgtgggctacaagggtgataacgaaatggatgctggtatctactacgctccatacgttgcgctgactccgctgcgtggttctgatcctaagaacttccagccagtaatgggcttcaaaactcgttacggtatcggcatcaacccgtttgcgaactctcgctctcaggctccggcagatcgtatcacctctggtatgatcagcaaagaaatgtgcggtaaaaacgcatacttccgccgcgtgtgggttaagggactttgatcctaagttgttgaaaaacaacgactttttaaagggaaccttcgggttccctttttgtttatataaatagtgaaaacatttgaggctatattatgaaacatatcatttataaaataacaaacaccatcaataacaaaatatatgttggtgctcactcaaccgaagatatcaacgattcatacatgggttccggtattgcaatcaaaaaagcgcaaaagaaatatggtatggaacatttcacaaaagaaatacttcatgtatttgacacccgtgaagaaatgtatgagaaggaaagggaaatagttgatattgaattcataaatcgaccagatacatataatgctggtattggtggtaaaggtgctccaatggcattgattggatggagtgatgaacaacgcaagctgatttctgaaaatacttcgaaagctatgcaagctccagaaatgcgcgaacgcctttcaaaaatcaaaacaggaaagaagcaatcggaagaatccaacaggaagcgttcagagactatcaaagctatgtataagggttctgcattcgatagaaccggatctaagctcacagacgcacacaaggccaaaataagccgttctgtatcgatagatggagttgtttacgcaagcggttccgatgctgctaaagcgttgggactttctcgatctggccttgattaccgtttaaagagtgacaaatttcctgaatggaaattcgttgcataaataaacaatatactccctataattcaggaaccaaagaaatgagtgataaacactacacaattcacaagttgatgcgtcagtctgcgcttccgtctggtaaacgagaaaaagttatcaacgaagcaacaggtacgaccgacatcaacgtacagaacacgcgcccagaactggtttctttgactcgcgcggttaacaacctgatctatcatgaactggttgctgtacaagaaacagaactccctgttgcaacactgttcggtgttcgctatcgcaaccctaacggtgatatgactttctccagtgctgcaacctattcaggccgaatctctggacgtacagacatcgacgaaatcgatctgactaaagcctacgttaaaggtgatttgttcaagcatgacggcactgacgttgtttatgaggttatcgcaccgattgccctgaacactctggatactgacaaagacaccgcgatcatgaaagctgtgttccaaagcaaaattcgactggttagcgaagccgctgatacttctaagtatgaaaccagtgaagatatcgcgtcaacctccttccagatggatcgctggaatattccggtacgttcgcgtaagtttaaaaccgaaatgacggttgaactgatgcaggatttggaagcaaaccagtttgaagctgatggggtgatcgaagacattctgggaaccgtggcaagtgaagaagtcaacaaagacattattcaaactctgatcaccgtttccaaacgttacaacgtcgatggactcgttacggatggtatttttgacggtactaccgcatacaccgcgaaggatgctccagcattgggtcgtatcctgtaccaattagcgtgtgaaatggggcaggaaatgaatagaacgacttcatttgatgctacctacgtcctcgcaacagcgcgtgttgtaggcattctggctgcgtctggttggatgcacgaaaccgacgaacaacacccactggcaacaggtaagctgaacaacggttattatgtctatacagacaccaacagcccgttcgattatatgctgactggttgcaaatatgatctgggtgatatggatcacgtaggctctctgttcttcgctccgtataccgaagctgatgaagcaggttcaatcaaagtatccgtagatccggcatccctgcaaccgaaagttgctattctgatgcgttacggtctttccgtgaacccatacacagcagaaagcgaatccgatcacctgatcaaaggtgatgattggtctgctcttgcaggtaaatctaagctgagtcagatcgtaggtattaagttacctaaactgggttaacaagttttgttttgagaagaccattatagtaataaagatctataaggtcaaacgagctaagcgagttttcacgaacgaagtgagtgatgggtaagtacgatgtactgtttataatatttatattt

SEQ ID NO: 6 - DNA, 39187 bp, Unknown
  source: /note="Description of Unknown: colon-14 Bacteriophage Sequence"
cacagacactctacccttagtgaagttcattccataaatcgctgcgaggcttatggacgtctggtaggtatcatcattatatgccccggtagggatgatgtatttcctcttagcgtcgatgtataatctgtaaggctctcccggaatgtctatagagttcttcgtgaagtgtaagcgtcccatccacacagcatgttcattgcccatcaatacagtcatagttgagtttatcacctgtgctgcaaacaccgtaacgttgtccccaaagtcccaatgagaccacgactgctgcctgatttcttcatcaatatagaggaacttgtagatatacacccggttcggtgctccgctcgtgaggatagccgcgaagttctcagcggttgtacccgatatactgaatactccattcggtatgtagttcggaacgtgagccgtcatgtcctctgcgttcttcacagagcttacatcctgtaccgcatagtatcggttaatggatgtgaaggaagagcgaggtgacgcaaagtatacattacgccccacaccgtgtggtcgcgccctgtcttgcacgtcgaactgagtcgtaaggttcaactctacggagcgactcgaaaggataccagaggctgtcagaacgaactgcgcttggtcagaccacaggagcaactcttcggagaacggaacggcatacttcaaggttgacacccggttgtgactaacggcaacgtcgattgggtcatcgtcagagtagttagacacggaggccgggaagaagttgaagtatttcgaggtgcgagacaagatgatgttctccccgctaaggaaccccaaacggttacggaagaagaaaatatcattgattgtctgtccggtaaacgatgggtatgggttagttgtatcatcgcccacagtacgagcaccccactcaaggtacttgaagtcaaagttcccgtcagaagcacgtaccagcgcccaaggcatcgtgtggtagtgcaggtgagtccttgtgttccagccgattgtttctacccataccttacggttgaggtcgaacctaacgtaatactggtcggcagtctttgaggtatcaccaacaatcttcacgatgtacccatctggagcgttaataggcaacttctggaacgactgagtgtaatgggttacagggttgattagctggtctgcgtaaccatccttagtctgtagtccccaaacgttatcgttatttggcgcaaggatatggatgaatccggggccaacgttgaagcgccacttattcgggtcttgctcgttgttggggttccctaggttattccgcaactgagccgccagcttctcagcgatggcctgaccgtcaacctcattgacgtgtgctggttgtgagccgtctggtagttgaatagcagcacgctcagccccgttgaactcgattgagagcctacgcccatattgcccaccacgaacattaatcagcgcatcgccttggtctttaaagcccggaaggttgaccgattggtcgttactctgcacaaccaccttgcggttagtcacaaaggtatagtctgccacagttaccatccgaaggtcttcccgtgggttagctgtacgcacataagagcggtctccacgtactagatactccttaccatcgaggtcgaacaccttaatgtcttcaccagtgaacacaacgaaatactgctcgaactcatcacggttgatgaggtgaacgtaaggttgcgcacccacatacccagcagcgccaagggtcttaaggtgaatcatcggtgggcgcttctggagaccctcggactcagaagaccaaccgttaatctgtacgctaccctgttcagcgaaccggagaatatctggctgttggctgataccacccttgaggtttttgattgattggctaataagagccatagagcctccttatgattagcggttaagtagaccagaggtgaatgcgtcaccatccagcatgttgtagttaccgtagtctagctcgtactcgaagcacgcacgccacgcttcctgttcctcttcctgcaacactccgtctacctccggcgcaccgaagaatcggttgttaaactggcgggaagccttggtaacgatatagtttcggaagcactcaggcatctcgtcgaactctctcagacgaatcaggttgacctgaacaccagaagggaatctgtcggtcttcgcagagcggtcatagagatagccaccacggttgatatattgggtctgaccgctggttgccattacggacagatagtcagagctaaatggaatcataccagagaacgcatccggtagaagagtcacaccttcctcaatattgaatgtccatcctcgtgattgaatctgtctgttaatcttattgagtacacgtcgagcattcgcaacgtcagcattcgcatcaccctcaagggtcgatactggtggctcaccgatggaagccagaatatcgttgacggctgatagctcttctgcggtctcaatgttcatctcataagagcgcatggtgttacctcctgttagtgagggtttaaagcaaaaaacccctcagataccctcagagggcacccaaggggttcataaagtaatgaaggaaagtaaatccccggtaaagaccttagccttctacgggaggctctactgctttcacagtgaccttgcagacagccgtcaggtcattcacagtagtcgcagtgatgtcagcggagccagcgcccacagcagttacagtaccagaggcatcgaccgtggcaatcttcgcattggaagacgtaaaggtcactgtctgtactgcatcagccggagttaccgtagaagtcagggctttagaagccccaacgtctaagctcatagtcttctgactaagagtaactccagtggggtcgggaattactccgacacctttgggagaacgatagcgccagcagcttctggacgcagaccgccgtgacccatcgcatatttagcgataatctggtcagcctgatagttcgcacgacgagcgcgctccagagccaagtctttcagcttgaccgtaccaaccgcagagcggtgctggaacaggccaacaacgttatccagagcaaccttaacggtagtgctggaagtcgccgggaaagcgtgcttctggtcagccggagtgtcctcacggtcatcaccagcaccaccagcagtcaggtgcggaacctcaaccacttcgaagcccatcacgttacggatagtaccgcgctcagggtcaatcagtgcctgatagtttgcagcgttcggcatcagagcagccagaatcgcggagtagttatcaggagtggtgtagaaagtacggtcagcagccggaacgtagttcttggtcagagcagcacgagcaacggtcaactgagcgataatcgctttacccagctcaaccgggtcagtcaggtcgccagtggtcggcttaaccagagtcagtacggtaggcttaccgagaccctcgatgttctcattggaggcgtccggcaggttaaccagaccagccagttcagccagtacagcaccgtcagccgccatcgccagagattcacccaactgtgcggtgtactcggcgcgaacgtcatagtggttcatcgcgtcctcaatgtcgtaaatcagcacgtccgcagtcagcaggccatcaatgtggattaccttctcggtgtgtttgatatccttacgtttatcatcgaggttctcacccggtttcaggtaagcagctttggtgcgaccaatcacagggaactgtgcggacttaccagaagcaatagagcgcagcatgtgacgaggcatggtcacggaggtgcgagcgaaagcagtcaggacttcaccgccgaacactttcaggaacagcgccaatttgtccgctgcggactgacccttaccctgattagtaccaatttgctgtccgccttgaatgttagccatgttgaatctccttatgttaatttaaagaaaagtttggttactacttgaatcgagttggttctcaatgtttcacctacgggagtgaccacaaagttctgtgctcaggtgattcaaccattgtagtcatctatggtctctccctttagtgagggttaattagaagctggagtcgataaccttctgttctaccatttggcggtaggcagaatcgctacgatagcgcgggtcgctcatagctttaatcatctcagcctgattcgtaaagccctctttctgacgagctactggtttaaccggagtagcacgcttggtaacactacggttggcaggcttaccgaatttcttcgtgtaactctcaccagccagattgataattgctttgacagtcgccaagtctcggttcatcatggcagcctcaagggactcagccgcagccgggttggttgcttcaaggtgcgtatggattgcgctaaagcgctccttaccaccagcaaaggcaactacctgattgacgtactggtctacaagggcttcctgaccggagatgtaggagtccacaaaggcacgactatagccagcagcttcgagttccgcgtaggatttctcagagataccatcggcttcgtactcttcgtagatgcgagtcacagactctgcgctcagtccacgctcaacggcctgctcgaccatcgcctgaaagccttcttcgtgctgtcctaattgttcagtcacttggctcagttcttctggagtgtcacccagcggctcaaactcatcggcttcaccttcggtctccacctcagcgttatcgctaccagtgtcgaactcggcttcattaccatcttcactgatacgaacctgaatgcggccctcatcgtcttcaccatcagcgaacgggtctacaccggatgcatatgggtcatcgttatgggaactcggttcctcgctaagtacgattgcatcatcgccatcacgggcagcaacatcgagactcagcatattctgttcgtgttcagtaggtgtacttccggtcattaccgcgttgttcacaccgaaggacgcataaacgtctgcattagattcagccattgttaaatctcctaagttgttaaagataaagggaaaccaaaggactccaacctttagtcatcgctcatttcaaagatgaggtctccctttagtgagggttattaggtggcgtcgaggccagcctgtgctgcggcaccctgcatagcgtctggacttgaggtcgctagggcacccacgccagccccaccagttgcggcagcgttctcgatacctgtttgggccgcatcctgcatcatcagggcttgcttctgctcgtccgtcagtaggataccagaagtatcaataccaatggcgttcgcaatgcgcagcttaatgacagcgaggttaatgtccgggtctccctgcataggagccagagcagcccaagcggagatacagcgctccagcttatcgaggtcttgaccacgaccgattgcttccagacctgtactgatagtcggctcaacggcttctttcggtagctcaggaatctgcgaggttgcttggagttgcttcaagagcacacgaaccagaggcaattgcagttcttgagacagaatcgaatagacgccaccaagcgtatcttccagttctgacgcaacgtaccgaatctcttcggcggtcacacgttcaccagtgcgttgtaccgcagagttcaacataaaggcatacgataagcgtgcttctatctggtcactcacagctttcgctacggtaaagtcagcttgcttctccagttgcaggaagtcaatgtcttctcgacgaccgggaacgaagtcaccagtctgagctttggttaatctacgtggctgcgtaatgccagccgggttcaccagaccaatgaccttcgcgctaatcatactcatcttaacgatagcctcttggagattctcaagagaccttaagtcacctaagtattcttcacagtaggagcgaccgtaagactcaccatcaatgcgaaccatgcgaaccggaatgtagggcatcgcgtcagtcggataggtggcatcggagccatcaatctcaacgtcctctacttcctcgtacttgaggtaatcgccggactcttcatcgagatacacatgggtatacacatcgaccatttcgtccatcttcttctcaccaccagctttctctaccgcagaccgaacgtcttccgggagagcaccaaaggctatctggtcacgagtgacaatctgtaacacattgccgtatgcgtctctttggacaacataagaagacaatcggtacagcttcatcggattgtagctaccttcgggttccggtaagtaaagcagggcgttaccagccacgattaactgcttgaggcactcaaagagtgttacacggtaactgttggattcgatataattcatgataatacgctcaaccatagacagaccttcgtccaccttagcgagtccatcagggtctccaacaagctgcttcgcctcatattcactaatggtcagcttcatccacgactgcatcgggaatagtgccagcattaacttagaggccagattgttaagaccccgcgcacctacagcctgccacggcgtcgtgtagtcggtagattcgttatcggactccttcgggaacaaggacggaatggtgtattgcgcacagttttccgcacgagtctcataggctctacggtcgttcgttaggcggtcataggtagctttagcaccgtcttcgcccaatcctgtacgttttgaatcagccattcagtcctccttagatgttaatgccaccgccggagctacgggctacactcagagacttcttaccaccagcacgggccttcttacgtgcgctctcggtttgtgcctcatcctcaccctcagccttatcctgttcaggtacatctacaatctgtgctggaggtggcgcagtcactactggtactggagcctcttgttggataatctcctgcttacctgcaccaagcgcgcctccaaccaccttaccaacttccttacctgccttctcgactggtctaccaacttccttcacaactttcttaacggctttcttgattttcttgaagaatcccataatgtgtcccctatgttatgtcacaattacccaaacgcctttgtgcgaatggaggatttactcttgttcttggctgcgctgtcatccagctttacctttaggctgctcttaccgctgctcggtgtggttggcacctcagaggaagacacgctggtgtcctcatcgtcatcgcctccccataccacagatttcggtggttcagtcaaaggtgctggttcggcagcgcgaatctggttagtgtccatcttagggactttcaccttcggtttccagcacatataattactcctgtctcagttgctctttacgcacctcaatctcatcaagtgttcgagaggcaaggtacagaccatgcatcacacccgcaatgaaagactcagagtatccagcagcgcgtagcgcacggtactccccggactccatcacataggtctgattgaagcgcacctgtagatactctttagctgcacgaggcatactaggaatatcatcgggatgagttaaaacatgattaattggttgtaacataatttcacctcttaaggttaagtcttaaagtaataatcataaaggctccctcttccctttagtgagggttaatacagagagccttgagtttatcacttaatctcggagtctcgcttcacgtctcggactatgagagtgaacatccagagacctcgcgccagcatacctaccagcacagcgatggttgtgtactttgcggcgtccataggtaaatctccttgtcaatgtaattgtattcctcgaagcgaagaatgcgagccatctggccttgcttgatgatttcctgctcggtcatcccagctttggcaccaatggatttaatgcagtcccacagcgtctcagtcgcatcaggagcacgcttcacccacttggttactgtctgccccttgttcttaccggacttcaacacggactctacaggctccacaatgaacgggtcattcaggaaaccttctgccgtatcgccccagccgggaatcccggagtagccatcggtcatatcgcccttgatagtctggaagagatgccaccaatcagcggtctctttggtctgcgtcaagatgttaccagtggtacaccacaggaagtcaacgtccgggatagtcttgaagtccttgtcacaggagaccaacacagccttcttgaagccgaagacctcgtgaccagacccaatgatgcccataacgtcatcaccttccagcatgtcctctttgatgtgaatgaactcatcgcgctcccacagcttcgacaggaagtcacggtagcccacaggcttacgggtcgccttgcggttctccttataggtctcatcaaccagtaccttacgccagttcacatcgtcggtaaacgccagaacaaccatagcgtcactccaagccttcttacgggttcggtacgattcgattgcagaatcgagaatgctccgtgccttggcgtggtcacactcaagagtccaaatgtcgtctccccaatccgtctcaacttcggcagcagccattgactgatataccaaccagtcaccatccatgaccagcactcccttctccataggcttaccttcacgcatctccgcgaagtctttcaatgtgattaggctcattcgtaatcctccccgtaaaccatttcgactgcatcagagtatccgtcccaattatccacaccacacgccttaagcgcattcaggaactctaggtctttctccagcttgtcaatgtacgcgctaacgtcgttccacgcatcacgggtcatcgttacggtgtcactcttaggcataatcatacgcaacctcccattcgtttcaggaagcgcacaccagaggctgtgacctcccatgctccaccattgcgacctcccacagtcaaacagctaatgtgtccacgagaagcggcctcagctacgagagccgcattgtttcgcacatagttcgactgaaaggacttagggcaacctttgatagctgccagaactttcaggtattcactcatttgaacacctcgcgcacagttgcaggcgagaatctcatcaacttctgctcggtagagcttaactcactgtgaccatcgcggataaactcacggagaccttgcttgatacagaacgcaacagcaccttccggcccgtgtgtcaggccttgaataagcagttcttgtttgaacggattcagcttctcgccagccccggccttcttagctaggtctaccagcaactcgttcagattcttctcggattcactgtcaatcacagcggtaacgtcgaaggttactttaaagtgtttggtcattgccataatgtttctcctactgttagtggcagacggcccaatttggccccatcttaccttcggtatctaaacgacaacggaaagcccaatgctctccgacccaacgcatagcttcctgcgcggtgtcaataacaatctgagcgatgtgctcggtacggcaggccacctgaatctcatcgtgaacccaagccatgtacgcaaagtcaccatcccagccatgcttcaagcctttctcaatgagcatctcttcggtcttaataatccacagcttacaaatcagagcaccagcagactgcaacaatgtgttgagcgctgcgtgtggagacctgacgtgaaccttgcgaccatccagacctttaatccaacggcgtttccactggactttctgctcaccgccaatccaagcggaagacttaacgagagactgttggatagcttctcgcaatgctgcaatcgccggggtgttctctaagaatttcttcttgagttccttcccgcgctccttcccggccccaacaatctgaccaatcttctcatctcctgctccgtaaaggaacccgtaaatgaaagtcttggcgttgtcgcgtgtcgggagttccgcagcgttctggttcttggtgtgaatgtcaccgttgagaatctcattcgcatactctccgttgtcgaagcgagccatgaagtgtgccagacagcgcaactctaagccactggcgtctatccccgcttgcacccacggtttgccagtaatcccatccaaatgatgttcagcaccaaaagcactacgacactgctccccgtaaggagaacgaacaccgggtatctgtgcaaggtttgggaaactatgagtagcacgaccagtaactgcaccgttagggttaacggctccgtgaatcttaccatcatcttgaacataacgcaaccacgccttgtcaccttctgccgcctgaccgattcgcttctgaatcatcaggtactctttaatcaagtcaatgcacgcctgcttctcagggtcatccactcgtacatgctccaagacctcatcgtccaccacaggcgcacccttctcggtgaacttctcaggaacccatccggcctcctgtagtttcttctgaatgtggtcacggctactcggcttgaacgtaacgaactcgaccggagtatacggagcaccctccatgtaatccctcgtgtccaagtcgcaaggttcaagaccttcgcgctgtgccttattacgaggcttcttgtacacgccaccctgtttcggatagaccacgcgaggataactcggaagtggtttgcctgtccgtgggtgcttgaagagttccttaccacctttcggttgataccacgagccaaacgtttcggttaactttcgcagaagttcggcgcgtttcgctgccagttctacataaagttcctcaatggtctgtgtgttgaacgggaagccgttacgctcctgcttcgctaacagccacgctgcacgatgttcaatatccacagactcgccagcttcacgccagaataaatccgcatcgtacttcgtgaagcccatacccgcagggaagtagtggaggtcggtaaggaatttctctaagagcttgacagtgaccacaacgtcttgaacgttatacgccatcatcggctcgttgaatgaaacccactcagcaccctcaacatattcttcgccctgctcttccagcatagccttgaagtcgtccttgtattcgcctttcatctcgcccaagcgataaccccatgcctccagagcgtgagacccgaagcgacgaccgggtagtttcccggaacgaagaagccccatgtctgtgtctttaaggttcgcatgaagtaaacgcgagagtaccaatgtgtcaatacaattctcacgtggtaacttgaagtcacgattgagttgcagctttgcgagtttctctaaagccggaacgtcatacttgtgaccgttatggaaaacaataagcccacctcgcttcacctcggcttccagcgcatccagatacgccccgaagtcgcccggacgataactatgatactcaccatcacggtagtcatagatgacgccacagtgaaacttggtgactttctctaagaggttgttggcctcaatgtcacttacgagcataatgccctcctttggtttcgtgctaaatgataatcataaaggccaccctttggcgaccttgagtttatcacttctcgataatctcttgcataccagcgccgaactctaccagacgctcacggttatcgccgaccaccttgtcagcagccatagtcagggcacccatcaggcggcctacctgcttgtcagtcaaggtcatgcgttgagtgtgtgctttcggagacttgtggtctttccagcggtagaccatcgttaccttctcaccacgcacattaatatgcactcgacgagcgaactggtcagcggtgtccggcagacggatggtgtttgcgtgagtgattgacttgctcatggtgtgctccttactcaaagaatttgctcatggactgtgctttggctgcaatcgctgccgacttgtggatgccactaacagccgcatcggatttctcacgggactgtttcgccaactcaatggctcgctgtgaatcagctttggccttcttgtccagcttcttggcttcgacgaagtacagtttaactaccagcttacctaaagcgttaatgaatttaaacatggtgtgtctcctattgtttgaggttgttcccgttagtgagggttaatcaattatacattccgccatcgcagtctggatgaccgcagtggcactggtatttagaagtctgattgtccgtcttgttcagtccagccagtatctccttctccttcttcgccagtgtagctagacggttcaagccacccggtttctctgttgtattccatgtatcctgcaattccagtgtcgccagtgaaacgacacttaagcaggcgaaccaacaccaagttaggcatatcaccttgctggttacgctccaaggcgatgatagtatcagataactgacgcaaggcaccgctaccacgtaggtcagtaatagaaacagcgcgtccttcttcatgtggtttccccttctccgggttcttcaagtgacaaatcactacgagcacaacaccagttgacttagcgaacccttttagcttagtcatgaggcggtcaatcatcttacgctcatccgattcctcagaggcagacacgacgattgatatgtggtcgagcactataacatcacaccctaagcctgttcgcatgtaggccagcttcgctaacagcctgtcagcttcggcctccgcaaaggagtcataaaggtggaacgtatcatctccgaatagttcatcataccattcatcgaaacgtccgtcctctgctatagccttcttgacttcatcagactgacgcagacgaaccttattgttcagacccatcatatcctgaatggtatcctcaacggattcctccagcatcgctaggccaacacgtttacccattcgcttgccccaagccagcgcctgttgacgaacgaacgttgacttacccataccggaaccggaagtgaccatgatgacttcacctccacgggcacccaaggttctatcgttcaggccttgacagccatcgaacagcagacctacagcgtcctcggaggtcatagcttccttaacgcggtctttgagtgacaacgcagagacaacaccgtcaggcacccaagggtttgcattccagacctgctccaagattgctttgtcttcacccatgatgtgacactcattggcgtccttacacggcaacacggcaacacgaaccttaccagccgggagaacctgtgcggcctcttcgactgccttacgtcctgcgtcatccatgtcgaacatcaagataatctgctcgaactggtcaaagtattcatagttagcggcgcatgtcttcttagcagcagaggcaccgtgacccaatgatacgaccgggtacttacagtcttggagttccatcacagtgagcgcatcaatctcgccctcagtgaccacaatcttcttaccgccagaccagaggtgcttcaagaataacgcatcgctcttgtgacttccggtggtcttaaagttcttgtccttatcgcgcaccttctgtgacacgatggaaccattctggtcacggtaatccgcaacctgatacattcggttgtccactttcgccagccagtagccagccttttggcacgtctcctttgagatgccacgggcagtcaggtcagagtaccgaccgttgctgtcaccgaaattccatacgtcatagctcataggcttgctgcctcctgtacgtcttctcgttgataactttgcttcacgctcttcgtttgcgggtactcgatgttcacacacgaagcaccattcatgcccgtcagagtacacagagttaccatcagaagacccacagttttcacatggagcatgaaacagaaagatactatcgtcttctcgttccattgtacattccttaatcagttgcgagaacaaagggaaaccgttaagtctccctttagtgagtgttaattattcctcggtgtgttcctcagccttgattgggtctttgcactgacactggcgtgacggtacgcgactcttcaacggcttatcacagcgaatacaaatcatcctcatggtatcaccctcggtcagatgtaaccagttcgttcttctcccaccagcgcttcaaatcgaaggacgggcaggctttgggtgcaacgtcatggtgagcacgaaggattgaaccctcatacttcgccagcagcgtgaccagcagactacgcagcgcttgcatttgcgcaggtgtaaagttggcgtcaaacttacctttatcgtcgatgccacctacaaggcatacgcctacggagttgtggttgtaacctttcacgtgggaacctacagccagttcatcgcggcctgcttccacagtgccatcacgcttgatgatgaagtgatatcctacgtctaaccagccctgctctttgtgccactgacgaatctcacgaacgccaatgttctggcttggcttggttgctgagcaatgcacaaagattgcctccgtggttgctcgtggtttgaattgaactttagccatttactttttctcctttacacgaattagtttctcccacggtacgtcccgcttaggctccttgagccactcgacgggtatcagtttgtcggcaaagagaatccctttcttctcgcagaactcggcgtaagaagttggagaccctttgtagattttggtacgactcgaagagaacaccagacgaatgtccagttcaggatactgctcacggattagcaagtgcttcttccggtcatcagcttcccacagtcccttggtctcgacaatgattccattgggtaaaataaaatctggtcggtacgtgtgattactggctggcacaacatatggaatcttccacatttcatattcagcctttataccacgagcctccagttgtttatgtactttgtcctccagtcctgaccggaaggttcctacttttcgtattccttttgcaccatatgctgccatgctgcacctctctttatgttccagattaatctctgagatacaccatagagttcagcgagttttctttgtgacagcttagaatcataaatctcctgtgcttcctccagtgtcagcttgcgctttattggggagcggtgcaaggcatccttcatgttgtcaaccctagttcccgctcgaagatgtgccgggttgcagcacttcctgttgtcgcagctatgtaggacaatcagacccttgggtatctctccgttaaacacttcatgagacacccgatggacggtctcatttcgaccgccaccagtgcctatgttaccgtacccatgagaaccgaaggacttctgccaaatccagcagtcgccatccagttctacattggcacgaatcttagcttgcagttgttcgcggctcaggcgactcaaaagtcctcatcctcatccggggtttcttcgtgctcgtcttcctgccactcctgctcatcgcgggactgacgggattcactcgcagtgtaaccaccatcttcgacttcatcggcccactcatcttcaccgccaccaccgaaggtagccagttcgaccagcatcacggactccagttgcagcttgacgcttgcgcccacagcggtgttccacttgtacggcaccagagagtatttcactttcagcttggagccgccaccgataatcggcacttcctgaatcttcttacccttgctatcgaccacgaccagattgatgtgcttggtctctttggtcttcttatcttggaaagacgcatagcatttgaacttgaaggtagtcgtaccgtcaccattatcgaagaacggcatgtcgccctcgtaaggtttcagtggtttcttaccacgctgtacctgcggcgggttagcctcgaactcttccacggcagcagcataagcctcttcgtgagtcttcacgatttcatcgaccatcgcctgacagcgcgggtctttattggaaagagtcaggtctaccttatagataccacgagggttgccgaagccacgctcttcgttgccataatccggcttactcaggtaagcataaggctcagcagtgccaagaccggaggtgtagattttcttcttgaaaccagccatagtatttctcctttgtggttaatgattgggttgttccctttagtgagggtaattaggctttcacttctggacggatgcgagtcactacgaaccctgcgtcctcgtaatgttcagcctgtagcgttgcctcttcgagagaccgggcgaataccggaatctcaaaggactcggtgttaccttccattgtcagaaggtatttctgttcacgttgctccactttgggcctccttaaagcgccgctcccacagcgcgtacagttgttggtaagcgtcagcagccgccttgtcaccatcctcaatagcttggttccacttagcggcacaccaatcgcagcattcacgaagcgtcataacacagccccttatgtttgtcaaacagttcctgatagaaagccgctttcttaaggtctttctccatcgttgccagttcggatttcttaccagcacgcaggcggtatttcaggatgttcccaaggcagtacccacggaacgcctcgacggtcattgaccgggcgataacctcaatggcttccacgttgtcgaacagcatgtagtggttcggatgggtcacgtcagacttgacttctgtcttcggtgcttccacgttcgggccgactttaggtagcgggattagtacggatggatgcacctcagcctcacgaataccgaagcgaaccttgactcgaccagtgtgagagtagccctgcactgttccggtcagacccttgaacaaagggttcgctcctgaataacgaacggcagagttaaccgggaagcggctacgcatatcataatattcctgtaacattacagtacctccttaatccacttaacgaacagacgaacgcgaggccagtaagtgaccacggcttccagatgcggacgctctttgttcatcgccttgacgaactcaccgcgagtaatcagcaggtgaacgcaaggggatagcgtggcgaccgaaccaatcagcggcagcttggcgttgcgctcagaggccaatacggtcgagcggtctttacggcgaaccgaaaagataccgttggatttgttgaaatgtaaacgcatgatgttatctccttaacaatcaggccaaatgttgtcgtcggcagccattaatcccagcgttgcgacgatagcgaataggataagccacatggtgtgtgtctcctgttagtgagggttaattcccccccggaacgaagaaaggcccacccgtgaaggtgagccagtgagttggttacattttctcttgagggttgtcctcagtgcctcggaacttctcgaagctagggtgacgcagggagccgtccggggtctcttccatatagttgacctgacaggcccacccgttgtagaagtcttcaccatgggctttaacgttggctgtgaactcgtccatcagtgcgcgagagatgttgttggcgtctactaaacgaccagtctcaagaagcacactaaagccaatcactttgccctcgttggctaaaccttcggttccccaattgacaccctgaatgatgccatcagcttcacattctggtttgagcttgaaccagccagacttcttgcctcgcttgtagatgccttgcgggtctttcacaatgagaccctcgtgaccttcggcacgcttggcctcgtacagttcagtcagcgaatccatatcgtagacctcataggtctcagcaataagccactcgatttctgggaagtattcaaccagaagagagcgcatggcttccacatgatacggcatcagcaggttctgtacattgtagtcctcgccagactccgcaatgtgaatcggcatgacagcatacaggcgcacactcaggcgcttagggtctaactcaaaggctactttggaacctttcagcggctcaacaccaccacggtcaaacatgaagttgttcttcttgagccacttggtacgcagcaggccagaccctgtgttgaagtctacgcctttgacaatcagttcaccatccagcatgaagccatcagggaaaatgcagcggtcatcgttcagtagttgctgccagcgcttatcgaaaccgttcaggtgttccagcgccgggatgaacttggatacgcgagacaaccatgcggcctcagccacgttgtcaaccacaatgttaccgcgcacaccatcgtacttaatgtcagcaatcaggtagccggaggtctccagcgctttcttaacggcagactctacgaatgacacagccttatacgggacggttttgaaaatcatcataattaatttcctctttgagtttctctaaaagttctgccgcctgttccttcgtggagcaaccagcggtgataaatgttttgttgcctcttcgacactgaccgtaccaaacttggcggtgtttgtgccagtagacacctttgattcctgacttgttgttccggtgtactgaccgatttctgttgttctcagagcgggtcacaagtctaaggttactaggcgcgttgttaagtttgttacggtcaatgtggtctacttccattccctccgggactgcaccgttgaagtgttcccaaatgagtatgtgatggtttaaccacttaccttcataacgaacccttctatagccgttgcgaatagagccgccagtgtgacgacccgtatcccatgagagaaaggaaggactcattaagtcaaatgaaattctcataatgtttcctcctttcgttctccctttagtgagggttattacttccagtgtttcaaatcgctgtgaaccttacggagccatgcagtctgcgcgttgatttgtacatcgctgtcgctatgctcgaaggttctggatgccaccggatgccctgagcgtgtgaacacgcggagaacctcaccggatgacctgcacatcttcgctgggttttcatagctgaatgactccaccttcacggtcacgtcatggtcttcctgtagacgcgctaccgcatctttgtaatcgttcaggttgccgctatagatacgtcccatcattagttccactcccgtttctgtgagttaccgcgctgttgcttgtggcgtttcttcatgcggtcacggcgctcttgccactgttcgccatgctcgttgaccactgaatcgcgcttggtaaatttctcaaagttggtacgcatagtatcttacctcatgttgatgtgtattgaaagttaatcacaaaggccaccgttgttgatgaccttaagtttaactctcccgttagtgagggttaactgtatgtccgttcgatacgaccacacgttgaacctttcgggtagtagaaggatttcgtttcgttgtcctcagtggtctggaagatgaccatcccggaggacgttgagtaacattccaacttcgtgaccaccttgccgcacggccctaagcctaacttaaattcagtcttgcggaggtcatcactaccgggcatccaagcgtagaacttaacggaagtcaagcggtttagcttaaagatgttcttaaagaaagtcttaatgttaatcataaatttaatctcttagtacctaaagtgtcttaaagtgggagaccttaagtagtctcccgttagtgagggttaatgctaagtgcttgttatgcaaaggcaaagtcagacttgagaatgtcttgcaggttcaggttccctttcttcggaagcgggggcatcttgtccagttgggtctcgtgcaattggtctgcaaactggtcatagaagtctgccagcacatcgttgttctcgtaggtgagaaccatcgtttcacgcacagccttaaagagcttaccagcgtctgccggaatagtcccaaagctgtcatggatgagcgcaaaggactcaatgccatacttctcgtgagcataaactactgtcatgcggaggtggctaccgtcctgtgagtgaacaaagttaggcgcgatgccagactcctgcttgtgtgcgtcaatgcctgaatccttgagggtattaatcgtcggttgcagacggaattgccctaagaaaatcatatcgagacgcttctggagtggcttgcggtattcctgccagaccgggaagccgtccggcgtagtccagtgaaccgcacaacggtggcgcagaatctccttggtcttcttgtccttgacctcagcagccagcagcttagcggcagacttgagccagttcatcgcctcaaccgctgcgactacggtcacgctcaccgcgtcccaaatcagcttagccatataaccagccgcttggttaggttgggtgaacatcaagcccttaccgctgtcaatcgcaggctgaatggtgtcgtccagtacctgttgacgaaagccgaactccttggagccgtaagccagcgtcatgaccgaacgtttagttacgctacgggttacaccatatgccagccactgttgcgccagcgttgaggttcccagcttgagcttctctgagatttccccggtgtccttgtcggtaacggtaatcatctcgttaggtgtgccgttgattgcatcctgtttgagaatctcgtttactttctgtgcaacgatgccgtaaatgtcctgcacggtttcgcttggcagcaggttaaccgcacgaccacctacctcatcgcggagcatcgcggagaagtgctggataccagagcaagacccgtcgaacgccagcggcagagagcagttgtagctcagaccgtggtgcgcaacgcctgcatactcgaagcagaacgcgaggaaacagaaaggtgaatcctgctcggcccaccaagtgttattgattgggtctttagcgcaagccagaatgtcgtctacgtgcttctcaatgaacgcgatgcgctcagggaaaggaaccttatcgacacccgcacagttcgcaccgtggattttcagccagtagaaaccttcctcaccgattggcttgcctttagcgagggtcagcagacctttcgtcatgtcgttgccttgagggttgaacatcggcacagcgtacacacgaccgcgccagtccatgttgtaagggaaccagattgctttcttgcttgcgaacttgttggcctgctccagcatgaactctaagctgatacggcgagacactcgtgccttgtccaagcggtagataccagcggcggctttcttccactccttgagtgctgcctcgttggtgtcaatgtcgtccggcttaggcggtaactcttggcgctccagcgatggaatgtctgcgaccgggcaattcttccagttaacaatctcattgacaaccgcaagaactttcttgttgattttccatgcggtgttctgtgcgatgttcacagccttgtagacttctggcatgtaaacgtcttcgtagcgcatcaagcccttcttagagtgagtgcgaacgagtgccaaaggtctgcgaccgttagcccaatagccgcccccggtgattgctacccaaggtttcggcggtacgacacatggctggaacatcggagagatacccgccagagcgcctgcacgcttcgctaatacgtccacgtactcttgggccagttgtagtgcctcatggtcagagcctgcgttacctgcgttgtggcgctgtaattccaccagacccgtggattcaatcagcatttcaatcaggcgaatccctacgtgcatcgtggtttctttatcccagctagaccacgcctcaccaccaagcagcccacgaccaatcatatcggcctcgaccacctgcataaaggctttcttgtagacttgcccgtggcgcttgttaagctgttcctcaacgtgcttcttgaagtgcttcgcttcgaggtcacggatgcgcccgaaacgtgcctcatcctcaatggccttccccagcataccagcagcggcctgaatggttgtcatgttcgtgctggtcagtgacgcaaggatgaccttgagtgtgataaacgcggacgcctccggcttgagtaactggagtggtgcataggctactggcttgcggcctttcttcgaggcgtactcttcgagccactccacgatacgtgcggttaacttagggagaagagtagcgagtaatggcttagcggctgcgttgtctgcaatctcaccagctttagcttgacgctcaagcatcttgaggaagcggcgctcgcctagctcataagactcatgctctaaagccagttgttcacgagccaatgcgctgccgtagtggtctgccagtgtattgaacgggatagcagccagttcgatttcggagaagtcattcttttcgatagtttcgatgatgttcattgcttacctcgttgtgaataaatcgttcctattcaggccacctcatgatgacctgtaagaaaagactctatcagccttgcagtctcctgtcaaggtatgcgtctatgtgtaacggtttgccccactgaatgcgcacctcgtcatgcatcatcattgccgcagcagcgcggcgctccagttctgcaaagtttaggttattgtggtgcatccaagcgttgcgccagtgcttatcgccccacaccatacgcgccctaggctcatccctgcgattctgattggcgtccatgcgcatcttagcgagtaccttagcgtcacgtttagcacgcttagaggcctttctgcgccatttggcacgggctttacgtgctacctgaaagtctcctttagggtcacggcgtgccttacgtgccttgcagcggtcaatcgcttcctgcgctctcagcgcctcaatctcagcgatgagttcatccgggtcacagtggaactcacccggctttaacttgtcgtctgcgctgaacgataccgggtctgtgataatcaggcgtcccatctggtctttcatcatgttcccgctgtgacaatcgaacgatgcgatgcctaagaagaacttgcggatatccttgcaggtctcaatgaagccctcgcttatcgggtactcttcggcggtatcgaagcaatcctcctcaatgatttcccttgcagcgtggaagtggtggcgaatcttatcgctttcaccgtggcaccaatcgttaagcggtgtcagatagtccaagaccaccgtgtagcagcctgtatgacgctgaatgtcgtacaccgtagggataccttcccggccttggttcatacggcagaatgcagcataggcagcgcctgaatcctctttcttaaagcctaccttgataaccttgcccggtaacaatgcgtgctcatatgctgcgctaaagtgaccgttgcccaagcgtacaaatccaacatcacgcatacgctcagccagtgtctgccagtagtccatagactccaagccccaattacctttggcctgcgtcagttcgccgtcttgagtctcatcgttcacgatagcagccgcaagagccaccagcatgggctggcgttcgttcaggcgctcaatcggcaggttgcggatagcttcgagtgcggcttgtgcttcggtgaaagtcatcgttcagtgtcctgttatctgtaagaagagtaaagagtaaattcagcccatttgacagcgcttgcagcctgtcgtgcggtcatcttgcggtgtctcgttaagatgcgtttgaccttgcgtttcgatgcaccataagccatcgcatacagtgcaatctttacgtgctttgagttagtgcgtagcaatgtagaatactcctaccttgttggccttaaagcgtccgttacgttcacgaaccgtaaaccgtgggatgaatccccacttaaagtaactcagcgttgccttgtgtattgccagaccgcgcttaaagtctcgcataaagtacattgcgatgcacagatagaccagtgcgataaagagaatcatcatgcgtgtttcaccagttcgatagcctcgcggcctcgcccttctgcgtccaaatgttctatgagtttaaccatcttgcggtgatagcgagcggccttgcgtgactcagagtaccagccagcgaccgcaaagagtgcgatagtgataagtatagccattgctaatcctcctgtaatgtcagtcgttccagcccgcacatgttgcttggtgtattacacaggcttgatactcctcttgtgccaaaaccatgtttacccagtgcgtgacctgtttgccgtagcgcacaacataggtgcatcccattgacccgtggtaatactcacgcagcgttacagtgcattgtccttggattttggaggttgccagaagtttactcatggtgttagtcctattgcatgttaaagtgataatcataaaggccacacatacagtgcgaccttgagtctatcacttactgtacttgccagcggcgaccgaactcgtcaatcgtaaagcagccttgcagtggtgcgcctttaggcacctcttggaagctacccggcaggcgttcagccttatacccgtcgatacctttagcgtacaccagaccagccgtgtgagtctgtgatttgtataccagtacgcaatcttgctcccactcattgcaagctaatcgtgcaacatttagtgcctgcgccttgtccttgcagcgtacacgaaccgttttttcctcagtcggtgcacttgcgattgcctcacgatagcacccggtcaaatcggttgactcaacggagccataaagacccggtgcggcacgtaaagtgcttaccatgtggcggtggcgactcatgttcacctcatcatcaaggttagaacggaaagctgacaccagtacatagaagacgttagcaggctctttagtgaaaatcatttggtgttacctcatgttagttcatgttaagtgaatatcataaaggccacgctttcagtgcgaccttgagttattcgcttatacgtcggtacactcaagagctattatccagattgttaaagaactttaggctacagtttcgtcgagccgaggctatttcagtgttagccgtcacttgcattataagtgcgacaagctctttattatcgtggtcgcttgtgctttcgccatctatccactatgtcgcgtttttacacctacgacactcggtgtctttcatgtggtacatcgtaccgtgcttacttcatgttgtcaaccattttgtttcgctttatgtgccgtggtgcgcttaagtcacctagaagacaccgatttgctggttgacgttacgttgtgcatcttactacttgttaccttgcgttgtcaatgcctgtttttcgtatgacttatcaggctgtctacttatccggttgactccggtatctcagggagtggctttaaggccgttgtcccgttgacgagatgaataatagccttaagggttacttaaagtcaaccattaattttaatcttttattaaatcccttattccctctttaagtatcccttattccctttagtgagggttaacgaaataactacagataactacaaggcgtcactacaggctaacagtgggtctatcagtctggttgtctttaagatagcgtcgctctttaggtggaggctttaggtagtggctttaggtagtggctttagggtttactttaggaatggctaacagatagggacacatagagatgtactatcgaactggtacactaggacactctttaaggcctctctacggcctccttaagccatccaccactttaggtattgactttaggcaacactttaggctatcctataggccacttgaggagatacccaaggttaaccgaaggttaaaccagaggggtagggctggctttaggtggctttaggagggctatgggggtactttgggttcttgaactgtgagatacccattcagatttttgtggtaaattcttaaagggtctctttaggaaaccactttaggtaaggccacaccataggtgagaccataggcgcatcccgaagggatagctaggagacaccagaagaccctgtaagaccattacgaactacagggcatctttaggtataacctttagggttgactctacagggatgagttggtgtagtgaaactatacctacgaatccctcagagccgcttgtcggtcatcaacaacaatttaatccccacaagagagtatagagcaaaaggccacttccagttgaccgaggtggtcagtaagacctgcgtacccaagggcagcagtaagtaccagaagaaatcgccaagtgactctatgacgcagcagggcaatcagcaagcgtaacattgagccacctcctttcagttgctctaaggtagggtgattatacaatgataatatcaccaatcatagaggcagacttaaagtgcataaagggtcattgcataacctgaatgactaacctatatagtagctttaagtcccctctctccctttagtgagggttaattcaaactcattgattcttaaggaatttcttaaagtgaccatccgtggcctcaatgcttccttatgcactcaatatgcataactaccagtcaatgaacctgttgctattcgcatcatcatcctcccaatagagttccatcccgtcaaccatagcggtaactacgtgaccagccgaatggattgggtgctccatgtgttcctctaagaacgcctcaagcacctcagcttccaccttcacggcgtccagttccatcgtagagcgtaagaactctacacccaatgctaacgcatcaagtcggtcatcgtgggccacagcgcccttctcacgggccatacgggtcaactggtagaacagcgaatagcgaacgtcatgcttgccatcagcgtcacgggcagtctggtagtcctcacgaatcacctcgtcacgaatcacaaggcggtgcgtagagagtacaggctccagcgtatcacaaatgcgtagttccttcataccgcgagcacgaatctcttcaagttgcgctgcatggtgtttcaggagcacagggctgaataccttaccaaacataccatccccgaagttactctcgaagaccactgtctgaaccttccactgcttcgctttcttagcgagggactcaagggtcttatcggaataaccatcgcggaacccgccagcttccatcagatagatgtagccgttcagggtgaacaacactgcgtaaccagtctcatccttgccgcgaccacttgggtcaatcacgaggatgcgctgctggtactgtccagtgttctggctgcacgaatgatagctatgaatatcatcacccttaaggcccacgttaggaagctcttcattgcgattctgacggttcggaagccactggtaatgcattggggctttctcgaagtccagaccgcacacgatagcgtcacggaggcgtaaggggtacttctcggcatcactcaggttcgggttgagcatgaactgcaaagtgaagccagccttaccgtattccaactcacgctcacgcaggtcttccatatcgaagcgcacggggtcagtcggttgaccttggagcatctcgaacccatcgttgaactcttcgcggagcatcggggccagacggtcgccatagtacaagtcttcctcacggctacgcggatagagcgcaggccagatgattgtggtgtacccacggttatcttcgagttccttgtacaaggtcatttcggtttgaggcgtgccaaggtagataacgcgagaagtcggcagtggtttcagaagcgcagcaaattcctgcaccagagtccacagcttctcacgggcaccttgagttgcggagttagacggaatctcaacgtcatccgctatgatgatatcagcacgactaccagtcaactgaccagtgatacccaccgacttcacagacggagagtggtcaggcttggcagggccaacatcgaaactaatcacagagtcacgctgaccggggcgaggctttagctcagccaagaagggcagcaggtcaatgatgttcttgatgaagatggagttagcgtccgcacgttctttggatgcagagacaatcagtatcttcaactgagggtcacgccataacgtccacacaacgaacgcacaggtgatgaatgacttaccgataccacggaaagcctgtaggataaacttcttgttgtctccgttagccagacaccgggccatatcaatctgacacttagttggcggcgggagagccaaagccttccacaatacgaacaggaaggccacgaagtcacccttaagctgcgcgatgattagcgcattacggtttgcttgggtgtcgctcattctgcatctccttaatagtacgctggagcgctcttacgtgagcatcagcagcttgggttattccgataatacgcttagcatctgactcgtgtagttcggctcgaccattaaactcgcatctaccgttatcttctggtagtccggtaagggttttgatgcggactgacagccgcttattattactacgcaggtcattaagcatcctatcagtgctgccttcaatggctgcaatctcttcttggtactcacgggatacccgactgacctctgcctgagttgctgcggttgcctttgttttcgcaatgtattcattttggattacctccttccagtttgctctctcatgggttgaccctaagtgccagccacccataaagagtgtcccggcgagtacccaagggagtgcgctgcgtaaaagttttagcataacacctcccatcaatttttagatttcacgtagatgcaccaaataacatccataaaggctccccgcgtggagaaccttgagtatgtcacttactgtagcgtgattgtttcatcatcagtcagaccattagggccgaccactttgttgtagtcttccagaccagacgcaagaccgccaaggatgttctcatccggggtcagcttactgatttggaacttatggcggtctaacagtttgccgattgcgttgtaaagctgcggcgttcggcgctcctcgctttggaggtcagcaagcatacgctgtgccatctcagtgtctagcatctccagcagcttgattaaagtcttgtcgctcataggttactccttgtttgcacgtttccagtcaatcatcttatcgactaccttggcaccaatctgaaccactgtgtaggcgatagctgcaacgtagaaccattcgtttaacgatagtccccaaaagagtcgggccgcaccatcagcgacccctgtgccaacaatcggcgcagccttaacgacctcgttgttgaagtcaaaagaaagcattgtgttctccttatgttgtgccgtccgctggctttgttgattatccttcgagttctttaacgcgttgacgcagtgcttgaagctcagttattacgtcagcaagcaacgccctgtcgttggtattcaaaagactaccttctgcggtggtcgtgaggtatgtgtacagcgggtcaatcgtgtcaagctgttgggccagccacccacgtttacgttccccggtggcaatctctgtgtattccactataccaattgcgtcaatacgctcaccagcaccatcaagaggtttagtgatatcatccttgattctaatatcagaacccgaagtcatcacatcaccaagtggtgtagatattttaccattggagaatagctgccagttagtatccttgctataaccattgaggttaaggattatcgcgtggtctgtaccaacgtgctcctgaatatacataccacagtacgcaccaagtggatcattcttagcaccacggccccgaagctgtgagcgaactgccacagaattgagatattggccaagatatggattagggggagcatccacatatgcgatgatatcaccattaactcgcgttggccctgtaaagtcaaacctgttggtatctgtaataacaaaaccagcacgtaaggtggatgaagtaccagacacacggtagttctcgaagtgcatggcccctgcatcatccatataaatcctgttggcatagttcacgccattcacggtcttatcttggtatagcccactgtggttcagtattgatactttaccgtttcctttaatggtgaagtcacccttcatgacaacattgttaccgttgactgaatcaatagcggcagcaaagccattcatgttggtcagcttagccgcctcatccttagctgtctgagcagaggccgcagcgttggtctcagaggtcttagcgttggtctcagaggtcttcgagttattctcggacaccttagcattatcttcagaaacactcgcggcggcagcactcttagcggatttgcgggagtagtgatacgcagagaactcgctaccctgtaccggagagtcctcagcacgctgcgcccattggtacgcgttggtctcagaggtcttagcgttggtctcagaggtcttagcgttggtctcagaggtcttagcgttggtctctgaggtcttggcagcggcctgagaggtagcagcggcgttcttagagttcagggcagactcgttccaccgagtgacttgacctaaattgatagcatccccgaggtcaataccatcagctacgtttacgatacgacgaccacgagcatcaaggttgccatcgttgttcacaccaatggtatcagccgttaagtcacgagcctcttctgcaacgtgaagggtttgaacctgagagatgttcaggtcgtatgcccgaaggattgaaccatcggtgaagtcaaccagcctatcggtagcggaggtaaatcgacggatttcaatcatgttataaccgtccgctggcccccacgctctcgttgtggagattgtggtcttagttgcaaaacgatagtcttgattcaagatgagttcctttcggtcaacaccgataagggtcactcggacgaacttacgagccagatactcaaacggaatattgaagtccgtagtggagccatccagcgggtaagtcatcacggtcttaatagttgtagccatgtgacctcctttgtaaattagcattaggagagaagaggccagaatgtgacctctctccctttagtgagggtttattgtttcttcggcgtctcctttatacggataccgttggcctcgtagattttcataatgagttgctgcgatagcgggtcattagggatcaactcacgagaggtgttgaagagtcctgtacggaactccagagcggtagccttgtttggagaagacagtagggaagcggcgttaattgctgttgcgcccacagaacccacaaaacctaaacccggaacctgctcaccaactgcacctgcgatagttgaagccacctgtctacctgtcaccgccttgttagggtcacgcttctcggactctttagggagtacagtagagcgggtgtacttataggtatcgctaccaaccatcccagcgaacatgtcgtagatactcaatggtgagcctaagtgtgaactacgagagattgacgcatgagcaatcatcttagggtcaagtgcgttcttaaggtactccttacgtttgtgctcctgtaggcttgcggccttaaggtgcgcctgcgcaacgtagtaaccaccagctagacccaaagagatgatatgcgtcaacgcttggtctaacgcacggttgttcttagttgcctcgtagaagctacggacgaaccgggagttaagggacttgatgacgaagttcttaaactgcatcaccatcttcacccctgcaccgaacgctttggagtcctgtgatgaaaccttgtgagggcgcagtatagtctcatccgccaccttgtcagccagtcgccacaagtccatcgaacgagggtcgttagcgaaagcctgtttgtcacgaatggtgaacttaccgtcttctccacgagtcgcatggtctctgaacaactgcttgattccattccactgctcagggctgatagaggcagacttaaggtagtttgccttaccgaacttagaggctttcccagcaagggccgctccagccacatccccaagcacaccctgacgggcagcatcaagaatgtagtttgatgttccgtttaggagcattgtccaaggagagcgtgcagccaactcttgagtgccgaaacgaatcgtaccgaccacattggcaaccgcagcgctggtgtccgtagactcccggagtcggcgcacgtggtcttcacgtcccggacggattagttggtctagttccttaccgaacaccatcccgtgtatctccttaatctcagaggcacgaagcggtttaccacggttgacccaatcgttaatcatagggatgccatgagttatcgcagagacgttacccttcgccagcataccagcgatttcagtaacgttctgtgcgcccatataggcgttcttagcaaagaacgtgaggtcatttacggagcgcagggctgtaccccaagcgccttccgggttcctacgagcacgaccagtcagaatcttcacggtatccttgagggcttccacttcacctttcagtgtgccgttgccctctgactgcttatccagcgccatgatttcatctttcaggtctttggtagtcttaccggaaccacccatgattgcaacatcaccatctactcgtcggtcgtatgcaggcagaatttcagccatgtcatatgtacgcaggtcgttcacagagaacgtgttaccatcagggagagtcaccgccatgtcactgtcgaacatgttacgggcttccaagaagttgttgttctcgatacccaccagaccctcaatgttatcctcaatgacagaggaggcagagaactggtcggtgtgtgaaataccatacgccttatccatcgcgtgcttctgcaccatctcaggtgtaacttcctgcacggatttgagaccgttaagttccatcaggtactcatcgaccctcgccttgacttctggacgagcacgataagacgtcaaccatgactccgcgattgctcgctgtaagccatcattaccgtagcgtttaaccatctcaatcttgattgctcggtcgtacacgtttggcacgtaggttcccttgtggcgtgagccggggaagatactgaccgccttggtgttgccgaagattgacgggttctccatgatttcgcgtttgaggtcaaagtgctgcttgaggatgttcatcacattccgctcaccctttgtcaggtttgcttgaagctcaggccgctcaatcgctaaggctgcacgcttgtagatttcctgtcggatttccttacggctcattgtggcaccacctgtggagaactcagggtctttcattgcagtacgaacagcatcataaagctggttgtaggtgcgctgattgttcgcgtgtagcctctccttaatgtcagaagcagtcgcaccgaacttaccattagagcctgattccatccctgtcggagaacgcacaaggtcactcgcaatggagcgaacagtcgggttctcagagcggagagtcttcaagccaatctccgtgaagccacccaaagagataccacgtgcggcacgctcagggttgacagcctcgaactcgctaagagtctgagggttcagcgggttggtgtcgctaaggatttgaccttgaggcaacacaacggcacccggctcggtctccagaggtgaatactcaacgccagcgtgctcacggtcgaacacacggttctcgctcggcatacgggtcaggtcttcaccaccagagttcagagcggtctcacgggcttccaagcggtgtgccataggagcgaagtcattaacaacctcagtaccacgggaacggcgaataccagcggcgatagcgtcactgattgcactcatcccggcaccgaacatcagaccgcctaaagcagcatcagcatagtgggcttctccaccagcgattgatgtacggagaccctcagaggcaacagcgaggccagcactctgagtaccgacaatgaaagccttgttagccaccttgagacccttcccggctacgcctactagcggtacataactcagcgggtctacaccagcaccgacgataccagcagtaagtttggcaccaacaccagcatcggcagaccgcgcgtccatctcgtagttgtcattcgccatcttaatgagggcgtccagattctcaggagagcctccagtgactacgttgatgtacgatgggttcttcacttccttacggatacgctctaactcttctggagtccacgtatggctgttccagcgagtcggcgtaatggtgtccttgaataaatcaaaaccgtcatcactacgagcggcacgaaaagccacacccaatacggagttgtgaagttctgcacttgtggcatctccgattccgaagaaggttgaacgagaattaaactcgtccagtgttgttccagtcttttcccaaaagtccttagcatatggcacgttaggtgctttctgctctttaccctccactttgaatccagttgactccggcaggtcagttcctaccgtctgcttcttcccgattccagcaaatgcatcccccgatggaatgcctttagcctttggggtgatgccgccgaacgcctccaagtcccccttgcgaggactgttagctacgtccatcaggttgcgcatatagttacgaccttcctcagagattgaagcccaatcacctttgtcataagcctgtatctgtggagcaccgttgcgcccctcgccctgattatatgccaaagcagctttgagttcatccccatcgtacttccgaatgaggtcactcaggtgacgagcggctgcatccacagccaactcagggttgtaacggtcatcgtcatcatcgtcagtaacctttaggccaagcgcagtggctgtacctttggtgaactgcatgagacccttcgggccagttggggatttggcctttggattaaagctggattcgttgaatgctaatttacgaagcaggtcataggagaccccatgattgtctgccgctttttgaaataacccatcgaactcgctaggtttgttcttatcgtagctcatggagcctccttatcactgttagtcttctttacgtccatagatgtacttcggagtcttcttccgtttctcttggacacgtttacgcgcttcttcacgcgcctgcgttgcgcgactgattggagcacgcttattggcctctttgagagctttctctcgtgctgcctcagcttgcatctgtgcggtacgctggtactcacgctggagcaactcttggtcataccgaatgcgaacctgtccggttgtgtccatcaggtagattgaaccaccttgctggtacaccgacagttgcttgttggtaatccaagggttcgccgctgtgattcccttaatggcttcgtccagaatgttcttcccttgctcccacgacttagggtcatccgaaacagtcaggatgttattcggcaggacaccataggtatcaccctcaacatcactactggagaacgtggtcgtcgaatcagagaggaactttgcgacctgttcggttgccatgtcagggttccctgtccggtacttcacggaatcataaatcttccgcgcgtaaccttggacactcgaaggcatgtacttgatttgaggattcgttgaatcgttcatcatagcggcccacgctcggtcatcctcaaactgcatctccttggtcttctgtgcgcgggccttatcagcgtcgataagaacctgcgtgtcgatgccttggttatccaacatgtccatcgtcaggaacaactcggccttgtcaggatacagagaggcaatcaggtcagggtcagtgttgcggatgcgacgaaggttgtccatcgctggtgtgctctcaggcatcttgccgttaatcaccgcagcctgccattcgtttccagcatcagtaatcatctcaccaaacgctgtacggaaagcaccctccttggagtctgcccgtaggtagtccaatttcagtttgtctttctgttcaggcgttaagtccatcgcctcgatttccgctaacttctggttcgcgtagttgaccatatcactatgtgtaaactcaccagtgttctcgttggtcggcatgtccttatagttggtcgagacgtattcaccgttgaggcgcttctggaactgcttgtcgatgaccaaagatttattcagggtcttctgttgcttgtccatcagcttggctgtctcagcttgttcctgcttgaagcgggtgcgcatctgttcctgtgcggaaatcagccactcacgctcaggagtcatctcttcacccggctgaatcttatcaagttcggccttgattccttgaagagtctcccagcctttaccagtgtccgcttggttaagcgctgagttaatatccagtctgaacttctcggttaacttcgcgttgttctggaattgagtgtgctgtgccttaatcatcattgcctgccactgctcatcacccatcagttcacgataggtagtcgtagcgccattaagagtcaccttgcggttctcaatgttctgcaagaaggcggcaccacccggacgctgtagcacgtcattcagggacgaagagataacctgttgagcctgattgtcggtcatccctgtcaccaaggagttgtcgatgtagttctggaagaactcaccggactcaggacgagacagtaggtcagggtcagacaggacgccattgagttcaaccttcgagttcaggattgcacccttctgcgcttggtcactcaggaaggtatcatgtgccccatacagagcgatgttgcgctcggtgatgttcgcattgaaacccttctggtactcctcgtccatctcattgatgccgaactgctcagcgaacgacttcgagtgctcctgtaggcgtgagtgacgatactgctccatctcttcacgagtacggaagcggccctctttgatggcctgttgaacctcatcgtcaacgaggaacgcagcgttacgcccggtcttgaacttcaaggcttgcattgcgtatgggtcatcctgatacagcagtgtaccattctggatagcctgtcggcgctgctcaggggtcagcttacggataatctcgttggagcgctcatcggctcgttgcttatcgcgttcatctttcgccatgtacatatcggcaccagccttagcgaatcgaccaatggagtccagaagactcgctcttggttgctcagcctgaatggttgctgcccggtagtccatgcctttgacgccccggagtcgttccataccgggagtcgccatgttgcctaaaacactatttagtttactagccattattacctcccggtcttggttcctttggcggcactgataggtgctgcttggtttccacctttcttgtcaaatccaccagccgcatattgacttgcagcttcctgacccataattgacagagggtctagtacacgcatcagaccagacttacctttggcctcgctcttgtacattgcatcgacttgacttgctgttgactgagtgcgtcccaactgttgcgcaaagatactcgcgtagtctcggcggtaattctcggtgacactattagcctcccgaatgtagttgccctcttcgatacgcttgatgcgcttcatggattcgccttctagcatactctcgccgatagctgcacggatggttcccatagcttgtaccttctgcatgttacgtgaagtcaactcagaggatgcagcttcaagggcgtcccgttgttccagcgaggcgttggcattctggatattcatctctttgaccatctccattgcctgtctgcgtccagcttcggtctgtgccacccgtgccttgtcagcactgttctggctacttagagcttgggcacccatcatggcgataggaattgctgccatccaacacataatcatttccctcctaggtatgttattgccttccgaagacgctcggtgtcgtcctcgaacttcccaagagcgatgttacaggcagagcaaaggagaccacgaacagcgccagtggcgtggcaatggtcaaccgctaacgcccgtccctcaactctctcggtaagaccgcagatagcacacactccgtcttgcttaaggagcatcgcttcgtattcttccagagtgattccgtacagacgcttaaggttcatctctcgcgcctttgagtagtccttcttgtaatacgtgtagtgacatggcttacagtgacttcgtaggccgtccttactcttcttgtccttatagaactcggagacagctttcatctctccgcatttcttacagttcttcacgttgcctccttgagattgtgaatagttggaaccgaccatcgagagtgtactcgttgtggaataccgctccgattgtctttaggaaacgaatgtgcgacttattgcctacccatacgaagttccaaatggactcgtactggttcagcatcatatcgcgatattcgattattaacttacgaaactctaagcgctccttcaaggtaaacagtgggacgtacttagaggtaaggaaccacactcggtctccctgattgccaccaattgccaacacagcgttatcgctaagcattgccacagtgttatcatcaggaattacctttggttcgacacccaatgcctcagcttccagaatgtcctctacggacggctgaaagttgtcagcgtggctttgtaaacactttgtaatatacataatgctttaaccctcgtatctattagtgtctccctttagtgagggttaattcaccgcagggagactttaagttaaatgccagaagaacgacgaaggtagttcccctcccagccgcacccaatgatgttcagtggagttgacgcatctgactcgatagttactatgttcgtctgcgcattacccaccaccgggaagcggtactgccctgttccaatgttagacctgccaacacgcagattgtcggaacccaatcgagcaccagccattgtgtagatgaactcacgggacaggttgttcacacggatggtgaacgcgccagaatcctcatagtttacccacgcacgccgaagctgtaagcgaccaatatcctcggtagccgtcgagccgtcctcagcagtcttcttaattaggaacttcgagaacgtataagtgaacgggatgttgaacccaatgtaaaccacttgtccctcttggttcccatcgagtctcaatattgggtcgctactccacccgttgactggcgggtctacctctataatctttccatcagggaagac

SEQ ID NO: 7 - DNA, 177937 bp, Unknown
  source: /note="Description of Unknown: colon-14-15 Bacteriophage Sequence"
tctatatataaaatataaaaatattaaaacgtacattcagtacatagacactcactacgttcgtgtccttcgcttcgctcagatttttgaaatgatctattgactttgaaaaagtgatcactataatcagtttcattcaacaacaacgaggtattgaaatgtcttcatttgcaagtatgttcaacctgaacagcttaatgagcaatgacgatgatcctgttgatgtgatgtgtatagatatttcaaacctttcggtagcaacgttgatgaacaacttcaagccgaaagaccagaatgacatcaaccaacaaattgttcgtcacatagtgcttgacaccattcgtcacaatgtggttaaattcaaaggcgagtaccctgaaattgttctagcctttgatgataacaagtattggcgcagaagtaaagcctggtactacaaaaagaaacgaaaaatggaacaagaagcatcggattgggactgggatcgcctgaatggtttccttcacccgacatacgatgaaatccgtgctaatctaccgtacaaaggtatccgtgttgacttcgcagaagccgatgacgtgatcggtgtggtgacgcgtaaagcggtatccgaaggtaaacgtgtcctgatcgtttctgctgatggtgactttgcagcccttcaaaaatatcagggtgtgcgtcagtggtcgccaacccaaaagaaatgggttacaccgaaatatggttcacctcgtaacgatttgcgcatgaagatcatcaagggcgataaaaaagatagtatcgcttgcattaaaatgcgaaatgactatattgttacgaaggttgaaggagaacgcgccccacaaatcagggctgctgaactcgaagcctggctggaagcggacgatccgaccgtgggtatgcccgaagagtgggcgatccgttacagagaaaacgaagaacttcgcgactttgattttattccgaaagatgttgcaacggcaatcgaagaagcgtacaatgctccaaaaatcgggaacaaagcaaaaatggagaaatacttcatggaatgcaaacttacccgtatgtatgaaaaactaagtgacttttgaggtaacaaaatgagtgtagaattactgcaagaaaacccagacatcgctaaagcggttaaagaactgatcaaagaagcgtcgaacgtgaaaacccagatcgaacacttccagggttctttcaaagacatcaaatccaaagcgaaaacggattatggtatcgacggtaaaaccttcggcaagctgttcaaactgtatcacgaacaggcacgtaccgcgttcgaagaacagaacaacgaacttatcgaactgtacgatgtgatcgataaggcgtaatatgagcgaaatcggaaacaaaaccgaagtcggcttgtatatcgaaaatctggttgcctctgagggggcaacctacatggaagctacgttacaatggatggacgaaaacagcattgattatgctatgctgtccaaaacagtaccgaaagcgatcatcgacaagattagcgacgaagccattaaaaacaatctgctgcgtccttctgtggctaaagaccacgcgacgacgcaaacactggatgatttcatgtgaaatttaaaaccccgtttgacagttcagacgctaattcccgtttgaaaccgatcgcggtatacaaactgtatctggtgatgaaaaatcactttgctgggaagtatgacgcgatcaagtacaaatgggaaataaagatcactgaaaaagcgttcgaaaagagaagagataagtattttttcaaaaagttagccgaaaggtttacattcaaagaaatatatcttatacttctctccaacatggtagctaaccccgacttctgggtcggggatgtagacgaagatacgatcgtgttttatcgtcaatacataggcaagttgaggcgaattgataatattttcgtggacgatgtaaaaaacctgtatgaattttcccgcatgaaaggtattcccctctcaacggtgtttcagtatagcgtcaaatcatcaacctcgtatatcagcaagctcgtactttctggggtgatttcttatgaatcattcttgatcctcgactcgtttttagacatcataaataaacacgatgaaatcgcaacggatttcgtctggaatgaatttagcaaaaaactaaacgcatacagaaaattagttgaaatcagtaacgaagaaatcgtaaaataccgaaacttaatgaaacaaaccttaattaacttaaacgagaaataacatatgtcattctttaaacgtcaagatccaaccaaactgcaagaacaagtcgccgctctgaaaggttcatccggcttccagaaagatgaaaaagagtggaaactcggtgtcgatgcacagaaaaacggttctgcggtgatccgcttcctgcctaaccgatctgatgatgaactggcgttcgtgcgtatcgtcaaccattcattcaaaaagaataaccagtggttcatcgaaaactgcccgtctacccacggcgattacgatgcttgccctgtgtgtcagtatatctctgaaaacgatctgttcgaaaaagcgaaagtgaaaggcagcgaagccgaaaaaacactgggtatgatcggacgtaaacaatcgttctgggcgaacattctggtggttaaagatccaatgcacccagaaaacgaaggtaaggtgtttaagttccgcttcggtaaaaagatcatggataaaatcactgcggctatcgcggggaacccagatctggatgaaccaggtgttgctgtaacctgtccgtttggtggcgctaacttcaccctgaccgcgaagaaagtaggcgactggcctaactacgacgacagcaaatttggtgttcctggcccaatcaaaggcatcgaagacgaagcgcgtcagaaagaaatcttcgaaggtatgagcgatctgcgtccaatcactgctccagaccagttcaaaccaactgcggaactgaccgcgaagttcaccaaagtattcggtggtgctgcaatgggtgctggcgcaagcgctggtgcggatctggattcagaactgaactcatttgacaacgaactgaaaaacttcgataatggcaaccattccaacggtgctaaagaatctggtggcgtaagtcaactgaacgtaggcggaagcgtaccggaagatgataatacacctccgtttgacctggaaggtggttccggtgatgacgacctggataaactgctggatctgtaatgcttacgggggcgaaagcccccaattttgaaagtttgaggtagatatgaatttagaacaaaacgtatatgtagcgcatctgaacaacgttcgcaaatcctgggtaggtaaagtgccggaaaacatcaaagagattttccgtgcgatgcctcaagctgaacgctttgagcattacaaacggatcgacgaagcagtaagcgcagtacataccggactgattcacgacgctcgcgaagcgggtacgaaaatcaacgagtccaaaagcaaagaattccttgacaatgcggcggatcgcgttgtagaatccctgattaacggcacttttgcctaattgaaaactataggttgaatatgaaattctctaaacaaacgatcgacatcctgaaaaacttctcccagatcaacccgtctgtaatgctgaaaaagggttcgttcattatgacgaaatccatcaacagcgtagtttacgcagaagcaacaatttctgacgtaattgacgaagatgtaggtatctacgatctgaactcattcctgaacatgctgaacgttgtaggcactgatgccgaagtaactcacgatctgtccactggcgaaatcgtcattcgtggtgagaaaatgaaaatcgttgagcgttcaagcgatccaaccacaatcgtacagcctaagaagcgtctggaaatgccagttgcggatctgattttccagattagcgcgaacgatttcgaaaaactgatcaaagcgtcacgcatgatgaaactgaccgacctgtctgttgagccaatcaacggcaagctggtaatcaccgcgaaaagtaaagaaagccagtcaaccttctctgtagaagtgggcgattacgaaggtgataacatgttcaacttcgatatgaagattgacaacatgcagttcatcaacagcgattacaaagttgaaatctcttctcgcggcgctgcgaaattctcgtccgaaaacggcgttgcgtatgtagtggtacttgaagcaaccagccagttcaagtaagataaacaaagtagtacacaaggggcgttaagcccctttttgataatcaattgaaggtaatattatggaacttagtgaaaacgtacagttaatcgaaaccaaatacggcaaaatctcccagtctcccgaagaattcgcatgggatcagcgctatcgcccgacgacgatcgatgaatgcattctccctgctgctgataaagcgacgatgcgcggcttcatcaagtctggacgcatcgacaacatgactctggtttctgattccccaggtacgggtaaaacaacgctggcgctggttctggctaacgaagttgatgcggaagtgatgtttgtcaacggttccgattgtggtgtgaacttcatccgtaacgaactggatcgttacgcgtcctctatgacgcagaagaaaggcggtaaaatcattctgattgacgaattcgatcgccctggcatggcagaagcacagaagcacatgcgtagctttatcgaagcgtacagcaagaacgttactgttatcattaccgcgaacaacatcaacgggattcaccctgcgctgatctcccgctgtccggtagtcaagttcggttccccgtcgaaggaagaacgcgttgaactgatgaagcaaatgatcaaacgttgtttcggtatcctcgaaatcgagaaaatcgaatatgaccagcaggtgatcgccggattcgttaagaagcactacccagacgcgcgatccatcgttaaagctcttgggttctattctaagcgtggcaaaattgatgctggtattctgtctgagattgttggttcggacatcacaccagtgattgaggggcttaaagcgaagaacttcaaagcactgcgagccgaagcaatcaagtacgcgcctgagtatgaaactttcctggctaaacttctggatgcggtatacccgatcgtcaccaacgaatctaaggttgcactcattcaggcagtaggcgaaaacaacgcacagtacgggctggcagtgaacaaagagattcacctgcaatacctgttcatgggcttaatgcttaccctcgcgtgggaggcttaaaaatgtcactggctgcttttctcgatgaagaagaactgaacgaacatgaagcggcctggcgttctaaagactgggacaagatcgaagaacttgtgaaagagtacaccaaagacaaggaaaacaccttgtttatggtgctcgaagaactgaacaacgggaagacaccattacggatctctgcccttgattcatacgataagtttttcatcgacaatgcaatgagccagcatatcgaaacgctgatccctgcatacacgatgaatatgatcggttccggtttaccagaccaggcgcactttgattattacctgcatacggtgcgcaaaggtaagcggttcggggcgtgggctaaactcaccgaagataacgaaatgaaagttatccttcatgttctccaaaaacgatacggtgtaaatacacgtatagcaatggaatattacgaagaactcaaacagcttgaaaaactggacgagtggaagcggaaaaatatgaaagttgctttatctgtgttggctgatgttgtgaaaaataaaaccgaccagaaaaaggttgaacaactaataaagaaatggtgatgtatgaacatgctcgaaattaaactgtccagcgatgacagtttcctgaaaattcgcgaaacgctgacccgtatcgggatcgcaaataacaaaaagaaaatgctgtggcagtcttgccacatcctacagaaacaagggcgttattttatcgtacacttcaaagaactgttgaagctggacggtcgccaggttgacatgaccgaagatgacgaactgcgccgcaataacattgcgcgacttctggaagagtggggtatggtttccatccttacgccggatctgaaattctccgaagagaacaacttccgcgtattgactcacgcacaaaaagctgaatggactttgaaatacaagtaccggatcggacattaatcaaaagcccttgcagaaatgcaggggctttgttatattggttgtacaccacttgtgaggactaaattatgaaaattcgtattgaagaaatcatcaaagctattgaatccggtgatcacttgatcaaccgtctgcatagcgaagacatcaaactgtctcttacttgcaatctctctgatctgcgcacctacgcatacgcgcgggatcacttccctaagttctatacccgcatcatggaagaatataccgtgctggttgaacaactaaatcggcctgacacccaacgctatcacaaattagcgcaacgctcgcttgatctgatcaagctggctggggtatcattcctgtcacgattaaacacggagaaagaaaaccgtaatgaatgaattttatctatccgttgagcaaatgggcgatcacatctacgagcgcttcattgactctgagggacgcgaacaggttcgcaaaacaaaatatgcgcctacaatgtttcaacacgctatggcgggtgtagactcgccatatcgcgacatttacggcaagacctgcatcaaaaagaacttcgaaagcattaaagaagcaaaaaactggatgcagcgaatgaaagatgtaggcatggaagcgctaggcatggatgatttcaggctggcgtatatctccgatgcctacagaaaggaaatcgaatacgatcgcgaaaagatccgcattgcttcacttgatatcgaagttaccgcgcctgaattccctgatccacgcgaagcaaaatatgctatcgacgcaatcacccattatgacagcgttgaagataaattctttgtgtacgatcttgtcgagggtggtttagacgagtgggtagcgtcaaaagttgataccgaaaacgagatcagcgaagaagatttgaagaaaattgtttaccgttcattccagaccgaaaagtcgctgatgtcggcttatatcaaagactggaaagagcggacacctgttattgttacaggctggaactcaaacaagttcgatatcgcgtatatcatcacccgttacctgaatatcttcgggcaaaacgttgttcgtcatttcagcccgttcgggaaagtgactgcgaagacaacaaccgaccattacgggaacgaacaactgggctatgagatttacggcgttgctcaaatggatggaatggatctctataagaaattcagtttcaccccgcaaccaacttacgctctgggcgcgatcgctgagttcgaaacaggtaaaagcaaagttgattacgaaggttcgctgtctgaactgcgtcaagcggatcaccagaaatacatcacgtataacatcgttgacgttatccgcgtgttggatatcgacggtaaacgcaactttatcgaactggttctgtctgtagcatactacgcgaaaatcaatttccctggggttatgtcaccgcttaaaacgtgggacgcaatcatttacaactctctgcgtgaagagaagaaagtaatcccagaaaacaaacgccatactaaaacgccgtatgatggtgcatacgttaaagatcctgttgtcgctccataccgttacattgtatcgttcgacttgaccagtctgtatccatctatcatccgacaggtgaatataagccctgagacaatcgctaacagctttgcagtgcgtccgatgcatgaatacatcaataagactgcgccgcgtcctagcgatgaatttagctgctctcctaacgggtggatgttccgacgcgatgttaaaggcgtgattccggtcgagatcaagaaagtatttgatcagcgtaaggcgtggaaaaaaagaatgatggcgggtgagcgaaatctcgaactgattaagcacgaactcgaacacctgacagacgcacacagccaaatgatcaaccctgatttcgagttctatgaagatttcggtgatgaatcaaaagctgtactgaaaactctgtctaagcaaatgcttaaagccgtgaagaaagtgtgtgagaagaaaatcgcacaggcgaacaccgcacagcttaaccgtaaaatcagtatcaactccctttatggtgcgttgggtaacgaacatttccgttacttcgatattcgaaacgccagcgcgatcaccatgttcgggcagttggctattcagtggattgagcgtaaggttaacgaataccttaacgaactgtgcaacaccacggattacgcatacgtgcgttactgtgacaccgactccatttatgtttgtatggacaacgtgatcgcgaaagtcggcggtgaaagtaagttcagggataacaaccattgggttgacttcctggataagttcagtaaagaacgcatggaacctatcattgataagggctaccgcgaactgtgcgagtacatgaacaacgtcgaacacctgatgtttatggatcgcgaaatcatttctggtccacctctgggatcgaaaggtctgggtagtttctggacggctaagaaacgatatgcggctaacgtatgggactccgaaggaacccgctacgagaaacctaaattaaagatcatgggaatggaaacccagcgaagtagtacaccgacagcggttaaaaagttcttgaaagaagcgatccgtcgcatcctgcaagaaggtgaagaatccttacacgaacacttcaaagtatttgaagaagagtataaggcgcttgactaccgcgaaatagctggtgtatcatctgctaacaatatctcaaaatatcgtgatgattttggatacccaatcaaagggacaccaaaccacatcaaaggcgttctgttctttaaccgatatacgaagggttttcaaggaattaccccgattatggaaggtgagaaggttatggttctgccgttgcgagataaaaacccgtggcaatccgattgcatcgcatggcaatccggtacgcgtttacctgttgagatcgaaagtgatattctcaactgggttgactacaacggattatttgaaaaacatgtgattagcccgttgcaaaacatcacggaagcatgtaaaattgattacgaaaaacgcgcatccctgaacactctgttcggtgatgactggtaagacctgacggggcagaaatgccccatttatataaatttgtgaggaatatattatgcgtgtatataaaccggaaaaataaatgtctaataaagcactcctgaaaaaactgatcaaaaactcgaatagtcaatctgcgtcaattctgtctgaaagcgatgttttcaataacatcaccaaaactcgaacccgtgtaccgatcctgaacctggcgctgtccggcgctttcgatggtggtctgacttccggcttaactctgtttgctggcccgtcaaaacactttaaatcgaatctggggctggtgacggttgcggcgtacctcaaagcgaatgaggatgctgtgtgtctgttctacgattcagagaaaggcgtaactaagtcttacctgaaatcaatgggcgttgaccccgatcgtgtggtgtatactcgtatcacgacagttgagcaacttcgaaatgacgttgtgagccagcttaacgcgctggaacgtggcgacaaagtgatcattttcgtggactctgtaggcaacaccgcgagtaaaaaagaactggctgatgccctgtctgacaacgacaaacaggacatgacccgcgctaaagcacttaaaggtatgttccgtatggttacgccttacctggcggatctggatattccaatggtgtgtatctgtcacacatacgacacacaagaaatgtacagcaagaaagtcatttccggtggtactggtctgatgtattccgcagacaccgcgatcatcctgggcaaacagcaggtgaaagaaggtacggaagttgtcggttatgacttcatcatgaacatcgagaaatctcgtttcgtgaaagagaaatccaaattcccgcttcatgttacctatgagggcggtatcagtatgttctctggtcttctggatctggctatggaaatgaacttcgttcagactccaacgaaaggctggcgcggtcgtgcgttcctgaacacggaaacaggcgaacttgaactggaagaaaagaaatggcgtgaatcggaaaccaactctattgagttctggaaacctctgttcactcaccaaccattccttgatgctattcaggataagtaccgtattcctgacaaagagatcactgacggggcagcactcgaagatctttattctgacgatgaagtagaaccgtcaaataaatttgatctcgatgacgatatccctgatgatgtggatatgtcagaagagtaataaacaactgggggctttgcccccttttaataggtgaatcatggacattgaacaaaaaacaaaaaacattcttgatgaagcaatgcaggacgttattcaagaactgttgatcaacgatgaaaacgatgttgcacacttagtgtacatccataaggtgtattgggataacggcctgaaagtcgaatttagtacgccggacgaagacaaagaaaaactgattccgctggttcacgatgcaatctacgcgcagatcaagcccaatctcccaaagcctgaaaagaccttatgggcggcgttgaaagtaaagctgtataatttctttcagatgttcgctaatctggtttaagaggtaataatgatcgtcgaaacaatattttcaaatctggtttttaatggtacgtattttgttcaggcgtggccccatttacgccgtgaatatttcgaagggaacgcgcagattctctttgatttgatggataagcacgtacaggaattcaacagcattccttcacaaactgctttagaagtagctctggacaaaaagagcctgagtgatgtagtctacgaagataccaaaaagatgatccgcagcatgaaaaatgcgccggaagatctggaatggttgatgaaagaaacggaaacctattgtcgtgacaaggcaatgtatcgcgctctgtcccgtgcaattgagatccaggcgaatgctgaaaaacctgctggcgaacgcaacaacaaaatccctgacgttggggcaatccctgacatcatggcggaagcgttagcgattagcttcgatagttcggtcggtcatgattacttcgaagactatgaaaaacgctggatgctttaccagtccaaagcgatgaagattgctttcaatatcccgatcctgaacgccattactaaaggcggcgcagaacgtggaacattgaacatcttaatggctggtgttaacgttggtaaatctctggggctttgttctctcgctgctgattacctgcaatcaggtaaaaacgtcctgtatatcagtatggaaatggctgaacacgtttgttctaaacgtattgacgctaacctgcttgatgttgcgatggacgatatcgacaacggaaacatcacctatgcggactataagaaccgtatggaacgcctcaaacagtcgaaggtcgggcgtttaatcgttaagcaatacccaacagcaggggcgaacgcgaaccacttcaaagcgctgattaaagagcttaaattgaagaagagtttcgtacctgatgtgattattgttgactacctggggatctgtgcttctacccgtgtacgcggggcggaaaacacatacatcctggttaaagcgattgccgaagaacttcgcggtttggctgttgaaacgaataccgtaatgtggactggtgcgcagactacccgcgccgcgtgggatgcttctgatatcagcatgggcgacgttgccgaatctgctggtcttccagctaccgctgactttatgttagctgtgattgagaccgacgagttagctgatcagggattgcagttgttcaagcagatcaaatcccgttacggcgataagaaccactttaaccacttcaaactcgaagtgcgcaagggtaatcaacgctggatggataccgacaacagcgatatcgggttccaatctgattataaaggtcgtcagatgccgaaaacgcttgaagaagcacaaggtgctatggtaaaacaagccgagactaaccgaagcagtaagttagccgaagtagcaaacagtacagacattcaattttaacggggcttcggccccctccaaaggtatagtgaaatgaaaaagattctcgttattgtgttcctgatcctcctgtctctgaaactggcagcaatcggggttatggcaaatgcttcatggtggcttgtgtttgcacctctgatcgtgatcggtgtgattaagctggctttctgggtgctgtttgtggtggcaatggcaaatgtattccctaaactgactctctggattgcaaaaaacgcaaaataatcctgattaggggttgacgggagttatgattgtgataatatgactcccgtagacaacgaaacggattaaaggagataccaaatgaacttactgaacaacccatacgacgaagtgatgaacccagaactggatttcagcgcgggttatttcgatgcagtagtgaacagcgtagtaaacagaggtttgctggttgaaatgctgaaaagtgggaaagcagatgttgaaggtagcgttgatttcctctggggcttcctcccaatcgacccagaattcaaactctgctgtaacgaagttcaggccaaaaacgttcttcggtatctaatcaacaaagcataaaattaagccccgaaaggggcttttttgtatctataggtattgcaatccttcacgaaaggtgataccttattctaaacaaacaaaggaggacatcatgaaacttgcaatcgcttttatcttactggttctaaacgcacttatgggatttccgttcccgtggttggtgcttctggctatcccgtttgcatggaacctgttcagaatcggtttagcgggttgtgttggtgtcctgatgcttatcatcggcgctatcggtggcaaagacgcttttatcggtgttctgaaagccatgaaagagggcgttaaagaaggtttagtgaaatgagtgatttattagatatgatacttccagacgaagaaccggagttcgatagtccgtatcgttccgaatggatcgtatcggttgatgataaaggctatgtcgatatcatgcgctggcctaatattcatcctggctatctggacgaaggtatcaatgcggaaatgctgggtatgcctgaacaggttgaagatcctgctggggtgtataagtggatttgcagcccgtgggaaacccgcgactgggaaagcaatattgttgatgactggggctttgatgtggtagaatctacccctctgttcttattaccggaaaaggtcaatggcgaagttaacgaaagcggaaaccaaacaacacaacaagataatggatctggtggagtctgacaaggcgctaacctacgacgaaaaattattcattatcgaaaacttccatgaaggtgcatttacgaataactctgaactgggtgcattctttaccccgatcggacttgctcgcgatttcaccattgatgcttgtaccagtggaagcgttgttgacctgtgcgcgggtatcggtgggctatccttcgcgatgcttcatatgatgatgtacgccaaaccgcgtgaaatcgtctgtgtggagttaaaccatacatactataagttgggtaagcgtatcgtaccggaagcgacctggattaacgcagacgcgttaacgacggagtttgatactatgtttgatatggcgatcagcaatccgcctttcggcaagataaagacatccgattttaagggtaagtatacgggcgcggaatttgaatataaagtgattgaacgtgcttcacagattgcccgtgcgggtacgttcattctcccgcagatgtccgcgaatttccgttactctggacggcgttatttccaacaggacgaatcaacgacaacatcgaaatgcaaaaagtttcttgatgaaactggccttgaaatgcaaccaggttgtggcattgataccggatactatctggaagaatggaaaggcgtgaaaccgatgtgtgaagttgtctgtatggaattccctgaaccggaaccagaacccgcgcaaaaccttttcactttcacaatagagtaaagactatgagcgatcaattaatcaaaaacatggatttaacctacagtgtgcgaatgattcgcctactgaaaaagccctggactgaatggacggcttacaagctgggtatcatcgacggtcaaggggaagtattgaaaaacccgaagacgaaggaagaactggaagcatattccccgttccatcgctctgtaagacatatcaagcgccgtttaaacgcggttccttatatgtctgggttcatgaaccttacaagcgcgtatgactctctacggaaccgttggaatctgaccgagcaagaacacgaagagatcatgatgaacctcccagaacttcgcgaaagactcaacgaagaaatggttgcaggtgattcaggcggaagcgtggataacattgcttcgggtgtgactacaggcgcgatcacgaacaaagggccaaaggttctgggttctacgcgtccatataaacgcaaacgtaaaatcatgaagagtgaagaatgaaaccattaccgcctttgaattaccggatctgggttactgcgaacaattacacctggtttccgatccgtatcaagtacatgagcgacaccgcgatcgtgtacacgaacgaaagaaaaacttcatcgggtgtcgatattcctagaccttatccgttttataagatattctatgaatggaaaatcactttagacggcacagagaaagaagttagccgatagaggtaaacatgtatcttgatatagagttcgcaactcgtatcatgggatcattaccacaaagcgaaatcgttcgacggggtggagaattcagtatccattcccgttgtccgatttgtggcgactccatgaaggataagcacaaaaaacgtttctggatatttccgtcaaaacgaggcacacatatgatgtgtggttgttttaactgcaactacagcaagccgttttctgtgtttctgaaagactattacccggatgattatacggcgtatttgatggaatctttcaaggatcgtaaagatttaaaacagacgcacgaagaaccgccgaaggaagaaaagaaatatattcctgaattgcagttctgcgaacgtctggacacgttgccagaaaatcaccctatcgttaagtatgttgcaggtcgtcacatacctaaagacaaatatgatcgcctctggtttacgcgtcaatggcaacacctggttaactctgtgaatgcggacgcataccctttaccgaaggatgaaccacgtttggtgatccctatctttgatgaaaagggtaaaatcgagtcattccagggacgcgccttgcgtgacaatgccaacgcaaaatacatgacaatcaaagcatgtgaacactcaacgaaagtgtatggtcaagataccatcgatccgttgaagactgtttatttccttgaagggccgctggatagcctgtttgtagataatgctggggcgattacgggcggacaaatggcgctgtccgatgttccgtataaaaatatgcgtgtttgggtgcttgacaatgaacgacatcatccagatactaccgcaaggttaaaaaaattgattgatgctggagaaaaggtcgttttatgggataaatgcccctggccgtcaaaagatatcaacgaaatgattaaaagtgatggtgctaccaaagcagacattgctaagtatctgaaagaaaatacagtgtccggtttaactgcaaagttgagattcaaccaatgggatcgaagtccgaaaaagaaatagatggtataaaggatcttctgactaaggttagaatagattacaataccggaaaggtttactggcttaaaaatggtatggaagctgggacaaaaaccaaaaagggatatacccgcatcgaaacaaaaggtgtgaaatatatgcgtcatcgtgttatattttactcgcgttttgggtatctccctgatatgattgaccatatcaaaggcgttgatgttggtgactttcctgataacttgcgtccagcaagtacagcggaaaacaatgcaaatcacattaacaaacgtaaaaacaacacaagcggttccattggtgtataccctcgcggaaaccgattttctgcaagtattcaatataagggcaaacgaaaacatttgggttcttttgcaactgttgaagaagcacaagccgcttacaatgatgccgcaaaagagattttcggcaattttcataatgaagagacaaataaatgactgataaaactcctgtgtttaatagctgtgcgcacctggttaaccctgctgatctggaatttgttgataccgaatatcaaaaggttctggcacgtaacggcgatcctctgcaatcaatgctggatctgcaaaaccacgcacaacaaagcctgtctgataccctttcatgggttccgcgccctgataacctgaaaacgtgcggtgatatcttggactggctgaaactgcaagatgatgcgattgcagatgaaacccgcgaactttacaccgctctgggcggtatgtctcgcggcgcaaaacctgcttccggtgtctggaaaccgtggaaagcaaatcaccaggaactgcgcaatcaggtattcgcagaaatgaaagaagaagacaaactggaaatcttgtttgaactgattgaccagtggcacttcttcatgtgtaagttcctcgcgttgggactggatgcggaaaccatctacaagctgtatgctctgaaacaggcggaaaacctgcgtcgttgggctaacaactactaatggaaatcaccgcgctacatgccgtatttgctttgtcttatatcgtctgcgcggtgataacgtacctcttcggttggtgcgttttccacgttaacggtgttgacagaaaagccgctttgatagtattatcattgctatggtttataggttttttctacgtcatctatgaggggcgaaaatgattgacaaatactatatcattgttacgaaagacaaagacggctttactattccatacgttgaaaacgggaaaacgccggaactgtttgcatcaccgcaacttgcaaaagataaattagattttatccgcaagtgctacgaaaccaaactgaactacacgccggatgaaccgcgtttcagtttcttccgcaaaaccgagcaactaccagcaaccgaagaacagaaaaaagagatgcgttggtttattgagaattcgaaaattcaaggggtattactcaaattatgagcgagttaacatttgatgatctgagtgacgatcagaagtccgcgcatgatcgcgttatccacaacatccagaacgccattcatacaactattacgggtggccctggtgttggtaaaacaacactggttaagtttgtctttaacactctgaaagggttggggattagcggtatttggttaactgccccaacacaccaggctaaaaacgtgttagcagcggctaccggaatggacgcaacaacgattcattctgcattgaagattagccctgtgactaacgaagaactgcgtgtgttcgaacagcagaaaggcaagaaagcgcctgatctgtctacctgtcgcgtgttcgttgttgaagaagtctcgatggttgatatggatctgttccgaatcatccggcgcagtattccaagcaacgctgttattctgggactgggtgataaagatcagatccgtccggtaaacgccgatggacgtgttgaactctccccgttctttgatgaagaaatctttgatgttatccgtatggataaaatcatgcgtcaggcagaagggaacccgattattcaggtttcacgggctgtacgtgatggtaagatgctgaaaccgatgtctgtcggtgatctgggtgtgttccaacatgctaacgctgttgacttcctccgtcagtatttccgccgtgttaaaacgccggatgacttgatcgagaaccgcatgttcgcgtacactaacgacaacgtggacaagctgaacgcaacgatccgcaaacacctgtacaaaacaacagaacctttcattctcgatgaagtgatcgtgatgcaggaaccgttagttcaggaaatgcggttgaacgggcagatcttcactgagattgtttataacaacaacgaaaaaatccgagtcttagaaatcatcccgcgtcgggaagttatcaaggcggagaagtgcgacgagaagatcgaacttgaattctatctcctgaaaacggtatcgctcgaagaggaaaccgaagcacagattcaggttgttgttgatccggtgatgaaagaccgtttgggtaattatctggcttacgttgcgagcacttataagcgcatcaagcaacaaacaggctataaagccccgtggcattcgttctgggcgattaaaaacaagttccaggatgttaagcctcttccggtttgcacgtaccacaaatcgcaggggagcacgtatgaccatgcgtacatgtacacgcgcgatgcgtatgcgttcgcagattacgatctgtgtaagcagttaatctatgtgggcgtaacccgcgcacgttacaccgttgactatgtataaggggctacggcccctatgaggttattatgaaattgagtatcaaagttaccgacatccagcagattctgaacgcagtcgaaaagattcgcgaaaaagaccctcatgcaaattccatgtttgcaatgtacagcactatcgatcctgctgatgtgatccgtaagctgaaatacattgacagctacaataaaaatctgtattgccctaatgggccaagttattcatggggtaacgtcgcccttacagttgaacttacatatgaagaatatggtgttgttactatgattcttcgtgtcatgcgtaacttacgcgaaaacaaagacctgtggtacttaccatgaaaacagatatctctatgaaattccctcgtcttcatgcggatctgattgctgacctgattttaaagacaccccgcgagcaaatcccgttacacgttgattatgactatctgtgtgaattcgtggaagctgttgaaaatacaaagcgactcgaacagtcgatatataactgtggtttgcgtcaattcggtatgcagatgctgagtaacgaagaaatcagtgagtttgatatcactcccagagtagcccttgcgctggctggtttcatggaagaatataagaggattcgtaatgtcacatcttccagttgattacgtatgggactatgaaactgtaggcccgtcaccaaacggtaaactcgttgaactgtcttacgttccgtttatcgacgacccccacaacccgccaacattcgcggaactggtttcgcgggggagaaaatataagttcgatttgaaaaagcaaccggatcgcattgctgacaaatcaacgatcgattggtggaaacagcaaagcgaagaagcccgtcaaatcctgaaaccgtcgccggaagatctggaactgtatgcaggacacagacaattctttgaagacctgaaagcggacggtgtgagccgttggcaatcactcgattatgttcgtggccctgaattcgatcgcggtatcctggttgatatcgtgcgtaagatggttggtaagatcgacatcttcgaagatatgccgaccgtgttctggaatagtcgcgatgtgcgtacatgtatcgaaaaccgcctgttaacgcgtgatgcttcgacctgtcctcttcggaaagggttgcttgatggttttgtgatgcataattcaattcacgattgcgcgaaagatgttttgatgatagtctattcattgagatatgcgctggggctggaagaacccccaagtgaagaagaaaccgatccattgagtctgccgaggaaaagatgattaaattatcatttgtgggtaaaactgtacatgcaaaaacactgaacgaagcaaaagcgcagatgtttgacattctcatgaaccccgcgttcgttaaagtcgaatacgatgaatatgttgttcagcctggcgatagcatgtattcaatcgctgaaaaattatacggttgtggtgagcgctggcagtctatcgctaagttgaaccgtaaaaccgttagtaatgcaagctatatccttccggggatggttctgaaattgcctcagttagtcgaattatgataaaaagcccttgcattcgtgcaggggctttgttattttgtagggactgaaacaaaagaggatgaaacatgtttggtgatttgaaagaaggtttgaacattttaatcggatttgcgatcattggtgtgattgcgtgtgtatccggtgcggtgtggttgtcttatcaggcgatcgtgtggttaggtgaatggcttcacattctggcacagtaaggggatattatgcgtttatgtttagttggtgtaggtttcggtcgtgcgttaactcaagggttaatcgactcaatccgctggattcaaccacgcgttgaactgtacgcaatgccgaaccggatcgaatactctgatccaacaccgtacaaaatgaaaccgtatcaagcgccacgcgttaaccgtgtgctgcaccgtcaatctgtaaacaggggtaagtgatgaaagaacttacgatcgtcgcagcagttctgattttcgtcatagtttcaatgattatcgtcagactgtaccagcacggggaagcgtttgaatggttcctggatcacgacaaagcgtttcgaaagcatttcgcgggtgagttcatctttactcatgtaagcgtagcaagcggtacggtaacgtttgattttgacgggaaagggaaatcataccatgttgaactctcccttatggatgctaaacgcgtgtatgatgccacacaaaacggcggtatgcgaaagatgcttatacctctttcaaaataattttaatagcctcttgcattgcaaggggcttttttgtatattgcgcacataccaaacggaggcaactatgacacgtattaacacaatcgatccttctcttcttctgaacgaacacctgattgcagaactgcgcgaactccctcgcattcccaatgccgttttatccggtaaggcaaaaatcaacctgtcaaaaatccctgctgtgtatacgctgggaaccggacacgtaaccttcttttacaataagctgggataccttcgcgatcgtcatgctgcattacgtgctgaatacctcgcgcgtaatggtaaagaatacatggacggtgcatacgaagatttcgatcttagtccgctgtcaaactccctgtttcatcgtcatttgtgcgcagattggcaaccaacgccggaatcagtgaaaatcaatgttgagcgcattcgtgaacgtttcgaactgcgcaaacgtgcttatcggttcggtactgagatcatcaacgacgaagccgcatgggatacgtattacgaaaaattaaaagaaaaatacgattttctttgatttgggtattgacccaaatttcgatatgcagtatattacacacatcgaaacgaaacagacaaaaggaacgcatcatgaaaaacttagaagccaaagtagttaaagtcctggttaagaacggtttcaacgaaaacgacgcggtagcaatggttgaaaagaatctgaatgatgcgttgaaagttagaccagaagcaaaacctgctaaactcgcagaggtgattgtatgcatcatgtaaaagtaagcatcaaggatatcacggtgggtgacaccgtgatccacgaagggaaaatgaagactgtcgggaaaaacgatatcaagcacgaccctttgtttggtgttctcctgttcggtgatagtttcaacttggggagaacttttattgaccgggttattttcccgaaatggtatcaagggaaacgggtttaacaaatagcactttttgctaaagacttcacgggatagctttgatatagttatcccatcgaaacgaaacagactttaggagattgccatgtatacttttgacgaactgaaagccgcagcacagcctttactggatgcgatgttcaaagcccgtaacggtggcgcattcgaaaacgaattctttgaaactgttttcgttctggaaaaaggccgtaagtatcatcgtattgtgcaggatactcgcaacaaacagactggtgaaatgttcgatcagcgttcagttgctggtttcctggacaatgacggcaatatcctgaaagccgcaggatggaaagcacctgctaagggtattcgcggtaatatcttcaacaacccagagaacgcgatcgaccgtagcggttacgttcgctatcttcgctaaaatcggggcttcggcccctttggaatattaaaatgaaactatcagcgaccgcaagttggtcaatcttcggactgatagccgcaggggttttattcttcgcatggcaatcaagagatccgaacaaagcggcgtatgaagccgcacaacgagtagtagaacaggatgcagaagcgcaacacgaagcaatgttaaaacaacgtcgtgatatgggctttgtggagactgtgagttacacaaacgcttttggtgatgtcaccacgcgctctgtaaacgtcttagggcgcacgaaagggacaatgctcaccatcagacgggaaggaaccggaaagctcgtagacgtgtgtttcagcgcgattacggacgattccaaacgcgaactattcgccccgtatttttctacgccagtctatgctaaatttgacggcggagaaacaaaagagtttagcgcaagcagaggaagtaccgaagatttcctgtgtattacttccccgcaacgtttccttttcaatatggatcgtgctaatgttatgcaagtccagttagtattcctggatcattactccaaagtgccggaagtgcatgaatggaacctgtcaacatataatgaggttgtgaagaaatgagcagacgcccaaagaacagcaaaaccgaaatgtttgcaacgtttgatgtaaacggaaagaacattgagggtaaaccatgcacgaactcaaagtttatgcatatcgccggattgcctggtatgagtgttaagacttcgtatgattgtcattacaacgaagaaaccacctctgtttatttgggcgaagaactcatggctgaacgcgtcatgcagtgtgtgcatttccctggcgaacgtccagaagtgaactgttttattattggttatcataaaggtattgtaaatgagcaagtataaagttggcgatatgtacgccccgaaatctattttaatggctgtgtgtcaaatggcatcagaagccgatccgattcgtcgtatgtatgacgcgttgcgtaagaatccgatggacttcaattcaccacgccggatcagtatggtgtatgaagaaacagggattctttatcttgaaggtattcccgttcctgtaaagttcaacgatatgaaagggcttttcaatccggtatgggttgcaccagaaccggaaactgaaattacgatccacgtcaataaaggtgaggaagtaccgcgcgaaaattccgctgtagttctggataagtttttcaagaccgctcatagcgtcaaaaaacgaaccgttagcgacgtggttcaccacctgtccgcagaggttggggagatctccgaatgtctcgttcagcctcaacgcggcggtgatatcgtcgaagaaagcgttgatgcgatcgtgtgtgccctggatgtgatttacctgaaactgagtacaacccacgggacgacagaaatcgcgcaagtgatcaataaactgcttgataagaaattagataagtggtactctacttgtagttaatcaattacgaggatcggatcatgttggtttatcgcgttgaattgaaagcgtctatattatccaaatatgatggatggtgtaagcaattaggcccgtatacgggttgtgtcggtgatgaagacgatctctatgagtatctcgatattcatggaatcgagttcggtttaaacttcggtatctccgagactcgtcaccccgcaccatgcgaagaccttcgtttaatgcgtaacctcaaaaaacatggtaaaaattatcgtagctatattttcggcttctcttcattgcagaagttgtctaaatggttcgatagctgggagcggcaaattttggagaatcagggatatatttgtatggtgtacgaaactgatctcatgtttgcagggaacaagcaatgtgttttcagcaaagccgcaaccccgatccgttttattccattgtcagagatttattaatgccaacatatacctataaatgcaccaagtgcgaaaaagaatttccgaaaatgtccagcatcgcaagccgcgacgaaccgaaagattgtgattgcgggggcgaggcgatacgaacggttgataagccgcagatggtgaaagacggattcccgtacaacaagtaaaaccccgaaaggggttttctttttcatagaaccctatataatgcctgagaactaataacgaggtgaatatgagtttagatttcttaatggacgataacgagccgcagaaagcaccagaagccccagcaaagggcgctaaggtggatgaatcattctgcttgagcgatcgcgatcacattcgcaaacgtccgaatatgtacgtgggttcagtgaacaaagaagcccatgaacgttttatcatggggcaattccgcaaagtggaatacgtggaagggttggtgaaaatcatcaacgaaatcctggataactccatcgacgaagcgatccgaactgatttcaaatatgcgaacaaaatcgaagtgaagattgatcacaatctggtaacgatttcggacaacgggcgcggtattccacaagatgacgtgagaacgccggaagggaagattgttcctaaacctgttgcagcctggacaatggctaaatccggttctaacttcgatgacgaaaaccgcgtaacaatggggatgaacggtgtaggttctttcctgacaaactgttacagcgcaatctttatcggtgagacatccaacggtaaacgcaaagtcacgatcaattgtacggacggagcgcagaacatggattaccgcaccagcccgacgaaggagcaagggacaaccgttaagtttacccctgacttctctatcttcggtgtggacggtatcgacgaagagacaaaggaagtcatcaaagaccgccttatggcgcttgcagtggctttccctgccgttaaattcacatataacggcgatatcctcccgaacaaattcgcgatgtatggcgcgatgtacggtgataaaacgattacccagacaaacaacaaaatcagtttcatcctggcgagcacagaagacggtttcaaacagaaatccttcgttaatggtctggatacgaaaaacggcggtgttcatgttgacaccatgatcgacggtatctattctgaactcgaaccgatgatcaagaaaacacacgctatcgagatcccgaaagcccgtgtaaaagaatgcttgactttggttgtgtttttgcataacttcaatgcaccagcttttgatagtcagacgaaagaaaaactgactaacaccgctggggagttcaacaaccacgccggactgaactacaaaaagatcgcgaaacagattatggatacttctgaaataatcactccgatcattgagtccgctctgattcgcaaacaggcagcagaagcagcagccattaccaaagcgaagaagaaagcgaaaaaggcgaaggttgcaaaacatgttccggcatcagggatcgacactgacggggtagaaaccactttgtttctgaccgagggtgattccgctgtggggcagtttatcgagtgcagaaacgaagagacacaaggcgcatttccgctacgtggcaaaccgttgaacacctggggaatgagtaacttagaagtgctcaaaaacaaagaattgtctgaactcatggcgatcctgaatctccatccaggcgactcttccgaaatgacttacgacaacatcgggatcatggtcgatgcggacgttgacgggggcgatattctcaccctactgattgcgttctttagccgctggcctgagttgttcgagaagaaaaagatccgttatatccgcacaccgattatcattgcgaaagtcggtaaagatgaaaaatggttctactcccttgaagatttcgcaccgttccgcgataaggcgaaagaggtacgatatatcaaagggctgggttctttacgtaaagaagattacgatcgggtgttgggcgaccagttaaaatacgatacaatcgtactgggcgacgaatacaaagacgttctggaactgtgtttcggtgatgaatccgatccgcgtaaagactgggtgaacggaaaacataaattttcggtgaaatgatggaaagaagtattaaagacgttgtacaggtggaggggcttacatttgctctttacacaatttattctcgtgcgatcccgcacctggtagacgggttcaaaccagttcaccgtttcttcgtgcattccgcagcgaaaggcggtacaggcttccagaaagtagcctctatcgctggcggtgttgcaatgtatggttatcaccacggggaaacatccgttgaagaggcattgtctcttatggcggcgcactggtgcaataacatcccgctttttgaccgcgatgggttctttggttcccgtctggttaaaaagccaggcgcaccgcgttacattaaatgtaagctgtctccgctgttcaaggctatctacatggatgaagatttaacaatcccgcatgaagatcctgaacacgtaccgccagcctattacctgccaatcattccgatggtactggttaacgggttcagcgggatcgcgaaagcatacgctaccaacattccaccacacgatccgatttcggttctgaatggatgtgttagttacctgaacgggaaagatttcacgctggatctgaaatacccgcatttcaaaggcgacattgaaaacggtacgatgtacggcaagtacgaactccagggtaaaaccaaactggtgatcacagagattccggtcaagtatgatcgcgtgaaatatatctctattctggataagctggaagaaaaagggtatatcgtaagctataaggatctatcgaaagaagatttccgctacgaaatcacccttaaacgtgagtacgcaaacgggcttacccgtgagaagatcctgaaagatttcggattgattgagaactcaaacccgaacatcaacgttatctttaacgggaaactgcattcatacgagcgtcctgaaacgttgctgaaagacttcgttgatatccgtattggtgtttaccaacagcgtattgataagcgcatccaggagactaaggaagcgttagataaggcgctggcgaaggtggacttcattgaccagatgatcgcacagcctgacgcattgaaggggcttagtcgcagcgaagcggttaaacttgtctctacgtggacgggttgcgagaaccacgccgaaatcctggttgcgatgaacatctatcatctaaccacggatgaacgtcaaaagctggaagacgaagcgaacgaactgcgtaagcaactgaaatactgggaagaaacaaccccgaaaactgaatatctcaatgatttgaaagaactttcgaagaaattgaaataatttacaaaaagcctcttgcatcgcgggaggcttttttgttatagtgtcctcactgatttggggaggatataaaatgttcaaaactcgtagcgatatggaaataaccatctgggccaaaagcatcatggcgaagcatggcttatctcattggtctttcaaaatcaacggacgtttcaagcgtactctgggacaatgcaattacagtcgcaagtcaattgaattgagccgttctcacgttaaggaagatatctacgagaacgttttagatactctcatgcacgaaattgcacatgctctgaccgaaggggctggacacgggatcgtatggcagcgtaaagctatcgagttgggcgcacagcctacaccatgcaaaagccgtatccgtgagaaatcagtaattcaggaaagcgaaaaagacatatacgcgtttttcctgaaaactccgaacggtgaagtttatcagtgcaatatgaccgaaaagatgtacaatgagatccaggaaggtaaacgcaacattgcaaacatctacatttcaagaaacaaacgagcaaccaaagggcgcttagtagcgcgtaaattgacaccagaacaatatgcagaggcgattcaatgaaaccatatgatgcaccaaaaacgggaaaatatattacaatagctgtgctgtgtactattgcaatatgttttgtaactgctatcgtggtcggtatcatggatatgaaagaccgcgaacgtcagaagcaacaggtttacgaataccttgaccggatgtgtacacctgttgagtatgggcttgatcaaaagcctatgaaatattcatgtgataacatcatcttcaacaccaagtgagatataaacaatgaaattgcgtcagttagcaccacaaaccattcacactacgggcttcgataaaggcgaacgcacgaagtttaaaatggctaccagtgcgaaaacatacaaaatcatgtcatcaaccatctacaaatacaagatccgcgcaatcattcgcgaaatctccagtaacgccattgatggtcatatggtagcgggtaacatgaacccgttcgatgttcagttaccaactgttctcgatccgcgtttcatcgtccgtgattacggcacagggttaagtgactggatggttaaagaggtgtttgcaacctatttcgaatccaccaaaaccgacaccgacgaactgatcggggcgctgggactgggtagcaaatccccgttctgctacactgaaacattcactatcgaatccatccaggacggcattaaacgcgcgtacacggcttacatggataatggtgaacctttcgttgacccaatctacgaaatcgaaacagacgaacctaacggcgttcaaatcaccgttccggttaaagtcgaagatatcgcagaatgggaacgtgaagcggcgcgtgtttacgaaccgtttacgggtatccgtccgcgctttatcggtgttcaggttgatgtaaactggcaaccgaaagaagcagacgatcgcgggatcatccgttataagtccatcaactattcaggcgtatacgcgcgtatgggtaacatttgctatccaatcgacatggacatgttcgaaaactcgctgttctactgctaccgcaacagcaattacgcgtatattctggatttccctctgggatcgctggacttcatgccgtcgcgtgaagagttgagccttgataaagtcaccaaaaaagtaatcctggatcgactggaaaagatcaacaaacgctatgacgaagagttagttgcggagttcggcaagcagaaaacaacccgtgataaaatcatatggttcaacaatctgcctagcatgttacaggcttttgtaagccgcgataagcgtttccgtgtgggtaaagattcgctggctgaaatcctgacgcatcttaaaagctctgagactgcaaccggaaaatatatctggggtttctgggctaacccatatgacgggaaagattgcgtattcgaacgtgtgggttctggtcgccgctatgagacatacaaagcggaaactaccaaacgccaggacgttatgcgcatgattcaaccgtggcgacagaagaaactgtttatcgttgaaaacgataatgaagcgcgttcactccgcccgtatctgatcggttactgcatgttgaatggttcggatcgtatcagtttcgtaaccaaagagattaatagtgaacctgttcaggacttgatcagaactgggtatttcgatgaatctgagatcgttacactgaaaaccagtgaaatgaccaaagaattcgaaacgtataccgaagatcgtaagcgctggaaagcaacgcgtgaatcatcttctggtgattcagaaccgcgtccaaaaacgcctacagcatatcattacttcctggatgatcagggcaacttacagaaaaacgatctgtacctgactaaagcacagtttgtgaaactggatgaaatgtacgctatgcgcctttatggtgttgatgaatatagccgactggacggagaagcacagaactattcgttgggtagcatcgccagcagtatgatgaccatgttaacggttacagggctgaacgaagtgatggttctgcgaaactctctgtggagtcgcattccagatagcaacatgaaatgccttgatgattatctggtaaaacgttttgcggacgcagcgaagaagataaaacctaactggttccctgcatggatttcatcaaaccacggaagcgagatccgaaccctgcgcgattctatgggcgtaacccttgatcgcatggttaaaaaccgctataatccagaattgtatctgttgctcgattatcttgatggtaagtttacctatgatgttatcgagggcaaaaacaaatcaaaaactgtggtgcgtaacctgttacttcgtgaaatgtcaacgaagtattacaaaatgcggaaagatatgaaagaacgcgttgatactgcttacgatttatttgcagaacgcaacccatcaattcattacatgttgttacattcatcttattctacattccgcagtatgtttaatgatgataaaattgtgatggatttggtcaaacttatacggtggaaataatgagaaacgttaagatccttgatgatgtacaaaagaaagcagtttatgagggctttctgaccagcgcaaacaaaaccgcactggctaaacaatttggtgtaagcgtccgaaccatcgggcgcgttattaccgaacagcattctaagtataatacggaagcgtcgaaaccacttccacaaacagatgtcaaatctaaaatgattggttctgaatcgttcattactctggtactggacggcaagatcatcacagcggattcgtcacaccctaacttcgaaaaagcacatgctttaatggttaagggcgacatcgagggagttgctaccctgttggacacaacgcaagcgttgaagatttacagcaaaggcaacattaaaatcatcgggcataaagtcctgtacaaagatatcgtgtttgacagcggtatcacacaacgtatcgttcgcgaaatgtacaacgatcgcccttacgagcacctggtgaacttcttcgagaagttgatggaaaacccttcacgcgatgctgtgtatcagctttacgggttcatggtgcataacgatatcgaactggcagatgatggagatttctacgcgtggaaacgtgttcgtgaagacttccgcgatctggcttccggtaagttcgataattcccctggtgttgtggttgaaatgccacgtaaccaggtagacgagaataaaaaccgagcctgttcatgcggtttgcatgttgccgcaaaatcgtacctgcctcactatggcggaggacgtgggcgagtcattcaggttaaggttaatcctcgcgacgttgtagcaatcccgacagattacgataacgctaagatgcgtgtatgccgttatcaagtgatgcgtgatgtaactgtgggattcagtcactactaaccccaaaacagcgcctggagcgattcaggcgcggaggattcgattatgaaattcctacagagcattcctgactactggcagaacttgagcggggcagaaacagccatcaaaaccgctaaagaaatctggaacggaggcaacgttaccgctggacgtacagaagacggagaacagacatacttcaaaaaaccttacggtattatcgcaacagcccttgcatttaatctgggttatgttatgctggtactcgcaacggttcagaagtgggtagagataccgatgaaatggatcgggacgttgttgattcgcttagttcgcttagtgttcggcgcaacgatcttgattttgtcatgccctatcttcttgctggtactgacaatgaatatgaaaactggtgtaaacaccaaattaggaaataaactggtgaagaaaaatgaaaagaattctgacaaggcttgacatccacaaatatgctgttaagataggtgacatgaagcgcggtgacttcaccaagttcgaaggggttgacctgaaagaacacggcttctacctggtagttgatgataaaacgggtaaggtagtatttcgattctacgtagccccaaatcaacgccgtaagactggcgcaaaccgtactctgttacgcatcaaacgccgcgaacatgaaccatcagcgatggtggccttgctggatagtgcttctctgtacttcgttgcacacgataagattaaaaacctctttggtttctcgaatcttactggtacaatagcggaaagcgcgattcagatgcggttcggggatggtgagaactatactgaatacaaccgcgcactaaatgatctgtttgactttgaattccaaccatactaattgagataatgaatatgaaactgttttccaaaatccgttctgtagacgaaatcgtagcaacttttgacaaaaccctgaccgaactcgaagcgcgtattgcgcatgatcagaagcaggtcgaacaggtagcagcagaccgcaaagcagcggaagaagaacatcagcgtaagctggctgaactggctaccaaagaaagcgatcacaccgcaagcgcaacccgcgccggacgtatcgcggataagatccgcaaactgctggattaattcgaggggcgaaagccccttaaatatttctttttgaggggctttaaatgaacaatctggtagcaaaacatgatttcaaccgcgcttctactcaccgcgatcgcaagcgagcacttaaagaagcaaaacgtaagcagaaacataaaggtaagtgtgatgaaaaccgctttgattattcttgaggaaatcccagaaaacacggggctgtatctcgttgaagccgacgaagatatcattgaaatcctcaaaaccgctcacgggcattatgtgaacggatgcaacaacaccccagaacaggatcacgctgtcaatatcgttaacctcatgttagggccgcgtacagacgacaacctgaaatgggcgagcgaatccaacgttcctcatgagtatgtcgggatgtattatcagtgcaacgttgacgataaagcgccactgataccggaaaaacagattgatttagtagttcgaacaggtttcttcttatgagttcacaaattctgttcagcaaagaagatccattaggcacagattcatcggtgcaacgcttattctggcacatggattatgcaaaaaatcgttgtcgtaacccaaacaatacatggggaagcaacgaagacattgataaagcaaaaatttatcctcgcggaaaagcatactggaaaatttttgatatccatcttcataaagttatgaaagattcgaacgcatgataaaaaagcccttgacttcggttgagggcttttgctatattggccttgtcgaaacgaaaccactaaggagattcaccatgactaacctgactaaagttaccgcgacatacttcatttcttctggcgctaaaaacgctatgtacactctgcgtgtagagcgtcgtggaggtggattcacttctgataactatatctgcaacctgtctactgacccagataaagcggaagcgaaagcgcgtgaatacttcgatcgcatggtggatcgtctgaaccagaccgatactttccagatggtgttccagggcttcgcagatttcgatctgttcgaacgtcgcggcaaactgtctgtacaagataccgaaaatctggaactgctggaacaaggcatcatgccgatcggtaagcgtaaaggtgaagtgattgctgatatgccgatgtatactattctgtggtgggctgatcagtgcaaagaaaacggcaacgatagcccagtatttcaggctatttgctcttactgcatgggcgtagcgctggagaaggattatatcgctaaacgtgaagagatccgcgcagaatgggaagcagagcgccaggcgaagatcgcagcagcgcaacacatcggggaaatcggtaagcgtatggaaatgagcggggttgttgagaaagtgatttctctcggatatacccaagtttcttattacaccgaagtggaacgtttcatgaccaaaatcaacgtagatggtaacgtggttatctactacggaaacaaaattgttgaagagggtgatgtgattcgtttcaaagcgacacctaaacttcacaacgaatacaaagaagttaaacaaaccattgttcagcgagtaaaggtattataatgacatacgaagaaatgcttaatgaagtgtgcgcgggtaaaaccgcgtaccgtccaattaacccagatatgatcgtgtttcgtgaaggggatacgatcattcgacgttctcaccgcaaggttgagattaaccaggtattcattgcgagcgtagaagaacagaaagcgactgattgggatattgttgcagaagaagatcatcatgacgggcttgacctgatcttagtcatagataatcacccgctgggtgttcgtccatacatctaccacaatcaatacagaggcgaagtgattctatcatgacacacgacgaagccatgaaagccgctacacgcggttttaaagtcgcccctgtgggtaaggctgggttctttgtatatcacagcgtagaggctggtttccggcgcattacgatagggaacattggatactggaacgatgaatatgtacctacaccatatgaacttatgcgcgtatgggacatatacgataaaagcccgatgacgaaagtaaaagatttcatcaatcgggctttgagtagtttgaaactgaaattatcatcgaatcctgcctaaaattcttgcggcctgattgcacacgatcattaacttcgtatcggtgacttcgggcttctgtatataccattccattagaatcgatccagaatagtagttttcgagattgaaataaggacaactaaaggtatatgctaccggaacaaggtcttttgttggaagatacgggcttgcaatatctgagatatagtacagcccgtttatatgtctattatactcttccgatgtcttgtctataggatagccacccagatttttcggatctatctgttgcggtaacttcccttcatacgcaattatatcaacaaaataattgacattcttaggtctgaaaccaaagattgccgaaaaatccgcacccgtagttgaatgcactatgtttaactgttcgatggatgcggattcaaacttttttgccttttcaatctccatcgtcggcacgtctataacgcttgaagatgttttccagactgaaaataagtcatcccacttgtaccatgttacgaacataatgaaaatagtgacgataagaaccaatttaatgaataactgtttccatgttttgaccgccatgatgaacgatattacccgttcaagcaccgccaatttatcttgtaatagtgccatgtttaaacctcaagttcgggggatgccgaccccgaacatatttaggaatttacttaacgttgagtaaccaaaccagaacggttttgacctacacgggcgtttagatagtcataccatctggtcgcctgagaagaaacaacctgatattgacgatatccatcatgtatacgtccgttgttgtcaaaatcgaatacacctccgtcatccatagtaagccgtaagttaacagcaggaccgttttgaatagtgattacactgatatcagggcttgattgtgcagcaactacagtaccgaacgcattaccattaaaactaccaccgaccgcaggatagccagaaggttttgaatatggtgaataccaaccaaccccccactgaccacgataacgggcgttgttatagtaacgctcatacaccgtaaagttgatgttatataccgattgtcccgccattcgagacatataaaacggtgttccgattcgaaccgcattacccgcagcagacatccatcgttgccctgtttctgtgaccgcagacgaaccgatccagccagggactcctacaatagccataaaaatacctcatgaaagaggggcaattaagcccctaatttgttttcgattgcttccagacgttcacgcagttcgttgattgcgttaaccagaagcgcgttaattcccgaaggtgaaatggttaacataccagtgtcgatgtcttcgcgcactgcttccggtaataccttctcaacatcctgagctatcagaccggattcgcgatggtatacgatatcatcagcatcttttgattgcttatcgtagatataacctttaagctgttcaatcttgcttaatgaatctttcaattcaaccaaattagatttcagtcgaatatcggaacgaatatacacatcgttggcgtttacgttaccttcaacatacagaccacggttcatatacagatccgaagtacgcaactgtaaggtcgtattcagtcggtagttgtgtaccgatacgttatcatcagcaccaccaaacccgaagtatgcgccgttgttacctgccaaagtaatcagcaaataacatgattggttagtcgctgtgttattcagaagtaatgctggcccgttaacaccctgaacctgtaactgtttatagttagcagttgcaccagtagtccatcgcataatacgctggctatttgcataggcgttgagaataccgtcaccttcctgtttgaaacctgtatcgttatcacccagagaaataccagtcgtacccaatccgtttggcgtaccacaaccaataccgtttgtttcgaccgttccgttgaagtttaccgcgttgccaaagttaacagaaccgttaatgttcgcgccgtttcctatagaaacaataccagtagtcaagctgatagtaatcgggcgtaaactgttccatgttccataaggatcgccggagttggtgatcaaggtatagtagttaccaccatcatttcggtgtattaccccgtagtttccttgtaccgcgcggaactgtccaccagaaccagacgtagcgctttgaacttcgttacggaatcgagcataacccgcagtagaaatctgcaattcttcctgtccgtctgtagaacctgttgccagtctccacacaccaccctgaacagtttcatgccagattgtgtccgcgttaccgcctcggaactgacgcaaatagtttttcccgccctgtccaacagtaggtaagaaatattgcgctggtgtgccctgtggaacgtcgttataatacgatggtacgtttacgttaagccccaatttggtgttgatagaagtcgaaccagtaccacggaaataatggttatatcgtccgttgccgtctttatagcctaagtgggtaacaccatcaccaaccccgtttccatcaccgtttgtttcaacacgaagaatcgctgagtttattccttgcgaatcataatctacgcctacagaagcacggttattgaacacacccagaccattaaatgtagcctgaccaggaacggttagatggttagcgagaactaaagttccatcagatgcaaaacgagttgcatatgcaccaccgccagtacgaacatataagttctttcctgtatcagcatagatcaaaccaagctcattaccgccagcatcctggaagtataggtttcggttcgaatcgcctttaatagccatttgtgtaccaaaaatagtaccactaacaacagtctgcattcctatcgttaaaccggaacccgtcatagatacttgcccgttgccgtttaggtaaatctctgctgttcgcgcaccgcttgcgcctgtggttgtatttggggctgcaaatgcttgcaatgttagtgatccgttaccctgtgctgtctgatctgctaatacgttagccaattgagcaccagaaaccggatctgctgtagttgcggcacgagcagtgatagtcattacacgaagtgtgtttgatggataaccgaccgttgttgggttgttgtctggacgtacaaacaacacatagggatcgccatttgccgctcgtttcatcaggaggcgatacggaacagttaattgactatccggtcctgtaaggttcagagatccggtcatatcgtcgccagctttcttcacctgtgcatcgttcgttacgttgcctaatccgatttctgcctttgttggcttatcgttttcggtgtagattttaaagcctttatatgtgattgtgtttccagaagggagcaaaggcaagttcgcctgactccagatagtattaccgccaacggtagtacccgcttttaaatctgccattattagatcctcaaatgcttttatgatatttataaaaagaaaaagccccgaagggcttttaattagcgggatttaagttccctgacttcctcacggagttcttttaccgcgttaaccagcaaggcgataacagcagaagaagaaacagttaagatctcgttctgttcaccatcaacacctttcttaacggcttccggtaatacttcttgcagttgttgtgcgactaaaccagcctcacgggtagtttcttcacccccgatatgatttgctttgtcgtacaccataccatcaagcaaatcaactttatccaatgcattttcaatcttactgaaattgcttttcagtctttcatcagaacgaatatacacatcgctaaagctaccgttaccgttcattaccaactgaatgccggatgaagggttgcgttcaaaataaaccagatatgatgcactatcagagatttcaatacggtttccacgagaagcatcaccagcatggaacatatacatatcgcgagggtttgcaccactgcgaataaattcaacgcgtccgttgccgctaccgtttaatgttaaatttccattgtcaatataactactagattgactaatacgaccattaacggataacgtatgtcccattgtaacagcacccgtggtgttgctgtaataaatcggacgcaaattgttatatccaccataaacatcaccgctatttgtcagtaggaaatacgtgttgtttccgtcactacgaataaatgatccggtgttgccatatgcgatacgaaatccgtttgccgaggtggtaataatatcaccagatgatacaaattcacctgaattgtcaaaataccactgccgatctaccgaactcgtgcggtaatgaacggtaaatcggttagtgtttaccaacgtacccatagaccaagcaccaccagcttgtgtgtaatactgtttaacaataggccagtattcggaagttgctgttgtgttaatggtttggaaaattggagcttttgcggtgttttgtgaagcccatgaacctctcccttcggcagatgtatcaaaatacccgcctgtctggttgattgttcctgttacagtaccacctgtatttttcaagaataaagcatcaatccatcctgcaaacccgcttttgttgatatacacgttcccgtcattagccagaacaccaccgccgggtgttttaagtggttgagatatgtttgccagtgttagaacaccagtcatcgcatcaccggatttattgactgcccctacttccgccggagtcggaggaagcgaagtatcataaattcttctccatccattagcatcacccgcactataagaccatgcaccaggagaacccgtcgcagcacgaatccatgttgatgttatatcatagtaagtctgaaccagagaaacaccactattcagagtacggcgatatgtggcaacctgaccgtaatatgttgtgtttccatatggaccgtccgttacgttaccacctaccgacagaacatcgttcttttcagtaaccgcagcagccccgaaactgtttccagacataccgcgaggaatacccgtgatataacgttcatcatggttagcccagtttgacggagttactgtattcgcagtaaccgcgccactaactgccattgatgtagcattcgttaagccgaggttagaagtcccgattacacggaaagaaccttgctcaactgttacctgttgggtttgagaatccagagttaataatgtattctgtgttccgtctttgtatgcacggaagtatattttattaccgccgtctggacgtgcgttaacgttaaatgcaccaacaaactgacctgaaccgttgtgtacgttgatatccatgataccaatttccgaagaaggggttccggtaacgtcataacgacgaaatgttaagtttgcacccgcaccgcctgttcttgcaatttgtacgcgagtattagaaagaatatcatttgctgtcaacacctgccctacattcacgttctgactgaatgtagtattcttcgcaacagtaccgccgttgatcgtcgagagggcgtttatatcctccgctgttggacgatcgttttcggtgtatactctccaccctttatacgtcaatctgtcgccagagggcaacagagggaggtttgacgcactccagatacccgcaccacccagcgttgtgcctaatttcaaatcagccataaaaatttctcctgtaatgactgtatttatgaaaaaggggctttcgcccctttatctcacgattgacagtttaacatctttagcggatacagtgccgatgtttgtgttgcttggataacgatataaaccgaaatcaaacgtaacagcaccagcaggaataaccccttcgtttttgtagaatgaatatacgttcgggatcgtgccaacatcaagcatgttgatccctgtgatatacgtattattcgcgtcccagaactgcattacgatatatgcgcctttattgttggcgattgcgtttgcatcgcgtttcatttggcattgcatacggatcgtatcacccgcttttaatccataactgcttagtgatgctttcgttacctccgcttgccgtgtagcagtccattctttgaactggtactccgctgtgtttgtcgaagtatattcaaccggatcagaaacaatataatcaagttcagcaaagttatgcgaaatgattttcttatcacttgcaacaccagtaggcgaaacgggtagagaaagcaatttatcaatcgggttctcatttccgcttgcgtccacttcggaaagtgtctgcattcgaacaccgttcacaccaacagcagcaccattacggtttatttcttcgcgcggtactttcgtgatctgtacgttgcgacattgtgccagcccgactttaacggttgacggataatgatatacctgcgaacccatacgaacgtttactgcatcatttgggatagtgaaatatcctgatagagaatgccactgatcgggggcgagtccagttgttctaagaatagatgaacttgtccattgtccaatactgttttcagtccacatatacagatgcacttcaccgccagcatcgcgaagttcttgtgagcaatacagttccccagtaaacttgaagatgtctccctggtaaacatcgctaccgataccccacaacccgtaaagatgaaagccgtacagatccccgctgttctggtatgtctggacatcatcaaccattctttctggaatacccgttaccccgatatcactgaattcatcaaaaacaacttcaacaaaactcgttgtgttatctttcaagctaccagcaccaccgacaaagttttccatgcaaatctttttcatcgtagatgaatagatagctgaataggatgaacggtgagaataattggttgtggtgatcgggatattaaagaaccgagtttcaggccacgcaacagaacctattttcctcattgttgctaaaaagttgtcatcacttttgatagcatcgaaagtataaaaacacacaattctgttcgctggaagtgaattcaggtagtctttaatcgcattcccgttcgtagcaggatcaccatacatatcgaatgccttgtaatccaataatgctaaagttgttccatcaatgacagccaggttaattccgcgagcaacttgtgttcgtctgtttataatatcagccccgttaatagatacctcaaccgagttgaccgcagaatcgttattcgttccacggacaacaaggcgatatttcacggcgtttgcttctgaaaacacattcgccgtgaaactatcagggccgaataacgccataaattcgttattcgccatttaaattattcctcccacacaaattcacaagtcttagttgttggatttgcgaagatttttacgtttccgattttgatgtaatcacgaacaaccagagtatctacagttgaacccgcaaccgcaaccgccccaatttctgccggagttggtttacgacctgcatgatagatcaggtttccgttgatcatcgctttgttgtaatcggtgatattgatattgaattcagtcaataccttatcgtcaatgccagttaagcgcatcttctggacgttaccagagaaatcacccgcctgaacatgtgccgtaccgctcacactggtaaagcgtccacccgtgccgtttacgctaactgacagcgcaccagtcatagtatcacccgctgtattgacataggtactgtcaagatgctgggtaaagtttctggtgtttattacggttgcagtagtcacgccgttatcattactgattgttacaccgttccaaccgttagttgcagcggttcgtaattgtaccgtaggacttgcatcacttgcaatagtcacatcacctgttgcgttcgtattagccagtgctttaccattcaggcgcagagtagtaccggagtacgccattgtaccgttagatacatcaccaacagtcagaacgtcggtcgtgtcggttgtgccagttgccaagcgatacgtagttccctgaacagtttcatgccatgtagtatccgtcacaccaccacggaaagtacgaagcaagtttttagttccagcggttgctgtactcaaaacagtattagcataaaccgtgtttgctttcgcagactggttaatgttattgttcgtggttacggtgttgttaacagttaccgcagcgttagccgtcagagtcccgttagtggttacgttaccaacgaagttgcttgtaccgttgaacgtgttgttgcccgttacggtttgatctgcatcacgacgcatccagcttgcagctaccacaccacccagtttcaggctattctgtgctgttgcgttcaacggtaagaagttttgcagagcaaagttcagaccgcgaggcgatacagcgtagaaatcttccagataactatctacaggctgagtagaaccaaccacattatcaccgatgaaagtgtttgctttggtagtgataaacaccgcaccacgtcgagttgttgttgcaccccacgccggatcagtaccgttcaaaaactgcatggtagccggagtaattgccaggttagtagcagtacccgcacccgcttccgcgttagtcgcacaacgaataataccttcggcggtatccgtcgctttcttcgcttgcagttttttaggcgtaatgaacacggtatccagaagacctgcatcagtttcgccctgagtcgcaacgcgtaaagtaccacgctgtgtttcagtcgcagacgcaatccccaggttaaccgttgtccagatagtgccggactgagttaaaccatcagcagttgcaaccgcaacatgactcgtaacgtcgaagaactctttcagcttaaccggaacaactgccttattcgttaccgtacctgctgaaacttccgcagtggtagcgagggcaataataccatcaagcgattcagtagccttgcgatcgttcagtttcttaggcgttacagcacggagatcatcagttcccgtgtttgtttctgtctgggttgcgatctcaatcaatccgatacgcgattcagtagacgttttacgatgcagcatttcaggagttactacgatcggcattgaagcagatccagcagcagcaccagttaccacttcgttttcagtcgccagaacaaccagaccttttgacttttcggtcgccgtcttctcgttcaatgatttcggggtgacaaggtcaacaccgttattgaagttgtagacgttcgtaccagcatccccacgtaaagccccctccgctgtcgtagcgcccgttgtaacgagttttccgatacctgctaaggtttcggtcgcgcggcgtgtgtcgagctttttaggcgtgattgcggtagtgtcatcagtaccagcgtttgtttctgcctgagttgcgatttccagcaccccacgacgatcttctgttgctgatcgttcgttcagctttttaggcgtcacgatcacgtcatcgaggaaggttgctgtcgtgttctggttaacttccgcagttgttgccaggcgagcgataccacgacgcgtttcagtagcggttttattcgccagtgtacgcggggttactgccagttcatcagacggcgtatcttcatggttcttgtttacttctgcctgtgtagccagcgcaatcacacccagacgagaacggtttgttggatcgacacgttcaatgatcgggcgatactgtgcaactacccattctttcgttgctttcagatatgacagttccatatatggaagatagtcagtatcggcgttgaaagtcagagagtcaacactgaaccagtcatcaggcggataatccttacgctgtgggaactgcatcatgtttttgttggtgcggatcttttcaccggaaccatctttaactttgatcgtacagttctgcgttttccccatcatgtacatactgatatacacgcgatcaccttcggcaacatcttgcggaagagtcagcgttacgttacgtacaactggaggactgccagcaacaggagtgatgaacacgtaatcgttcggcaacatgttcaggtcatcactgatacgacgcagacgaacgcgctgatcaccgtcataaacaacccaacggttattagcctgatcgaacatgaagataccataaccggaacgctgtgaagtcacagaggttacgttattgataccgtcatagctgatcgtgtgtccgctaccaggataaacttgcagagtcgcaacgttcaccgaagcaaggcgatccagatcgtaagttgtgattgagtcaccatcgtttgcgtagcgaggcaactgcaacgtaattttacccgttccactgttacggaatgttaccatacccgcttgcatttggaaagcggttaaaccagtcgcattaacaaactgcgaatcacggttatcacgcatttcagcaacacgccataagttgccgttaaaaataaacgcaacggtcatatatgggtgagtcagtcgataagagcttgactgaatatcacgtaaacggatctgacgagtgtttgaacgcactaacaggttgttgatccctgcaagaccgccaccatctttaatagtgataatatcaccctcaacaggggcatctggcagaatataggtcaattcagagaaacgaccgtcagccattaagtacgtaccggattcaacagggagaccgtcattgctcgttacgttgttatatacccattttggatcgttacgggttgagatccattttgtttcatcgaaagcacccgctggtgatggaatatctgcgcgagcgtaccaaatacgacgcgcgtacatgatagccataaacgcagcataaccacgggtagaatcgtattgttggatcgtgttaaattcgttaaaaaagtcaacgttcacgccgtcgctcaacacagagcgtgatgctttaccaacgttgataactttttcgccagcagcatcaaggccacttgtggcgcggaatgatttagctaccattatcgttttcctttatcttattcaatactgatatttataaacaaaaaaggcgaccatcaagtcgcctttttctcacggtaattgttcagccaatctttaacaatcgcgtgatgaagaggattcgcataatctaatttgtttcttttcttgtatggcgtaaaagcgtttttctctttgtccgtcatttggaaaagggtttgaaatgatttgcgttgccttttcgtttgaactgcttctgtggtttcgataatggcatcgggaaaatatttttccttcatgtatttcgctaaccgcatatcaggcacaaataaattaatctttcttttgctgttgttgtgtcggatatcagaacgagcgcataactgaaaggctggttcgtaatatttactgacaacataagcatcaactaattcttcctcttcaagcccagaggacaccgcaaccgctcgcaacatttgacgaagccagggtaacgggttgtaactgaataatgccaccacgttagtataacttgaatagaagttcaatccgtgcgagttatacgggatttcctgcccctcgctaaacttcgatctgtatgtgttggtgcaatagatgaactgttcgccccctaaaagcgcctccacgcgttttttaatctgggtgtatattgtcgtcccagattgagagagatcgcccgtataacgcgaataatccccctctgcgagcacatgtattttaatgcgcttcgtgtttttatattgcttaaagtcaaccagcgtttgaagcggtgaatctttgaactcaacatcatgaaacgtttgcaggatcttccctgtaattgtgtctttgatgttggatgaagcaatggttacatttttgaacttccactggcttacgtcatgatcctctacgaagtaacagacatatcccgaatcgctacattgcatcttcaccggaatagcccctaacagagcacggtaaagcgggaacatcttcattgcgatatcatcacgtttacgaagaccatcataggctaatcgtgtaaccagttctcgtttttcttcgtcaagttttaaatcaacgatatcatcggcattgcaactaaacggcaagcaaatctcgcgtatgtgcttgatattgctattaaatcgcagactttcgaacgcaaccaaatcaggaacttcgtcaatatacagggaaaaatccttatacaaatcaaagtcatcaatgtttttcagtgctgcatgagtgatgaaaatcacatcgtaatcattgactacttcacgcagcgcatcgttattggttcttttggttcggtgatccgtgtccacaatcaccgcccgttttccttttacctggttgatgtaatagtcataagactgttttgataacatcatggaaatcgaagcgatgattgctttttcgcccgtttgattgatatggttcagaatcgcctttgttttaccgcttgacggaacacattcaatcgtattaaagatcatttattcttagcgtatttcttctggtatttcttgattgcttcgtcggtgatctgtttaggcatttgacgtgctttcttcggtttcagtggttcgacaccgaagatttcaacgccgtaatgtttcagcatcattgcaacgatttcctgacgaatgaagttgcggctaaccttttcgggaaattgatctttaatctgcttatgaagacgatcttcgagcgcgtccaggtgagtaggagtgatgatcgcggtgttatcgcgttcaacgaatttctccatgtattccattgtttcagcatgaacagcatttgcagcagggagtaaaatttcacggctcatttaatcaccaataagttgtttcaattgcagataaccgccgataagtttgttatcgacaaaaatacgcgggtattgaaacgctaaactgcgttgccttacccgttttgctaactcttcgatacgtgggcgatcgtattcaaagcccagatcgtttttcgcttctttcagaacgggataaaatgtatattctatccctttttctgtcaacagcttttgtgcttgtatacacccgtaacagttatgaagactttcggggattccgtatatttcgactttcattcttcttcccgtatggtttgagatcctgcaaaatacgctttttctctttgcctaacagtttttcgatattttcaacagcggttaattgagtgtgcagatcgaacaggtttgcaatctggtcttcctgcattttcagttcagattccatgttgatttgatagatgctaccaccactgaaaacatgttgcaaggcgaaacgaagcattgcatcagatttacgtactggcatcggtgcgatgctcaacgtttccaggttagccccaaatgatggatcgatgcggagatcacgcaaaggattttcctgtacagggcgatacgtgaatttagggatatccatcaggcacagatccgaaccagtgacaccagcggaaacctcttccggcgttgcgatacgcataccattttcagtctcgaccccgttaccgagattaacctcttcaggttcttctggggtgaattcaccctcttccggcgttacttccttgaaccatttccatagtgatgcagggagttcatattcgtaaccaccgtccatgataaacgcgcggtcttcgaactcaccgatcgaggtgcgatcaatcgtcacgtaacctttttcacgaatgatgtttgcgatacctgttttccaggttttctctgcaaagatttcaggggatacggttaaaccgtaagtttttccagcgaataattccatgattacctcaaataaaaaggggatgccgtaagcacccccgaattatattacttatttgccagcagtgcaagttttgcggcggcttcgcgaactgcgcgagctttctgcgctacaacttcgatcgctttctggtgttctgccagtgcgtcttctactgcctgtgcagcagcgatgaccagttgatcgtgttgctgtttggaaatatcaaccgcctgaactgctggagtgtttgccggattaccagtacccagttcacggaagaatttacgctcacggtgcatcacaaacgggaggctacgatcttgcgtgattgtcgcgtcaccgtcgccgtcaacattcgaaaacaccagaacaccgttgttgtttttgatgtgttgcacaatgcgtttgttcgcggtgtgagagcgcaggaaacctggttcatctaccagaacatacggacggtcggcaacaaaacaaccaggcatcgcttctacgagcgctggctgtggtgcagcaggtttagcaacagacggttcggttactgccggagcgaggttaacaccaccatccagttcagaatccagatccggtttcgctggtgcaggtgcaacagacggtttgcctactggttttggctttttagcgcgttttggcgctggggctttagccggagcaacttctgtgaagtatttcgcttcccatgcacgaagggtgttcatagcgacacctgctggagcattgaaggtgtagcgatcaccgttacggcttgcgatgtttacaacaccgttcagtaattggtggatctgttttgattgaacacggttcgcaatgtttttgccgttgtcagtgaaaccttcgacatcaaccagcttgtaatctttaccagtttcgaagcgggtttctttggttctcaccgtccacggatgtgaaccgcttcctttggtgatgtttttcagcgggatcgaccacttccagcaatagtcacgggcttctttacgggttttgaaattcagaatcatgatattatctctcatagagggcttgcaatttagtaacaaattcatctttgctacgggctttgattacaacttgcagacgagatttggcttctgctttagcagcgcctaaactccaaccatacacatcaaccagttcacagatttctttgatgattgcgtttttcattttctcgtcctcaagtttgtttcgatgtggatatcttaacagaaccaccaaccaggtcaagcgatatttttaatttcgatggaattctttttgaactcaatcattcgctgattatccgaaccgcgaaacggtttcttagtcggttgatccttttcgtaccgtccatcaatcagaacatcaatgaatggtaacagcttagaacgttctgtatcgctctgtaaggcttcgagggtgtatcccgtccaaacccacacgtctttatcaggaaacgtcgcacggacgcgctcaagcagttttaagagcgttggatgattggtgcggtaaaacggatcgccgcctgtaagcgtcaacccgtccacatggggatttgaaaggagtttaatcaactcgttttcagtctcttcggtgtatggtgtaccgttgcggggattccatgttgatttgttgtagcaaccttcgcatttatgattgcatccagtcacaaacaacactacacggattcctttaccgttaaccacatccatgttatagatgcggtcaaagttcatcagcctttcgcctctgggaacaaacgggctttgatcgcttcgtcgataatttgcgggaattcattattcacgcgcttaacgatttcctgacgaaccgttacttcgaggtttttggttacacgagccataaacgcttcttcgtccgctttgaggtttttggttgcatcgttgattgcttccagcttgattgaatccagcaggtcggcgcactgttttttaacgtttgtcgtgatcagttctttgatctggcggataccgcctgaattgatatcgaaaacattgctgtatgcgtaacgtttctgaatgtaatcagcaaactctttatgcacaatcttttcgatttcgtgattggctggcatcatcaaattgacgtgcttgatcaccatgttttcgatttcttcggttacgcgcttaccgataacgctgtcaacaacgttcttgatgacagcggcttgcagatccattcgcgcttgtgttccttctgggaacaggttgttcagcgcctgtgtgtctaatttcagttgaatcattttatagtgcctttcttctcaaggatcagttctttgatccgttccacgattacggcgtattcccagttggctaacttctgggtatcacaccactgttgaaaatccttcattgcttttacgtgaccttctttccagtaagtcaccgcgatttcgttacaaagattttcagtagcagtatttttgattttcatgatttagcccctatagtttgttgtctacaggggcatattataacatcattcgtcttccgtcaactcttttttgaatccgacataataagcatcagatccattccatgttgaggcgttaacgctacccaacagaacacgacaaggcatattgttatgcgcagactctacaacctgggagactgaatccagcggattgctaccagacacccagcggagcagatgacgatcatcaccgttaatcggatcaacgaattcaaatctgataccgttttcaatcagttcgtgcagcagaaagttaatcgctttgcactgcgctttgttaatcagcataaatcacctaccagatctttatcaattttggtgtatgtgagcgccggatcatacttctccagcacgttctttttgcacgaatggatgaacttttccatcgcacgggctttcatcaatactttgaaatcttcaccaaagcattgtttgattgtgggaattgcacgagccgctttgtcacaatcaatgatcagcttgtattcgccttgcgtcgtgacaaccaccattgagatcagaacacaaccatcaaatcctttttcattgattttgtgaaagttcagcttatccgtagtgcttgccaggttcgcataacgatccccgcgaatgttaccaggagaactataccgcgaaacgttgattgacggaatacgaatatcttcaacgatatcacacgacgcaacagcttcaacgaaatcaagaattctggtcgctttgatgacgtgcgccttaaacgaaccgacttctaactcatattcatctttccagcctgaatagtagtcaaccgcagggctaatcgctttcatgagcgcttcgggaatgtcaatgtgccataactgttctgcgtactgtttgcgccagtctggatacgttttacgtgctggtttaaatgcactgttgccgtcttcgaacatcatttctttcctctctttttcgtaaatgtcatatacacttcttcgttcgtaagcgtctttaaggttgctgtttactatactatcatgcgtcagttcttcgcaatactttttatcccattcagaacacgcatgatcaaccatttcctgaaaaactcgctgtggaacattcccatctacgagaattctcaataagcgatcagtatcatcattcggtaaagtatgaaagtttttaggaagtttaacatagaagtttctcgcacgagaaatcaaccattcttcaccgcgatcacgttcaatagtgtaatcgtacatagcaaaaaaggggctttcgccccttcctcttatttcgcgttcagggagtcgatgtaagcgctaacgtcagcggaggttacggaagcggcatttttgccacccagcaacacatcaatcttcgtcacgatggtatcgacgcttacggaggtgtggcctacagcggcgatcacgtcttccggtacagtcagacccagactttcggtttgcttgttcagttcgatgatctccaggttgattttgacatcagccagtttgcgatccagttcgacgacagagagatcaatctctttgttcatcccttccagttcttcgatcttcgtctgtaagccctgccagatgttacggtgttgcagcgccagcacgtaatgactgttggacacttcctgccccgccgccagcagttttttgatctccgactctttgccagtgtgaaggtctttgtgttctttgactttctttttcaacttcacgatttcctgaacagcagaaacgcgagtatgttgcagacggtcgatctctttgatcaggatacgtgcagcactgcgccaggcttcttctggggaagtgttttgttcaattgcagtttcaactttaccagtcacgaatgctacgattttcttgaacataattttaccttatttgatttcaaattgatttgcttcgatgtagaaaatactaatcgatttgattcggcaagtcaacacctacatagaaccaatttacatttttctgtgatttgcatcgagcaacgattgttccttgcgacaaccccagtgtttccgcagcttctttgacggaaccatacacaacaccatcaccagaaaccatacggcgattcgatgcaggtttgccgaacataggatttttctctcctgtatgttttcctttatgagcaatggatagtttttgtttggtttcttccgaccgaaccttccctgtatgacgcaatcgacgttgatttttctcttcttctgtttcattagcataatgtgctttgacagaagatgatatttgctgtttcaattcaggacgagatttatacagttctgtaaaatgagcagacatcttttctttatgttcgggtgtactaacagcaatctttgatgcttcactcagtttccgttgatgttcttcactacggacatgatttttcaatgcacgggagatccgatcgcgatgtaatggagtgatttctcttccttttagcgcattactgtttttgcgtcgatgttcttcgctttgttcgtaggccgttccgcctttaccaccgggtttgatgttgtatgtgtgaggaagcgaaatatactcgtctgttacgagttcagcttcttttagatacatttcctcttccgtatcaaaaacatacaatatttcctttacgaaagattcaatgccatagaaatcaatagcatgtttgatgttctttccagaacccatgtatcgatcatcgagattatcagttttatgagcgccgatatattcacgcccattgatagtgttggttattttgtagattgtgtaaaacatattagcgccctcaatttttctttatttattgaaggcgctaatactaggtgttcttagttatgtttcacacggtgaatgatttcgttttgtttacctttgttcatcggacgttcagcagcgcccagatatccgcaagtacgacgagttacattcattttagccggatcgtgattaccgcagtgcttacagtggaaaccttcttctgtaggcgtgaactcgtcatcagagccacatacaaagcacttatcgaccggaaggttagttccgaagtaatccagtttatccatcgcataatcccagactttttccagggcttgcaggttgtttttcatatcagggaattcaacgtaactgatatgaccagcagtagcgatgtaatgataatcggcttcatagtcgattttctcgaacggtgttaccttgcgatcaacgtccaggtggaaactgtttgtgtaccagcctttatccgtgatccccttgacgcttccaaacttctcaaagtccagcttacagaagcgatggcaaagcgattccgctggggttgaatacagactgaatccaaaccctgttttcttcttccatgcttcggttgcagcgcggagatattcaatgatcaatctgcctaatttctgggagccgatgcgatcaaatggatgcagaccggagccaaacatcaacagcgtttcatgcagcccgatataacccagactgatagagctacgcccatttttgaacagttccagaatttcatcatccggtttcagtcggacaccaaaagcaccttctgtgtataggatcggcgcaacactggctttaacaccgcgtaggctttcgatacgagtcatcagggcttcaaaacacagttccagacgttcatcaaggatgcgccagaatgcgtcgtgtgcgtcttcttcttcctgcgcttccgcttcaatggcgatgcgtgggaggttgattgtcaccacacccaggttattacgtccatcaagaatttcattaccgttatcatcatgccacacgctaaggaaactgcgacaacccataggagatacaggaacgctagaaccagtaataacacggttgttagctgaactaatgatatctgggtacatgcgtttagaagcacattccagggcaagttgtttgatgtcatagttttgatcctctggatcaaggttgattcctttttccatgaacataaccagtttagggaataccggagtgataccctctttacccagtccacgaatacgatttttcagaattgctttctgaatcatgcgctcataatcgctcgtaccagtaccgaaagtgatggtaacaaacggggtttgtccgttggcagtatgcagggtgtttacttcatactcataggactggaacgcatcatacacatctttttcagtcttttcaatcgcatacacataatcattatagtgttcgataccgtaatgttcagcatcgcgcagatgtttgaagaatgtcatttctacgtatggagccagcactttatcaacgttcgcaaaggttgtcccgccgtactggtgagaggcaatctgtgcggtgatctgcgccatgagagcggtagcaacaccgatcgatttaggcggttcaatgtccgcgttacccatcttgaaaccgttctcaagcatacctttcaggtcaaccagacagcagttagtgtaaggggtgaacgggctatagtccagatcgtgataatggatgtcgccggagtcatgcgcttctacgatatgtttcggaaggatatgattacgggcgaaatgcttcgctacaatacccgccagcaaatcacgctgtgtcgggaatacccgtgcgtctttgtttgcgttctcgttggtgatctctttgttggacagattcaccatgccggagatatctttgaacagcttacttttctgttcacgggcaatatcgcgatcgtggcgatattcgatgtatgcacgggcgaccgctgggttcgttttcatcagggattcttcaacgagttcctggatacgggcgatcttcattgaactaaaatcacggatctgattgtactgaaccagcatgattgcggcatcagcatccgtcatagtcccgccagctttatacacagcattgcgaattttttcttgatcgaaatcgacggttttgccgtcgcgtttttctacaagcattatatttctccaaactcaccaaagagttcttgagatttgcgaattcttgcgttgatagcatcatccaaatcgtcatactctccgatataaattgattttccattgaactttattttcgcaacccatttgttgtatgtgttgcaccaatgtacgcctttatgtccagatttattatttctctgaacctttttcttcatgatgttttgttgttgtgtaatcttttgtaggttcgaaagcccatcaccacgttcaactccgtgaacatgatcaataacataaggtttttctggtagtgtaccatgaatcgcataccatataacgcggtgtcggaagaatttcttccctttgaacccaataacagtatacccgtttttatcaacaacaccagcagattgacctatacaaatttttcggtttgttggcttaatccacgtaacaacaccgctaaaaatgtctacacttacacacttgagaagttcatcaagttccgtatatttttcattcatttcgttgccttcattaattgctttctatatttcgcggttaaggctttgcgttcgtctttgtcggcgtactcgaagcccatagaaaccatttcggcaatcatatcaggtttggtaagtcttgaaaaccattttaccttatctggtatgaatttgtcatgaatacggttttcggaatagtcttgtttcagatatgcaagcaagttctctaaccactggatgtaatcgacatcacgggacacaagaccggatctgttgaatttgtgcttcacaataccttctgtaccgttacacaggttacacaggaggccgcgcacacgtccggcgttttcgccgtctaaagcatggtcatggtcaaggtgatgtttctcgatctctccctcaagaggacgtttacatatagcacaatgcccaccttgtttttcaaagagggcttgcttgatagttgggtagtcttttttggtaattcgtttcgtcagcataataacaccattcagtaaggtgtcattatttattacagggtgcggacgtactcacgaagttggtcgaatccgcctacgtgtttcccgtcatggaaaatctgaggcatggtcatccggcgcgtaccaaccagagattcgagttcatcaatcaccgcttcgttcagtacaggtttaccgtcttccacggaatcagcaacagacacgaactcatacggatgttttttcgcgtccagcaagcgctttgagttcaggcaaggggcgcagttatacacagaagggatatagccataaattttaaacatgttaacctacattaaatcgttcagtgttaaagggaatgtatttacgtcgcgtttctggtagttgcacacgtagacttcttgcgttttgttttgctcgtaagagtcggtatgctggcctaacagatactttttatccagattatgaacgcggtatttctgcatccattcaatcaggatatcattttgttttccggcatggtgagtcacgttggacaaaccaaaccaaataccccgttcatgcagggagtcaaggaaagcatataactcgcgttcgtgatctgcgttccagaatttgttatacaccgcatcagtgatcagatacggaggatcgcaataaacaaaatcgttatcgttgatttcaatatcagagtatgaaccagaacgaaattcaattcctgtcacattctttttgaaatgttcgaaacgtttttctgtcataaagttgagggttcgttttcctacagcagcgttaaaatcgcctttgtcgtttgtccggttaacgttgctgaatgaatgcaggatcaggacatagagccataaaggatctttattctggttgtattcatcacggaatttcagatactcttctttcttgtctttccccagccccttcgatgcaatcaattctctcaccggagacaggtcaggaagcgttttaagacgttcatacatatcaatcagcgtcttatcgtaatcgttgcttagaactggtttagggacgtttaacgacacactaaggccaccacaaaaacaatcaatgaaacgcatgtatgaacttctttcggggaacagcttgaatagttcaggtaatagcgattgcttgttacctgtatacggaataacacccaaataactcatagttcactcagtcctttctcaaataaggcgatcgtttcgtacttatacccacgattcaccacgaagcaataattttcgcctaatttctcaagcattgcaatagcacggtgttcatcttttttatctttcaacagataagcaatccgaacaacctcttttagtgtcgcgttgtccacctgttccaacttgaacccgtagcccaccaacttacaaaaaagccccttgcgagcgacaaggggctgattgttgtagaagactactgatccgttatcgttggcgcggatattaaatccttgctcgctcacggataacccctactgtatcggaggtgtttaatacaccgttctcgtaatacgtaatcatcgcatcacgccacccgtcaggaatctcagtttccagagtgtcgattgttttgaattccacaccgttagtgatggtcatcagcaaacctttcttactctgtttccattcggaacctttcgggcatttgtaaacgcctttccacacaccattcacgcggatagcgcacagtttttcagcatacttttgagtgtcgcgggtaacttcttgcagcaaaccgccgcccataccgaacgcgatgttctcactcgcccacttgttcgcttccatccaacttaacacacggttgattgtttcaggcccgtggatctcgtcgccctggatgattcgaactgaattatgcagaactttgtaacctttgctgtttacggtgtatccgaagatttcgcccagtttacgcagggtgtacatgatgttatcaatcatatcaccggaatcaggacgaacaaccagagtaccacccgcagcaatgatttgctctttatattcagcaatgcgatctacagcgcctttgtagtcccaggaatcgtacacacaagcgtagaaactatccccgaacatttcgatgctgtttttatatgcttcgtcttcgttctctttaccgtaggaaatcgtagtcgaatgttcgcgagccggaattgaaacaccgattgcttcgacgttttcaacttcatcaaacagagtttgatagtccgcaaacagactgattgccataatcataccttcaacggtatcagtcccgatgaagttatagaggtgtgccagcccaccaatacccgcagattcagcagaggtcgcgccacgcgccccgaaatcatgcagacgtgtacccagtgtgatgttatatgcttcgccagtcaggtcagaagtcatatcaaggtaatgagccagaacctttttacactcacgcgatagcgttgctacagatgacggataccagataccgcgaatcgtcattgtctccagccacccagccaaccatgagaattcacgttcggcgtacacagtcgcaacggcatttttaaccggaacaaccgtaccttctgggatcgcacggaaagtaacagggacataacccagttctgcgatcttcttccacccttcgtagttgaaaatctctttcccaaagtgcttacggtaaagtacccgtgccaactcaacttgtttcatggtaattggttcagcaagaacccgcgcaacgaagttaacgccagcggttactacttcatcaaacttaccaccgcgagattcaatatagaacatcgctgcatcagtgccttgtggatactgcaaccagtgggacactttgtaggaatcagttgaggtgatcaggctattcagttcattaaaagttttcatttaaacgtactccacgttttgatttaaaagatacgatccaaacgttctggatggatcgtgttccagtatttactcttacagtctttcctggattttttaccattagagcagaacaccttatgatatgtcgtcttcttgtgcaactgtttgcacgtaggacaagtgatcatggttcctactttagcggcttttgcaacatcgtacaattgtttgatgtccttctgccgctcggacgtaatgacacgcccgtttacttctttgacaaccgtttcagttcgaatagaaccatcggaatatttaacttgctgtttctttccagatccaacagtaagccccattgctaaacggcttcgaagttcacgcttcgttctttcaaccccgcgcccaacacagaagaattctccatcttcatcatcgagatcaaggtcatcaaagtcagcccagtcttctagcgcgtccgcttctgaacactcattcattccaaacatagtcgatccttagttgctggtcagtaagaagacccggttgtcgctatagtcgatgtagcaatcccaccaacccgcacagttaacaccatctttttcaaggcttatgattttaacgctggttgcaacgtcatcatattcataaaccgcacccagttcgttcagcattgcttcaacgttagcccgtaagcctttaccgttgtgtgctacaccattcagtgccaagcagtagccagcgcaagtaggtactaatttgatttccatgatgttttccttttaggttagtgtcttgtctacgggagctatattaccacactcataactcccgtcaacaagtttttcgaattattttcaccaggtgatgtaataagtcagatcgctatatccgtcacgcttaggatcgctaaagttggtaatacgacgcgaacccgcgaaggtattgagtaacgcagcttgtcggttgcgctgtgtatcgaaagtaaacccttcttccgccagccattcacccagatccgcatatgctttttcggtacattcctgatccataaccttaccgataaaacgtttcatatcaaaggtatatgattgtttagtcggatatttcaggacatactcggaaatgtctttgcgggatgcttcgaccattttcgcgttgatttcgtcaacaagtttacgcgcacgttccgccagtgtcgggctacgtccacagcggggatcatcttgcgtttcgcgtttgacccactgtgtcccgcttcccgcctgtgcgttcacaccgattccattgatttctaccattatgtttcgccttttttaatgcctcttcaactgagaggcgttcgtaattacgtgattgttcgggagttatcaccagagaaaatccagagtaggaggtttagtgttaatccctaaagtatcgcagacttcatccagaacgttttgattccaaagattgaacgttggaaccttatacaatctggcaagccttgcagcgatcgcagtaccacctttaacacaaaaatctttctctaccgcccagaatagaacaaaatctgtaggtttgtccaggttttcggttaatacctgcattgaattgcgagcatatcggcgctgtacccattcgttttggttgtcgaagtgtccagctacctttctcgcttcgtcagcggctttgtacgtgtcgtattctgtatagtcgatgatatccttgccattcgaatacaacccgttaaaaccgttctcagggaggattatacgccgtctttctggtgagtagtcaaacatgaaatggctatccattccaggagcaccaccagagtaagcgaagatcccccgatcacttaaagcacgtccaatctttatggctatactcgcgatacgttcagggggttcacggctaccgatcagtgtagccgtttttgcgttttcgagaacagttttaaaattcattgttcaggattgcgccccagttctcacgaaccagatttgacgcttcgttagtgaaggttttcttcgccagcgttgggttttcgaactgttccaggaaaggcccgtagttacgttcgatttcttccagcgcatcctgtacagtcagccccatcacgcgaccgaaatctttcgcggtgagattcgcgctgtcaattttggacaggacgtttttcacgcggttttcagtcaggaagcaagtgaattcgttcagcttcgctttgtctgtttctgacagttcagaaggagcattgaagcggttcgcttgcttgttcttcttctctgtgaacttcgtcgttttgcatttgattgcaacgcgttcaccgttcggcatgaaagcaggttgaacaggcttcatcacgaaaccttctgcgatgttctcaccttcaccatctttcagcgtcatgaagtttttgaactcaggttcaacgccgttctttgcagggatcgcaccggagttcgccaggttaaccaccgaatcaaaggtgataggaagtgcgcggatctcgtcaaaagaaccgtatgccagcagtggagccattttcagacctacagcaacggaatacgtggctacaacgttatcagggaggaattcaccattaacgcggatatcgaatacgtagaaatctttttcgccgtagtcaacatctttctggacaccacgccccgcaaattcgccgtatacctgaacaaccaaagaaccagtatcagcatattccttatattcacaggcatttgctaaaatttcccacagcttacgaacaggttcggagtattttgcaactactggttcacaaccgtagaactgttcagcagggagaatttcaccgctacgttttgccggaatgactttgataccgtccgaagtgatcaggctaaaattagccccgtggatcttttcacgcgcaacccacacacaaccagtaaaaccattcatgatcacaccattgatgaatttaccttcataatggttagtcagagaagaatatttcacaaacataatttaacctttgattttcagttgtttttcaatttgatacgcagctttgcgtaacagtttcagttttacttctggaaggatcacagaacccttcataaacgcatcgagatttgatttctcgctattcgcggcgctggttactgcgatcgtgttttcaaccgtgtatcccagagaagcgttgattcgttccattgttcgggagtcagagcaaccgcctttgttgctaaatggtctgccggagtaagaacatactggttcactcattagcttcgcccagtcgcttaacgtcagagcaaattgaaggttgcggttacgcgcatcatcgtttttactgttgtatgaacgagcgacacgcagatcgaattcaatctggtttgcacggcggcggtgttctaactcagcaggatcgagtgataccaaagtttgaactttttccggttctactggctttggttttgcttcaaccttcaccaaatcctttttgatagtcgaagttatcacgcccgaccagcgattcatcattgaagacatataaaccccttacaccaaacccgcttcctggaacgccagcgccatagcgccgttgattgctttacgtttgttatctggacgcggatcgcgtttagctttgagtttaggcttgcgctgttcttcacgatgtttattgatgtacacacgacgcagaacatgtttcacttttggattttctgcgcggaaagcacgaattcgctcaatttcctgaacaatcacgtaaatgtcgccgttatcgagcatgtgctcacgggcgatctgtgcatagcccagtttcagatcattgaatttgaaatgaatctgtactttttcctgctggctaacttcgctgatattacgctgaacgattttcatagttactttcctttagtagaatcaattttacgaataaactctaacacttcggcatttctgctgtcaacatttttaagaacaaaagttacaactacatgaacaccggatgcttcgttccaaccatcagcacacgggatcatcagatcatccagagtgttgacaaggttttccatatccgcagggtgatcgacaaacaaagtttgcgtttcggtgatactggctttgaatcgtttcccgatctgtgcttcgagttcgtccagcatcccagcagataacgcggcgatgtcgatgtttttcattccaccatatacaacatgaaatagtttcatatacaactaacctcattttcgtatttttcgcgttcgaaacagtcgggttcgttccagatctggtcaaactcacgtttcgtcatgatatagccacgggcgattttgcgagttagatctgaaccgatcggagcataccacaaaatcaatttacacaccattccctgaaccagacaatcatacagccctttttccagggtgcgtacatctgttacgctatcgactaaatcgggggcacttcgttcaggatggtctttccactgactttcgatgatgtcgtttagttccctgtgaaaataaatccacgattggaacgatgcatcaggcggatttgacttgcaaccagcaggataaaattcaagcattttgatcagcctcattcgcaatacagatcgccataaaggtaaacataacccccaacgcaaccatccagatcgcggttaaatccccatacaaagaagaataaccacccatcacttcaacgcgatatcccagcaagaaaacgagatacgctaacaccttatctttcataattcctcacagaaagcccatgcagcatgataaacgcttgcgcctttgtcatcgttcatgcataccacatctaccggacacacaacccgataaagtaccggatcaccacctattgaacgtgcagcccttccagcatagatacgagccagcccgatatcagcagtgaagaaaacacgatccagatttttctttctgcctttttcagacagaatatcagaatcacaaggaggcaacaacatgctttcgattccggcagcagtacatgatccgtgatagaactcaacgaactctttgcggcagtgaatggtattcatggttatctccttgttttcagagattacagcttatcgctattcgcccgacaagtcaacaaattctttttcaacgtcttcttttgttctgaacaggtaatcagtaaggctacctgtcatcaattcgcgagttttagcaactgaacgaacacggcgttcacgttggctttcggcatcaccaattccgtgacctggttcccacccttccatatccaacataatgcgcgggtgcctcatcacacgaatatcgtttccatatgaatagctgttatattgcccgaatacaaatcttttgaatttttcgtggtgaacatcatcaacttcgacctgttctccgtagtaaacaatttcatcacagaacgcagcaagaacaagcccaccagagttttgaattttcaggattgcatggatcatgcggtgacgtgcttctgcaattatatcatgagagccaaatccaatctcttttgtcccgaagcgacagaaaatagaataggtgatgttcagcaggtatttcgcgacgatttgccattcattatagataggattgggattgacacggtatgctgatttatattcgcgacgcagttgaagaagtgtttctatgactttagcaacactccacccgttcggataagtcgaatcgttgcgtttagcaacagcaattgttgaatttgcgtataagtggttgaaagacattacgcggacgttatcgacgtaaccacgatcgcgatcactccatttgaagtaatcccattttggatcacaatctggacgcatagacggggtatgccagcgcttgaaccccaggaaattacagaaatcgtcaatcagggtatcgcgacgggctttatattttgactggtcgccaagaacagcggcgttgatgaattcatgcagttcatttttcataattgttaccttatggttaaagttcttccggcttatccgtcgaacaattgcactataaacgcactcataaaccgtgtcaataaatacttttaaataaacacctggagttctaagatgaaatcattcaaagactttacgagccttgatgaagcgctgatcaccttcggcggtaaggcttatcctaaatttggtcaggtagtcatcctggctggcggtgcgggttctggtaaagggttcaccctcgaaaagctgttaggcatcgaaggtatcacactggacgttgacgcactcaaaaaattggtcatgggtagtaccaaactggcagcagagatcaaagcgaaaactggtcacgatgtcaaaaccatgaacctgaaaaacccagacaacgtagcaacactgcatcatgtgatcgcggacgtgttcaacgtatccaacaaaaaccaggcgcgtgtgtacgcgggtatcgcagcagcaccggaagaccgtaaaccaaatctgatctttgacgtaaccctaaaaagcatgagcaagctggcaagtatcgcccgtgatgttgaaacgctgggttatcagaaagaaaatatccatatcgtttgggttatgaacgatgttcatattgctatgcagcagaaccttaaacgcgatcgtgtagtgcctaaagaaatcctcatggatacccacgaaggggcagcgctcactatggcgaagatcctgaatatgggcgactctctgaaacagtacatggacggcgatatctggatcagcttcaacaaagtaggcattgacagcgaaatcaagaaatctgacaaaggcggtatgtttgtcgttaagtctaactacatcaaagttaaggcaaaaggaaagccgcagaaatccattgatcagcttgataaagagttagtggcgaaagttgcagcatacgcaccgaaaactgatacatggggttgacaataggaacatatatgaatatgatgcacacacaaaccgaggaattgatatgaaaaagtttttgttcgatatggatggtgtactgttcaactgggaaggttcttttgttccgatgtacggtgacccggcgagaatgccggaagaagaattgaaaaaagcgaaacaggctatatcacaaactgacttctacgaaaatctggaaccattacaagagggcatcgacctgttctgtcatttgagaactttaggtcaggttgcgatcttaaccagcgtagggaaatacaattccgatgcggtagcagaacaaaaaagaaaagcgttgatgaaggtgttcggttatctgcctgaattccactacaccaaaagcagcggagagaaagcagcatatgcggacaaaggtatactgattgatgacagggcaaaagctgtgttgccattcagaaaagccggaggtaaagcgattctcttcgttggtagcaaagaagaagcattgaaagaaatcagaaaaattgcataaaagaaagggaaccattgcggttcccttttttgtttatggtgtgtaatccgcaaaggagcggttaacatcctgaatagtgatgttcatatcgtcgttcaggaaaacactacgatatttccctgcgctatcccatgcttgacgatgcttatcattgcgggagatcagagggcaacggtaagcgtgggctttcagttcgttcagatcccgacaagtccagaagtctaaacgtacaatacccatctgtgcgcatactttatccatgtacgcgattttttgactattcacccaggacgggctttttgcttcgttgacgagaataaaaccgacttcgcgatcgcgataggtcatgccccatttcatcatatcccaacccaacacctcgatcgccagtttttcatagaaatctgtacgaaccagggacgatacagcagcttcatattctgcatctgtcatgttttgtgggcgtttgccaaatttggcttcgattgcgtcgctgaattttgcgaatacatcattgaattcaaatagtagcatttttaccttcttagttgttattatggtgcaggtttaacgtttaccgtcagagttgcagtaacagatccagaggttgctgttacgacaacatcaccttcactaaccgcatgaagtttaccaccaacgatagaaccatgaccggaagagtcaacactcagagtcatttctgtaccagaaggatcgatggtaaacagatcagttgcagccagatccgcatcacctactttgaaatcagcaggagcggtttttggtgtaattgttacgacaggatcagcaggagtaaaatcactcagcttatacagataaccgttacgggattcgatgaaatcaacatcggtgtaatcaatatacgcctgtttcagtgtgtcgaattctttcgcgtatttttcttcggcataatcacgccagtcttcgcttgcagcattcgcagccacgatgatatcaaagatccaccacggcagataggtaaagctggtgttacgccacgggatcgggtgtaccgtagtccatttttctgtagccattttcaaaacctcttagtttttctctatttagagaagtaaaattttgccgtcacaagacggacatttatcatattggttcacgcgcccatagccgttgcattcaggacagaacgggtttgttacaccgaacacattacggatcgcgtaagtggattgttcttctgtcagccctacgaacccatcggtattgatgaaatgttcactctgttccggcagcatatcggtatcgtcatcaaggataaggtaattcttacatccgaaggtgtcgatccatgctttgatttcatcaccgcgtcctgcttgtcggtctgttagattcgtacaggttttcccaatgatgcgatacaatccccacggatagaagatttcccgtagagtatgggttgtgttgccgatcctccatgtagaggaaatgacaatatcacagttcgcatgatttacgatccggcgcaggtgtcgagcacattcaatgtccatatgctcaccaaatttcatgcaccgcatattatttagaacgccgtcgatatcaaggaagatgacgtttccgatctctttaccttctgataagtctttcaggcattcgtgatttaattcagtcatattttacctacaaaaagggggctacgcccccctttgaattttaatagaaaccgcgagcttcgttatccaggcgacggtctgcaatcatgtgcgcttccatttggcgagaaacataatcaggatcgcattccatttttgcttcttcgtagttgtcccaggtatcagcaacccattttgaaccgttccaacgagcataaccaggttcagcagggacaggataatcagcttcgtaagcgtgacgcagtgcttcttcaacagtatagtaaggagcatttgaattgactactttcttcactttaccatcagcccaaacaaacagaactgggtagtaagcatttttcatcatttcgtttttcattttgctttccttcttcactgcgagagccattcccccgccttcgagtacaaatatactttaaacgagggtatgcgtcaacaagttttttagcaaaaagtgctaaaacttaaatgtttcgaatcggctatttctggtttcgcgaacacgaacttcgccatcgcgcacgatatagaacgcaagtgatttgattgtgtcgattgcgcttgcatgtggacagctatcaggatctttgtaccagtctggggtttgtttaatccagtcatagatccaccacggacaggtataatacccgttagaactcgcagagcgccccatcatgaagattgtcgggctaaacccttccaaccataccagttcgcctttggactcgtcagaagcgcttacaggagcttctacgacatcaggtactaattggatttgatcggctacttccggcgcgacctctttaacgtactccataaaatccgcagaagcatcaataaccacatcgggaacgttcggggcttcgatgacaggttcacccatagtcacctcacctttatatgcgacgatttccggttctggtgaatcgatcagcagttccggcttttcttcatcttccggtaaagcagcaaccagatccgccagcatgttatcgaaggatttttgtttgttcagcttaaccgcaaacacagtcatagcgtaatcggctaaagcgcctttctgttcttttgcgtcgagggtacggaacccatcaactttttcgtaatcaatgttcattggtatctccaagtgtttatccaatatttatgacataaatacgtatatactttgtacatagggtaatcatagtggatattgaagtcaaatttttaaacacaagccacgtacagattcaggcagaaccaaacattgtctatgaactgcgtgactatttcagcttccagcccccaggctatcagtatcaggccaaatacaaatatggtggatggaacggttacatttacttgatggactacaacgggaaactcccgtatgggttagcctatctggtatccaaattcgcagaatcacgcgggtattcaatctgggttgatccaaagatccacgaaaccgaggatatcacgcaagaagattttaacaagtgggttagcgaacatccggtttatgacggcgacaaacagatcgatccgtactggtatcaacgcgaatccgtgttccacggtatcaagaaccgtcgcggtgttctgaacctgccaacatcagcaggtaaatctctgattcaggggcttatctctcgttggtgtctggaacattacagcgggaaggtgttgatcatcgttccgactaccgcacttgttgaccaaatgatcgaggacattgcaaactatcgtttgttcccgaaatcggcaatgctgggtatccgttccggtacagcgaaaaacagtaatgcactgatttacgtttctacctggcaatcagcggttaaaatgcctgccgaatggttccaacagttcatgtgtttgatggttgatgaatgccacctctcaacaggcatgagcatcaaaaagattatcgacacgatggatcaatgtatcttcaaactgggtttatccggttccctgaaagaagggaaaacgaacatgatgcaatacatcggtgcgttcggcaaagtctttaaaccagttgatacgcgtcgtttgatggatgatggacaagtcaccaacctgaaaattaacacgatcttccttcgatacaaagaagaagaggtcaaaaaattgaagggtgcggactaccagacggaaatcaagtacgtaaccagccacacacggcgcaacgcgtggattctaaaattagcgctcaaattagcccgtgagaagaacgaaaacgcctttgtgatgttccggtacaaagagcacggaaaatggctgtacgagcagttgagcaaggtttacgataacgtggtgttggtcaatggtgatacagacattgacgatcgtaacgaaatgaagaaaatcgcggaatcgacgaaaggtttaatcgtcatcggttcgatcggggtactgagtacgggtatctcaatcaagaacctacaccacatcatttttgcgcacccttgcaaatctgctgttgtggtgaaacagtctatcggtcgtgtacttcgtaagcacggatcgaaagcgctcgctactgtatgggatatcgttgataacctggctacgctgtcaaagtctaagacagccaaaaataaatacagtgcgacaaactacggtatgaaacatgctatggaacgtgtgcggatctacaatgaagaacgattcgactacgcgatcaaacaggtagaaatttaagaggccaaaatgaaaagttttactacattcgtaaacgaagcagcgattgatgatttcatgaataaggttgcttcgtgccggacactagaaggtttgaaagaacttgaaaagtattacaacacccgcgtgaaagaagtcgaggttgcagcatccgatgacatttcaatgcgtgacgcgatcaagggacggcgagaagaactgaaagccgaacttgaaaccggagaagaagagaagttttaaaaagaaagccccaaccgaaaggaaggggctttttaatttcggaaaccgtttgttccgacacgtacatttattttatttcagtgctgtactattctgaattacaattaactggcctttactcgaaggtatcttaccaatcaccccaccgaaagtaaattctatcggacggcgcaaatgggtacgccacacggtaagcccaagccccacaaggggtacacatctatttactgctataaatctgggcgttcgtcttcgatacaaccgctttcaaacgaaattcgaagtgcatgaaccctggtcacacattcttccatcaatcccagcaaacgaaatacttcgttaaagtcgatttttgaatagtctttcatattcacacctacagcaacatttgaacttcgttcagatcgtcggcttcattgataccgcgatcattcctttcgttgagatattgcaaacatacgacaccgcagatcgggccagcttcattgacaaacgccgtattacgggagttcatcggttgtttgcacacaacgcatttgcaatcaaattcttctgccattttatgcaccactctcaagtttacggatctccaacatgtttttgatggagtagcctttgttcttaacgatatccagcgcttttccggtaaactctgcaatcagttcgaagtattggatcagcttgttaacttcaacggtcttaggatcaccggagatagcaattttgatttcacccgaaccagtgtaaatgacatcggtcatttcgctttcgtgtctaccagtgtagaacagtaaccgatcttttacaatcgcttctttcttcgcctggagttgaataagttttttcttagcattcgaatggtatcgaagccattttgaccaaatcttcggaatgtctgctgattcgctttgtaacttcaacggatcaatacgcatatcctcttcaagttcagcctgtagatcttcaagttttagttcagccatgtatcacctcaaaacaaagtaacattataaccagttagatcaagaagtcaaatctacgagcgaagcgagtacatgaacgaacgtagtgagtgaatgttggttaaaaagtatacggaaatgtactgttttctctatatataaaatataaatattataaacagtacatcgtacttacccatcactcacttcgttcgtgaaaactcgcttagctcgtttgaccttatagatctttattactataatggtcttctcaaaacaaaacttgttaacccagtttaggtaacttaatacctacgatctgactcagcttagatttacctgcaagagcagaccaatcatcacctttgatcaggtgatcggattcgctttctgctgtgtatgggttcacggaaagaccgtaacgcatcagaatagcaactttcggttgcagggatgccggatctacggatactttgattgaacctgcttcatcagcttcggtatacggagcgaagaacagagagcctacgtgatccatatcacccagatcatatttgcaaccagtcagcatataatcgaacgggctgttggtgtctgtatagacataataaccgttgttcagcttacctgttgccagtgggtgttgttcgtcggtttcgtgcatccaaccagacgcagccagaatgcctacaacacgcgctgttgcgaggacgtaggtagcatcaaatgaagtcgttctattcatttcctgccccatttcacacgctaattggtacaggatacgacccaatgctggagcatccttcgcggtgtatgcggtagtaccgtcaaaaataccatccgtaacgagtccatcgacgttgtaacgtttggaaacggtgatcagagtttgaataatgtctttgttgacttcttcacttgccacggttcccagaatgtcttcgatcaccccatcagcttcaaactggtttgcttccaaatcctgcatcagttcaaccgtcatttcggttttaaacttacgcgaacgtaccggaatattccagcgatccatctggaaggaggttgacgcgatatcttcactggtttcatacttagaagtatcagcggcttcgctaaccagtcgaattttgctttggaacacagctttcatgatcgcggtgtctttgtcagtatccagagtgttcagggcaatcggtgcgataacctcataaacaacgtcagtgccgtcatgcttgaacaaatcacctttaacgtaggctttagtcagatcgatttcgtcgatgtctgtacgtccagagattcggcctgaataggttgcagcactggagaaagtcatatcaccgttagggttgcgatagcgaacaccgaacagtgttgcaacagggagttctgtttcttgtacagcaaccagttcatgatagatcaggttgttaaccgcgcgagtcaaagaaaccagttctgggcgcgtgttctgtacgttgatgtcggtcgtacctgttgcttcgttgataactttttctcgtttaccagacggaagcgcagactgacgcatcaacttgtgaattgtgtagtgtttatcactcatttctttggttcctgaattatagggagtatattgtttatttatgcaacgaatttccattcaggaaatttgtcactctttaaacggtaatcaaggccagatcgagaaagtcccaacgctttagcagcatcggaaccgcttgcgtaaacaactccatctatcgatacagaacggcttattttggccttgtgtgcgtctgtgagcttagatccggttctatcgaatgcagaacccttatacatagctttgatagtctctgaacgcttcctgttggattcttccgattgcttctttcctgttttgatttttgaaaggcgttcgcgcatttctggagcttgcatagctttcgaagtattttcagaaatcagcttgcgttgttcatcactccatccaatcaatgccattggagcacctttaccaccaataccagcattatatgtatctggtcgatttatgaattcaatatcaactatttccctttccttctcatacatttcttcacgggtgtcaaatacatgaagtatttcttttgtgaaatgttccataccatatttcttttgcgcttttttgattgcaataccggaacccatgtatgaatcgttgatatcttcggttgagtgagcaccaacatatattttgttattgatggtgtttgttattttataaatgatatgtttcataatatagcctcaaatgttttcactatttatataaacaaaaagggaacccgaaggttccctttaaaaagtcgttgtttttcaacaacttaggatcaaagtcccttaacccacacgcggcggaagtatgcgtttttaccgcacatttctttgctgatcataccagaggtgatacgatctgccggagcctgagagcgagagttcgcaaacgggttgatgccgataccgtaacgagttttgaagcccattactggctggaagttcttaggatcagaaccacgcagcggagtcagcgcaacgtatggagcgtagtagataccagcatccatttcgttatcacccttgtagcccacggtgaagtaatcctggcgagcgtactggtcgatgtacactttgtaagtgccacccagtacaccagcgaataccgctttagtggtgtctacgttcagagttttctggagaccctgacctgccggagtgatgccgctgtcgatacgagccagagcggaaaccacgttacgggaagcgatgatgaagttaccagcaccacgaccagtttgacgcgcgatttcgttcgcttctttgtcgatctgaatcagcagagctttatagctttcaccagcccaacgagcgccgcgaatatctactggatcttggaagtcaaacgcaccagctttagagcctacggtctgggtgaaaccagttttaccaatctgcgcggtgtagttgatcaggtcaacgatttcgcggttgatttccagcatgatttcagttgccaggattgcagacagttcggcgtcagcgtccataccgtgtacagcgcgaagatcctgtgccagttcaacggaatactgtgctttcagttgacggctacgagcttcgataacctgtttgtcgatacggaaagccatttcgttccacgggttagcgctggaaccgttgaagttttcctggagttctgctacgctggtagccataccttcggaaatttcagccagagtgcctttctcgttttctgcgattacagcagcatccagagcagcagcatcagcaccagttacggttacgttgccggaggttacgttctggaagtacgcgacaccagtttcctggaatacgtgcttaacgatagcgccggaagcgatagcaacaccagttgcgatagcagcaaacgcggtgtttgcaccttcaccagaatacatggtgtctggagcgaacatcggatggaatgcttcacgaacgtttgcaggagtaccgccagccagaggatctttaccgtatacagcacggagtgcgaacacctgaccagtagggccagtcataggctgaacaccgcaaatgtcgaatgcgatcaggttaggaatcgcacggcgaaccataccgattacagcagggccgatgttggtgattgcaccgctggatttaccagaggcaatgttggttgcgtcgtaaccgtggtcacccgcgatctctgcttccgccaggaaaccgccgaaggattcaatgattttttcgtcgcgatatactggatcagtatcagcatccttttcctgagtttccagaattgctgcaaccagttgttttttggatttggtagcgatatccggtaaaccttcctgagattccagaagatcgttccatttttccatcaattcgtttttcttagacattgtttcttaccttataagattaggaaagggctttagccgcttgtacatatttattgatcttcgatttctctgctggaggtgtattttcattcaccggaacaaagtcatctttagtggttgtctgagtagtggtactctcttcaacctgtttttccgctttagtcgctaccatttcaacgattgcggtcagtttggattcgaacttgtcggaatattccaaaccttcgatcaggttctgaaccttttcaatttgcgattcagtcagatcttttgttttttctgaaacgatggtatcgcgtttcatgttggcgatctctttagcctgagcctgattagcttcgaacaggcgtttaacttcctgctgattctcggtcagttcatcttcgagttctgcaacaacatcaacctgcgcttctgggataactacgttgtgttcaacgaacagttctttcattcccattaccagagattcgaacagatcggccttgatatcacgggacacagcttctttgttttcagagagccattcctgcgcgatgtggtcgaagtatttattcgcatcttcgtacagtttattttcgatttcgccagctttttcggcaacctgggcttcaaccagttcatcggagcgttccgcgatctgggcgatgtgggtttcagcgagtttcgcagcacctgcttttacagcttgttcgaatacagtggtgaagtttgctttcgcatcatcagaaagttcaactgattcgaaaatgctgtctaactcaactggggtatccaggttctgggcttctgccaacagttgttctttaagcatttctaagtttcctgtttgatatgatattatttatatagacttttcaaacgttcagagagttttctgaaagcgtcatcatcagcactattattctcaacaagcgttttgcttgactgagattcggtaatcggcttaacgtaagcatctggagcgcttggcccccaaacaacatcaacgcctaccgccaatttaaacccttcttgtacgataccgtaaccttttccagaatcggaaagtttacccagtccgcgagaagaaacacctggaacccaacctgcgcgaattaacgccgcgagtttatccccatcaccgttatcaccttcgacaacaacagcgcgaccccaaacgtcattacctttccaccataatttttcaattaggatgcaagcattacgcggatcgacattcggtcgcggcgggtgattcatttcacccagagcttgacgggtattaacctgagttctgatataatcgtttactgcttcttctaatacttttttcggatacagtcgcttattgcggttaactttttcggcctggaggaaaataccttcaatccgaagtttaccgtcttttttcgactcaccgaccgattctaaaatcgaatcggaaatatccgcacaaggtaaaccccattcctcgattagcagcatatcgccgttttcattgagttgggattcattcatatttatagccctaatgcggcgcgtttacggagcgcttttttacgcttacgctgtgcgcgggttgtaatagaagggtttgcacgttttgtttttagcgcacgacgcgcaatttggcgacgttgagatttagttaaaccagttgtttgatacgcattacgttcacgggttttacggtcttttttacgttccacattaccgcgcgaatctacgtgtttaacaatgacttcatctaaactcaaaccctcgacaatggacatcatagccagggctaaatgaggttcattgaccgccaaattttcgatgatcttcacagtgccgtcatcgatccccagaacatcaacacgggctttcgcttcggttaaatggggttcgagatcttcgacgctgatttcttcgagttcgagttgcattatttacacctcttattcgtctttatcgtcgtcttttttatcagacggctttttgtctttgtcgtcgcctttatcatcgccgcctttgtcgtcgtcatcgtcatcgttgtcgtcatcgtcggtttcaccttcgatgcgtacagcttccgcgagttcaacgcgcatttcttggcgaagggcttcggtacggtcttccatgatggaatagaattgcttcttcgcttccaccagatcaccgcttttgattgcttcgataaattctttcatcaaaagttttcctcttcctcttcgggatttttgaaccgttcttctttggattcttcttcgatcagcttcgcttgttcgtcgatgtcttcatcagacattcgaagaatctctttcatgatgtatttatgggagacatatttcccaactacaccttcaacctgtgacatcaacgttaggcgacgttccataatctcaatatctttcacttccgcgtaatatgaatcttgctggaaaatgaaggaaattttgctaacgttttcttcccattcttcctctgtgatgatttttttcgcgatcaggttagtttttaacggatcggaaagcacagggctgaactgaatttgcagtgtgcggataaacttactgaatttcagttcatcacgggtgatttcgccaccaccaccaatttgcatacccccatcatcgcgaggcatacggcttaatggcacacgcagtgcttcatagagcttacggttaaaccatttgatatcatccatatcagagaagttagcaccgcctggaagcgtgtctacttcggtgatagctttaccgtcacgacgcattaaccagtaatcttctgtcattgacaggttgttttgctggttcttaacagtacccgttttagcatcgtacacaacgcggtttttaagcccctgtgcgatgttatttacgtactgtgtcgctttgttaccgcccatctgccctacgtcgatgtagaatacacggcgttcaggtgcgcgggtgatacggtaaatgaccatcgcatcttccagtaaacgcaattggtttgctggcttgactgcgcggtgcagatatccgataatgttgttactgcaatcttccagtccagaatgcgcatacacgatagcggagcgcgggattttaaccttctggttatgctggtagatctgcccgttgtatgtatagccatttttaggagcgctatacacgaaaaattcgcgataaccacggaatactttcacgccaccatcaagggtttcagtgatagattcgcggatcagttccatcgaacgcggatcaagttgacgcagttcgcggatacctttgctttcgtctttatgcatgattttatggaagtagatacgggaatccacataccaatcacggaacagacgcgcacccatgttatcaaaatcatagatatttagaacgttatcaaattcttctacgattttgtcctggattgccttactaaaatctgttttggcaagatccaaagtaatgatatctttgccctgttcattcacgatcgcatcgtcaataatttcagaaacagcgttttctacttctgggtaagacatgatgccgcgatatgtattgattaattgttctttgttctgaatcgccggatcttgtccagaataaaactgctggaatacgcttgcgtatttctgattagtcagatcagtttcgatttcataagcaccatcattatttttaggaggcgcgaccgaacctgtatcattttttaattgctgttcaagatctaattcgtcctcacgggcgaaattcttgaaaaagctaagtacattgccaaagcccaaaaagttcatagtaactccgaaaaataatgataggggtattgctacccctgtatttatagcctttattcccaccagtccagcgcgaaagtaacctcaaaggttgacacttcgttgttgctgtcccagtccagggtaacttcgcctacgttagtagggaaaagaccgtgaatggtatgttcggcggtaatttcatcgttacggtttttctgtttcaccgtagcggtttttttgtagttcgctggaatatcaccactaatctgatcgcccattccgtgcatcatgtttgaccatgctaccagagcgtcacgcgtattatgcgcgtcatcgttatagatcgtgattgtccagtcatcataggtacggtcaccagcaacgttgattttgcggttttggtatcctaccggaactttttcaactgtagccgctggcatggttgccgctttacacttgaatttaaagtttttgcccagatacgggatctctacttcgaacaggttcggacgtgcgaaatcaccggattcaaaggcgcgtaaaatgtcagtaagcatttttaacctcggattatttatgggggcttttcagcccccttgacgttatacggcttgcggccctaccagttcatcgaaatctgcgcccgtagacgttgctacgaagttcagagtgatgtagttgatagaacgaggcggtttcacgtagatcgttgctacaaactcgttacggtcgattacgtccggtgtgttgttcgtggtgtcgcagattacacggtaatcgtagcagccacccagcgcacgaatattagtcatgtactgacctgtatccatacggaacgaagaacgggtgaaatcgtcgttgttttcaaacagtttgtatttcgcgttatcaccgatgtctttcttgatcatgttgaacaagcgacgaacgttgatacggtcaaatggactcggtacgttagtcagtgttttatcaccgaacagaacgaagccggaaccacccgcgaaaccagttaccgggttaatctgaacctgatacattgcgtcacgatgtgctgtgcgcggttcgatagccagtttgatacagttgcggatctgaccacggttgtaacctgctggagacatccacggttgagcaacgctatcagtgtaaacacacaggccagcgatatcacctgccagcggaacccaacggttcacgtcattgtatttatcatactgatatttatagttaccatccaggaagccatagcttgaacttacgttcaggttattgtcaaccggagtaccaccactgagtttatatccagtacgccattcaatgatgttatcaaccgctgttgccagtggaatattcaccatcagagagcgcggaggcgacacaaacacagtacaatcctgacgttcatcaccgatagagataacgtgtttctggacggtagacatgatctctacagtttcaccagcacacgcaccagcaatcagcagaggtacatgcagcgcttcacgatcagcgaacatatcccaaccagtcatcagttcatcagcgcctacagtgtcgtttgaggacaaaccaccgccgaactcaaggataccggagaagcctttaggccagttcagggaagtaccgtaaacgtactgagagccaccgttagcgaaaaagtcatccatgaagatgtttacgccgtagatatctttatcggtcttctcagttgacacgatgaaggattcctgtacaataccaccacgacgcacaacaaaagcgtactggttatcggtctgtggcccgtaggtcattacagaacgaccgctgttcttaacggaaaccccagaagggtagcctgaaatcatagcgccagaatcgtaagcagctttggagataatctccacctgaacagttgaacccagttcaccaggatacagagccacgacagacgggatctgatatttctgggtaagagtctggaatgcggttccctgaattgtttcttttgcaatatccaggttcaacagagtgatccctgaatcgctttcgatgccgtcaatcgtaatagacgcggaaacaccggaagactgagaaacaatttcggtagtccagccagtagaaatatctgggtaagtaccaatctgtttagcacgggcaacgattttttcgcttgggatgattaccgcgaggatcttgccgttactgtcaactttggacactttaccgttttcttctacaacaacgttgttgtactttactttaatcacatcgtttacagtgtagttagaaccctgtgatgcgatagttgttttgatctggttgaaaattgcgcttgcgtttttagcggcatctttatcgacaacgcgaaccacacggagatcattaccgtactgcaagaagttaacagcactcatgaaatagtcagcggtcaagttgtctggggaaccaaaatagtttaccatttcgacttcgttagaaatctgacggatctgataagctggcccccatgaaaatttaccgacaatggcagcgcgaccagttgaatttcgaacaacggtagattgtaccgatgtttctttggtttcaatacctggagattgtaaagccattatagaatttcctctaatttatataaacgaaataccgtgagaaccaaccgaaatcgtttcatcaccgcttgtaacgataaccggacataatgcgtcttcgtatagctgttcgcgttcccgtgcaaaaacttcattggctagtcttaaatcgtctttctcgcagaattcggcaaatttcatttgagttgtaagccaaccgaaacaagcaagcgacataacgaggtcatcgtgatatccttcttccgcagcccacgaaacgcctttttctgagaaagtacgaaattcgagtattgtctttttgttatttatgatcaatttatctttctcgatcaggtctttcagcgtcgaacatcccatagcttttgatcgcttagtctgtttcatacccagatcgttgtagctgtcacaaataacattctcatattccagttcggaaaacagagatttggcaactgaatgccctgtgctatttagctcaatgtaaatccatgcctcgttatacatattcagataacgtaacaggatatccggcaaaataagatgcgacgttttgtttgagtgatacaccgcaacctgttcaaatggcatcgtcgtaatgtcgatgatatgcattgcatggtaatcctgtccgcgaccttccgctggatcaagtaccgcaacatatttatgcccctctactggacgtttatactgatagaagttcgtttccgtttcatcaatatcaatccatgtgagttttgacaacttccaaccagcgatcagggttccactggttcccatgaattccgcgcagtgttcctgcaagaatgcctctttgctggagccagcgatcattttcgcagaccacgaataaccgtcatcaaatgtaccgttgtcgccgtctgtatacaatcgctctttaaccgatgtccagatcgccgtgtaaggcacgaagccggattttccttctatagcagcgttccagatatcatagaagtggttaagcccgttaggtgtcgttgtgataaggattttcgatttacgaccagaagagattactggttgaatcgctaaccacgcatcaacaaagttcgggataaacgcgcattcgtcgatgtagatcatcgcgaaggagttaccacgcaccgcatcgggagaagatgcaaacgcaccaattttacatttgttgtcaagttcaatagaacctttgttccattcaacaataccaggctgcaagaagtcaggcagtagttcgatcgcctgtttggtacgatccagaacttccgcagacattgaggctttgtgagccagcacaccaacatatttatcttcgttgaaacacacgaagtgagccaggaagattgcaacaacggttgttttacccaactgacgcgacaggttacaggcaaccatacggtttttgtgcatttcgatcagcatttcgcgctgatagtcacgcaactgaaccttgattgtaccatagtcaatgtgggtgatcgcacaatatgtttcagcaaaataaacgatatcatcacgacatttcacccactccatcaacatttgttgcgtccatttagtctggatatacgcacgtttcaggtttgggttgccgttatatcgggttttcttgttgcctttatttttgtacgtggcaaagttcgaactgtccttagactgaatatcgaccttttgaatgccgttaattttcaggtagtcactgaacgttgtcggataccattttttatcgtgttcgctttgtgtccactccatccccaattcatcaattttctttttcagatatttgggatgcattaatccgatagggtgatctgattccttactcggatcgatcgtcggttccatttccatcagggtttacctctacagcttcaccattaatgaagccctctttgggttcatatgcactgccgtatttctgcatcagttccgtaggggaaccaacaaatacggttgcattctcgatattcatttcactaccaccaccgcctttttcagcacctggttttgtagtctcttccgtaatctcacgcatttctttgtgaatcttcatcaggccaatgtttgaaacgtttaactgattcatcaggcttgtgaatacctcgacgtggcgaggcgattcggagttcttcgcgttgtgtaatgcgatctgcgccatatccatgatcatctgattcatatggtgcgcagtcttacgcgcgagcgtataatcctcttccagatccggtttccggtctgctggatgtgattgaacgtcaaccagttcaagtttctcgtaaacaaccacatcctccccagactcaacgccgccagggagggaatcaatattcagcaattgctgcaaatctaatttttcatccattttcattccctcggcttaggaggttcatcaccagacgggatcggcttatcatgcgagtacgtctgaatatattcttcgcccgtgtagtcctgcatgggcaaatctaccggatcggcttgactatccacggattcaaagttatctttatctaacgggttcatgttagagaagaaatccgtgtaaacggttctgatttcgcccttgacatcagttacaggcgggtacagataaccctgtaattcaaacataaatgaccactcaacatgacggcgttgatttgcatcgccctcgaatgtggtatccggcgcaaccgactggagactgattttgatgtctcggtcaactgtgatttcgttcttatgcagttcggtaatcttgcagttgaaatgcggttgaaaatatggcaaaatctgttctgcgatctggaacatatcatcttcatatcgcgtatacacacccagttcgaaaatcagacgatacggcacagggttaaactgtgtgatcgtttttcgtggggttgctaactgtgtcattttttggttgaccgcgatactggttttacggattgcgttatattgcagatccaccagtgataagttcatgcgcggtaaaattgtttccgttttagcaacgttttcctgactcaacgtgtagttaagtttgttcatggaagcgagaaacttctctttcgatgcataggtgatcggaaccttgatgtatttttcttgatcgccgcgtactcttttaacctgaacatggttaaacaattgtcccataagaacaatgtagttgcgtagtgagctattataccagtatccaaaaattttctaatccccctgctggacgcgtccagacttacagttatcaaagtgccagcgcttcgctgtattagcggcgcacattatcccacaatgggggcattgtaccttttctcgttttttgcctttgtgagcagcaacgagacttgctatatgttctggtgatagcttctttcctttatgaacagcaccaattctttttctgaattcgtcggtatggtttttcccgtaaaatgggttgtttttaccgtcatgtttgcctttcatctgttcttttttaacaatgcgcattgcctttcgcgcctttgtcttttcttcaagaatgaactgctgttcttgttcagataacgatgaatagcgtttgtgttcataggtgaacatcatgaagaacgcaagaatcattttaggatcattggtttttgctaatgtcctgtgggccatcaaatgcttcattatatcaagttctactaaattttctggttcgtgttcgaattcaggaaataaagaacgtggtaatatatgatgtttttctgtgtgttcagtttttggagaagcctttatgatatcaacatactcaacgtatagatcatgaggcaaccattctttaagttttgtgtatatcataaaatcctctttgaagagggtatagacttccgcctatacccatataacgtatttatggcagacttgcaaacggtgaaccgcgtccgttgacaacatcaaaagattcgatgaattcatcaccttctctttcaaattctttgtcttcttcgtactgttcaatgttgatatcagccagcccgtcaagatttcgaatcggttcgagatccagttctgcatcaggttcgatatggattccttcatttcgctgcaattcaggagccagttcttcaccagtgtagatgaatttcgccaggttgattttacgctgaggacgatcaccgaactgatagaacggatcggcttctacccacgtaatttcaaacaggctattgtccataggaaaataaaccagatcccccagaacaggaataccaccatcagtttgatgtgcgaacaaacgagggttaattaccagcgtcatttcatcgtttgaactcagaccaaatttactaaagaaatctcgttgtccttcatagttggcatacgattcaatatatgcagcaattttccatgacttcgtaaatttggattctcggtcttcgcccaggatcttatcaatattcacgaagtcacgccggacgtaatacatatcaggcgatttcatctggattgattctgctgtcagtgaatcgtgtagctgttgtgtcgggttgtatttgtaccagtttacatacgggttagtgacctgatcctttaagttgcgatcaaccccttcccccgtagacaactgagcgaataaactttcatcccagttttgcattattccccctacaccataatgatcggtactgcgtcagacatagaaatcagttcatcgcgcagactttgcagtttggtttccgcttcctggatcagtcgcgtaccatcaggagcaacaccgccaggcaattgcatcccctggaatttagccagaatttgtccgttgatctctttcaccagtgcggtagagtagtcttttacccatcggttgttatatgcagacgttccgcccgtaacagttgaaccctgtcccgctcgtacaccgcccacaacgctgttatacgggttttcgtagatgtcggctatggattggtcttccactgcgttagaacccgctgtagcgtatcctgcgacgcttcctacggagctagggacatcaacgaaggaacgaaccatcgcttcaataacgataatgtcacctttgttcacctgcccccatgcgcagaactgaccagtatcatcgttgaaccagtaatcaggcagtggggccagcaggtcttgcattgagcgttgataggacatcatctgggtaaagtagcccatatccgcaccgtatgcgttcataccgtacacgcttgatgcacatcgaccgcccagagaaccaccagtaagccccattaggaaatcggtaaaccacggataaaccgctgtcccgtccattgtggtcaatgaacccatgtttgtgcgcaataccttcgtgatcgcgaagatgtgctctttgctcaagtcgaacacgttgcgcgggttatcgtcgcccagagtcagaataatataactcttgttcgtgccgttgtaatgatattccgcgtataagtctaaagcgcgttgaatacagtcataaatctggtcttgagtgacttcaattttgatgattggtgcgcccagacgacgaagaatttcatctttcaattgttctggattattcgtaatcatatgatcctcaaaaggggctttcgccccttgttaaaattatgctaccgttacagttacagtcgcggttgctgaatcgttggtactgttcatcgcgtcagttacggttacatagtaatcacccgcatctgcgctggttgcagcagacttgacgatagaagaaccagtttcaccactcaatacagatccgtctttatgccatacgtaagtgtacggagttttaccaccgctaaacactacttccagagtcaatggatcaccatcaacaacagaaatatcactcaagtttgtatcgaactgaggaaccgtatgtaccacaatgtcaagttcatcagaagtaatcacggtattttcagcgtcggttacgacaactttatatacgccggaatcactcgttgtggtgttctggataattacactcggtgaatcagtcccgatatttgcggttcctttcttccactggtacacataaggcagtttaccacctgtaacggtaacagataaagaaatagcatcaccctcgatataatcgttacgaccgaccagattttgagtaaatgacagtggaactttcttcgcttcgtatttgttatccgcttcaacttctgtgatatacggaaccagagcatcagtaacatcctggtgagaggctttattctgttccagttcgtccagacgttgttcaacgttaccaccaccgccagcttcgagagcagcaacacgcgcagtcagatcggaaatcagtttataaatccctgtttctgatcctgtagtattaacgccgatcgcagttttgttatcgcgagccgttttctgaataccatctttgaggaatggatcagaactggttgcgtcaccataaacagctttacccatcgcgatattagccgcaacgagtccagttgacgtattacccacaattgcggtaatatcaaccagtgcctggtggtcgtcgcgctgtgtgttttccacattcagcagacggcctttgatgcttgttggctgagagtcagtaccgatatcggtcataacctgtgccatttcaccgcgcagaccatcatcacttgtttcaccaacgatcatattcagatcgctaatgctacgtttcattgtgctgatatcgtaacggatactacctggaacctgtgagttaccaacagcgctttccaaaaggattacgcgaggcagaaccccaacaaccggatcattcatctgggtttgcagagtagtaatgttcgtttccgcagtttccatgcgggaatcaatactaccagaaccacctgagcctgtacgcccgatataagtgttgatgtttgacagttcggtattaataccagtgatatcgccaccgataccattcagacgaacatacacagattcgaaagtggctaaatgcttcggccccatttcgttacgcagatcggtaacttcatcggttaaattacctacatctgagtttacccagtcatcttccagcttagtaatacgtgcttcatggatagataccgcctgagcgttagccattaccttgtatttcacgccggagccagtagaggacggatcaacatcaccatcttcgttaaagccaggatatgcacccagttcatctttcaggaaaataatatcttttcgaatggtacgatgtttaggatcggttgacgcatcccatacaccaatttccttttcgatatcctgaattttcagggtgttgcttgctgtagttgcctgtacagcagacatatctactttcagcacgtcaacatcagcgacaactttatccagtttgtcgatcacactatcatcagagatcgccgcgaggttttcagtaatgaggttaacctgatcgataacttcgttgatttttgatgtctgggtagttgtatttgcttctaattgtaccgcgttcttttgaaccagaacaccgcatctgtttaaagaaccctcgttagtggttttggtttttgcaccatcgagagtttcgccgttaacaatccaattgatctgggtttgtgtggtgtccgcagggacaccatcaacaaacgggatctttggtaacgggttaagttttgaaatcatggattaacccctttatcgtactcgaattacgtagttgaccgcaaggtttttcattcgcgtttcatttccgccagttgccatagctttagtgtatgctggattcagttgcataattaactggtcgttcttttctgaatttttcaattcgtatattgcttcggatgacggaagattaccaccgttacgatagatcatctgtaactggtgttcgtgggatttaaacatatcatcctggtaagtaccgaaaccacgtccaggatctaatccacgtccggcatcgaaaccgcgagcagcaacaccgcgcatatctgggaggttgaaaatatccccagcaccgccgtatgtatacccgatgcgggaaaacagaacaggatatgtgttgcggttcattgcgcgtccgttacagataaaaatatttccatagtcggagttaaatgcagatagcatcatacaaccgatcggaatatttacttcaacgtcgctttgtgtctggtatttattgtcagcaacaatagaaccctgatacaacgcaccgccagtgatagcactgtttctgttgcttggaactacgttagcaccagcagacaacgcggtattcgctaatccggtattgacatctgttgataatttaaccaaaccaaatgcagagccagaacccttcacagcagcaagtttttgcggggtgattgcttttgtgttatcagtacccgcgtttacttcctcctgtgtagcgatacggagtaagcctaaatcggtttctgttgcagtcagacgaataaacgtgtatggtgaaattgcgaaaccgtcgcggatagtacctgcgcggacttcggcaactgttgccaactgtaccaaaccgaaattgctttcagttgcgtttgactgtaccggaaccatagcagcaattgcttgcttcactttaagcggagtcattgcggtcgtgtcatcagtaccagacgttgcctgtgcagtggttgacagttttgcagaaccccaggcgttttcttttgactgacgggtgttaaacacatagttcaatgaacgcggtgttaatgaaaccagatcgttcgttacggttattgattctgcatcagttgcgtaacgggtgtaaccccatacggtttgtgatgcatgagggttttgcagacggtattccagcagagccggagttacgatcgtctgtgtgtctgtacctgcatcaatcatttcctgtgtagcaatagcagcaataccacgcacaccaggcgcggaattaggcaaaccaacatcagtacgcgcccatgatccgatagatgcaagcgcttgctgaacattcgtgtacgtgctaggccattgcgtaccagcaggatcaaatgtcacgtaaacggatttatcgcttacgtggttaattgtgttgttcatttattgtccttatgcaatacgcttgaaatagtaaaccgtaacagcaggagtaaccggaagatctgcttggcctaatttcgaccatgtaccataaccagatttagcctgtacgtcgatcgtgcctaccatactgatcccattttcggaagtgttcgttacaggatgcggaaccgcgtcaataaaacgaacttctaggatctccccatttaaaccctttcgagtcaccagatcgaaatatttttcatcgttcacaaattcagtaaatttgttataaacggtttcgcatacggttgatgcgttcgttgtgttgtcaaaaacaaacgggaacccgtaaacatgaacagtcgctttcgtctgatctggatctgggttctgaacagtaccatcaaacgtaatgctttcgacctgctgaaccgcagacggtgaattatcttctgccattgttactaccccattaatggggatttgttcagacagagaatataagtcatcaattgctgattgtacgtttgggtattctaccccttttcgaagttgatcgacgtttgcgccgccaatggtacgtttaccgccaatcagcggtaatttcgaacccatttcatattgcaaaaaatctgcttcgcgggaagggactttcgccccctcccttgttttggaaataaactgtgtcatttatgctacccttatccagcggtgaacagtaatatacggcgggagcgtttttagtttatctggggtaatgttaccctgatttacttttaatacatcctcacggtatttagtgtaacctggccctgttgcatctggatcaacctgacaaccaccgataataatgatcccgttgtcatccttaatcagcaccttatcggttgaatggatttcaggaacgttaatcggtttaatttcataaccacgttcgccaccagtaccaccagaagtgtgagttggttgacctgaaccatccagatcgttgttgttcaaaccgaaatcactatctgcttcgtcggtagtccatccagcaaggaacattccttccgcataacgtgtccagataccaaagcccatataatcgcctgggttagcatcgttgtgcgcgttttcgtagattgtcccgattgggtgaataacgtcaaagaacgcttgcaaatccagaagacgaccactaaacggttctgcgacttttcgcgcggttttctgagtcgggttgttataatcggtgtattcaatctgattaaccagcgttacttcttcttcgttattcagataaatcttatcggtgtgttctttaataccgcctacaccgtcccattccattacagtgccgatatcattgttgaaccagcgaatagttaccacatcgcgagtttccagaggttgagcaaacttaataccagtaacctcggaatcaacaaaaatcagactgtaatcctgaccagaaggaacccacaaaccggagtttgcaatacagctatcttcgtcataaccttctgcgccctcacaaataaatgtcgggagatccgcatcacctgctttaacaagctgtcgaccgttcagcagcagttcgaacgagttcgggttaaccagaattcgcggactgataccaaattcagcagtggtgaatgtgagtttattcggcagatcgccaacccaaatttcaccagggatacttacctgttcggtgtcacccgtgttatatacgcgcatggtatgcgcttcatacgtcgctcgccatgcggcaataccatccagataggtaacgaattgaagcgtatcaccagcgttacacgggtttttaagacgtatgtttacaccatccagttcgatcagttgtccggcgctcgcaccaggtgaaccgtaatcgctgtttgatgcattaaacccgttcttgtcgtcgatgtacagcaagttaccacgatagtaaacttccagtgcgcggacgttgtaagagttaccagggccaaacacattcaggaagtcagtttgtccctgagtcgcgatataggtttctttcgctacagtagccagatccgaagttgtgattttgtcaacctgtttgttttcaacatattcccaacgaccaggagaacaataaaccagttcgacatccatcaaatctttgtacagttctttgtagttcggtgaacctttgatggtatctccgcttgcagggacgatacggacgttgtttgccgcccacttaccccatacgtcacgtaaacgaataaccttgttataatcgcttacgctgcctttaggaaggtttaccgtaatacggttgttgcttgtgttcagcgcccatgaatcaccaaagataggggatagcgtaggcgcggtatgcgttttccacgcacccgctggatgcgggatactcccatcacccagcttatcatacaattcggtaaagttggcgttagtcttctgaccaccacggcgcagataatcacctgcgccatcgtcaaccacgttaccgataataatttcttgtttcatgctgcgatccctgatttgatggtgtcaaccgctttgatcgagaatttaatacgatcttcggttttcgattgcacgtttgcgtaaacaacatcaccagcgccaacagtaaaattaagcgtatacatttcatcttctgtatttttaagaactgcgtattcggttgaataaacgcccttagccacacgatcgacggcaagcagaatttctgctgttttattgactgtgcctgtcatgttttccgcgtatacgagaagtttagcgccgctaaattcgctatatccaaacataggaatagccgttggtgatgctttcaaaatgagtttggtagtatcaacaggcattgtctttgaaccaaacattgattcaacagaataatcccatgtagaaacagaaccttctttcttcacacaccagattttaatctgagtatatggagaggttatgtaaagctgatcctgaacccctttgataccatcgccaacttgcggacggaatacaacaggacgatcaacagaaatgctaccgttactatttatgaaatagaacccttcgccgggtttacccgatggaagcacgaccgtaatcgggcctgttgaggtatccatatcatgcaatgaacccagttcgatcgggttgcctgaataataggttcgtggtagtttctggaaatatccggtcgcgtggagcagcattgtacccacaccatcattcgcagtcaacaaacgcacatcaccaaacgcgttgtacatgttggtgatgatttcgttaagtttaacaccgccgtcatacagcgggtcaccagttgacgggttgccgatctgccccacgtcaattaattttttaccagtttgatatgccattatggttttccttagaattcgaaaataatactgacttcttcggtctgatcaggagaacgaataatcggttgacggttttccatgtagatcatttgccctgagtcaagttcaagctgttctttcgtgtaatactgccccgttgcttttacttctggatcggtcggttgcgcctttttcagtaacgggtttacaattacactaacctgacggaatccacggttgccaggtaaagatgcttgcgggaagaacagggaatccatgtacgcacggaatcgcattgagtgaaccttcattcggaacaccaaatcatacatatctggataccacttgatcacgttgtcataaccccagcgaaccggatcttcttcgagttcattcgggaacggaacaacgatatgttcgttcgtgcatcggttaataaccacatcaggcgggatcgtgtagagatattcccagatatagccgtcacccatgtcgataccgttcgcttctccgcgtggaggttcgaccgattcgtgggtcggtgtccaaatgccaccaatgcgcacacattcaactttacccgtgatactggagattgagcaagaaccaatatcaggaacgtccacaacgcgatacaccatccatcctttaccgtaatcagtacggttataaggagcggagtttactaccacgatgtcattaatgtaaaagatttttgggttaggatatcgagtatcgccccagtctttacgcggaacgattgcatcaatcatttcgcctggtactttcgtcatcccgatcatatgcgtccacatatcaacgataccatctgtatcatcgttaggataagggggcgcgaattcaggatcggattcgttatccgcccattgttcagtacgcccgatcgacatatagatcgagttatgatcggggtcatccccgatcatttcgcgaaagttcatcatgttttccgtgcggaacttaccagttacaaccgcacggtagatgttttgttgagccattatgctacctttctctgagtcggtggattcggatcgcgaggattacccgcgtcgtctttcaatcgtttttccactaagttacggaactgagagtatttaaccgcagaactatcgaacagaggactttgatcaaatcgacgcgcggaaggtaatacaccattcagcggttgttcttcaacgtcatattctggtggaacatcgaacggttgccccgctttagggtgtggttcgtataatgcttcgcctgttacgaggtcaaatgtctggtttccgttaccgtccagacgggctacacgatcaggccaatacttcggataaccgctatcgaagcgatagtttcgaagaatatcaatgatcgtttcgctatgtgtcatagacaaaccggagttaatgaacaccgttaacatggtgatcccgataaaaccaaagcctaccggatgcacgaatcgtaaaacgtcatccttatatcgtgacgctggcagattcgaacgaattttcatcacatagtatgaacgcccacggttgaaatagtcgatcgagttgttcgccatttgcttaccacgcacaccgcgcagaatagttcccgtgaagttagtcttttcagacttgacaacctgcccttcaaggaagttcccgatcacgttatgcagagtcattgaccagcgtaattgaccgtcatcatactggcgttcgatatacgtcacgtttgctcttgcagttggtgtgtaaatcgtccggcctacgatgtcctgactaatattcgttgactgaaccagaatatcatattccagagtgttcgaactttcgatttctacggttacatcttcgttatacagcaatttgaacaggaatttatagcttgcttcgatgcctttcgttgagtaaaaatcactgcaacgagattcaaagaaacgtaccacttgatcgcgcttcgttttatccaggtagatattacggcggtttacttccgaccacagatattctacgctgttcttctcacgcggatatttgttcctgatcaggttcagcagtttgttatagtaggtgttttcacccagcgaaacgaactgcaaataatattcaccgaacttctcaaaatattgctgatccagatagctttgaggcgcaaagcgcgtaatcatatggcttaaatctgggtcaatcaaaccaggtgacagatccggtgtatacggtttttcgcgttcctgctgaatcagatcggcaatcagcaacgtgttatctggtttccagaaaatagttaagctgtcacgggcgcgataactcaattcaaagaacccaatgatttcgcctgaactcttatacaacaacacaccgttcgtatacttcgtgaatccggtaaacttaatgttgttaatgtaaatcgtaacatgtccgcgatcccatacctctttgttcacacgaagcgatgacgaagggccagcactatcggttacaaggctgtaggtgattttcggatacaccaccagaggacggttatcattagtgatccatgtgcgcacagagtcgcggaagaaccagctatagttcgcctcgttgtagtattcctgcgcaccaaatttccaaacagtcgggtcgtcgatatgagcgcgaatcgtcgcaaagttaatcgcaaggctggcagtatagccaggacgcaaatcatattttacagcaccaaccagtgcagggttctcgatcaataattcaggatcgggaagtgtgcctggatatttgtagttcgctacggaaataaaaatctccgtgccgttcgttgacatattggtgtattcatgctggatataaaaacgttcttcctcggtgttcccatacaggcgcacaaaggttttcgtgttttcttgccattgatacacaccagcagcagcggacggaaccacgttagcgggttttgtaggatcttgcagagcggttttcacttcacccgttacgagtgcatagagaataccatccatcacatccattttcttgacaacgatcttatcatttccagggacaactgtatagctgtcagtatcgaaaatcttttctccgaacgttggagaactcggatcggtgtcgatcggtgtctgtttcagtgcgatacgacgcacaacgtttttagcaaccacatagagccagtcatcggaacatgccattgcttctgcatatttcgatacgttaccaggcagtttagcaaatgtgttgtatgagtccacatcgaaatcaaggccagtctggttccccagtttggcaaacgtaacatcatcagcagagaatcgcacatcgtccgcagaccagcgaatatccgttgaggtgcgcccgtagaagatacgatcgtaacccagtacataggttgtgtttcggctttggtacgcaacagagcgcgatacagggtttcctacgcggtcgttaaacgccttgtagtaatgccatgtttgtcctttgtcgtttgacaccttcgccatgttctgaaaacgttcaaacaggtacaataaaccgtttgacgctaccaggaaagttctgttaatgtcattacaaacgtgttcaatatgatcctggatttcgtgatagttttcttgtgtaagaattttatcgctgatctgggatacgtcagtgtaaagtggagaaaacacaaagtcttctttcatcaacgctgccattaccacatctgtattaaagttaacgtagttctgattattttttgcgaatttctcgtttatgaatgcatcgcttggcgtaaattcacgcatggttgaatatgcgtaagcgttaagggtaaacgtccagagttcatctgtataaacccagtcagacggttcaaagcccttgtgcgtaaccatgacgcggaacttgtaaaaattgttgggctgaacatcggaagaaaaccattcgtttacataagcataacccaactggaaccaggttaaatcttcatctggaatagttacaccacctaccccgcgagtttctgccatttccacgacatagtaaaaatccatgccgacgctatcccacttcaaataaacgaagttagcagccagtttatcaacgcgcaaactggtaattgacggcgctttaatcatatgtttctccaaatttgcgttttacttatatcccatatttagcaaacaaaaaacccctgccaaatgacaggggttgtaaattattgactgattggattcatcgtcaacgttgtatattgaggacgtagatcgttttcaaatacaatcagagaaccatcacgggtgaaaatgttctcttccagaggtgtaccagtcagttcgatgtaagcagcgctgaatcgctcggatggaacgttcaggacaccaagatcgaaactaatgaaatcattaaaatgttccacatagccgacttcgtaatatttatcacgatcggttactccaggatatttatcaaaatcgtttcctgtataggctgcgataccgatatcaccgtttttgaatggcccgataaccattttcgcgagtccggtcgtggtgttcatatctgttgacgcatagcgcacatcatacgaatcaccagcagcatttgtgtacttgaacccattcgaaacaacagaacgtgatttcacctggtttaagaagtgaataccagacatcggggcgctgtaatagttatccagttcacgcaatagctgaatagtcgcagaagaaccaatgatcgacacgtccgcgttatcaacataagtcaacatcttggatttactgaaagatttgttgaaaatttcaacgttatctgtgtagtatctgtcaatttcattgattacttgaccacgcaaccattcctcagactcgatcaacttactgatatcatacgttactttaacgctttgtacaatatacaggtagttcgggtcaaggatcgacggcgtaatagtcgccaggttatacttcgccagatagttttgcatgtcctctttttgaacagaggttaagcgcaaccctgatttcggtttaacagcgatgaacgcatagccaggtttttctttatcagtaaagcactgaaccgcctgaataacagaaccgaaacggtgagacaggaacgattcataatccgatgcagtaacacaacggcgctgtgtctcacgcataataggcgcgagttcacgaatacgttcgatatcttccggttcaccaccaccatcagcgcctacatagtccgctgaatcagtcgggttttcaacaatacttgtaatgctgatatttgtcaatgtatccacataaacaaagttttccgcaccattggcttcttcgccattggttgaaatatattcaattacaatagtcgaaccgtttgcaggtttcaagcccccgatgtaatccgcagtcagagcaccacctgcgacctgttggctggtttcaccttcaccaaagtaaacttcggtatgtccatccacagtttcacgcatgtaaaaaattgttgatgcgcctgttgcgtttacgatactttcgtttgtccagtcatcccattgagcaccgttgacagtaacgcgaacctggctacggtcgatgttcggatctcgaaccagaatcgtagaaccatcatagatgacttctgtacggactaaacgcccctgtacgatgttcagcatcgaaacatagttattgtctttgtcacgaacgatcaccacgtcatcagatacgacgaacgggaaactgtttgtttctttcactgtacctatgaatttcgtgccgcgcggaatacggatcgatgtcgggttcagtgggttcttcgcagtgatcaggatcgcagtatttgcagcggtgcgggagtccggcatatagcccaaatcctgagcctgttggacaacagaactacgcaatgcagcggtacgaataaacgattcgaacagtgcggtgttactcatttgctgaatgtacagtgtacagtatgataacagatccacaagtacgttcatgcgtgagccggagaaatcataatccttgaattcgtcctgaccacggagccagttgattaagtcagatttgatttcgtcaaaagtagccccgacaaagatatcggggatctgattaatttgtttctttgtagtagccattattacccctcgttatcgggtatttagtattgaaccatagggacgcaaacactaattgaaccgaatgtgatcgcgagtccgattaatgacaataatttgtttacgtattgagttaccttacttagagcaagcgtacaaatctggttataaatcaccttgcatgtgtccttaaacgagcgggaactgtcaacaaagtttttatatagcgattgtgcgcccgtcagcgcgttctcatacgtttttaacaggtcatcgaatgcaaccccacagtaacctaagaactggttaatctgagccattacaggcagtttcttgagttcagccattgccatgctgtaggtgtctttcatcccattttgcagattagcaatctgtgctttgattccctcatatgcggccttagtcgcattcacagcagcgttagcggcatcaagtgcagcctgataagcagcagtcgttgcttcctttacaggttcccacatccagtttaggtactgatcgaacttacgtttaatcgaatccctttcctgtgtctgtgctttcagggttttgaataattcttgtccctgatcatacagtgcggagatctgcgcataggatgcatcaatgaacgctttcactttcgcttgtgcttgctgatacagatccattgctgtaaaccctgggaagttaccgcccagaatcacatcaagcggtttaatctgccgcatgatgtttcggatagccagaaccgcagaccaaagcgggtttggtgtttcaggaggcattgaccagatctgcatcatacgcccgtacaaatccaccagagcaacgcaaccattttggaacatagtcaaacaccagtcaaataacgcactacacgcgtctacaaggtcgcgagcgccagccttgacgtattcaacggcatagttgtaagaactgcctatagccccgtagattgcgtttatgacgctttcatacgtttgtgcgccggaatcaatcagagcctggaaagaatctttcagggattgaaccgaactatcaccaaacaccagatcgtaaatgttgatcgcaacacccatgatcgcaacagtagggaggaaattcttgatcaaatcccacgccccgcccacgatgttaaacgcagagctaatgatctgtcggaatactttcattgcggtttgccatgcttgctgtgacaatgccagagcacccgctgtgatttcttccatcccgatcgaaagcccgtcaaacatcgtcgcaatgcccttaccgttcttaatcgtacccgtcagcatatcaaaagccagcttgaacgttttacgagtctcgttccacgcagacagcatagcatcactgatattcgtatacgggaaccctacggtcgccggaatacagcccaatccagagcgagaagaaaacaatctggcttcactcggtagcgccccatacgttgacgggagagcaggaggaaccggaggaatgctggtatctgcgttcgtgtttactgacatccctgtatatttgcactggtgcgcgggggattcgtcgtgtttcatgtacgcaatacgattaccattccagtaataatcaatgctggtaaacgcgcctgtagtctgattgtatacctgtcggattcgctgatcgcaacgggggccagaagtcagcaaataaccaccggagttttccaccttgtacatcgcgagttcgccagggttcttgaacagattcgcttttgacagatccgccccataccagtcattacccgcgagcttagtagccccgatagattcgatataggcatcaatatccgcttgagtggcgaaataataaccaatcttcgtaaccaaaatgtcagtagaaactccagggcttccatctggatttgtgggtacgtttggagagttcaccaccggaagcggatcgcttttctgcccgaaaggggaactcgtatacaggtgagttccgatcgggatgatttcggtcgcccattctaccccaacagcggggtaattttctgtgtgtccctgccagataacgcgtcggtaatatccagcagggatctcagcatcgcaaggatgctgaaaattttgcataatcccatcaatgatggtttcataatccatgatcatgattaacctacctggactgttccgccagtgatcttagtcagtgcgccggaatcaatgaaagtattattcgatgctcgcatgttgatattacgtgcgccaatatccaaatcttgctcaatatcaatcagagcattttttgcggtaattgttgcatcttctgttacggcaacggttgcattctgtttaacgttagccattaaattctgattcacgtttacggttgcatctttttcaacggttaattctgcgttgcctttaatcagccccacatattcaccttcaacggtttgatttacattaccgcgaacgaactcggtcacgttaccatcaacggtctgttgaacgttacccatattgtaaatgaacgcatcaccctcgataacaacctgcaaattacccttaacgtttaatttacggccttgcatgacgatttgataatcatcaccaacgattttaacaacacgggttccatcagggcgaatttcttcgtatgatcctgctgggtgaacacggttgtaacgttcaaagcctggtgtatcgtcgaattcctgaatgtgtccagaacgggattcgaataccatgttgtatggatattcagcagcgtatgcggatttaggttcctcgaacattacgcgagtatcaccaggaacaaaaggatcttctggatttgatgcagccaacacaacagcattgtatgcagcactcaatgaacgcccttctggatctggaacctgaacaccgtatgattcgaggttgcccgtcagcacgattttagatacgcgtgaagaacgtcctggtgtctggttagcccatgttgagtttcgcagttcgttgtaagcggtttgccagtcctgacgcttcatagcagccagagcattagtaaatttggcaacaccaccaacacccatctggaagcacatgttttcgattgccatttgacgaggacggtttaacgtcacgtatacttcgcgaacgtttgaagtgttgctgatcccctgccggacttttgccaaatcctgagcaaacagcgttgaaacttcttctgctgtgatcgttccattggttacttctcgaccaactgctttactgatcgcggcgttaatcttcgcagtatcacgggttttttccatgataagcaaatgcccgatcccgatagtcggataaccttcactatcaatataccattttgtgcggataccttcatcctgtttaagcatggtttcgatagtgaacccgccagtatcaggacggttatcttctgggatctcgtcaagtgggcgatcatctggattgacagctaacgaactgttagcatcacgaataatcacgctcgaagaaccgcgcccctctgcgccaccgcgagccagtacgttgacatcgttacctacataacgaggatactcaccaaacgggtcacagaagcctttctgggtgtccggcttctctcggtactcacccgcaaaggttcccagtataacgccgtcctggtgccatttatcgcgccagtaaccgataacgaaactaccgcgcgtgataccagtcggggaaaaaccaacaccagaaatagcggcgctgcgaatatcctgaataggcatcatccacggcaattcctcaaccggaataccgatagtttcagatttttgtttctgtgccggatgctcaccgaatacacgcacctgaacacgccccaatagacgaggatcatcgacttcttcgaccaccccctcaaagaaaggggagtatttatttccaccgtatttcataggtttgccttttccatttccttgatataatcacttacaaacgattgaatatcagaggggttaataatcttgatggttcgttttgcttcattttgaagcaccgcatcttcataaatatctacagggactaatgttccctggtactgcaaataacgcatgttcttatcgcctttgtcataccaatgaccgggattcgtagggtcttcaaccaaattgtaataacggttgcccttaccatccatatgataaagaacctgttcaccacctgcttttgaataacgctggatagcgcattgataagccgtttcctgatcggtaatccatccgtaaaacggatcgtaattatcgttaagcatcaggataacccagtagtattgctggtttccgtatagcgtttccgctaattgttcgggtcttaatgaacctgtcagttgatatgtacgcggcttataattcctgatcacgcggttaaagtaaaaacgataatcgcggtagatatcagtagttggtgtgcctttgtaatcaacaggcgggaagaatgagaacaacattgtaatttcccctatctaatgtttactatatttaggatctaaaatggctggaagacagacatacaaggggtcttttatgccccagaacatacagaaatataagggagatccgcgaaagataacgtatcgttcaagctgggaaaaatatattatgaactggcttgacagaaacccgcatgtgaaacgctggaacagtgaagaggttgtgatcccttatttcagcaacgcagacggaaagcgacggcgctacttcatggatttctatgttgaaatggataacggtgtgacctacctttgggaagtcaaaccgatgaaagaaacgttgcccccacctaagccagcgaacaacaacgttcacaacaaaaagaaatttgttgatgcgttgtatacttatgctgtaaacattgacaaatggaaagccgcgaatgcagcagcaaaacaaaagggctgggagttcaagatcatcacagaggacacgttgaaacgtgtgttcggatggaaagggcaataaataccctaaacggagggaattatgagctttatttttgagttcgagatcatcgcagaagaagacaagccaaaaccgccaccgaagcgaaagctgggtgaatgggttgaacttggtatcaaattccgacgcgcaaaattaaaaggcatgacagccaaaaagttcgcggacgaaaacgggattgcatacgcaacgttcacaaagtctatgcaccgctacaagcagcagattgatgatgaaatcgaacgccgtacagcagaaaccgaagcccgacgcaaacgtaacgactatcgcaaaaaacacgcggttgatatcgtaaacgatttccgaaacagtttgaagaaaatgactgttggtgtaaccgctgcgaaacgtcagaaggattcgaccgattggtttggtgatttcatcaaaaccagcattaagacgcacagggttgcgaaaccagcaacgggtcgcttgtatacgttcatctacgatgcgaaatacaaagacaccctgccatactgggatcggttcccgctgatcattttcctgggttcaggacgttcgaaagcgggtaacttggttctttacgggctgaacttgcactatgcgccaccgcgagcacgtcaagagtttttagaagaactcctgaaacgtggctacggatcaacagatcgactttctaacaaaaccagactgaaaatcaactggaacaacgtgaagggaatgcgcggggctgatcaaatgatcaaagcctatctgccagcccatctacgttcaccacttgcagagatcgccccaaaagattgggcgaaagcagtttggttgcctacacaggctttccagtccaaaggaaaaccatacagcgcgaagaaagtttggaacagatattaacaataaagccccaaccgaaaggaaggggctttatttttacaggatactcacgatttccgcgagtttgccaggggttgcgccaggtcgaaccttcatcgcatctttcaggtttttatcaaccatcttttctgcttctttttcgttaaacccacgtttcaccaacacagcaataactttttcgcgaatacctttagcggcttcgttcaaatcttctgattcagctagaaccagtttagacagaacatcacctttgtattcctgggtaaagcgtttacccgataccagacgaggcttaccagaggcatctacaaccgtaaacacggcgtattcgcctgtagctttggttttggtacgtccggtatacagcaagcacatatcgttacttgggagcttgtacacctttcctttcaccaatgcttcatccagaggcagatcaatctcgaaatcttccgccaactgattgtacagatccaggttttcttcggcttctttgtacagggaagcgcctttgaatttcagtggcttgtcaaatttcaggtcatcagcaggatcaccgctgtagaatgaaacagtgcctttcgcccagtcaatatacgctgcctgagtcttgccagtggttttacctttcaggcggacaacacctttaccgaagtaagcgagatcgtgggagtctggcgcatacacatcgtaatcagcaccatgtgcaaaatgcaggaaaccgatctgaccttttgcagcgttaccacggtcaaccagatcaacggtcttagcaaattttttgttctgaacagattcagaaagtagttctttgaatgatttcatgttttcaatctcttttgaaagtataggtatagtatacctatttattgaatagatcaactaaaaattagatcgcgagcgaagcgagttccgtcaagcgaagcgaagacggatagttaacgattgtataaaaagtatacggaaatgtactgttttctctatatataaaatataaatattataaacagtacatcgtacataacactcacttcgttcgtgtgttcgcttcgctcacggtcttgatctaaatatctataaaatggagatcatcatgaatacaactgctatgatcctgaaccagatttcacctactaacttcatgttagatattcctgacaatgattatgtaaaagggttgaaactacaagttcagggtgttacactacctgctatcaacattccaattacggatgtcccactgaacccaatgattcgagggaagatcccaggatctgcaatggagttcgatccactgactattcgttttgctgttgatgaagaactgcgatcgtatcttggggtttacctttggatgctcggtactgtcgattttaacaccttcgattccgtgcgttggagtgaaccacaacaggcaatggctttgcatatcctggataactcgcagtcaaaaactgtagcgacatttcgcttctatggcgcttggccctccaacctcggagagcttgagcttatgtataccaatgattcggatgaagccgtatcctgtatgacgatgttcaacttcgctcacatggaaattgagatcgacggacgggtgatcgtgcctactccacggaaaacgcaaaaatgatttatggtatttgtggtaaaaagcgaacgggtaaagataccgttgctcaaatggttgtgcataacttccgcaatgttgaagttatcgcgttagccgacgaaatcaaagctatcctgaaacgttctatggaacatcacgataacacgcaattgcgagcgctggcagcgaagaacccattctatgagggtgatcgtgaagccccgctggtgatgtccaataacgatgcatacacgctgttttctagcggtatcaaaaaattaagttctcgcgggttcttcatgagtaacgcagatgttatcgctcataaaatttgcgaagaaaacacccagccctggacgattcgccgtttgatgcaggtgttcgggactgatattgtttgtaaagtagatccgtctatctggacttcaattgcgcttcaaaaaatgttgaaatcctacgcggatcactttatcattaccgatgtgcgtcaaccgcacgaatataaatacctgagcaagttcgggactcgctttgtgttccttgaacgtgaaactggtattgaagataatcattcaacggagaaaggtttgacacctggcttgagtgattatacaatcctaaataatggtacgttagacgatttgaaacgcaacgtgcttaatgtattcaatcttttaagagtgtaaacaatgactgaacaaaaccaaacccaacagcttcaaaacgatgtcctgatcctgaaagcccgtgtattcgacctgaacgaaatcattcagggtaaagaacaagaactggcaaatcaccgtcaactcgtaggccagatttgcggtcttctggaaatcgacggttcgcagggtgtatcccctgatgccctgatcggcgcgatcaaagcacttctgccagcaacagtagaaatcgctggtgataatgaagcgattgatgcatcaaaagcataattaacgcttaggcgtttaaccactgggggcgaaagcccctttttcatttggagtacacatgaaaagttttattgaagtagcgaaacccgtagttgatccggggatctatatgtgtgcgaagttcgatcaggcttcctgtgaagcgctcgcgaaggtgcaaaaacttctgggtgtagagaatcctgtttccgctgcaaaactgcatacaacgattgtgtatagccgtaagacggttgatctgttccctgcctccggtatctctgaacctgcccgactggttgacgtggagaagtgggaaacgaaatacggtaatacgatcgtgggagttctggagtctgattatctccatagccgcttcaaagatgcaatggatgctggagcaacatacgattatgacgattacaaaccacatgtaaccctcgcgtatgattcccgcatcgaagatatcagcggagttaaaagactgttgacattgcccgtagatttgactatcatccgggaagatgctgaaccgctggatctggataagaaagtcgaagacatcacggagcacatcgaacatcgcggcgataagtgggttgtgctgaaccacgatcgcacaaaagaacttggtgaatatgattcgaaagaggcagcggaaaaacgtctgcgtcagatcgaatactttaaacataatgggtgatttatgaacagagcacgattaatgtatgttatcaataacttacgcagagaagttaaccaaaatttcagtaaagcgttaagtgaatggtacgtgacaaaggtttcaatgactacggatcacatcgcagaccgattcctggatcgttccgcgtcagtcaaaaaagactttgcgatctacagtgaaattcttaatagtctcgctaatcattattcgtgtaacgttctgtattacgcggtgaaagcgaaaaacgaaggtatgcaggaagtcattgcatatcgccggattaatggcaaagtgtttgcctgtgcgttcaccgtccagatgttcgaaaacatggatgattcggttgctcacgaaaagccagtgattgctttacgattccgaaccgttatccctgagtacacgttgagcctgaacacgcgaaacgcgatccatgttaattacatcgcacctaaaatcaagttcgagtatgacggctacagacgcgttatgtcacgcctggatcgcctgattgcttcaaaagattgtccgcctcaactacacatgttgaaaaatatttgaaaaaagcccttgcattcgtgcaggggcttttgttatattaggggtgtcgaaacaaaggaggcaatcatgaaactttactggctggtgttctcaaacgggtttgtaatgaaaggcactgttcactgtgcgaaaacttattgcaaatggaatgaatgctctttccgtatcctgagcgttgcatcttctcaacctgtaggggattactaatgactggtgataagtgggttgataaaactttgttgttgacagtaatctactttctggtaaaatacctggtgtagacaaaggagggagttatgagaaacttactgaatatcgcggaaatcttttgctatggtgtcgctgtgtatgtcctgtttaacggtgacggcgcgggatactggatcatgttcggtggtggattgttcctctctttcatcaaaaaattttttaagtgagaaatatactatgcgctcaaatgtaccgaaaaacctgtataccgttattgatgctggttcgattcgtattgctgatgtaatggcactggtcgaacgcttcgatcgttcaacaacgctggggcaactgctgagtatggttaaatcccagtacccacacaaatgcccgaaatgcgagggtaaagggttcgaagtcaaacgtgttaacacgtatccttctggcttaccggattctggctgggttgatcagatggaagacttcaatgttacttgtgatatctgtaacgggcaaggcttcactacagatcgccttatcgcaaaacctgtcaaagtggaatatgtacccgcatgaaaaacaaaatctatgctcatatgtctgagcacacaacggttcgtgttatcttggtagatgggccaatagctcaagtagaaaccaacgataaacctttctcgttgcctttacaaaccagtgtcggtactttcgatgaagttatcgaagaattgacaaaacatgctgttgtttatctgtgggaagcgcaaagctatccgtacccgactcctacaagtccggcgtcagaagataacgtaaaaattcgttggggatatattgaatgaaaattaccgatctcgtaaaagcggctaatgcgctggtgacaagcgaacattacgccaactactgcgagcaataccctgttcccctggaacgcgcaattactcaatccggttatgacggtatcagtaccgtaaccgttgaaaacctgaaaacgttcatcgtgtttgctaacacgttctggatgtacttacccgataatatcggaattcgccagcctacattcttcacgctgtgtatgttctgcgaaacctatctcccagaatgcgaggattacgaagaacattatggaaaaagtgaataaagtatccctgatattcttcgatccgaaactcggtatcacgttctgtaacggattcgcgccgaacgccgaagaaatgttcaggattgcatttagcaatgaacctgataaactcgataaagaagtgttggcagagataaacaaaactggtacgctgtattatgcccgacgcaacgacattgtgaacggcattcagtaccaatcaaccctcgaaaaactcaaaactgaactgaaagaaataggtgaattatgacttctacagctattcaacaacaaaccattgatcatgatgctgaattcgcacaactgatcaaagaacataacgcttttgcggcttctcgcgtcaatgaagaaagcgaacagacccgccgatccctctgggttgccatttaccgcgaagtgttcagcgagaaatccgctaacaaacacactcaggcagttgatgcagcagataaagcgctggcagcatacgatcgcaagttcggagcacagtaatggaacggtctgctggtattctctttctgaataacggcagcgttttaatgggtcacgcaaccgaaacgcctcattgggacatcccaaaggggcatatcgaaaaaggcgaatccccgatcaatgctgctatccgtgaatgcttcgaggaaacgggcgttgtagttgaacaacacgaactgttgagcctgggtctgattgattatacgagtaaaaaagagcttgtgttattcgtatatgtgggtaataattaccccgaagcagaaaaatgtgtttgcgcttcaaccttcgttaaaaacggtcgaaccattactgaaatggatgacttcaaatatgttccgtatagccagatccgcgatcatgcgcgtaagactatggggaatttactgactaaacttgtgggatatacatcatgaaacaaaaagcaactactttccaaatctgccaaatgatccttctggctaccgcaacccgcgccgctgaacctatcgcgtataagtcatggggtgattcattcaccgtgaaaaatattcgcgatcttccaggacgcctttacgcttcccctgatttcgaaccagtcgatccaaatgacctgactctggaagaaatgaaaaacctgggcttccgtaagtgggatgacgattcaaaaatgatgctgatccctctgtatctgttgccgtacctgaaagatggtttccgtgctatcagtatcagcggtgaagaatttgaattcagcactggtgaatcagataacgatcatcgtatggggctgctgtcattcggtgcgatgcctaatgagtcacgttgatttcaacaccttatctcaattggggttgatctggaaaatcaataaagatatcctacatcccctggggctggcgttgacgcgtgatcctgaaactggcgtatcggttggtgcgctggtttccgatgatggtgtctggtcgttcagcgaaaaatcagactttgagaacatagcaaagctgaataaactttatgctttacaggccgaaggaaagctgttagagttcttacaacaaaacgtgaaagagtgattatattatgaatggtgaacgtgtaattgtcattggcaagtcgaagcataaagctaacgcgaagggtgatcacttgatcatcaacaccgatcgcggtgactggtacggtgcaacgcaagtaacgagtggttatgcaaccatcgttgaaaaagatgcagttcgtcccgcaaccgctgctgatcctggttactatggaacccgcgaagagttcgaaagtgaaaaggatcaggagatcgcagaactgaaaaccaaagttcacaacgcgcgggtgtatgcggtgatttgccttaccgttgcggctatcaatactggtttgttgggttgggtggtgaatcatgtctaaagatgatattccggttcataaccgtatccgcgatcagttaacttttcgcagtcgcgatcacgcgatcatggttgggagttatctgcattggtggaagaataaagatctggatctgaatccatcttatcagcgcccctatgtgtggacgcagaaagagcaagatgcgtttctgactaccctgatcagtggtttcccttgcggtatcatcgcgatcgcggttgatagccagttcaacgaaactcactgggtagaagtgatcgacggcaaacaacgcctgacgacgattatcaaagtctacgaaggtgaaattgggattcctatgccggacggttcccgtttgttctgggacgaaatgccacgacacgaacagcgagcctttgaaaacatttcattacctgccctggggctggatgaatgcaccaaaaaggatcgtctggaattcttcatcaaactgaacttcgcgggtgtgcctcaatcacaagagcatatgaaccgcgtccttgaaatgtataaggctgcaaaatgaacaaagacgaagaactgtatatggattcagcagaaccaaaccagtttatcatcggcaaagaagatcatgaactgttgcaagcggttaaaaacttgctggcgtatgctcatatccgcgtacctaacggcgataacgcaaaactggaaatcgcgtgtgctggttacggttacatggctaacgctgataaaatcattagctattcagcatccagaacccgcgaattggttcattatcgtgataaattgagtgaagaaatccatcaaactcaggtaattgtagaccagttgccagaaaaattcgattaaagtgaaaaaagcccttgcagcaatgcaggggctttgttatattacacacatcgaaacgaaacagagaaaggaaaacatcatgaacatgaacaaaaacattgccgctgtagttggttgtgaagtttctaatgcagaacgttatgacaacggtttctctttctgtgttccgactgaactcgatgcgtacaaagccgcttacaaataccgcactatgccgatggtaaacgttacttacgcgccgaacatcgaaatgtggctggttcaggtttacaacaaagtatgaacttccacgaacgcaaggccgcacgaaccgattattacatgcggttcgtgtatggctggaaattacggaaatgtgttgcatgtaacggatcggggcgatatgatagcgaccgatctccgaaatgcagttcatgtaatggaaccggaaaagaacgctttaaacctgtgaggaatatattatgcaacatgtgaatctcaacccaaaaatggaaaagtatctgaatcgccgtcatgacaaccaggcgcaaagggatcaggaacgcgcgatcaacattgaaacggctaaactccttacccagatgttccgtaagtttcctaacaaatttccatgcaattccatgcattcaagtaactgtatcagcgtagaactggctgataagcgttgtatcagggttaacctggcttacgggttatccgaagacggatataacctggtgatgggctggacatcaatgatcggtaacttcgttgaacagaacagtatcgagttcaatatgatgcgctctgatatgttccagtgtccggtcgattcaatcaatatcggtagcctttacgctatccttcgcgcacaatatgatttgtggagtacaaaatgaaagtaacaagtgaaaaacttgaagaaattgaaaaatcagcccgttcgatttcttctatgatgggtagtaagtggactctcgttgaaaatatgagcatccagggaaatcaggaatatggtttcaggggtaaagagtataaacgcgcgttctcatacggtgttccttatggcgatagcccgacacagattaaaagctgggaagagggtctcggaaaatatctggaaaccgtagatccgcaaacggttctggatctggttagcgatctgtcactcgcgcttcgagacaagcaaaaagcagaatcagaagccgcgcactggaaagcaaatcacgaatgcgaagtatcccgcgcccgtgtcctcaaagagcgccctgatatgcctctggagcgcgtcaacgcatacaaccgtatggttgagttagaagaggaaaacaaagccttaaaacagcgtatagcgagcctggaggatgtcaatcaaacccgcatgatgttgcagatgattcagggtatggtgattgataaccaaaacatgaaccgcgaacaactgcgctactggcaaacacatttccgcaatcctaacgggtggtaatatgttcggtaaacgtaaatgcaatcatgttgctaccggatggatgcggggaactccttatgcatggatgcgttattgggtgactgatgcaatcgggcgtatacatggcgatatgtatgcaacatgcgacaagtgcggggagaagtttttgatgtgtaagatacacgttgaccacgcgatccgtgagctggcaaaacatccaatcacccgcgccgaaatccttcgaatcctcgaagaaacaaaatagcactttttgtttaaaaagccccttgcaaccgccaggggcttttgttatattacacacatcgaaacgaaacagagaaaggaaaacatcatgaaacttgttcgcgaagcaatcaaactgggtaacgaatacaacggcaaatggtacttcatcatttatgacgacaatgcagaaaaactggaaaaagttgaagatgcattacgtgcgatggaaactggtgcttctgttggtggtaaagtgatgacctgggaaaactactgcgacggttgcccttgctacaacgatggtttcggttctggtttctgggttgatgttgaagatgttccagcgttcaaagccgcatggaaaatcgctaagaaaatggcataattagcacgaattgctaaaactccataaccctgatctgttattgtacacacatcgaaacgaaggaggaaatcatggaaatcatctacaaaagccggaactacaaaaaagaagatgttgtagcagtttacatcaagtaccggaacgtgaaatgtgagtacagtggggcatggggttatgaaatcgttgttgaagaagtcaatgccgacaacaaaaccatttgcagtttcaccactaataccgatagccctcttttcactactgaacagcttgaacaggcttatgaactgcgcaaccaggcttttaacgcggtacgtatcaaatgagattccgtccttatatcgaattccttcgcggtatcagtgagatcctgaaccgcgaaatcaaacccagtccgttagccgttgagctttaccgactggatgcaacccccgaagatgcagcgaaagattacggagatcagttataatgttaacttttgaagagtacaaagcacagcgtgatcagttaagcaactggtacagagagatcggagcggagttaagcgcttaccctaaaaacgaaatgggtatgacgatcgaatcaatccgtaatacaccggaatacaaagcgaaacgtgctttgtgcaacaaggttttccaacagcttcgcacccttaacgggaagtacattaaactgtacaaaaaagaactggctgacgaacgtaaactgaaacggagtgtaaaatgatgcagcacgaaatcaaaacagagattgacaaacgtactttcctggaaaagaataaaacggtaacgctgatgcattactccaccaaaaacggttcgagtgagttctggcgcgttaacattgacagcaaagagaaacaccagtcgataccgttcgacaatgaaagccttgctcgcgctgtcttccaatcccatgttaaattttgagaattatattatgaaaactgtcgatatcgttaccagcatcaaagcgccgtccctgttcatctatcaacacggcaatatgcgcttcgctcgctcgaagttctacaactataatttcaacgttgatactggtgaattcgctcgctggggtgcaacatattcccacgatccagaatacgcaccattccccgaaattctcgatatcgagatcactaccaaatgcaacgggccagcgggtaaactctgcgggttctgctacaagtccaataacccgaacgggttcaacatggatcttgccaacttcaaaaaaatcatcgacaaaatgccctggcttactcaatgcgcactcggtgctgatgcacaggggcaaacaaaccctgatatgttcgatatgatggcctatgcgcgttctaaaggcattgtgccgaaccttaccattgctgatgtatcaaaagacgttgcagcgcgtttagcggcggttgctggggctgttgcggtatcggtttataaacacgctggctttgatgtcgctttcgactcggtagcgaacctgacagaagccggacaacagcaaatcaacctgcatttcatggttagctcgaaaacctatgatgacgcgtttaacgtggttgatgccgtgaagaatgatccgcgccttaaagaagtcaacgcgatcgtgttcctgggactgaaacaaaaaggacgcggtaagaactgggacaccgttacccgcgaacaatataaaaaacttgttgaatattgcctcgattctggtgtaggatttggattcgatagctgttcagcccccgctttcgttgaagcgatggagggacaccctaacttcgaacagtacaagcaatacgccgaagactgtgaagcgacgatgtttagctcttacatcaacgaacgtggtcagttcttcccttgctcgtttaccgaacgctgggttgaaggtggctgggaagaaggtctggatgttctggaagccgaagattttgtgaaggatatctgggaacatccgaaaacaaaacagttccgtaaagaactgactggcaacaaggatcataacggttgtcgtaactgtccggcttatgcggtatgtggtaaagatatgcgcgtacacaaagcccctgaaaccgatgtatatgcagtggagttaaaataatgttaatcgtatctcgtattaaatcatatgtccgcgatcgtgatattctggacgtgtcgcctttggttggtgaatctgttaccgtaagaaactatccggtgaatctggatcacgtaacctggatcgaagatgatgcaacaatcgttgttgaagggaagagacacccagcaatcacttttcacctgatctgttcaaccccgattacctgggctggatatgaaaacaaagaacagcgtgataacgctatccatgcgattgagcgtagaatgcagtttgcggagattacttactgatgatttatcaatcccataacgattcaacgatgcgaatggttccggtatctattgacattccagcaaaaccgcgtacactggaatcgttgattgaaaaatactctggaatggttatttgtccttctactgcacagttagcaatgacagaacgcgatgaaattgtatttgaatgtgatgcgaaaggttatcacaccgttgaagatatgcagatgattgaatatctctggggaatccgaaacgctgtagttcatcacatactcactgctgagaagaaagccgaagccgtgagagaagttgaacagcgcgaagagatccgctataatcggatgtctgcacaggaaaaggatgaagcatatgaagtgtatcgccgtagtcgatgaattaatgagcgcgtttaaaacgcgccgtacagatgggcgtattaaagatccgaagtcaatcgcgatcatcgaacggtacgcgatgaagttaagcgaacaggaattcacgccaaaggcgctcaatagcctgatggttctgaaactgctgatcgcttcgggtgacgatatgccgcacgatgaaaacagtgctgaatcattccaaaaggcttatcgttcatggggagtgatttactcccgctcgctgggttcgtatgactccgttatgtggaacctgatgcacctggatcgcctgatctgggaagtgctcgaagaagagggtattgtatgaaactcgatcgtgaattaagcatggctattcgcactattgaaatgatgcttgataaacttagcgcaaaagaagagttttgtgtaagtgatatcgaagcggatttagttgaatggcgcggtgcgctttacgaagcgacaaagggcaacgatcccctgttcgatgaatatgatgtgcatgaagttgaactctggaaccagaaataccgtttcaagtggcccaacgattcatatgatttcataaaaacactgtatacgtccggtggttatttgtatgcaaccagcgtaagtgtacatgatttgttgttatctcctgatggtgtttctttaccgaacacatttagtcatacaactgtatgtctgggtgatattggatctaaccaagtaagctggatcgaagccagcaaaactaaccttaaaagagtataaattatgtggaaaattgttgtgtgtattttgatggttgtcgttgttgtgttcttgcagtcaagctgtactgacgagaaagaggcacagcgtatcctggaagcacagggttatacgaacatccagttcacgggttacaagtggtttgcatgttctgaaaaagacacatactcaaccggattcgaagcaactggtgtgaacggcaagcagatcaaaggatctgtgtgctctggaatgtttttcaaaaatagcacaattcgtttcgaataactgttgacactaatccccgttgtgataatctctctcgtagacaacgaaacagataaacaaggggattaaaatgaacttactgaacgaaatgctggaaatggttgaagcgaacaaagaagcaatgaaagcgaaagaaggttgggtagttgttactgactgcttcaaaccgcaaagctggcttcctgtgttcctcaataaagatggtaacgaagaacacggcttctatgatgctgcaatcttcgaaaccgctgaacaggcttgcgatttctggtcttaccttagcggtgacaagcctttcaccaaatacggtgtttgccagtgcaaagacatttaatcccagccccgaaaggggcttttttgtaggtgaaatatgaccaaagcagaaagaattatcaatcatcttcaaaccggattcccgtaccagggagatttacagcgcgatatcatcgaactgttatcccagcatgacgggatggaagcggagataaaggaattgacacaccctgacgtgaacatattcgcttcactgatggatgatgtgatcgctatcgactcggacgaactgatctgcatcgagacaacgaacccagaagataagacgatcctgaaacaagcgtatgagcggatcgaagcattacacgatcgcctgttccagttaactttcccaaataaaaacgatagaccttgttgacatcaaaacagattgtggtaatctgtatatgaaaactaattgtgaggaatacattatgaacgcttttgaaaaacgtgctgtcctgaaagatatcaaacctggcgcaatcctgtacgaagtaatcagtatcactggtgaaaaggcacagatgggtcgaaaacatatcatcactggcttcccgcgtgaacatcgtgggctggggctgtttgttaacggaatcactgtgtatgatgattgggaaaataaaggtcaattctctctggatgatcgtaacgtaactgggcgcaaccattataatttccatgcgttgttccgtagcgaagcagatgcgcaagcatatattgaacaaatcaataatgataaacttcctcctgatgacaaacaggaaagtgttgaaatgacgattcgctggaaacgcgatcgcgcggaagatgcaatttggggttacatgtaaaacgttgcgcctcttaaaccgtaaataccctgtgtagcccatatagggtattttcataatagaggtatgtatgtttaaatttagtcagaaaagcctgaacaacctgcaaggcgtgaagccggaactggttaaggtggtaaaacgtgctctggaactctcacctgttgattttggtgtacgcgaaggtctgcgcaccgtagagcaacagcgcgaaaacgtccgcaagggtgtttcccagaccatgaactcaaaacacatcactggtgatgctgtggatctgtatcctagcgttctccctgctggctggcagactaacccgaaagtgtggttgcctgtcctgaatgcagtgaaacaagccgctgatgaacagggtgtaaaactgcgttacggtatcaactggaagaacgatccaaatcttcctattgaaacgaaatttatcgacgcaccacacgttgaacttgcataaggcgacaacatgatttcacaattctatgttgacgctgtaaagcagtcacgtaacctgcacctggcgcgaatcattgatgggcgttgggggcaagaatgcggcggggtgtcaatcttcgaaactgcgctggatatgggccggatgtcgggtaaaaccaaagcggctttcgatatcatcaagcagtcgaaagggacactgaatatctacgttgcttgtacgaaacaaatggcgatggatgaagcaatcggaaatggtatcgatcgcggggatgataacgtgatcctcctttccaaaaaacaggatttgcggacaatctttcgtggtcagaccatcaagtatcaggcaatcaacctgattttcgatgaatgtgacacgacgatcgacgaacggtttgaactggcaaaaacgctgaccttgtgtatgcgttcaagtcatcttcacccgttcccatatatccatattatccgtttgggtatgtaatgaaaagtcatggttattcatcaagaaccatacaggaagagattcaagggattgagtctcttctgagttatgtagatgttgatacatctacgggaaaagtgtattggaaaattcagcgcggcactatgtctcctggaagtgaagccggaagcaagaacgagtattcccaaattcattttaaaggttctatgtatttgcgacaccgaatagtgttttacgttgagaatggttatcttcctcctatcgtagatcatgtgtatggtgttgaaaatggagatacagcaagaaatctacagaaagcgacgaaccaacaaaacgcgatgaaaaagaaatgtaattcaaacagcagtacggggttgaaaggtgtttcttatcacaaagcaaatgggaagtacaaagcgcagataaacatagatggaaaaagaaaatttttggggtattataccactccagaagaagcaaaagccgtttatgaccggaaagcgaaagaggttttcggcacattttttaacgaaaccacataaggttaatgtatgtcaaaatacgtattagacaccaatgttttgattagtaacccatattcaatctattcttacatcgaacctgacagcgaaatcattatcaccgctgcaacgatggaagaactggatcacctgaaaagcaaagagcgaaccgctcatgaagcacgactggcgatccggcttttgtccaaagcaatcctgggacaaaattatgaagcaattacccaaacaggggtttcgttaaacttatcgaacccagcagtaccggaaagcgtaacactgaaaatcgtcgattatgacggcaccgaagaattccctctggataaacaggatgcgcggatcattgcaacttgtattcagcagggcgcaactctggtgactcgtgacattaacatgctgttgatcgcgatgtctaaaggttgttcggttcttcaatacactggcgatgactcgctgaaagatagtgatgtgttgtattcaggttatatcgacctgcctctgttctgggaaactgttgaagtcctggagtatgtcgggcctgttgccgttataacgtattcatcgcttcctgacgcggatttctaccctaaccaatacattctatcggatggtgaacttgtagggcgtgtagtggctgctggagagtatcagcttgaagtgttgcctattaagcacgaacaggcgttaaagcgtaagctgatgaaaacaatccagcctcgcgatgctctgcaagcgtcattcgttgatgctattctggacaaaaacaatgacgttgtgaccatcatgggcgcggcgggttcaggtaaaaccatgctggctgttgctggtgcaatgcacatggtaaacgcgggacacttcgcaaacctgatgtatgtcaaggcagatagccctctgtcgggcgaaatcggattcttacctggtactcttggcgaaaaactgcgtcctgctgtagaaccatgtattacgagcctgaacattctgtttaaggatcaaccggaagttgacaaatacgtagaagggctgctggagaaaaacgttgtccagttccctagcctgtattacttccgtgggcgctcaatcgggcatcctgatccgggtaaaggttcggttctgattgttgatgaatgtcaaaacttgagcaatcacgaaatcaaatccatcatttcccgttgcggtgagaacacccttctgatactatgcgggaacattaaacagattgacaacccgcgcaacactgctgttaacaacggctttgtgtatgcggttgaaaaacttaaagagtacggtcattcaagtcatgtgatcctggataccgtatatcgtgggcgacttgcagcttttgttgaagacaatttttgatcaagggggcttcggcccctttttcgtgaggtatacatgatcaacgttattatcagtccaaagctaattaccgtttgcgctaattgcaaaagtgggttagagtatgaactgtctgatgtacagaagaaaaacgaagtgttctacaacggtttcttccgtgctgctgattacatcgtgaaaaaacatatcgtctgcccgaaatgcggtagcgaagtgaaactattcttgtgaggttattatggttcaagttgtaagcattaccccaaaacaaactgcctgtcgttgtggtgctgttctgtcatacactgcgcaggatgtcaaagaaaaggtatcaactgattacactggcggtcgtgatgtgtatcgtgtgattcggtgtccggtctgtgataaggatgtagtagtatgaaacgtgaagaacgttatgtcgtgatgaaacatgcggatattgattccgcgttaagtgatagcgataaactgcttctctctgcggtgctaagtaaagttgagcgctaccgaaaagagcaacacaaagaacccctggaagcggttgttgtcgagcatgattggcctgaatatgaacaggtctggaagatgatcgaaacccgtgttgatcgcgaagaaaacaatcgtaagtttgaaacgatgctggacaataaagaacgtctgggctatttcttcgtggttgagactcaccaggggaaattcctgatcaccagcaacgcgcacagcgcaaaccgtttgaaagaatacacagggtacgaatatcgcgccatgttcagccctgattgtgggttcaacaacagcgaaatctttacgactagctggagcgttcactttaaacatgtggttcgggtatcgtttgatgaaatcatagcgctgtacgatccgattgcgtcaatttcaaactataacattgctgaattcatcgagaaaaagctgaccgaagcaaaacagcgtaaaatcgttgcataaataataagacgagggtatcatagccctctcttgttacaaataggtattacaatgaagaaaattatctttgctgccagcattttcttatgctctttttctggcaacgcggcgactgatccgttaggagagtttatccaaacactcccttctgtgaagtcaactttaccgctacaacaagcaacagtaatgaagaaagcgccagccaatgcccccagctatgttaaggaattggatgatattacaccaaagcagaaaaaggttttggagtacgctttcaggatcggtaacgaatacgatctcaaaactgcaaagccagttgaatcggaaacatcgaaacgtttgggatatcatttagcggctattgcctggatcgagtctcgcgcatgtgagaacgtagggaaaggcaaaaagaatcatcatgcttatggttgttttcaagtaacagcccgtagcgcgtccgcacgaatggataaatcatattccaaacgcgtagtaatcaataagctcgaaacccttcggggtggttccaagtacgcacttcacgaactggaatactggcttgattaccacaaaggcgacttgaaaaaggcgctggcgagttacaacgcggggttcaagtattcaaagaaagaagcccgtgattatgctcgcatggttaaccataccgcgaagctgttagaagaaaaacgcattatctgataaaaagcccttgcattttcgcaggggcttttttattatgtgtgtaccaactattgaggattaaattatgagcacatcacatcgagttatcaccagtcatccgactatcatcaagccgaacatgctgcacatcattcagggtgtgttagatgaactgaacaaagatccaaaggttaaagtggaaaccatcacggtcgatcgtcatcgtatggaatcgttcagtatctacttcgcatacggagaagaaaaacgcaaactgtttatctgcgaaagtcaagatacgtatcttgatgttggcaacagcacaattcatagcggcggtgtttacttcaacctgaacgtgtggggcagcaacaaagagatcatggatatcgtgaaagtgggtattcgtaagcacgtcccgaatgacgttagcatttacgaatgtgttaatgatgcaattgaagatcgctttgtgcgcgtaggggcttaacatggaaactaaactgacaccggaacagcagttagcgatcgttgatgaacgtatcgacgagatcagggcggtaatgaaaccttaccaggaaaagctgaataaacttctgaacgctcgcaaagacatcaaagaagagatcgatcacaaaaccgcttcccgcgtccgtgctatgactccgaagaaacgcatggagttttacatcaattcaccgaacagcggacgagagattttccatgattcgactaagttcttccaggatatgggtttggggattgatggatataacccagaaaccaatcagcatattcttcgtatcgcgatgaatgaggatcgcagtaacctcgaaacagtcctgaaatcgcttcaacgcgtgaagccatatgtgaagccgatcggtggcaaattgctgttcgatatcttcgaacatacatgttcacagttcaatatgtactggttagcctttgacgttgcagaagaacgctggatgtgcttcacggattggagtctgaaacgcaatcaaaagccagaatttgaaagcgatagtttgcgatcagtgcttgcttatgtctgcgaaacccattattatacccctatcgaaaacgattcatactaaggtaaaacgatgaaaaaacttgcgctgttactcactctgtttgctggctttgctcatgctgatgatcgactggctgaactctgcaataatcgtgacattaaagacgttgcggtatgtgaacaggtaatcgctgaacaactggacgcggcttatgtatggggcgaagaaaatgcgcacctcttcaagcgtcagaagctggttaaacagcgtgagtttttgcagtctgaaccgatgatgaacctctgcaccaaagcgccaaataaggaacgttgtgaaaaactccgtacttacctggttgaagaatataacgctggtataggattatactgatgttgggattagtgatcttttatgggtgtgtgattgctgctgcaatcattatctggtattacgttaaaaagccaaacgaaagctcgttccctgtatatgatgacgagttggaagcgtggcaaagatgggatgaccaatttaaatgaacacaggttatatcttaatgtgtgttattgttgtgatcgcggggctggctgtgctggcttaccgccactatacaggtgatgaaaatgattattaaagaaatcaaagggaacgctgtagagttgttcctgaaacgaaaagtacacttgattcatgggtgtaactgttattgcaacatgggtgcgggtattgctaaagaagtgaagcacaaaatccctggtgcgttcaaaattgatgcattgacgatgaaaggagaccagcgtaagttaggcactaactccatctacatgacggaagaaggtcagattgtcttcaatgcctacactcagtttaaattctggggtactggcccgcaagtggattatgacgcaatccgatcatgctttgtgagcgccgtagaacgcgccagtgcgtttcctgaaaaattgcctatcattacccctcttatcggtgcggggcttgctggtggcgattggttgcgtattagcgccattatcgacgagtgtacgggtgattatccaatcatcgttgttcacttcgatccatcggttgatccacataaggcggatttatcatgagaccgcaagaacaaaagctgttaaaacacaagctgaaacaactgggcgaagcgtatcaggattatgccgaagatgatgatcctgattcacgtaactacaatcaatcctgtatcgacgatattacagcggatatcctggatttcgttgaaaatgaaatcaccgatgctgttcgtgatgcggtagcggtggagcgagctaatcatgactgacaaaatcaaagctaaagcaatgaaggtgattgcgacatacggaacactccgttggtgtaacgcgcaggtgtgcgggtgtatgggttgtgcaaatcataccatgacgaaagaagagtatgatattgctatccagatgccggaaatcaaagagcatcttgcgcgacataatgaaaaactcatgggtaaaggatggtttacaattggctaaattgtattatcactatgcatcaatgaacgctggaaagagtgcgcgactgttgacggacgcgcacaattacaaagaacgcggtatgtgtgttgtaatctataagccagcaatcgacacccgcacatcaaacacagtgagttcgcgtatcgggctgaacgaaaagtgtgaattgattgcgcctgatatagatctgttctgggacattcagcgccggaataaaattgcttgcatcttcgttgacgaggcgcaattcctttcgaagaaaaacgttttcgatctatgtcgcgttgttgatgaactcgaaatccctgtaatggcttacggtctgcgtactgatttccagttgaatctgttcgagggttcttactggttgctggcctgggcagacgagatccgagaactgcggggaatgtgtcactgtgggcgtaaagcaactacggttgcacgtatcgacgcacaaggcaacttcgtaaccgaaggggcgcaggttgagatcggagccgaagacaaatacgtttcgctctgtcgcaaacattatcacgaaaaacttcttgataatgttggtctgaactgttaaggtgtattcagacaaacaaaggagaacactatgagccgtacttaccgtaagaaatatgttccagtccgtgataagtcctccatcgaacagatcgaagagacaaaagcattttcagagtattatgcacagcacggggaaagtcctgatggtttacgttggtatacaaccaactggaaacacaaatcaggttgcgcatatatccggttcgataagaacctgaatcgcgacggtaacaaagctcatcgtgatatctccgcgatgctttcaatcgctgtgaaaaagattgattcgaaagtacgcgctaaaatgcgtcaggaattacgccggatgaaagctggtgtgattggatgggatgaaaatatcgagaatgcaaataagatccgtgcttttgagcgtagcttatgctggtatgagataacttgatgtatttttagactaattttacataaggggcgaatcgccccttttttgctataaatatatacaggaacggatctattgttgatccgtaagcacgtagagaattgcttatgaacattaaacgcatatctaaagcgctgatgtttggtttgttaatcttgtctccgtcatcacatgctgatgataggtcagtagtagccaaagagttcgattactatatcaatgcggcgctacaggtatatcttgacaccatccctcccagcgtaaataccagtgaactattctataattacatggaacgaaaatggcagcagaagcaatgtaaatccgaacccgaatgtaaacgtttagggctacgggttgcaagtgaattcgccgctattcatcgttcataagggatgaagatgcagacgtttaacgaagtaacagaacgcgataccgcgagtaaaattgatgcctttattggcacttgcttaatgtctgtaacctatatgcacagcgcacattttgcgactggttcatattcacagcataaagcatttgaagggttttacgaagatatgcaggatttggttgataaattcaccgaaatccatataggcattactggtcgatacaaacccgtattaaaaacagaaaatgtgcttgacacggtcgcgtatctccgtaaaatagccgatgaagccaacgaaatctatgattcagtagatagttcattgaagaacgtcctggacgagatcaaaggcttgtgctatcaaacgatttacaagctgacaaaactttcttaaaaagagtttgacaagcgaaaaagtgatgatagaataactatcgaattgaaacataaacccaatggaaataatgatgaacttaaacactatcgtaaacaacccgaagaaaaccactctgatcgctctgggcgtaatcgccgctctgtggctggttccgaactcgtacactatcgttcaggatggtacggtaaaaactcaaaccttcatgggtaaagtttcaccgaagcctgttctgcctggcttccacctggtaaacccactggctgatttcgaggtgttcaacaccaaagacatcgcaatgaagtttgacaaattgcaggttccgtcccaggataaattcaaatccactgtggatatgaccgtgatgttgcagttcgatggtaacaaagccccgatcaaccgtatcaacgcgggtaatcaggatcaggcgcttgataagtacgtgaccgaaaaacttctgtctaccgtccgtgagttcggtaaatctgtaccgaaagcacaggatctgtataacgcagaagttcaaagccagctacagatcgcgatccagcaggaagttgaagagtatgcccgtccttacggttacaccgtgaaacaggtattcttgcaggacatcgacttaccggaagcgatcaagaaacaggttgaaaacacgaaaattcgtgaagaacaggtgaacgcagagaaagcagaactggcacgtaaagagcaaatcgctcaacaggcagttgttcaggcaattgccgataaagaagcccgtagcaatgctgcacaggctaacgagcgtgatgctgatgcccgtctgtatgcggctaagaaagaagccgaagcgaacgccgtgttgcagcgtaccattacaccagaaatgattcgctggaaagaacttgacgttcagatgaaacgcgcagagaaataccagggcggtgttccacataccgtaatgggtgcgggttacgatggacaagtgattttcgattctcgtaaataaggttttaaagcccccgttctgggggcttgactcctaaaacgagaatactataatgaacataaaacagatcatccttactatcttcatttcgctattcttcggctttattggcggtttgcttggtgtattgattattgcgtctgttttatgattaccctttaaacgtggagcacgttatgaaacaatttgataaagctgtcgtaattggcagattccaacccttccataatggtcatgcatcaatggtgcgtaaagcattagaagaagcaaaaaccgtttacatccttctgggttcagcatatgcttaccctaacgttttaaaccctctgacagcgaacgaacgcgaaagaatgatcttttcgtggctgatgactgaatacaaatacgaagatgtttgtcgtgttaaatttgctcatattcctgattatctttacaacgaagaaaaatggaaaacctctgttcgtacagcaatcgacgaaaccaaaggcgacaacatcgcgatctatggttacgaaaaggatgctgattcatactggctgaaagcgtttggatggactcatgttccggtagatccagttaaggttgacgggaaagatttatctgcgaccgatttgcgaccaaccatctttttgcataagaatggatgggataagaaactatctcgttatgttccttcgtctactgtgagttatatcaattcatggatgatgacggatacattttggcgactgtactacgaatacgagaaatgggaaagcgaattggagaaattcaaaaactacccatacccagaagcgctaaactgctgtacgggtgatagtgtggttgtgtgtaacaatcacctgctggtaattcgtcgtaagttcgcaccaggtaaagacgcgttagcccttcctggcggacacaaaaacgcaaatgaaacgttcctggattgtgcgatccgcgaactgctcgaagaggtacgaatcaaggttcctgaaaaggttattcgtggttcaatccgtaattcgatgctgttcgatcatccgaagcgttccgtacacttctcaaaaccgactgtggcgcagtacatcaagttagagcctaacaatgatggtagtctgccccgcattatgggcggttctgacgatgcgttagaggcgttctggatgcccttacatgaggtcgtacaacgacaaggggaattcttcgatgaccactatcaaatcgttgtggctttcacgggactctgataaaagattaaaaaagcccttgcgttcgcgtgagggcttttgtattatatacacataccgcatgaataatgaaaaggaagaaaaatgaatacgatcaacgtttctaaagctgatgttatgaaagcaacgattattgctaccgaagccatttcattcatggctaagaaagcaggagttgatggtgctgttatcctgatggagattacaaacaacccagaaggcaacaccgcaaggtatttcaaagatcttacttcctatgcaatggaagaatttaaatgattaaacgtccttactgcctcgtaaaccgtccgatctgtgcgggtggtttacccgtcaactgctggcagttggttgaaacaggtgaagcgttcctgaataaacgcggtgataaagtattcgtctatggtgtggactcgatcgagaatgaaacgatggtgatcaccgacgagaaaacaaaagaaaaatatacgttgacttccgaccacgattgccgtaacttcaacgtgtactggaaatctaatgaagactttgaaggaattaaatcatgaaagtagcaactgttagcggtatcactgatgtaaaatctcgtatggcgctggaacctggtaatcgtgttcacattgcgatgtctggactgcctggtcaaatgcaattcacgctgcaatctgttgcccgtgataagaacgatatggtttacgtgttcgtcactgaaccatcacggtacaaaacaagttcaacgctgatcctgaaaatgggaaccgctgatccagcaatgttgatcgcgggaaccgtagaatctgttcgagtgacacaaatcctgctgaaaggtgtggaatgtaccccagacggcaacggcaaactgtcctacgaagggactaaacgccaacccgtcgatcgtccggttgttgttggggatatcttcacgtcagaacgccgtgaataccacgtcgaatacatcgcacaagatggttctctggtttgtcgcatgtactcccgtaagagcacagacgataacaaatacatgggattaaccgtcattgatggacgtgacgcgatcctgctggattccctgaatgttaaaattaagtttgcatactcatgattcacacaattagcgttattatgggtgatgtcgtaaacatcaacgggcacgattactacgtagcggaaatcaatacaaagggtaatcgcgagatcctggaacttgacattgtaaggccgtccgaagggcaatcccttacgatcgaagtggttcataacacgaacacatgggaagacgtagtgaagccagttctggcacgtcttccggtgttctactgtgaaaagtcaaaacgttggaaaatgaaatgatagatttaactgatgtgaaagtgggtgataccctgtttgatcctggtattcgtcgatacagtcatcacaataccccacgaccgcgcaccctgtatgtgatcaaggttgcccgtcaatacctgtatgcgtcggaagatccaaatatcaccgatattaaagatttccgtgttgagcgacttgatcgaaaaactggtagcgctaatgactggaataaccatacacagggttatcacagcgaagacgaatacaaagaacatttgtaccgtgtcgaacttactgataaaatcaaagacgcgttcggtcgtggacatgtaacgcgtgtaccaaatatcactaccgctgaactgcgcggtatcgcaaaaaccctgggggttgaattttgaaaactgtaatggaaaccgtgttcggttctcacctgtacggactgaacacaccgacaagcgacaaagactataaagggatctttctcccgcacccgcgcgatattctcctggggaaagccccgaagactattgacaccagcacaggcgataaaagctctaaaaacaccgtagacgacgttgaccgtcagttgtatagtctgactaagttcattagtcttgcgtgtgatggtgataccgtagcgctcgatatgcttcacgcttcggatgacaagctgatcgctaactctgaaatctggcagtatatccgcgctaaccgctggcgtttttacaccactgaactaactggcctgttcggttatgttcgtaagcaagccgcgaaatatggtgtgaagggttcccgactggctgcactgcgcgaagttgtcgatgtactgaaagaaaccgaaacgatcggtggtattcaggaattcacgccagatatgaaacgctatacgcgtgaagtgaaagtgtctgacatcaaggatcgtttccctacaaacgagttctgtcgattcgttaccgacacaacaatgaaatctggttgtcaggacttctatgaagtgctggggcgtaaattccagttcacgatcaaagccgatgaaatgcgcaagtctgtgtataaactctgggatgaatacggagaacgcgcacgacaagcagaagccaacaacggcatcgactggaaggctttaagtcacgctttacgcggtggtatgcagttgatccagatttacaaagatggtgatatcgtttatcctctgcctgatagcgcattcctgaaactggttaaagctggcggtgtaccgttcgcaaccgtacaggaaaagctggaagaagtcatgggtgaagtcgaacgccttgcagcgatttcaacatatccgaaagaagttgatcgcgaattctggaacgatttcatcgaacgcatatacagcgatcatgttgtggggtattacaaatgatgtatcctaaattgtccggcgctgaaattgatgttctgtataaactttacggatacgcaactaaagtgctagacttagatttcgatgacgtacccagcaaatcagggcgtgatgccctgattcaaaaaggttacgctcgaagagtaacgggttatcacgataattcgaaagcatggttgctgattaccccactggggattgacgcataccgacacggtattaaaacggagtggcactaatggtcaaagacgtaagtttgtatgtaggttacattgagaaacgtgatattcctcgcgtagaggatattgtttccgatatgattaacctgtacagtgagcctccggtgcttgctgaaaagatccgcgatgctctgtatcatgcattctttcgggtatatgtcgttgatgttatcaaacatgatcgttccgtaacaaatgaggattacgattatgaaatcagtatcaacgaagcaagcccaacacatgtaaatttcaacacctacgggaagttttactaatgactgatattattttgaacgttaaagatgttgtactgggcgataccaaaaacccagacgcggttacactggaacaggctgttgttcagatcatgcgcgatagcctccgcctggaagttactgaacgtaccgaaagcaattacacgggcggaattgatggtcgtcagttgtacgaagatagcaaacatgttaatgtaaccctctgggcggacattgacgaaaactcatacaaaattgacgagattgattttgacgtatgaaaataattgacctctgcgcgggtgtgggcggggttcgattaggatttgataaggcgttcggcggtgtcgaatgccttttaacgtctgaaatcgacaagttcgcacagcaaacatatatcgaaaactggggcgatgataacctacagggtgatctattcgccattgatgaaaacaaagtgccggatcatgatatcctgctggcggggttcccgtgtcaggcgttcagtaaagctggattgaaactgggcttcgatgatgtacgcggtacggtgttcttcgaaatcctccgcattatacgcgccaaaaagccccgtgtgctgttctttgagaacgtgcctgaactgctaacccatgacaaggggaagacgtttaaaacgatttacgggcttctggaggccgaaggatataacgtattctatcaacgcctgaacacaaaggatttcggactaccccaaagacgggaacgcgtgtttattgtctgcttcctggatgatgtattcttttcatttcctgttcccccgcgtacacctacacgcgtaggcgacatcctcgaagatgctgatgattcattcaccctctcagataacgcatggaaaggctttagagagcgtaaggaacgaaataaggcaaacggtaagggtttcggttatcaggccgtcacaagcgattctgcgcacactgggactatcactgcaaattactataaagatggtgttcaatgtctggtattgcaggaaggaaagaacccccgaagacttactccccgtgagtgttttcgtttgcagggtttcccagattcgtttattatcaacaaaagcaagatgcaagcgtataaacaagcaggtaattctgtttcaataccagtcatcgaggctatagcaaaacaaatcaagaaggtgttatgtcacacaacggactaagaacaatcgaagaagaacagaaaggaattgacgaattccttaaaactgtttctgttgatatacaaacggggacaattatacgaacgtcacacaaacgttctgacttgatcggaaaggaagtaggttcgaagattaaaggaggatatacccgcgtttatttcaaaagcaaaggatatctacgtcatcgaatcatctactacgttgcaaccggaaaactgcctgatgtgattgatcataaaaatggtgttgaggctggcgacgggattgataacttgcgtgaagcggatcaatcccgtaactcccagaacaggaaacgacgaaaggaaggaaccagtcgattcaagggtgtatgtgtgcgcaatcaaccaaccggaatacgttacatcgcgcagataatggttgatggtaaggttaaacatatcggttcctatcgtgacgaatacgaggctgcaaaagcatacgatcgggaagcgataaaacattttggtaaatttgcaaaattaaacattgcatactgaccaggatagtgatacattagctttaacgaaacgaaactgaaaaggaacataccatgacttttaatgacctgtttaacggatgtactggcgctggtgcgaaatttaatctactgaaagattacccgctgggttctaatccaggttacgtgatggttgaagtgcgtaacggtgaatactacaacgtgttcatgtgggatcgttctttctcttactgctggttcggtgcgaaatacaaaccagattacatcctggaacaaatcgaaacagtgaaagcgaaaaaccctgaactgtacgcgttcgcagagtctattcgtggtgtgttcggacactgattaatcaagccccgaaaggggctttttcgtgaggaaattattatgatttacactgttgaatgtttggttgattatgaacctggtaatctgatctgcgcgtctgataccgttatggactgcatcgacgcggtgaacaatcacgaaaccttcccgtatgttgcggataatctgcatttcactgcgtggaaagacggtaagaaagttgcggttgcttctttagtaggaaacagagtaggcgatacaataggcgctaacggctatgaacctaaccctgtgacatacgaagaagtcattggtaaaatggaggcggtatgaaggttaaaaacgccgaacgctgggagaataccaacgaaatgttcttcattcgttgcaaccgtaagcctctcaaatgcgggtatgacgacatagacgaagccctgagcaagtttaacgaaatcatccgttcatccgtctaccgtagcggggaacatcctggcgacctgtgggaactggtagcaaaagatccttacagtaacatcgtcctgaaatccgaaacaaagggtaaagtatcatgaaaatttatactgttgaaagtttaagcgaagattactatacatttagtgatttggtcggttctaccgtatcgctggaacgtgcgattgaaatggctaaatcttttgactgggtgagtatcactgaatgcgacggctttactggcgaacgtctgcgcatagtaacactgaacaacgaaaaagccattgcgaacgcaaccaaagaaaacttacaatttgaggatgtaaaatgaaaatccgttctggttttgtgagcaacagttcatcaagtagtttcatcgtccggttcccgaaagatccgactaatatcgacaacctgcgcgaaatgatgggcgattgcgtccctgattgtggttactacgatccgccgttgacagcggaagaagtggtcaatcacgttcatcgtgacttaggcggtcatctgggtaatagctttgaatcgttctacgacgataagcgctatgactgggaaaccgaagaaagcgcagaaacccgctaccgttcaaaccctcaaatcgcgcttgcgtatgacgggcgagactggtacgatctggacacagaagagaaagacgctctgatcaaaatgtggttgtacgaagagtacaacacgaagttcggtaatcaggacggcgtgtttatctatgaattcacgtactccgatgaatgcggcccgatcggaactcaactggaacatggaaacatcttccgtaaccttgaacacacatcaaagagtcatcactgatggataagctaaaaacagaagtttgcgttgttatgcctcgctatgcgttaggggagtcgatcccctttagccaggatcgtcccgcaccgtttgatgtattttctttgcgaaaatatcttgaacgttttgaactgaacgagtatactctccaaatcgttcgagtatggaatccggtaatgtatgcgcttgcgtttgacgttgcagaatccaaactcacaacgatggatgaatacgttgaactcctggcgcataagttcgggtgtgatcgtacagtcgaagcagtaagcaataaagttaacgaaattttagaaaaattcaaatacgagaaaatttaaatgtcaatcacaaatatcgaattcaaaaacgctgtatcgaagccaaccccgacaaaccatgttttcgtgtgtgacgtatccggttcaatgtacaacgaactgcctaagatccgtaaacacctgaaagcaaacctggcgagtctggttaaacaggatgacaccgtttcgatcctgtacttctccagcaaaggcgattacggtacggtgttccgtggtgagaaggttagcaatgtctctgacctgtctaacatctgcgcggctatcgaccgttacctgaaacctacgggttgtactggctttgttgagccgttgaatctggctgcggaaatcgctaccgatctgcaatctgaaaacggcaacctgaacagcctgatcttcctgacagacggttatgataactgctggcgtaccgatgatattctgaaagcgtgtgcggttctgccactgactttcaacagtatcgcgttcctggaatacggttattatgtaaaccgtcctctgctggaaaaaatggcagaagcaaccaacgcattgcacaaattcgttgaaggtttcgacgcatacgaaccagcatttaacgaaatcatcaccgcgcagacttccgcacgtatcgaagttgcggttgctgatgctacccatgcgatctacctggacgaagggcgcgtgtatgtcctgaacgctgcaaacggtgttgtactggttccagaacacatcaaaaatatctgggcgctgggtgaaaacgcgattaatgatgttgacggattcgatccgaacatcgccagcgaacagcaagttctgtatgtcgtgctttatcatgcactacacacaatgaaccctgatctggcatggaaagtgcttcaaaagctgggtgatgtccgtctgatcaaagcgtatgacaactgctttactaagcaggactactccaacgcgaaagacctgattgcacaggctgttgtagatccatcacagcgtttcgttgatggtattgattacaacatggttccagacgaaaacgcgttcactctggttgatgcgcttgaactgctggcacaaactgacacagtgatcgacctgtcttctgagcactgggcgtataaccgcacaggccgtcagactgtacagaaagaagatgatacactggatcaactgaccgaacagatcgcaaacgctgcaaccccagaagaacgtaaagcactggcggcgcaaatggtagcgcatgaagtctggacaccgaaatttacccaaaccacaaccaaagtatcggttaaacatctggtgggtaacagttcccgtccgaacatttccatcaacacggatctggaagggtatgtgactatcccagaaagcaaacagaaagaattcggtctgccggaaaaagtcgaaactaagcaggtgcgtaacttcaccatcgttaaagatggtatcgtgaacgttaaagttctgccgctggaaaccgatattccgacactgaaaaaccttcgtgcttctggtctgactatcaagccgctggaaaaaatcggtgatgatcgtatgtctgttctggtagactttacctctctgcctctggttaaccgtggcatgactcgcgggttaagcggtaaagagttcgtgactgataacgtgcgcctggaaatcctgaaaggccgtcagaaggttatgaagttcttccgtgacaacgcgatcggactgcgcaacgcagaagggctgaaacagcgctttggtgaggctgcgggtgaatggctgtctgaacagggtattcgtgattacgggttctctccgaaggttgagcgcacagaatcgactgatgtttacatgtcgaaagaactgaacgtgaaaatcaagggtgtttcctcccttcctgctgtagcggctaccgtcgcgaagcgtgaagaaggtaagaagaaactgaacaacggcgacctgattatcctgtgggcttacgatcaggtgaaatctgaactggatgcgcttgacaaagatcaggtagtcgagtatcttgataagcagacaaaggcaacgattcaggaagtccgtaaactgaatgcccgtttaagtcgcgtaatgtacggtgttgtagtagcacatgcatggttcgcggatctggacttcgaagaaaccaaagtttctatcgctgcaaaagatattcttccgaaagaagataatattccgtccgatttctggaaagtctgggaaaccacatcattcgaatgtgaaattgtcctggaagaaaaagaagtcaaaatctaacaatgtccgcccccgaaagggggcatattgaggaaaatactatgtcacgtaacgtattctggggtgaagttgtaaaaggcgatatcctgtacctgtccgaaccacaagcctatcgtgaaaacaacgaaaagaaccacgcatacgcgcctatgctgccggatttcgtggttgttgatgatgtatttgtcggtgaaaatggctggcagattgatttagtcggattcccttacaaaaagggcgcaatccttctcgaactggaagatcatcatttcttcgcccatgttggcaacattgaagatcatggtgatttcgatatcgaagatatccgcgaaaagccgtatgtgttcagcaactactacaaggtcggtggacacctgcgcagtgataacaaaactgttctgtatctggatggtattctgtctgggatgcataatttcagcattgagaagccaggcaacagcgcagaactctaccgcttgtttggaaagtacgatcgccagaatggtaaactgttaccgtcagaaatggcttatatcatcaatcgtctgatcatgggacttcacaaaacattcctgattcactatgatggtgatgtagaacaggcgatgactactgtgattgacatcctgaaagcaaaatctcgtgaaatggataccctgccaaaatgacattattcttcatcattgcgttaggtgtgtttattctgggcgctacgattgcattcatggcgttcgataaacgcgaatatcaactggctatcatcgggcttatagtagcttgtatcccgctggtgttgtcatacaacctgtatcatgagaaaatcgcggagaacgcgaaatatgaggcaagacgatgaagattcgttctgggttcgtgagcaatagctcaagcagtagtttcattatcgggataggacttgtccgccctggtaaagaacaggaagttgcaaagatttacggtgagtcaaacgttgaatctctgatggatatgtttgatgatactcgtcctcgctgggatttacctcaaatacacgatgacggcacaatcacactggaagcgttcggatgtaatagcgtagaaataacccgcatctgggacaagttgaaagaactgaatctggatgatgttaaaatcgttcacttcaatgagcgcggcggcgaaccggaatacgacgatgaaaccggaagttataactatgactggtatgacgacgcggacgcattcgggccggaactcgaaaagaaatacaatctcctgagagataaccgcgaaatgttcattgaaggtgatgttcgttgcggtggtggttatgacggctaaacgattggtgatctgttatcgctgtttgcatgtgtatgatcacaacacagcgaagcgaacagcaacaaagcgcttgcgcgttaaagaggcggaatgtcctctctgtaaatgtaaaatctgtttggggtaatccatgataacgatagtatactgggaagaactggaaagcgaattcagtgatgaagctggggaaatggctgctgtagcgggtgaatctgaaatgcttacagctaccgaaagtatggatgatgcatttgatcgcatcaagaaacaccagaaagaaaacgaaggtcgggatattcagtacatgctatcgttctggctggatggtgaaatcttctgtcatgctgctattgctgaggatactccggtcgatatgtgtcgtgaagaaatcgtgaagtacgtcaaatcttttatgcattaattaaatgagaattgaaaaatggcttatgtatctaaaaaaattgaaataatttcgtcgatgatgggtaaaactctggaagagatcgaccggattgggaagaactttaaagatgaagttttccgtttacctgaacgtgaaataaatttaatcccgtatttcaacacggttaaaattctgatcgatcctagttttggtctaacggcaactcattacattgtcggtaatgctccatatatgttcgtgttcagaaaatctaagttgattgcgtatttcgatcgcgcgaatcttggacatattcgggcaatcatcgacaggatcgaccgttatgaagtaggaaattacacggaacaaaccagacgcactacatacggaaagattacgagtatgctggaacaaaccaaacaattcgacggagcaaacatcgaattgattgatgatctgctaaaaagggtcaacaagttcaaagaagcgtttgacgtaaagaaaaccgcgcttgctgaaccagaaacggtgaaagcgccaaccctggcatctttcgaagaaccagaaaccattccagtaaacacagcgttgaaatacatcatcgaaatcgaaccaacagatcttgatgcaacatgtaaagcattgaattctatagggattaatttcactctctataataaattcagttaacccaaaaagcccttgcgttcgcgtgagggctttgttatattacacatatcgaaacggaacagccaaaaggaacgagaacatgaaagctaaaatgatgaagttcgtaaaagactggagaaaaggcgcggcaatcggtgagagctatgtaatcgtagacatcgaaagcaacctgctcgaaggtgcgaacgttttagaagttcctcgttacggtatggttgaagccgctgataaagcaaaagaactgaacggttacgttctccacatcatcgaagcaatcgagaaggaattagcatgaacagcgtttatctgattgaagaaaccattatccagccaaacggcggagtgtatgaaaagaatatcgtgtgtgctgccctgaatgaacaagaggcagatcaaaaagtgaaatatttaaatgaaaatgctgttgtatgtcagacgtattccggttatagtgttgcatatgcttggaaagcggttagtttagaaacccaaccatcttggttaatcaacctgaaaaaataaggggcttatcatgaaaatgaattacgttcgcggcggtatcatggcactgttactgaaaggtgtttctcgtagtgagaatcgtatgggtatggggccgatgggtaaagtctggtctgtctatattggcggtgactgtatcggttacatcggcaatgatggattgagccgcgtttacctggctatctcaagcgggggtcgtgaagtcgaatgtggtaatttcatgcaagcacttgcgcagttcattgatactgcgatcactcagattgaaaaacagggctgcatcgaacgccgttacgcgaacaagatcggaatgattgaatattccaacttctgcttcgaagtcgaagaagtgcgttatgatacgatggatgaagtatacgaatatgtgcttcgtggtgaggaagtgattaagtcctataacgggacgaaggttgtcaataaccgctctttcatcactccgttcgaattgcgatatcaacagctaatgggctggatcgtgatggaataagaaaagcccctttcggggcttttttgttatgaggatgatagctggagtttgattctttctatttcttccggttcatcaatgatgctgtagtaaatcgttacggtgatcgcgttctcgtcatactgcggaatcacttcaacatccagattgtaaacacggggttcgtatgcgcggatcgcggagacaatcgaagtccttactgcttccgctgttagcgggttcatgttctcgaaaatctgttccccgatctcacaaccaaagttgctatcgaaaggccgtgtgcctttttgtgttgttacgataccgatcagactattctttaccgctgccgcccctttcgaggcggttacgtcattgttccagtcttttgttaagttgggatcgatatcgctatacagtaagcgaaggttaacacccattttatccaaccacctttagaaacgcctctaagcctctcagtgcaacgatatgttcgtagccacacgaacaccttaccggaatgtttgcaacgattgctggcttatccagagcgctatttattgatttaaagaccggatagtcgatactatccagaacggcttctttctctgactctttacagtcatcccataagatttgttcaccgtcgatgactacaaacttaatcagttcgggtaactcttcctttccggtgcggtgtggttcgactgaaatcttgatctcattgccgtacagcttttcttcgtattcgtccaccatgatatgatgacgattgagcacaaacttaatcagttccccacattcagggcatttgatttggagatctacagtctctttgttgatactgtcgaacagagccataatgtaaacataatcgcgctgatgcttgaacacatcaccttcaataatgaagttatccgtgtcatcaagatcgccaatggttaacgggcgataagtcacattatattttgggatatgtcggggtgtatgtttacgcatttgcattctcttttcgtttcaagtcttccgccagcaatgcaacgtaaattgaacgttccatcgggcttccattcattataggttcaatctgtacggtattcttatttaacaaatagttggttttgaagaactcattcagttctgatttgttgaataggattttgtacagtgtcaataagtcgctgaactcaatatcacgcacggtaacatgacaggacttgcgtaacagtttaacgatattttccatatcttcaatagacaccagatccaggatcgcgttctttgtatcctcgtctaatgcattccattcgtatctttcgccgtcctgcttgacatactggatacattcaaggaataattgttcactgttgttacgatgtttcgggaatttgaatcccagagtaagcgaatcatcaagggcatattcattttgcagaacataatcagttacgtgcatgaatgcttctgattgtccgctgctgcctttgattcggatcttgattgcgttcttaccgaacgatacacaatacaccttagtgaaaatgttttcctgttcggtgcgggaataacccggatacagaatatctaaaatttcatccagcatttcttgctgttctgtgagcgtcttcccttccatgtccgcgcttgtgagtaagaaactcaattgatcgcgcacggtaaacatagggaatcgcttcactccaccagggagttttacgcggattatatcaatcattttaacctcaaaaggggctttcgccccttattgtcctgtaaccacaccacgaacggcaattgctgcaccttcgataagtgattgtttgaatccgtcccaaccttctttatctgcttcaacaagccagcctgttttataagcaaagtcaacagtgaatgtccagatttcgttattgctttcataactcagttctgggttgctgactttaacaggcaaacacttctggaatacatacgtgctgtgcgggacaccatcgcgattgtgtaagtttacctggatcgcgcttgatacttcatcaatgaatgcgaactggcctgatacatcatcacgaatagctgataaccattcgttgaatactttcaggttacgcgcttctgaatccacacggaacgttagcgataattcaccattctccggtcgggtgaatcggatctggggtacaccgccattatacacgtattcataacccagtgttttaccaggcaactgaacaccaacgatgctcaaccccatattatacatcattttgtcacggaattctgttagcatctgtccgtaaacactatcaccaaacagggaagtaattaaacgagggcttaacgcccccatgattttactgaaacctgttttgttcagggacataatagctttatcaaccgtatagctgaatagcttgcttacgccccctgtaatagcgttcatgaactcgttcgggttattcgcgttaatggaactcatactaccatctattaaagtatcgcggatactcccgatcgtgctgtcgagaatgcgtgatgctggactagttgcgaatacaacactaaacaggttgcttcgctgaaagtctctatttgccattcctgacaaaaattcatctacgctatagaacattgttcccccttaatactgcgtatcaaaaatcgaatcctgacgcatatcgatcagttccataaactgaatttcgatttcaactgcgatcggggtgttcggtgattctctcaacgtatttacaatgttgtccattgtacgcccgaaacgaacgctggtaatacctgctggcccaaatgtagaatgagggaaccgcaaactgtcacctgtctggaagtcacgaataaaccacacaggaggcgatttaataacttcaacgttcgatacgaagtcaacaatctgatccccgatactgccgttgaaatcgcttgctgtcgtctggtttgttgatggtgcaaaaacgtttgcaaccttcgaagcgctggaattatacgcttgcttaaccagtccggctaattctgctggagtaccacccgaagtagtaccataacccaacaccgtgaacaggtaatagattttaatcagttccagcaggtcataacggctttcgataacgaatgtattgtaatacatctttgtgcgcttatcagagccttgaaacgctgctttcgtaccgatgtcgattgcttccctacggtctgccagaataccaccagaaacggattctacagcgccccagataacgtttgatactgcacgggatagacctttagcaacaatactatcggtcgcgtcctgatagcggtgtgagttcacttcgttatcgttcaggcttcgcggtaaaagtatttgacaaattgggttaagtgtacccatagtacgggtattcaaaacctgtttgtatcgaacgttcccagtgttggcactaaggatctgttgcgcgttctgtgcggcctgacgcaatgagcgatagttatctttgcttcctggtgcaagtccaccactgaaatcatatgctgtgaacagcaagccgttattataaaggcttgatgcgttgtacgcgttatcaatacctgctgcacgttgggaaggaaattccgctgttacgatcggttgagtcaacgcgtttttagttgttgcagcacccccagaggggatgccagcatttttgatttcagcaaatgattgtacagtgtcttgcaatactgtaattttcatttaaatttcctttaagctaatgcaatcaatggtttacggtcagttcgttggactgaatgctgaaccgtgttgtttactgttttgttgttgacctgaacgctgttaggcgttgtaggctgaacaggcgctttcactgcttccggttgcttgtcaatacttgcactcgtttccggtactgcggtgattttttcctgccagcgggagatcatatcacgatatcggtctttatcgtcctcattcagcttgttcgaattgtttttctcttcaagcgattctatgagtttttccattacctttttatcgttgcccgtcagattgtctttgttcaggatttcatcgccctgatcgaattcattatctgctttaggtttcgctttctcttgcgctgcttcgatctgtttggtttcatctacacgttgacggttcgcggtattctctttgtcaacctcagcctgtaacagtttggggttttcctgcaatgctttcagttctttcttcttctcttcggtgatcttctcttcgagttctacctgattgcgaagttcttcaagatgcttggattgtgctttctgtgcttctgtctgttgcccgaaactatatgagaatgtaccctgcgtagccttaacctgatcgacgagcttagaacgctgttcaacaactttatcgttctgatcctggatctcttgctgtttcaacagaaccaaatcatctttatcaatctcaagaccgtatttctgtttatcgcgtagcgctgataccttcatcccgcgtccggcgttagtaatcgtttctgatccggtatattcgcccagagcatagattagattaccgataccttccgtgattgcggttttaatggtatcgcccagaattttaaacggttcgaggaacaagtttttcaatgatccgcccaaatccttcatattgaagttttgcagcccttcattgattttttctgcaagggctttaatatttccgaagtatgatccaaataactctttcgaggcttcaccctctgcgagaatatcctggaaccacttctgaataaccttgctcagaacgtcgatagcgaatacgatactaccgataatcaaagtccatttggcaaacttcgccagcgcttcgagagagtatccgataaagcgagacagaagaccagatgtattatccttgattgaacccagcaacgcaagaacgcgcttactgaatttcttctcgtctttatccttatcgcggatcttcttcttgtcccgatcgacctccggttcctcttccggtactggttcaggttccggcgcgggggctggtttcttttcagcgagttcgataaacttggtgattgcttctgcaatcgttccggtgtatgtttcgattttcgcaaatgggttatgctggttcgatacactgacggagttatcaacactggttgtgctgttgtctgttaatgatggtggacgcgctggcccaacaaaatcgggcaactgttcagcaagtggttgttgatcctgttcgtattgttcctggaagccagcgaatttctctttgaaacgatcctcaaaggatttcacactgtctttgatgtccagtgtattcagcgcggtttcaagggtgttatcattgatatcctttaactcgcgcatcgaatctttatctaacgttgcctggatcttccgaacagttggttgcgcctgtggttttggtggattctgcatccgacgacgttgttcttcgttaaaatatggattgctagccattatcattcaccgatgatgttaagccctttaatggttttcccctcatgcacaatatagacttcctggagtacgccacgttttacatcgtcatattcataacgatacaggcagttaattaattgaatacggttttcgtccgtcagttcgatcggcttcccgttgtcatacgcttctttaagcagtaatgccagatcatccagcattagggtcggtttgttgaagaccaatcgaaggttatcaaaagtatgttcatacttagcttcgctgattttcatatcatccagattaataccgatctctttcagtatcgccattgctttatcgtcattatgataatgcaggtgaatcaaaaggaattcggtttctgctgcggttaattcgcgcggttgaatctctttgatgatatactcaagcaactgcattgggtctttcattgctttaatctgggtgaaatgacgatagcccagacgggggatcgtaacctgttcaccagtaggcaacgtgactactttatttttgctgttcttgatgtttaaacgcgtaaccataaatttatcaagtgtgtttttcttctctttcatgatcgcctcaagtatcccgatatttactatttagtaaatagaatataaagggaggatgtctaatgtccagtaaagttataaaccgcgtcgtgtcggttaaattatatccaacatatgaaaagttcgctgataacgtctatcttgaattgttacctgcccttgtctcaatgagtgagaaaaccatcattaacggtacttctgaaacattgatgcagatctatgataaccagttaatctatcagttgacagagaaaccgattattcaggtatccttccagtataacgaaacgttagaacagcattactacggtgttctgtattcaaacgtcgaaaccgatgatatgaaccgctctatactgcgcctaaacctttctccggtgcatacggtgtttcgtcgtaagttttcccgttcgttcagtaacaacgccgtacagacgattacagagtgcatgacggcactgtataatgatatgaagttgatcacaccacctatcgacgcatcaaacgtgcgtattcctccggcttgcctgagcgggacgtatgaaaccgtgtttgattacatccgtgacaacgggcagagcgtagattcgtctgacttctgttatctgtgggaagatggttccggtatctttatgaaaagcaatacggagatcctcgcacaaaccccgttaaaggcttacaagttcaacgtaagtaacccgtttttaggtgacgctttggtattcactaaagcagaatacattacccataaggataacactaccctgttagtggatgcaagtttctttagtttctcaatgacggataaaaagctgtatagtgatatcctggcgagtaccgatattgaaaacgcatggatcaccatgaaccggaacgcggtatatgagaacaacttccagaacccagacaaacagggacaaccgttccaggcagtgaagtgtcaactgttatccagctatgagaaaaggattaagtttgatatcaatcagggtcgaatggatgttaaagtgggggcattgattgaggtgttaggggatgaatattcagggaagtatctgatcgttgaatgtatccgcgacgtatcaaaagatttccacctgcaaacattagaatgtgtacaggtggcagcggctactaacgacaccagcaaaacaagtgaggcttaggccgtagtttcttcatgatagcccatgaacaggtcgaacacgttgttcttgttctgtttacgggctttcttgatattctcgtagttctcgcgaggcatatcaatcatgaagcacttctgacgcgctgtagcgttctctgtgagcgcaaacagttcatcttcggtgtaatccttgtttttgtccagatcgagaatgacgcattgccaggtgtcttcatcactggtttgctgcatcatcaccagtgcggcgtttttgaatcccagattatgcgcaagcatttcatgaacgaattcacgatcctgatcttcataacggatttcttgtccttcccaacggataaggcgcacagtcttacttggttcatttttcataacgtggttttcctgctcataagttcgcgtaaacgtttcgtcggttcaggtgggtttttaatgatctcttgaatctgatcccacacttccggtgaaacttctttcctgtccatgataacgatattctgattatcacagcactttccaaccattacggatcgcccacaattaaggcaaatcgtatcagggcattttccaagtttatcagggtcgatagattcaaggaatcttcttgctaccgataaccgctctttaacttctattgggtcatattctttatttttcatgctaacaattgactcccctcataattggtaggaacccgacaggcaaaaaacaattgttggtgttcccagtttttacgcgcctgttctggagtatcaccccatgcagcatcaaaaccagttttcgcacagcaccagcgatgattagggtcttcgctgatagtttcgaatatttcgagtttcttactcatttcaggtcaccgataatttccatcgctgcttcgatgttttcaacaccataaaaggtattcccacttacttcaaggagtttgataccatgaagataaaccccaaccagcgcaccgatagcatcgtggatagcgtagttgccgttttgaagttgatttgcagtgtgcataattttcatgatgtttctcctttcgtttcgatatgggtaatgtaccactacattacccagtaagcaagcattatttttcgatttcgtagcactcttcaacttcgatgtttaccagaggtacttcgatatcccatgaatccgcttgtgcatcgtatacggctttgtcttcgtcgttcagaggcagacaagtaacccaaccgtcagtaacacgcatcacgcgcattttagaaaggctttcgagtgcgtccgctggcagtttttcaccaccgttacccagttgtgccaaacggtcttcatttaccagaacgattactttgccttcgagttctttagtgatttgcatgggatgttccttttgtctgtttcgtttcgatgtgtgtaatatacaaaaagcccctcacatatgcaaggggcttctttagcaaaaagtgctatttaaaacagatcagcgaagataacgtgaatgtcgtccggttcggtcttatcgcgtcgaatcttcttgatgattggcaggaagaaactgaactcaggttcgcccttcttacgcgttttagacttctggagtccgtcaacttccatttcgacgatagcgccgatatagtcatctttgttcgccatgatgtattcgcgatccagttcaccacgttcttctaacgggatgtacacgcggttaataccgtcttcatcgtatcggtaatccgtatcagtcagaccggaacctgtgtttgttctggcttctcctgataagtcctcaaccacgaacccgccaaccttatgaggttctttggtgtgttcgtacacgtcgatgattcgcagttcgatcggggttttgttcttcaacttcacctgatccgcaacgcgtgaatccttccatttgaaatcaacgtttttcaggattgaaccctctttaccgtcattgcggtaattgttgtaatcctttttcgcttccgcgtagttctgcaccaggatagaagggatcaacttaaccgatgttacaccagagccagccagcgcaccttccaggatagagaaacgatcgcaatatggttgaacactcggagcatcaccatagtatacttcatacggtacgatatcccagacaacataaacgatattgcgctgttcttcgtcactgatagtacctttcagggatttgtttacaatcccgttgccctcttcgcgtttcgcttccgcttgtgtctcgttctcggtagcttcccgcctaacatctgccacaaggtcagaaacagaatcgtcgtcatcgcccataaacccagcaagactaaatggaacgctgttcgaaggaacgacagcagttttttcagcagggacataaatcagttctccatcaagtacaacatcataacccagataatcacgaatctttttcagatccttgtccagattcaccaaaccttcatactcatttcccgcgcgggttgctttgcggatctgattctctaacagatcggacatacaacgcgcaccatcggctttaagctgcgagtaagcagggaagcgaatacgttttaaggctttctcactaaacggcgtagcgaggcattgaggctgttctggaatgagtttcttccatacgcggtttggtaacgttgtaccagcaccacattccagatcgcggttaatgatacggcgaagcacttcgcgatcattctcgttcactgatgatacgatatccagcagacgatcacgggctgcattgcccgtatattttcgcgttgccaaatcagacatcaaatccgcgatagcattcgatagcggggttgtgcctggcttgccgtccacctgcggaaacttcttaatgtgaaacataatctgtttcgtgtacgtaatgcggaaaatctctttcagcagatcattacctgcattacgtttcaggatcgcttccttctctgaaattttcagagtcgaagcgagttcatttagaatctgtaagatcatgtaatttctcttcgatttcaaaccatgatttaactgactggtgaggcgaccacggggtttcacgttcaccacgcaacatatggaataacggcaactggctgatgacgttatgacattcgtttaagtttactgcaagatcatcaacgaagcaaaccagacgattaccatatttggctttcgcttccaggtagcggtgtactttggtttcaccatgcccaacaaccatcacttctttgaatgcggaagggaacagcgtgttcaggtttgcaatacggttaaggcttgctgtaggagtggttcccagcgccgtgacagccacgaaatcatatttggctttcagacggttgatcacaatcaacgcatcgtcatacgcgcttagatagcgaataaacgaactgttgttgtattcttccatgagaattttcgccagttggtgatcacacccgaagatttcggtcatatcacggaatttttcatctgtaaccatatccagggcaatatcggtcggcatattgtgttttgacaaaaagaacgggaggccgctttgccacttcacggcgatcccgtcaatgtcggtaagaataactggtttcaagatttaacctcataacgatcaaagaaaagggtacttttaaacgcttcaatatccgcaaggaatttgtcacgctcaaatgtacgataataatcaaattcgatgcacagcatatcatcgttcgtgacactgataccagtgatatcttgatgatatttctttgcctgttgcagaacgaaaggatcgagatccgaacagtcgaaataaattacgtaactcattatcaacccttgtacatataaacagcgtcgaagcccggaacatccatttcgactttatcgaacacaatatctttcagcttacatttttcaacgtagctgttgatcacgttaatgttgttcgctccgatggtaacgtaatacacacccgctttgtagataacacccataatcagggtagaactcaaagcgccctgtgcgtggagtaatgccagcgggttaatcgcgcctttgaacaggaacgcgcattctactctttcatcataatctttataacctatcataacagatcccttaatctggttaagttgcgtacaaactcacgttcagtgagtaccgtttcattcatcttattctttcccattgaatgagtcaaggtactttttccggttgcagccagcgcacggcggaacccgtcattcaggaaaagagcattgtacgcgttttcaatcaggatttgatacgcttctgattcacggtgaatcggcatacccttccagtatagggtctgatcgcgataccatttctttttcttgcctttgaacttggcggctttaccaaccagcgtacacacatgcgcttgcatatctggattgctgaatttcagactttgtaaaaagccctccattgatgcacattctaccccgtcaaacgtaaacggatgcggggcgaagttgctcaatgcgcatgatgggtatgaatcaccactaccaatattcataataactctcttaacgtatggtctacatagaaattcattgattacatcaatctcttcggagattgttctttctgttttccccgtataccttcatacaccgactcgattaaaagatctttttcgaatgaccgtaacattatgaacaccacccgccccgcaagtgctggttttcagagtttcggctttacgcgcacccagaaccagagttttaacaggagtcacaggagcagcgataaccacaacagcagcccaacgtgcgccaacagctttatcagtacccaggtcgattacagcagaggtattcttaccagcagccagaacatacgcacgggcttcacgacgagtgttgaagcaaaccagttctttcatgttgtaagttttcataatgtcatcctcagtttcgtttcgatgtgtgtactttaccacactcacgattcagcgcaagcattattttgcataaaaacaaaaaagccgctacctttcggcaacggcttgatttttaatacttttcttcgggctggaacaccgcacgacacgcccacatagaggcttctttcagtcggtctttcgccttttggatttgatggatacgttcaagcatcgcatcgagttcttctgtagtgaatgaatcggtatctgataccgcgtaatcacttgaatactcttcatccagttctttgaagatttcgcccagggcaacttctgcggccttgatgcggtttactttgtcgatcttttctttcgaatggggcttatagccctgtacgtcttcaatcgccattatagactctctgtaaaggttcgggcgataacgtcgcgctgttgttcaggagtcagtgaattgaaacgcactgcatagccggacacacggatcgttaactgtgggtatttttctggatgcttcacagcatcttccagagtttcgcggcgcaacacgtttacgtttaagtgttgtccaccttccactttaacagtgggttgaaattcaatatcaacttcacgttttgcgaatggagcaacgcgagctttaccgatcactgaatccatttcgagggttttggataccaccacacgaacatcattaccttcttccaggtagattgtaccagtgtgtaaaccttctaaaatctgatatgctttcattgtattacctttctacgacataataacgtaacgggttgatatggaacgccagcattgcacgatccagcccgttagggtcagttacttcctgtttcagtttccacccgcaatacacgcgtaagcagaactgaacctttccgactttaagccacggtttgaagacataaagcccccatgccgaatcattccacatcaacagataaccgtgacgcgaaggatcggaaccaccttctgttttcgggttgcccttccaggcgaagtctgactgtgcttcacgccctaagacgtgataagcgaagttgtacgctttgttacgccacaaccagcctacacgttgcgcatacacacccagatcgcctaagtgataccggatgttagcccaacgccggatatgtccaccatcaccatcgatcgggttatcgaatgtttccatccaacggaaccctttaggtaagtgtccggtttcttcactgtagaacggaaccacaaaaggagccagcagaatagccagaacaccagaaagaatatcaaggggaaccagtacaaaccagcttgcgtattttaaaaagcgcatgtgcttctccagaaaaaaggctatccgaagatagcctgttgattaacgaactgctttgatgtacttatgggcttctgcaaactcttccataagagcttcatttgtgaacggaatatcgttcgatttgaaaccgccgctgataagatactggatgataaacacagcagaatcaacagatatcaactggtgatttgttggttcgatgtcagtacggcgaaccacgtttacgatcgaccagtcgaagaatcgacgatggcattgtttcttgctgttcacctgtggtgatgcaaagaacccgttcacggaatacgcttctaacgcgtgacggaacagagtttcaaaatcatcaatttcttcggtgaaaaacttcatcaatgcattattgatttcatcgccagaagtagtgatttcgcgaatttttggggttaactcaaacagcttttggagacctttcatatttttctcttttaaatttgtgggctggaagtttctttacttcaccccgcattccggggaacctattaccggataccaacagagcctatcgcatacgataaggttgcatattccgaaccatttaacggcattgcgctacgcacccgaattggagcaggtgaagggactcgaaccctcaacaatctggatggaaaccagatattctaccaattgaactacacctgcgtatttggtggcccctgctggattcgaaccaacaaccgcgcgattatgagtcacccgctctaaccaattaagctaaagggccggaatttttagaactgtttgcgatagatttcgcgaaccagcggatcaacatctttcgcgtacttacatacgtcttcgaactggacgatgtacgccatgacttcatcggcacgggatttaagtttaccctgatgcgcatcaatgatcattgctgtcattacgtcaatacgcgctggggcttccagaatttcgcctttgtcgaacagctttttggatttgctgacggtatcagcgataattgcttgaatagatttagccatttttagatctcgtagattgcctggattgctttgtaatgtgcggaaacgtattttgtttccttctcttttgcttctttttcggaaatgtaacccgcaaccagatcagggtcaggaacattcgccatgtgagcgcttggcagtgggatatatttacccaggattcgttctgccgcttctgctggaacgtctacgcctacagaaacaactttaccataaaaaggttgttccccgtgctggcgtacaccaaccacgataccagattcagatttgatttcggaaccctgcggacgcgcagtagcttcgatgatcacatattcgccggatgcttttactttcagttcagacatttctttactcattgttgttaaacactaatctggaaaagttaacatgaggttctaactcttcccgtttaatttgttccacgatacagccatatttctgtaagcgtgaaatccattcaccattaccacgatcgtatttatcgaggtaatacaccgctttgatagcgcctattgcagcataccattcgatatgttttgcgcagtttggacacggcgaagcggttgtgtacaattctgcgttgttaagcatgataccattagtatgcgcacttagcaacgctttcatttcagcgtggatctcgttatcgtttgaccatgctgaatgctcaggacggtgaaccgatttcagtttaccttcgtcattcagcatatgctcgttatgatcagcacaacggcaatcagaatcaaccgtattattcgaaccctgcgaaaccacacgcccgttcattactataaccgcaccaacacgggtcgatatgcatcgagaagcctggctgtgttgaatagcacggatcatgtgaagtagtttcatcggtcatccatatatttcagaatgtctttgatgaaatcgttatcagggttgacgatgtgatacgtagtacctgaacgtgtcaccacttcaacaaacgatttgttcgccggaattgcgtattcaacaaccggacttgttgcaatgtcctgttgaggatcattatcaaccaacccaaacacacaaccataacgaagcatcgttggttcagtacagaaccatgcctgatgaatctttctgattttgtcgctcataatactcccgcccatgttacgaatttagttaccggattccactgaatcccgaactgctgttcaacgatgttacgttgactcaaaatacccagaaggaaggagaactgaccatcgcggacaatcttcactgtataaccagcaggaattttatcagcaatgcgctggcctaactggttgagtttcagttgaagttcaacaggattctcaactttaacacgattacccagttcaaccatcacattttcattttcacgaataaccataatattctcctttgtttgtgcgggtatcttatcacacccgcactcactgtcaactgttttttagaagtcgccgtaatcaacctggaaacatgggataccgttcattcgccacatcccgactggtgtatccctgtcgtccactgcaagaacaggataatacttatcgagaatcttttcaacaagtatttgctcttttacgtgaatatcgtgacgatgatcaccttcttcgcgcatgtagataccatcgctcaggtcaacaccatacccaatcaggcttgcagcggtatcatgtgcgcactgtacagtaccctcacgcccagacacaacaacacaggcatagccagcggccttatacatcctgaacagttcttgaacaggagggttaggcggatcgttgatcaccttcgtaaagtcatacgggctacgttgtccgactttggttaatgtcccgtcaacgtcgaagataacacatttcggtttgcttggatctgcatagctcatagccggaacccagccacggagtttacggtactgttcgaacatcgcccagacacgggaaacaggtagagcattcacaccgcgtttatggttgcgtttcaggagttctacgatatcggcatcaatccattcgatatggaaatcagcattgaactctttcgcgatctctcgccaaccatcatgatctttttggtgcaaatgggtgttgtgaacgataacattcttcccgcttgccagtgcattacgaactgtatcttcttgcactcggcaaacaaacagttctttctcttcggtgaagcggtagccagtgagatcaccgccagcacaataaagggttttgcggatatcgtcgcgggaaacagtcaaagtgtttcccagttgacgtgctttttctttcgcccatgtagttttcccgctacctggtacgcctacagtaataaacagattcatttcacaatctcatattcaattagtgctcgattggcataagtgtgtaaatctaagaaaatagaccaatcactacagatccaaagttgatctttgatccttgtagcatcatacacctttccaacggttaagtcactaaagaaatcaacttcggttattcttattttgattttttgcatttctcagggtatcccacggtacacagaatgttatccgtctggtctttctgacgcttaacgtcattcatccagctacggaagattaacgaatcgggatatgaaagggcaacgtatgggtttccgtcataaggcatgacaaggtattttttaccgtcaatctctcggacttctgcaaccactttccatttcacattaacaggattcaccttagcggggagtgtaggcaaaatcttttctgggggcttctccgcacacccaaccaacagaacgcccagaacaagggctaacgttgcaattttcatttgtcgtactccgccatatactcttcgaaggatttattgatcttgatttcgatcagtcctggtttcttgaacagcaggtctttacgtccggcatccttgaccaactgctgatccttgcctttttgttcgacatagatcaccgtattggtgttgtttgtctctttgacttttttgatatcagcctgtaactctttgatatctttagccaattggtcattttcacttttcagtgtgattgtcatgtacaaaagccctgctaacgaaccagcaactattacaggccatatccacgaacttatattaaacgtacccaatacgtttttgatattcatataacgcttcctcgtaagctattgatgcttgttcctcggtatcatagtaaccgatgtgtttttgcttcccgtctatctttatctgtgctcgatattttccacgcgaagccctgtaatcaacacctttggatttaaccgttttaggtgttgatttagcttttcttttcagcatattatgaagcggatctgattcctgtagattttctataccatccccagcttccaacccatgcttatgatcaataagcaaaggcagataaccattacagtaatagaaaattatgcgatgtcttaaatattttctatcgccgtgccgaattctcacgtaaggttttgatttgctcataatagaaccagcttcttttccctgattctgttttgctgcattgttattccaaaaaatttttccggtttctgggaaaacgtcaacgtaaagaagcagggaatcgatccctgctttctcttcttctaacgttgtgcttccagcgccaaagcactttgtcatttatattcttccggtataaactgttcgtagttcttcgccattaatgcaacgatgttatcgaccagcttttgcttatcggtatcatcgaaataacgcatcataggcccaaagataatacgaccgtcaggggttaagtcagcactcagtgcgatcgcgtagtctttgcgtgatttgcctttcgtgtcttcgattgcctggaatgcttttgcagtcagacgattgagactatcaaggaataacgtttcgaatgcgtcaattttcttgagtgcgtacatatcatcgaggaacatttgtttcaggtcatcgacggtattttcaacaatatttaagaacagatctttgttattgttgatgctatccttcgtgcggtggaggtttacataccagttggttttcgctttcacaaaacctttatcagttttgattacgtaaccctcgaaaccttctttcgagtaggcttcggtaatgaatgcatccagatcggtgacttcgattttctcgcgctcaaccaggaacggacgtaatacaccatctgcgaagatatcctgataatcaacatattcgcccgtgtcgttattacggatgttcaggatcaccactgctggttcctgatagccaattacgatacggtttgttggtgcgacgtattccatgttgacggtgaaaccatcgcgaaccagttcggtcagacgatcgaacaatgcgcggttagtctggatcacgctcatagcgtccatagcctgttcagattgaacggatgctttagacttaacgcccagatagccggaatcgcagaaggtagagatcagggaaccatcttccttaatcatcacatccactacggtttcaccaatcgtcacaggagaggctttcagtgcttcccatgcctttacctcggcatagttgaaaaacttctccatagggcgactgacgagttttacgggggtttccccatccatcgcaaacatgataccgcgacattccagcgcaccaggttttaaccagtcggaatagctcgccatgcgatagttaaagatgcgaacactggtttgcatcacagttttttgatcaatgaagtagaagcattcgctttcgttacacagcgtcattagctggttgaatagggttttctgatttttggttagctttgtcatagtgctgtttgttccattcaggattgatttttcggatcatgtttatttcaaaatcatgatatgtgtcttcatcgtgtgttgtcacgataagatttacacgcttacgttttttgattgccatttccagacgtgcggttttcaaaatattactggggtttgcttcccgccagtatttcgaattgcggtatgtgtctaaccgcttccacaaatcacgacattttccaacatacactatccgaccgtcgatttcaataaaatacacacaatgccggaattcgccacatttaacgaaactccggtctatcctcttgtctgaacccagacgcaaaggaaatattacaccaaatgttacatcgtccattatatatccaacttattcacctttccggtcaacacattgacgcagtgagcaatataatcaccgtggcacggtagaggtttgcatgtacatcctaaccgcttcccgtccaatgctttcagttcgtcgattgtgatcacgccagttcgaatcaagttttggaaatacgggatgaagttcatgatgttttcagcccgtgttcccttgtagaagggattgccgaatttcgtacctctctgaatatcgacatcccaactacctttatacttgtttacgacgcgacaatcaagcgtatttttgtcgccattttgcataggcttcgtcgctgatctcggtgttgaggttgccaaccaggtaagaactcacttctacttcttgtggggctacctgtacgttgtcagacttcaaccatttgttcatccacggatacgggttcggcgttggtttaaatggagactgcaagccaaccgcgcgcatacgctgatccgtcaggtgttcgatataagcgatcgtacttttcagggatacgccgtctacatcaccgatagagaacaggtgttcagcccattctttttcctgttcgtacacttccaggaaaatctttgtcgcttcttcttcatactggtaagcgatttccgccatttctgggtcatctttacccatctgccagagtcggatcttgctttgagtgcctttctgatgaagtgcttcatcacgggcaatcagacgcatgatcttcgcgttaccttccatcttaccttgttcggcaaagttgaacgtgaaggtaaacgacacatagaagcggatcgcttccagagcgttgacagcgtgcatacacagatacagagcgattttgcatttacgcatttgctctttgcgtttcttttcgtactctgcgatcgattcgtctgggtatccgtgggacgttaacatttcgattttgagcacaatgtttttcagttcgtgacattctgcgatcaggtcatcgtagtattttgtcatggaagccgaacgtttcatgatcgcttcgttgcgcagaattttatcgaactcttttgacgggtcgatgtgtaggttgcgctgaatgtgcgtataactgcggctatggattgtttcactgaacgcccatgtttcgatccacgtttccatcgagacatcggaagcgatagggaggaaagccaggttagggccgcgcccctgaatggtatccaacagggtttgatattgcaggttcgaatcgaaaatgattttttcgtgttccggcattttcgcgtactgcatacggtcgatcgacagatccacttcttccggtcgccagaagaatgacagttgtttttcagtcagggtttcgaatacacggtgtttctgttcttcgtatcgtgctacgcccgtatcctcaccaaagaacataggctgttctaagtgtttgtgatctgggtttgtgttcattacagttaacatggatttaccttataaaaagcccccgaaggggcattgaatcaaattttgcaaccttcgcaatcttccgcttcttcctcacctgcaccgtcgcgggtgttgtggtagtacagcgttttgatgccgaaatagtttgcatacagcagatcttcaaggatgatttcagatttcactttaccatctgggaagttagccggatcatagttggtgtttgcagagatagcctgatcaacaaacttctgcataaccgctacgtgcgacagataacctttgtttccacgttttgccattgtccagagataatcatagaagtcaatctgattattctggtttggtactacctgattgaatgaaccttctttcgaagatttcacactcacagggccgcgcggaggttcaatcccgttggttgagttacttacctgcgagctactttcacaaggcattaaagcagaaagcgttgagttacgcaagccatgttttttgatttcaccgcgtaaccattcccaatcgcagttatacacaggtgatgccagttcatcaacgtttttgcagtaccagtcaataggcaacagcccttgtgcatatttcgtttcgtggaacagtccacatgcaccgcgttcctgtgcgagttccatagaggcaaccagcaggttaaattgaaacgcttccatcaactcatgaacgtttccggcgtatgcttcggagtagtcgcaatagttgcttgccagccaggatgcatagttggtgatacccacacccagagaacgacgctgtttggctttcagagccgctgcaacagggtagttctggtaatcaagcaagttatccagtgcgcgtactgcgatgcgtgtaagggctgggaattcgcttatatcagcattatcgagaacgatcgccataagcgtacacagtccaatttcgccagccagtttatcatcgtcatccagcggtgaagttgggatcgcgatttcacagcacaggttcgacatacgaaccggaacagagaaactaccctgctggtttacgtgatgactgttgaaaatgtatttgcgtccggtctgtgcgcgttcctgaacaagcaactggaacagatctaccgctttgatgcgtttcttgcgtaccgttgggtctttttccagactggtatacagttcttcaaactcagtctgatccgcttgatagaacgcgtcatacaggcgatcgttcgcaacgtcagggctgaacagagtgatgtaatcgttattgattaaacgcttatacatcaaatcgttaagctgtacgccataatccaggtgacgaatacggttttcttcaacgccacggttatttttcagaaccagcaggttttcaacttcaagatgccagatcggataatacagggttgctgcaccaccacgaacaccgccctgggaacaggatttaaccgccgtctgaatgtgtttccagaacgggataacgcctgtatgtactgcttcaccaccacggatttttgaacccatagcgcgaatgtgtccggcgttgacaccaatacccgcacgttgagagatatacttcacgatcgcggacgtaacagcgttcagagaacccagagaatcacccgattcgattacaacacaactggagaactgacgcgtaggagtacgcacacccgccataataggcgtaggcaatgacagtttacgatccgaaatcgcgttatagaagtcaacaacatgactgattttatcagcgtgtttttcgtcctgatgcagacacatcgcgatcagcatgaatgcatactgtggtgtttcgtagatgtcgccggacgtgcgatcctgcaacagatatttcccgatcaactgctgaacgccagcatacgagaattcaaaatctttatcgtgattgatttttgattccagataatcaatctcaacaggagtccattttgtcaggatttctttatcgtattttccagcctcaaccagcttagtgatgtgttcgtagaacgggatcgggtcaaactgcccgtaaacggttttacgaagggcgaacatttcgaggttagccgctacatactgccagtcaggttcttttgcggagattcgatccgctgcatacttgatcgctacagcctggatctgtttggtagtcataccatcacgaagcaggtcaacgacactttcaaggaatgcgttaacatcaatatttcttccaatactcgcccaattaaggactttgaacagtttttctttttcgaacgtttgacttacgccagaagacttcactactgttttaatatcactcattatcttaccttgttaagaaaggggctttcgcccccttgtttatactgccatagctgcttttagcgagccgtggtgattatagtctttcaaatggatggagtcaaagaattcttgatccaaatcaagtaagctatttaccttcggcatataaagggtcggaagtggaagcggtgcgcgttccggcttcaacaactctttcgcttgttctactgcgtttttgtagatatggacatcaccgccagtccaaaccagatcacccacttcatacccgcaaatatcagcgataatatgcgtcaggagagcgtatgaggcgatattgaacggcaaccctaagaagacatcaactgaacgctgataccactgtagagacagtttaccgttgattacgacgaactggaagaaacagtgacacggacgcaaagccatatcatccagatccatcgggttccaggcagaaacgatgatcccgcgatcgtctggtttggttttcaattgttcgatgactttcttaatctggtcaacaccataataagaaccttccgcaccaaatgagcgccattgatgcccgtagatcggtcccagataaccatgcgtataacccagcgctttagcctgattttcgtagttatcgtcccagatcgtccgcttatcgctatcttcaccccacgtcattttacgcagtgtttccacgttggtagaaccttcgaggaaccattgtaattcatgcttacacggtttgaagaatagctgtttgctggtagtagctgggaaaccttctgcgaggttccaacgtgcttgcatcccgaagatgcgcagtgtaccaacaccagtacgatcggttgattcagtaccgtgtgttagaacggtgttgacgatatcaagatattgtttcattttatgcctttttcgtatgtcgatcgacgataatttttctgactcgttcgtttgattcgatctgttgaattttgaaatcagtcagttcatatttcagaaccgcttcgcagaattcaggaaccgtgaacgaaacatcacgtttaaaagctggtgcattatatgcatgatgtccgtaaatgtgggtcacaaccacttcatcaaccagtgtattattgattgcttgcagaagcaaccacttaccaccaatgagacacacatcacgatctggatgcgttgctttcatcacgtcgattgcagcagacaacccgccgccgtgaatgatgtaatcagcggtattcccgttcttcgttaccaaacgttgaccggatgcagacagaacgcaatgaactcgccctggcaatttaccaggcagagaagtaaaagtgttcgcacccatgatcaggacgctatttgcggtttctgctttgaagttctgcaaatcctctttgcagtggccccacggcaaaccctgttcataaccgaaagcatagtccacttcgtacatatcatgaccaacggcgaaaactgcttttactttgctcatagcgcaatccacattttgttgtcttcaatagtcacgatgtagcccatagcttcaaccatgacacgcaatttgtctttacaggcttcattatacccgcgaatcttttcaaattcaacagaaaagatactcaatccgttaacatgcgcgttaatgattttggattccagatcgaacaccatcacatctaacggactccattcaacagaatgaagtttttcgcgggttaacagggttgtgtgttttggtagtttcattggggtacagtttgccatagccattgttccattttgcgtaaatcttcctctaacggagtgaaaccaaaggattcttcgatcacaccgtcttcccatacatcaatttccagaatttccgttaccggagggtttgacatcacatgatcacgacatgcagccatagcggtcataatggaatttgttactgtcagagtgttgccctgaaccgatacctgaataatcatactcacctcataaaaaagggaactgcttttcaacagttcccattatagcataaccagttagtgtttcaagcgccaaagagcgattgcttcatcaactgcttttttgatttcttccggtgtgtctttgcgtccggctttaaccagggcagagagcatagaacgaatggttgcattcatctgtgacttctcacgatccatctgtgcctgatgcgccttatcaaccgctggggattctttcttcgctgcctgtggtttcgtaggctgtgcgcctaactcgtccttagcttgcgtttcagtgcgtttctgttcggcttctttcttcacatgaggtgcggagaatttaccagccttgaagttatcacgcataccttccaggatcttacgggctgtgtaccagtcagcaacaccacgaagttgtttcagggtatcaaccagcaaaccgatacttgcgcctttgctatcctcgtcaatgtcgatatctttcaaccattccacatgtttctgaccggagtgcatgaaatcaaagctgctgaaactccagaaacctttacggttgctgatctcgcgtttgaagtggaaagtcaaacccgcgccgttatcaaactcaccgtagttactgcggaaggttgcccccgcttgtttcagtgcgttgaaatagtcatctttattgatgcggttaacggtgcgttttggtttctcttccggcgctggagctgctgcttgctgtgcggtacgtttaacaaaagatgctgaacgatgccccgctgcaaactctgcgttcatccggtcgattaccgctgcgatgccgcttgcgtctggtttcactttctgcatttctttgaaagtgtcgatgatcatatccagacatgcaccgtcttcatcttccagcatagtacctttcagacgttcagcaggtttgaatttgttcaccgttgggtcaacaacatactggaacacatacgcgcctttacgcatgaatacgtgacggtagaagtgaactttatagtgtccaacatcaacaataacatcgttaccgctaaccttcgcacccaggatacgggcaaaggatgtcatgtagtccgcgcgtttgaacttgagatccttcttagtcgggctaaagatggattccagtttcttagtagggaacaggctttccggcgtgattttgtctgggttcttgccccattggtaatcgcggcttgccattttgtgtttcttcgtaccaaccagaaccagagtattaactgatacgctacccagtgcggacgcgtccggcgctgctaaaccttgaccgttaggcggttgacaagagaaagagaagtcaaagaacgcatcaccagaagtgaaacgataggttgcgtgaacagtgtgaccgcgaacttcgctgattgtctgggtataggttgttggttgtccggtgaatttcgtgaaatattccgcaaattcttgcgcgttgaatttagtgctgaaatagtttttcgccagcacgaaatacgctgcaaatttttcttcccatgcttttttgtttgctgcgtgttctgcgcgaacatcactgaaagttttaccagcgctgtttgttttggttacaacgtcatacgcctggttgattttctgcatgagttcagtgctaccaccacggtcggggtgattgcgcagagaagcacgtttaaagagttttgacagttcagctttagattcgtcgccagtagcgcccaaaatcttcaatgcttcgctgtgtgacatttgttcgttaatcatttttccgttcctcaaaataaaaacccgtgcaactcagtacacgggcgactttaaggtatttatgttttactgtcaatagattttttcgaggaaccacaccgaagatttattattcttgatgcgggtcaattcaatggggttatctttgaatgcttcctcaacatctgccattgtaactacatgtttttcttccaatagttcattatggagataaaacctctccacttcgggagaggtctttaaatcaaattcacgttctaacatgagatcgccatatctttgattgatggttttgtgaaccgtccaaccttagacatgatgatgtggcggtcgaagtcctgcggatcaagatcctggtgactgattacaataacgttaccatctacagaatccagcagggatttaatcgcgaatgaaccctctttatcaagtggcccatcaaacacttcatcaagtaccagcagagacagatccacgcctgatactttacttgtcacgtcacgccatgtgaacagaatagacaagttgatgcgagcgcgttcgccttgactgaatgacgcataactgaaatcatcgcgccccagtgatttgatcgattcgttgaactcgtcatctaaagtgaactgataatcagcacccaacagatccagataatatgctatctgtttgttgaagtacggaatataacgcttaacgatactcgctttaacgccggaatctttcaacatatccgtaacaataccacgaatatatttttccttgacgtagccttgtcgtttttcgttcagttctgcttcctgctgttgcaactgcttcacgggttcttcatcaatgactacttccgcgcttgcctgttccatgatcgcctgtgcgcgtttagcgttggcaacttcgttttgcagagtacctttcagggcttcatatttggttttcagggcattgagtgcgcgttgctgttgcagcaagtcattcatgatcccttgtaactcgtcctgtttggttttgatcagggttaaacgttgtgtacccgctttgatgttctctgcgatctccgccatacgctcaggagtgggtttaatcgcttgcttacaggccggacactcaccgcctttctgatacatcacctccagctttttaaactgttctacagtcattgagagccgagaataaccgtcacggagtttgttgatatcttccgtccggtcttctccagtgatcaccgattccgcaatctccgcttgcaactgcataagctgtgctttgatgttctttgcggtttctacgtggctatcgtagatctctttgtatcgggcgttgttctggtttgctttcgctcgctgttcgtcaatgaagcgctggtgtgttgcgatctgctgctggatgtgattaccctgcattgagagtgtatccaactgctgattaacaccgcgaatgtatgacttgtttaacttgtccatttcactgatgacggacagagacagcaaatcttcaaccagtttccggcgttcgggggttttcagttccatgaatggagtgtaacccgctgtacccagaacgataacctgtttgaagcccacaaggttgatgttcagcatagattcaagctgtgcctgataatcacccgctgcggagtcttccggcaacttctcgccgttcttccagatctcgaataccttcggcttttgtccgcgcaccactttgtacgagtctttcccgtattcgatttccagttcaaccaggcatttctttttgttgacgctgttcaccaactgcccgacttttagatcgcggaatgacttaccgaacagggcataggttaacgcctcgatcagtgtcgatttaccgccaccgtttttccccgtgatcagggttttctttgccgtatcaaattccagttcgatcggggtgttcccaaccgacagaatattttgatacttaatttttttgaagtttagtttcatttaaaatccgttcacataattcagtgatcatttgaacaactgatgaatcaatactatatgatagagtatcgtcgtccagtgtatcaagcatgaatattgaccatgttcgtgatgaatgccatgcacccttcatgatggtcaaacaaactgcgctggtttcccctgcttcgtcggatgtggaaatgatgtgtttcattcccaacatacgcaacaggtgagaatatcggggattttccccgaaatattcatcataacggctatgcacttgacacctccgcgtatagttcgctgatcagcttattcacttcctctttttcatcgtcggtgatctgcatgttggcgatatactcagtgataaggccacgaacggttttgatttcaaagtcggtatcgacatccgaatctgtttgaactttgtctatgatattgatttcataggcaatttcttcaattttggtttggaactttgcaagcccctgatcaatttcactgacaatcagacgcaccgcgcagttgcggaactgttcgagatcaacatctttctgtgctggatacatgatccggcgatggtgacacacagggttagcgatgaaagtcaattcaggcttgcccgtgaacacatagaatccgcgtgtttcgtcttcgtcgtttgcgctcatagtcagaggcgtaccgatataaaacacgttatcaccctcgttagcgtggtgatagtgtccagagtaaacacgatcgtacttcttcaagaaatcaggttccagcccatgatcggctttgctgttcttgtagaaatagtaaccagacagttcgaagtgtcccaaacaaaagttagctttcgattgtttgatgtagtcaaaaatacgctggctgttttcctgacaaatccacgggatcaggtcaatcgaatttccgccacctaaatcaaccgtggtcggttcgtcgatgacattaaagcattcgtattgacttagtatctcgcgtggcgcgttggggcgtattttgtccttaaattgacaatcgtggttgccgacaagaacatccagagtgatccccgcctcaatcagaagaggaaccagcttttcacgaacaaaattcattgtcgtttgtgtggttgcttttcgaacgtcgaagaagtcgccagcatggaagccgcgcgtgatcccgtgttctttgcaatactctacgatctgtttgaataccgtatacaggttttcttcgttccaggggttatcctggcgaagtccggcatgggtatccccaattaaaacatagttcatataaacctcaaaacccccgaaggggtttatttgccgtatttttcagaagccatgatgaacaggtctttcaactgctggttcgaagtgatccacatcgtttcaatcagttcatcgttgtatggttgcttgagcatatcacgcatctttttgatcgcgtatacgtactgctctttgttaccttcgaagagtgcgttctctgcgtgtttatgcagtcgcttccattccgctttgttcttccgcatgaacttttgtgctttgcgtagggcttcctgttcaatgcgtgtacccttgatggattccagttcttcttcacgaagatccagcgctgatttttggtgtacttcgtcgattacttcatgctgcacgttcatagtaggtgatctccatgatcattgtttcggcgtttattacatagtccagacgaccttctgctatctggaagtctggatctcgtacatctgtagggtcgatgataatcggaaccccgacgttctgcaactctaatttcacaaggtaaggaagcagatcaatttcgtcgttagcatctgctaaaattttgttcaggtcaattttaattttcatagaaacatttccaatgttggcgattcgtccacaacctcgattttatctttgggttttttcgcggactcttcatactgattaagtttgtcatggatatcctgaatgaaagtttcatcggctatcgtggtcatatcagtatcatcgctgtcatagacatgttccaggaagtatttgtatttcttcgcgttctctttcttctcgtagagaatacgagttacaaacgcttgccagcaagccttgttgatgtaaccgtagacgtttgtatatttggtttcatcaaagttatgaaggccggaaatcgttgccgaaattccatcgtcgatcatatccattttccagtcttcggaataacggttgaagttgtatcgacgtgccaaaccgtgagcaatgttcataatcgcaataccgagttcatccggcatcttacgatcaccagtttcacggatttgctgtttccacttacacataactggatacagcttatcattatctgcataaatctttgtagtcattatattctccaaattgaatacattcattatagccgattgaatcaggtgtttcaaacctacttccaatctatattatttaataaaatcagcgcgaagcgcttccgtgagcgaagcgaaacggatagttaaattggttaaaaagtatacggaaatgtactgttttc

SEQ ID NO: 8 - DNA, 178567 bp, Unknown
  source: /note="Description of Unknown: colon-36 Bacteriophage sequence"
caacgcggtaaacttcaacggaacggtcgaaacaaacggtattggttgtggtacgccaaacggattgggtacgactggtatttctctgggtgataacgatacaggtttcaaacaggaaggtgacggtattctcaacgcctatgcaaatagccagcgtattatgcgatggactactggtgcaactgctaactataaacagttacaggttcagggtgttaacgggccagcattacttctgaataacacagcgactaaccaatcatgttatttgctgattactttggcaggtaacaacggcgcatacttcgggtttggtggtgctgatgataacgtatcggtacacaactaccgactgaatacgaccttacagttgcgtacttcggatctgtatatgaaccgtggtctgtatgttgaaggtaacgtaaacgccaacgatgtgtatattcgttccgatattcgactgaaatctaatttggttgaattgaaagattcattaagcaagattgaacagcttaaaggttatatctacgataagcaatcaaaagatgctgatgatatcgtataccatcgcgaatccggtctgatagctcaggatgttgagaaggtattaccggaagcagtgcgcgaagacatcgacactggtatgttaaccatttcaccttcgggaattaacgcgcttctggttaacgcaatcaacgaactgcgtgaacgtctggaagcaatcgaaaacaaattaggggcttaattgcccctctttcatgaggtatttttatggctattgtaggagtccctggctggatcggttcgtctgcggtcacagaaacagggcaacgatggatgtctgctgcgggtaatgcggttcgaatcggaacaccgttttatatgtctcgaatggcgggacaatcggtatataacatcaactttacggtgtatgagcgttactataacaacgcccgttatcgtggtcagtggggggttggttggtattcaccatattcgaaaccttccggtcatgatgcggttggtggtagttttaacggcaacgcattcggtactgtagttgcagcacaatcaacacctgatatcagtgtaattactattcaaaacggtcctgctgtcaacctacgtcttactatggatgacggcggtgtattcgattttgacaacaacggacgtatacatgatggatatcgtcaatataaggttgtttcttctcaggcgaccagttggtatgactatctgaacgcccgtacaggtcagaaccgttctggtttggttacgcaacgttaagtaaattcctaaatatattcgggggtcggcatccccgaacttgaggtttaaacatggcactattacaagataaattggcggtgcttgaacgggtaatatcgttcatcatggcggtcaaaacatggaaacagttattcattaaattggttcttatcgtcactattttcattatgttcgtaacatggtacaagtgggatgacttattttcagtctggaaaacatcttcaagcgttatagacgtgccgacgatggagattgaaaaggcaaaaaagtttgaatccgtatccatcgaacagttaaacatagtgcatttaactacgggtgcggatttttcggcaatctttgggttcagacctaagaatgtcaattattttgttgatataattgcgtatgaagggaagttaccgcaacagattaacccgaaaaatctgggtggctatcctatagacaagacatcggaagagtataatagacatataaacgggctgtactatatctcagatattgcaagcccgtatcttccaacaaaagaccttgttccggtagcatatacctttagttgtccttatttcaatctcgaaaactactattctggatcgattctaatggaatggtatatacagaagcccgaagtcgccgatacgaagttgatgatcgtgtgcaatcaggccgcaagaattttaggcaggattcgatgataatttcagtttcaaactactcaaagcccgattgatgaaatcttttactttcgtcatcgggcttttatcgtatatgtcccatacgcgcatgagttcgtaaggtgtcggaacatattcatcgttccagtatccaacattacctatcgtaatgcgccggaaaccagcctctacgctgtgatatacaaagaacccagccttacccacaggggcgactttaaaaccgcgtgtagcggctttcatggcttcgtcgtgtgtcatgatagaatcacttcgcctctgtattgattgtgatagatgtatggacgaacacccagtgggtgattatctatgactaagatcgggtcaagttcgtcgttgttatcatcttctgcaactatatcccagtcggtcgctttctgttcttcaacactggcaatgaatacctggttaatctcaaccttacggtgagaacggcgaatgatcgtatccccttcgcggaacacgatcatatctgggttaatcgggcggtacgcggttttacccgcgcacacttcattaagcatttcttcgtatgtcattataatacctttactcgctgaacgattgtttgtttaacttctttgtattcgttgtgaagtttaggtgtcgctttgaagcgaatcacatcaccctcttcaacaattttgtttccgtagtagataaccacgttaccatctacgttgattttggtcatgaaacgttccacttcggtgtaataagaaacttgggtatatccgagagaaatcactttctcaacaaccccgctcatttccatacgcttaccgatttccccgatgtgctgtgctgctgcgatcttcgcctggcgctctgcttcccattctgcgcggatctcttcacgtttagcgatgtaatccttctccagcgctacgcccatgcagtaagagcaaatagcctgaaatactgggctatcgttgccgttttctttgcactgatcagcccaccacagaatcgtatacatcggcatatcagcaatcacttcacctttacgcttaccgattggcatgatgccctgttccagcagttccaggttttcggtatcctgtacggacagtttaccgcgacgttcaaacagatcgaaatctgcgaagccctggaacaccatctggaaagtatcggtttggttcagacgatccaccatgcgatcgaagtattcacgcgctttcgcttccgctttatctgggtcagtagacaggttgcagatatagttatcagaagtgaattcacctccacgacgctctacacgcagagtgtacatagcgtttttagcgccagaagaaatgaaatatgtcgcggtaactttagtcaggttagtcatggtgaatctccttagtggtttcgtttcgacaaggccaatataacaaaagccctcaaccgaagtcaagggctttttatcatgcgttcgaatctttcataactttatgaagatggatatcaaaaattttccagtatgcttttccgcgaggataaatttttgctttatcaatgtcttcgttgcttccccatgtattgtttgggttacgacaacgattttttgcataatccatgtgccagaataagcgctgcaccgatgaatctgtgcctaatggatcttctttgctgaacagaatttgtgaactcataagaagaaacctgttcgaactactaaatcgatctgtttttccggtatcagtggcgctttatcgtcaacgttgcactgataatacatcccgacatactcatgaggaacgttggattcgctcgcccatttcaggttgtcatctgtacgcggccctaacatgaggttaacgatattgacagcgtgatcctgttctggggtattgttgcatccgttcacataatgtccgtgagcggttttgaggatttcaatgatatcttcgtcggcttcaacgagatacagccccgtgttttctgggatttcctcaagaataatcaaagcggttttcatcacacttacctttatgtttctgcttacgttttgcttctttaagtgctcgcttgcgatcgcggtgagtagaagcgcggttgaaatcatgtttcgctaccaggttgttcatcgaggatataatggcacatgatgttgaatactgacttcgccatacagttttacgatagttaagctatcagatcctttaacaattctgtatttttctggaacaacgcggtcgatttcttttttgacaaagttaagcaatccgaagtcatctatatcttttggtgctttggaaatagaagacaacgatactcgttgacgtgaatcatagtacgaagaaattacaaacatatattattttccttattggggcttttcagccccattttagataattaatccagcagtttgcggattttatccgcgatacgtccggcgcgtgttgcgcttgcggtatgatcactttctttggtagccagttcagccagcttgcgctgatgttcttcttccgctgctttgcggtctgctgctacctgttcgacctgcttctgatcatgcgcaatacgcgcttcgagttcggtcagggttttgtcaaaagttgctacgatttcgtctacagaacggattttggaaaacagtttcatattcattatctcaattagtatggttggaattcaaagtcaaacagatcatttagtgcgcggttgtattcagtatagttctcaccatccccgaaccgcatctgaatcgcgctttccgctattgtaccagtaagattcgagaaaccaaagaggtttttaatcttatcgtgtgcaacgaagtacagagaagcactatccagcaaggccaccatcgctgatggttcatgttcgcggcgtttgatgcgtaacagagtacggtttgcgccagtcttacggcgttgatttggggctacgtagaatcgaaatactactttacccgttttatcatcaactaccaggtagaagccgtgttctttcaggtcaaccccttcgaacttggtgaagtcaccgcgcttcatgtcacctatcttaacagcatatttgtggatgtcaagccttgtcagaattcttttcatttttctttaccagtttatttcctaatttggtgtttacaccagttttcatattcattgtcagtaccagcaagaagatagggcatgacaaaatcaagatcgttgcgccgaacactaagcgaactaagcgaatcaacaacgtcccgatccatttcatcggtatctctacccacttctgaaccgttgcgagtaccagcataacataacccagattaaatgcaagggctgttgcgataataccgtaaggttttttgaagtatgtctgttctccgtcttctgtacgtccagcggtaacgttgcctccgttccagatttctttagcggttttgatggctgtttctgccccgctcaagttctgccagtagtcaggaatgctctgtaggaatttcataatcaaatcctccgcgcctgaatcgctccaggcgctgttttggggttagtagtgactgaatcccacagttacatcacgcatcacctgataacggcatacacgcatcttagcgttatcgtaatctgtcgggattgctacaacatcgcgaggattaaccttaacctgaatgactcgcccacgtcctccgccatagtgaggcaggtacgattttgcggcaacatgcaaaccgcatgaacaggttcggtttttattctcgtctacctggttacgtggcatttcaaccacaacaccaggggaattatcgaacttaccggaagccagatcgcggaagtcttcacgaacacgtttccacgcgtagaaatctccgtcatctgccagttcgatatcgttatgtaccatgaacccataaagctgatacacagcatcgcgtgaagggttttccatcaacttctcaaagaagttaaccaggtgctcgtaagggcgatcgttgtacatttcgcgaacgatacgttgcgtgataccgctgtcaaacacgatatctttgtacaggactttatgcccgatgattttaatgttgcctttgctgtaaatcttcaacgcttgcgttgtgtccaacagggtagcaactccctcaatgtcgcccttaaccattaaagcatgtgctttttcgaagttagggtgtgacgaatccgctgtgatgatcttgccgtccagtaccagagtaatgaacgattcagaaccaatcattttagatttgacatctgtttgcggaagtggtttcgatgcttccgtattatacttagcgtgttgctcggtaataacgcgcccgatggttcggacgcttacaccaaattgtttagccagtgcggttttgttcgcgctggtcagaaagccctcataaactgctttcttttgtacatcatcaaggatcttaacgtttctcattatttccaccgtataaggttgaccaaatccatcacaattttatcatcattaaacatactgcggaatgtagaataagatgaatgtaacaacatgtaatgaattgatgggttgcgttctgcaaataaatcgtaagcagtatcaacgcgttctttcatatctttccgcattttgtaatacttcgttgacatttcacgaagtaacgggttacgcacaacagtttttgatttgtttttgtgctcgatagtatcgtaggtaaacttaccatcaagataatcgagcaacaaatacaattctggattatagcggtttttaaccatgcgatcaagggttacgcccatagaatcgcgcagggttcggatctcgcttccgtggtttgatgaaatccatgcagggaaccagttaggttttatcttcttcgctgcgtccgcaaaacgttttaccagataatcatcaaggcatttcatgttgctatctggaatgcgactccacagagagtttcgcagaaccatcacttcgttcagccctgtaaccgttaacatggtcatcatactgctggcgatgctacccaacgaatagttcggtgcttctccgtccagtcggctatattcatcaagcccatagaggcgcatagcgtacatttcatccagtttcacaaactgtgctttagtcaggtacagatcgtttttctgtaagttgccctgatcatccaggaagtaatgatatgctgtaggcgtttttggacgcggttctgaatcaccggaagatgattcacgcgttgctttccagcgcttgcgatcttcggtgtacgtttcgaattctttggtcaattcactggttttcagtgtaacgatctcagattcatcgaaatacccagttctgatcaagtcctgaacaggttcactattaatctctttggttacgaaactgatacgatccgaaccattcaacatgcagtaaccgatcagatacgggcggagtgaacgcgcttcattatcgttttcaacgatgaacagtttcttctgtcgccacggttgaatcatgcgcataacgtcctggcgtttggtagtttccgctttgtatgtctcgtgacggcgaccagaacccacacgttcaaatacgcaatctttcccgtcatatgggttagcccagaagcccccgacatattttcctgtcgcggtatcagggtttttgatatgcgtcaggatttcagccagtgattctttacccacacggaaacggttatcgcgggttacgaatgtctgtaacaagccaggcagattgttgaaccatacgagtttatcgcgggttgttttctgtttattgtactgatccatcaactcttcatcgaaacgcttgttgattttgtccagtcgatccgtgatcactttcttcgtgactttatcaaggctcaactcttcacgcgacggcatgaagtccagcgatcccagagggaaatccagaatataagcgtaattgctgttacggtagcagtagaacagcgagttttcgaacatgtccatgtcgattggatagcaaatgttacccatacgcgcgtatacgcctgaatagttgatggacttataacggatgatcccgcgatcgtctgcttcttttggttgccagtttacatcaacctgaacaccgataaagcgaggacggatgcccgtaaacggttcataaacacgcgccgcttcacgttcccattctgcaatatcttccactttaaccggaacggtgatttgaacgccgttaggttcgtctgtttcgatttcgtagatttggtcaacgaaaggttcaccattatccatgtaagccgtgtatgcgcgtttaatgccgtcctggatggattcgatagtgaatgtttcggtgtaacagaacggggatttgctacccagccccagcgccccgatcagttcatcggtgtcggttttggtggattcgaagtaggttgtaaacacctctttaaccatccagtcacttaaccccgtaccataatcacggacgatgaaacgcggatcgagaacagttggcaactgaacatcgaacgggttcatgttacccgctaccagatgtccatcaatggcgttacaggagatctcgcgaatgattgcacggatcttgtatttgtagatggttgatgacaggattttgaacgttttcgcactggtagccattttaaacttcgtgcgttcgcctttatcgaagcccgttgtgtgaatggtttgtggtgctaactgacgtaatttcattgtttatatctcacttggtgttaaagatgatgttatcgcatgaatatttcacaggcttttgatcaagcccatattcaacaggtgtacacatccggtcaaggtattcgtaaacctgttgcttctgacgttcgcggtctttcatatccatgataccgaccacgatagcagttacaaaacatattgcaatagtacacagcacagctattgtaatatattttcccgtttttggtgcatcatatggtttcattgaatcgcctctgcatattgttctggtgtcaatttacgcgctactaagcgccctttggttgctcttttgtttcctgaaatgtagatgttcgcaaggttgcgtttaccttcctggatctcattgtacatcttttcaggcatattgcactgataaacttcgccgttcggagttttcaggaacaaagcatacatatcctttttgctttcccgaatcactgattgctcgcgaacacggcttttggttggcgtaggctgtgcgcccaactcgatagctttacgctgccatacgatcccgtgtcccgctccatgtcctaccagagcatgagcaatttcgtgcatgagagtatctaaaacgttctcgtatgtgtcttccttaacatgatcgcgacgtaactcaatcaacttacgagtgtatgaacactgacctaaagttcttttgaaacgaccgttgattttgaaagaccaatgagataagccatacttcgccatgatgcttttggcccaaatggttatttccatgtcgctacgagttttgaacattttatatcctccccaaatcagtgagaacactataacaaaaaagcctcccgcgatgcaagaggctttttgtaaattatttcaatttcttcgaaagttctttcaaatcattgagatattcagttttcggggtcgtttcttcccagtatttcagttgcttacgcagttcgttcgcttcgtcttccagcttttgacgttcatccgtggttagatgatagatgttcatcgcaaccaggatttcggcgtggttctcacaacccgtccacgtagatacaagtttaaccgcttcgctgcgactaagccccttcaatgcgtcaggttgtgcgatcatctggtcgatgaagtcaaccttcgccagcgccttatctaacgcttccttagtctcctggatgcgtttatcaatacgctgttggtaaacaccaatacggatatcaacgaagtctttcagcaacgtttcaggccgctcgtatgaatgcagtttcccgttaaagataacgttgatgttcgggtttgagttctcaatcaatccgaaatctttcaggatcttctcaggggtaagcccgtttgcatactcgcgtttgagggtgatctcgtagcggaaatcttctttcgatagatccttatagcttacgatataccctttctcttccagcttatccagaatagaaatatatttcacgcgatcatacttgaccggaatctctgtgatcaccagtttagttttaccctggagttcatacttgccatacatcgtaccgttttcaatgtcacctttgaaatacgggtatttcagatccagtgtgaaatctttcccgttcaggtaactaacacatccatttagaaccgaaatcggatcgtgtggtggaatgttggtagcgtatgctttcgcgatcccgctgaacccgttaaccagtaccatcggaatgattggtaggtaataggctggcggtacatgttcagggtcttcatgtgggattgttaaatcctcgtccatgtagatagccttgaacagcggagacagcttacatttaatgtaacgcggtgcgcctggctttttaaccagacgggaaccaaagaacccatcgcggtcaaaaagcgggatgttattgcaccagtgcgccgccataagagacaatgcctcttcaacggatgtttccccgtggtgataaccatacattgcaacaccgccagcgatagaggctactttctggaagcctgtaccgcctttcgctgcggaatgcacgaagaaacggtgaacgggtttgaacccgtctaccaggtgcgggatcgcacgagaataaattgtgtaaagggcaaacgtaagcccttctacctgcacaacgtctttaatacttctttccatcatttcaccgaaaatttatgttttccgttcacccagtctttacgcggatcggattcatcaccgaaacacagttccagaacgtctttgtattcgtcgcccagtacgattgtatcgtattttaactggtcgcccaacacccgatcgtaatcttctttgcgtaaagaacccagccctttgatatatcgtacctctttcgctttatcgcggaacggtgcgaaatcttcaagggagtagaaccatttttcatctttaccgactttcgcaatgataatcggtgtgcggatataacggatctttttcttctcgaacaactcaggccagcggctaaagaacgcaatcagtagggtgagaatatcgcccccgtcaacgtccgcatcgaccatgatcccgatgttgtcgtaagtcatttcggaagagtcgcctggatggagattcaggatcgccatgagttcagacaattctttgtttttgagcacttctaagttactcattccccaggtgttcaacggtttgccacgtagcggaaatgcgccttgtgtctcttcgtttctgcactcgataaactgccccacggcggaatcgccctcggtcagaaacaaagtggtttctaccccgtcagtgtcgatccctgatgccggaacatgttttgcaaccttcgcctttttcgctttcttcttcgctttggtaatggctgcggcttctgctgcctgtttgcgaatcagagcggactcaatgatcggagtgattatttcagaagtatccataatctgtttcgcgatctttttatagttcagtccggcgtggttgttgaactccccagcggtgttagtcagtttttctttcgtctgactatcaaaagctggtgcattgaagttatgcaaaaacacaaccaaagtcaagcattcttttacacgggctttcgggatctcgatagcgtgtgttttcttgatcatcggttcgagttcggaatagataccgtcgatcatggtgtcaacatgaacaccgccgtttttcgtatctaatccgttaacgaaggatttctgtttgaaaccgtcttctgtgctcgccaggatgaaactgattttgttgtttgtctgggtaatcgttttatcgccgtacatcgcgccatacatcgcgaatttgttcgggaggatatcaccgttatatgtgaatttaacggcagggaaagccactgcaagcgccataaggcgatctttgatgacttcctttgtctcttcgtcgataccgtccacaccgaagatagagaagtcaggggtaaacttaacggttgtcccttgctccttcgtcgggctggtgcggtaatccatgttctgcgctccgtccgtacagttgatcgtgactttgcgtttaccgttggatgtctcaccgataaagattgcgctgtaacagtttgtcaggaaagaaccaacaccgttcatccccattgttacacggttttcgtcatcgaagttagaaccggatttagccattgtccaggctgcaacaggtttaggaacaatcttcccttccggcgttctcacgtcatcttgtggaatgccgcgcccgttgtccgaaatagtaaccagattgtgatcaatcttgacttcgattttgttcgcaaatttgaaatcagttcggatcgcttcgtcgatggagttatccaggatttcgttgatgattttcaccaacccttcaacgtattccactttgcggaatttacccatgataaaacgttcatgggcttctttgttcactgaacccacgtacatgttcggacgtttgcgaatgtgatcacgatcgctcaagcagaatgattcatccaccttagcgccctttgtcggggcttctggtgctttctgcggctcgttatcgtccattaagaaatctaaactcatattcacctctttattagttctcaggcattatatagggttctatgaaaaagaaaacccctttcggggtttacttgttgtacgggaaaccgtctttcaccatctgaggcttatcaaccgttcgtttcgcctcgcccccgcaatcacaatctttcggttcgtcgcggcttgcgatgctggacattttcgggaattctttttcgcacttggtgcatttataggtatatgttggcattaataaatctctgacaatggaataaaacggatcggggttgcggctttgctgaaaacacattgtttattcccagcgaaaaggagatcagtttcgtacaccatgcagatatacccctgattctccaaaatttgccgctcccagctatcgaaccatttagacaacttctgcaatgaagagaagccgaaaatatagctacgataatttttaccatgttttttgaggttacgcattaaacgaaggtcttcgcatggtgcggggtgacgagtatcggagacaccgaagtttaaaccgaactcgattccatgaatatcaagatactcatatagatcgtcttcgtcaccaacacaacccgtgtacgggcctaactgcttacaccatccatcatatttggataatatagacgctttcaattcaacgcgataaaccaacatgatccgatcctcgtaattgattaactacaagtagagtaccacttatctaatttcttatcaagaagtttattgatcacttgcgcgatttctgctgttccgtgggtagtacccagtttcaggtaaatcacatcaagcgcacacacgatcgcatcaacgctttcttcgacgatatcaccgccgcgttgaggctgaacgagacattcggagatctccccaacctctgcggacaggtggtgaaccacgtcgctaacggttcgttttttgacgctatgagcggtcttgaaaaacttatccagaactacagcggaattttcgcgcggtacttcctcacctttattgacgtggttgatttcagtttccggttctggtgcaacccataccggattgaaaagccctttcatatcgttgaacttgataggaacgggaataccttcaagataaagaatccctgtttcttcatacaccatactgatccggcgtggtgaattgaagtccattggattcttacgcaacgcgtcatacatacgacgaatcgggtcggcttcggatgccatttgacacacagccattaacatagatttcggggcgtacatatcaccaattttatacttgctcatttacaatacctttatgataaccaacaataaaacagttcacttctggacgttcgccagggaaatgcacacattgcatgacgcgttcagccatgagttcttcgcccaaataaacagaggtggtttcttcgttgtagtggcaacagtaagaagttttaacactcataccaggcaatccggcgatatgcataaactttgagttcgtgcatggtttaccctcaatgctctttccgtttacatcaaacgttgcaaacatttcggttttgctgttctttgggcgtctgttcatttattcacaacctcattatatgttttcaggttccattcatgcacttccggcactttggagtaatgatccaggaatactaactggacttgcataacactagcacgatccatattgaaaaggaagcgttgcggggaagtaatacacagaaaatcttcggtacttcctctgcttgcgctaaactcttttgtttctccgccgtcaaatttagcatatacaggcgtagaaaaatacggggcgaatagttcgcgtttggaatcgtccgtaatcgcactgaaacacacgtctacgagctttccggttccttcccgtctgatggtgagcattgtccctttcgtgcgccctaagacgtttacagagcgcgtggtgacatcaccaaaagcgtttgtgtaactcacagtctccacaaagcccatatcacgacgctgttgtagcattgcttcgtgttgtgcttctgcatcctgttctactactcgttgtgcggcttcatacgccgctttgttcggatctcttgattgccatgcgaagaataaaacccctgcggctatcagtccgaagattgaccaactggcggttgctgatagtttcattttaatttccaaagggaccgaagccccgtattagcgaagatagcgaacgtaaccactctggtcgatcgcgttctctgggttgttgaagatgttaccacgaatacccttagcaggtgctttccagccagcggctttcaagatattgccgtcattgtcgatgaagccagcaactgaacgctgattgaacatttcaccagtttctttgttgcgggtatcctgcacgatacggtgatacttacggcctttttccagaacgaacacagtttcagtgtaatcgctgaaccacatgccagtattacgacctttgtgcatcgcgtccagtaaaggctgtgctgcggctttcagttcgtcaaaagtatacatggtaaaatctcctaattgtgtttcgtttcgatgtgtgtaatatactattatgcgttcaggattgcaagcattattttggttgttcgcaaatgttactcaatgcatcgcgtttaatgaacttcaatacacctgctttagcttctttctcgtcttttgcctgatacaagaagcagtcttcaccatttttagttttgacggtaatcacgaaagttttgtagttcatgcgtagttctccaggttagccagattttcttctgctttagcaagggatttttctgcggcttttttcactgctgcatactctttcttttcccatgctgcgatatcgctgttcatcttttcgtcgcaataggcgatgatgcctttgttgtcgttgatctgctgaaccaggaatttgccgtgacctttgattaaagaaccgttctgcatcatgataactctccttccgtttcgtttcgatgggataactataccaaagctatcccgtgaagtctttagcaaaaagtgttatttgttaaacccgtttcccttgataccatttcggaaaagtaacccgctcgataaaagttctccccaggttgaaactgtcaccgaacaggagaacaccaaacaaagggtcgcgcttgatgtcgtttttcccgacagtcttcattttcccttcgtggatcacggtgtcaccaaccgtgatatccttgatgcttacttttacatgatgcatacaatcacctctgcgagtttagcaggttttgcttctggtctaactttcaacgcatcattcagattcttttcaaccatcgctactgcgtctttttcattgaacccgttcttaaccaggactttaactactttggcttctaagtttttcatgatgcgttccttttgtctgtttcgtttcgatgtgtgtaatatacaaaaaagcctcctgcattgcaagaggctagtttaacaaaaagtgctattttaatgatttaagtgttctacggattcccccgttttgggtgatatcgtaaagctcttttgctttggaaagagataccgtgatgtcataatcggttcccttctgtgagaatgagaatctaacctggtttagctccgtgtatacgtgggtacacactgcttccattcgaaaatgttttataaacgctttcttcgtgtagtagtcgctaaaccattctcttgctatggattggtcgattgctttgaagatgacaaacagcacaaccaacacaaaaattactataagtggaattgctgtgctcattatttgcccctgttcacagattgacggtgtaacgcacggttaacgcgtggcgcttgataaggtttcattttgtacggtgttggatcagagtattcgatccggttaggtaatgaatacagttcaacgcttggttgaatccagcggattgagtcgattaacccttgagttaacgcacgaccgaaacctacaccaactaaacataaacgcataatatccccttactgtgccagaatgtgaagccattcgcccaaccacacgatcgcctgataagacaaccacaccgcaccggacacacaagcaatcacaccaatgatcgcgaatccgattaaaatgttcaaaccttctttcaaatcaccaaacatgtttcatcctcttttgtttcagtccctacaaaataacaaagcccctgcacgaatacaagggctttttatcataattcgactaactgaggcaatttcagaaccatccccggaaggatatagcttgcattgctaacggttttgcggttcaacttagcgatagactgccagcgctcaccacaaccgtataatttttcagcgattgaatacatgctatcgccaggctgaacaacatattcatcgtattcgactttaacgaacgcggggttcatgagaatgtcaaacatctgcgctttcgcttcgttcagtgtttttgcatgtacagttttacctacaaatgataatttaatcatcttttcctcggcagactcaatggatcggtttcttcttcacttgggggttcttccagccccagcgcatatctcaatgaatagactatcatcaaaacatctttcgcgcaatcgtgaattgaattatgcatcacaaaaccatcaagcaaccctttccgaagaggacaggtcgaagcatcacgcgttaacaggcggttttcgatacatgtacgcacatcgcgactattccagaacacggtcggcatatcttcgaagatgtcgatcttaccaaccatcttacgcacgatatcaaccaggataccgcgatcgaattcaggaccacgaacataatcgagtgattgccaacggctcacaccgtccgctttcaggtcttcaaagaattgtctgtgtcctgcatacagttccagatcttccggcgacggtttcaggatttgacgggcttcttcgctttgttgtttccaccaggcgattgttccctgatcagcaatacgatcaggctggttgcgcaaatcaaatttgtacttgcgcccccgtgcaaccagttccgcgaacgttggcgggttgtggggatcgtcaacaaatggaacgtatgagagttcgatcaccttcccattcggggaagggccaaccgtttcataatcccatacgtaatctacgggtaaatgactcatgaagttctccgcttataatcttccatgaagtacgccagcgtaagcgcaacttctgggttgatatcaaaagtttcaaactctttgctttgcaaagtcatcataccgaactgacgcagaccggaatgataaattgccttttccagacggttcgcgttttcaacagcttctgtgaattcgtccaacacatcgcgatcgatgaaatgcggaagttcttgaacaggggttttgaaaattagatctgcaatcgcttccgcgtggaggcgtgggatctggatagatatatcttttttcatgatattaatgtccatatgtctttatcttcacgaatgtttcgtgccattcgaaggatcagcacgataacgccatattcatcataagtcagttcaatttcttttgcaataggactccatgaataacttggtccgttcggagaatacagaatatcattagatttttcaatgaagcgcaaacggtgaataacttcttgcggatctgctgcgctatacatcccgaacacattgaccgcatgtggatctttttctcgaattttatcgagtgcttcaagaattcggggaatgtcttttacaaggatagtcaatttcataataacctcaaaaggggcaaagccccttatacataatcaacggtgtaacgtgcgcgggttacgcccacatagattaactgcttacacagatcgtaatctgcgaacgcatacgcatcgcgcgtgtacatatacgcatggtcatacgtgctcccctgcgatttgtggtacgtgcaaaccggaagaggcttaacatcctggaacttgtttttaatcgcccagaacgaatgccacggggctttatagcctgtttgttgcttgatgcgcttataagtgctcgcaacgtaggccagatagttacccagacggtctttcatcaccggatcaacaacaacctgaatctgtgcttcggtttcctcttcgagcgataccgttttcagaagatagaattcaagttcgatcttctcgtcgcacttctccgccttgataacttcccgacgcgggatgatttctaagactcggattttttcgttgttgttataaacaatctcggtgaagatttgcccgttcaaccgcatttcctgaactaacggttcctgcatcacgatcacttcatcgagaatgaaaggttctgttgttttgtacaggtgtttacggatcgttgcgttcagcttgtccacgttgtcgttagtgtaagcgaacatgcggttctcgatcaagtcatccggcgttttgacacggcggaaatactgacggaggaagtcaacagcgttagcatgttggaacacacccagatcaccgacagacatcggtttcagcatcttaccatcacgtacagcccttgaaacctgaataatcgggttcccttctgcctgacgcatgattttatccatacggataacatcaaagatttcttcatcaaagaacggggagagttcaacacgtccatcggcgtttaccggacggatctgatctttatcacccagtcccagaataacagcgttgcttggaatactgcgccggatgattcggaacagatccatatcaaccatcgagacttcttcaacaacgaacacgcgacaggtagacagatcaggcgctttcttgcctttctgctgttcgaacacacgcagttcttcgttagtcacagggctaatcttcaatgcagaatgaatcgttgttgcgtccattccggtagccgctgctaacacgtttttcgcctggtgtgttggggcagttaaccaaataccgctaatccccaaccctttcagagtgttaaagacaaacttaaccagtgttgttttaccaacaccagggccacccgtaatagttgtatgaatggcgttctggatgttgtggatcacgcgatcatgcgcggacttctgatcgtcgctcagatcatcaaatgttaactcgctcataatttgagtaataccccttgaattttcgaattctcaataaaccaacgcatctcttttttctgttcttcggttgctggtagttgctcggttttgcggaagaaactgaaacgcggttcgtccggcgtgtagttcagtttggtttcgtagcacttgcggataaaatctaatttatcttttgcaagttgcggtgatgcaaacagttccggcgttttcccgttttcaacgtatggaatagtaaagccgtctttgtctttcgtaacaatgatatagtatttgtcaatcattttcgcccctcatagatgacgtagaaaaaacctataacccatagcaatgataatactatcaaagcggcttttctgtcaacaccgttaacgtggaaaacgcaccatccaaagagatacgttatcaccgcgcaaacgatataagacaaagcaaatacggcatgtagcgcggtgagttccattagtagttgttagcccaacgacgcaggttttccgcctgtttcagagcatacagcttgtagatggtttccgcatccagtcccagcgcgaggaacttacacatgaagaagtgccactggtcaatcagttcaaacaggatttccagcttgtcttcttctttcatttctgcgaatacctggctacgcagttcctggtgatttgctttccacggtttccagacaccggaagccgcttttgcaccgcgagacataccgcccagagcggtgtaaagttcgcgggtttcgtctgcgatcgcatcatcttgcagtttcagccagtccaggatctcaccgcacgttttcagttcgttcggacgtggaacccaattcagggtatcagacaggctttgttgtgcatggttttgcaagtccagcatcttttgcagcgggtcaattccgttctgcaatgcattgcggtagaaaccttctaccatttccagatcatcggctttaaccaggtgcgcacagctattaaacacaggagttttatcagtcatatcaatctcattttttcggtgatttgttccacgacttaaaccgaagttttgccgtgagtccagaaacagtattatctttcaaatactgcatgatttcaagtttagttgcgccgtccgtttttatcatttcgttgatatcttttgacggccacgggcatttgtcccacaacacaaccttttcgccagcctcaattaattttaaaaggcggtgagtagtatcagggtgtctcgcttcattgtcaagaacccagacacgcatatttttatacggaacgtcagacagcgccatttgtccgcccgtaatcgcaccagcattatctacaaacaggctatccagcggcccttcaagcaggtagacaggtttcaacggatcgatggtatcttgaccataaactttcgttgagtgttcacacgctttgattgtcatgtattttgcgttggcattgtcacgtaaggcacgtccctggaatgactcgattttacccttttcatcaaagatagggatcaccaaacgcggttcatccttcggtaaagggtatgcgtccgcattcacagagttaaccaggtgttgccattgacgcgtaaaccagaggcggtcatatttgtctttaggtatgtgacgacctgcaacatacttaacgatagggtgattttctggcaacgtgtccagacgttcgcagaactgcaattcaggaatatatttcttttcttccttcggcggttcttcgtgcgtctgttttaaatctttacgatccttgaaagattccatcaaatacgccgtgtaatcatccgggtaatagtctttcagaaacacagaaaacggcttgctgtagttgcagttaaaacaaccacacatcatgtgtgtgcctcgttttgacgggaatatccagaaacgttttttgtgcttatccttcatggagtcgccacaaatcggacaacgggaatggatactgaattccccaccccgtcgaacgatttcgctttgtggtaatgatcccatgatacgagttgcgaactctatatcaagatacatgtttacctctatcggctaacttctttctctgtgccgtctaaagtgattttccattcatagaatatcttataaaacggataaggtctaggaatatcgacacccgatgatgtttttctttcgttcgtgtacacgatcgctgtgtcgctcatgtacttgatacggataggaaaccaggtgtaattgttcgcagtaacccagatccgataattcaatggcggtaatggtttcattcttcactcttcatgattttacgtttgcgtttatgcggacgtgtagaacccagaaccttcggccctttgttcgtgatcgcgcctgtagtcacacccgaagcaatattatccacacttccgcctgaatcacctgcaaccatttcttcgttgagtctttcgcgaagttctgggaggttcatcatgatttcttcgtgatcttgctcggtcaggttccagcggctccgtaacgagtcataagcacttgtaaggttcatgaacccagacatataaggaaccgcgtttaaacggcgcttgatgtgtctcacagagcgatggaatggggaatatgcttccagttcttccttcgttttcgggtttttcaatacttccccttgaccgtcgatgatacccagcttgtaagccgtccattcagtccagggctttttcagtaggcgaatcattcgcacactgtaggttaaatccatgtttttgattaattgatcgctcatagtctttactctattgtgaaagtgaaaaggttttgcgcgggttcttgctccggttcagggaattccatgcagacaacttcacacatcggtttcacgcctttccattcttccagataatatccggtatcaatgccgcaacctggttgcatttcaaggccagtttcatcaagaaactttttgcatttcgatgttgtcgttgattcgtcctgttggaaataacgccgtccagagtaacggaaattcgcggacatctgcgggagaatgaacgtacccgcacgggcaatctgtgaagcacgttcaatcactttatattcaaattccgcgcccgtatacttacccttaaaattggatgtctttatcttgccgaaaggtggattactgatcgccatatcaaacagagtatcaaactccgtcgttaacgcgtctgcgttaatccaggtcgcttccggtacgatacgcttacccaacttatagtatgtatggtttaactccacacagacgatttcacgcggtttggcgtacatcatcatatgaagcatcgcgaaggatagcccaccgatacccgcgcacaggtcaacaacgcttccactggtacaagcatcaatggtgaaatcgcgagcaagtccgatcggggtaaagaatgcacccagttcagagttattcgtaaatgcaccttcatggaagttttcgataatgaataatttttcgtcgtaggttagcgccttgtcagactccaccagatccattatcttgttgtgttgtttggtttccgctttcgttaacttcgccattgaccttttccggtaataagaacagaggggtagattctaccacatcaaagccccagtcatcaacaatattgctttcccagtcgcgggtttcccacgggctgcaaatccacttatacaccccagcaggatcttcaacctgttcaggcatacccagcatttccgcattgataccttcatccagatagccaggatgaatattaggccagcgcatgatatcaacgtagcctttatcgtcaaccgatacgatccattcggaacgatacggactatcgaacttcggttcttcttcgtctggaagtatcatatctaataaatcactcatttcactaaaccttctttaacgccctctttcatggctttcagaacaccgataaaagcgtctttgccaccgatagcgccgatgataagcatcaggacaccaacacaacccgctaaaccgattctgaacaggttccaggcaaacgggatagccagaagcactaaccacgggaacggaaagcccataagtgcgtttagaaccagtaagataaaagcgattgcaagtttcatgatgtcctcctttgtttgtttagaataaggtatcacctttcgagaatgattgcaatacctacagatacaaaaaagcccctttcggggcttaatttttatgctttgttgattagataccgaagaacgtttttggcctgaacttcgttacagcagagtttgaattctgggtcgattgggaggaagccccagaggaaatcaacgctaccttcaacatctgctttcccacttttcagcatttcaaccagcaaacctctgtttactacgctgttcactactgcatcgaaataacccgcgctgaaatccagttctgggttcatcacttcgtcgtatgggttgttcagtacgttcatttggtatctcctaatcagtttttgttgtctacgggagtcatattatcacaatcataactcccgtcaacccctaatcaggattattttgcgttttttgcaatccagagagtcagtttagggaatacatttgccattgccaccacaaacagcacccagaaagccagcttaaccacaccgatcacgatcagaggcgcaaatacaagccaccaggaagcatttgccataaccccgattgctgccagtttcagagacaggaggatcaggaacacaataacgagaatctttttcatttcactataccttttgaggggccgaagccccgttaaaattgaatgtctgtactgtttgctacttcggctaacttactgcttcggttagtctcggcttgttttaccatagcaccttgtgcttcttcaagcgttttcggcatctgacgacctttataatcagattggaacccgatatcgctgttgtcggtatccatccagcgttgattacccttgcgcacttcgagtttgaagtggttaaagtggttcttatcgccgtaacgggatttgatctgcttgaacaactgcaagccctgatcagctaactcgtcggtctcaatcacagctaacataaagtcagcggtagctggaagaccagcagattcggcaacgtcgcccatgctgatatcagaagcatcccacgcggcgcgggtagtctgcgcaccagtccacattacggtatttgtttcaacagccaaaccgcgaagttcttcggcaatcgctttaaccaggatgtatgtgttttccgccccgcgtacacgggtagaagcacagatccccaggtagtcaacaataatcacatcaggtacgaaactcttcttcaatttaagctctttaatcagcgctttgaagtggttcgcgttcgcccctgctgttgggtattgcttaacgattaaacgcccgaccttcgactgtttgaggcgttccatacggttcttatagtccgcataggtgatgttcccgttgtcgatatcgtccatcgcaacatcaagcaggttagcgtcaatacgtttagaacaaacgtgttcagccatttccatactgatatacaggacgtttttacctgattgcaggtaatcagcagcgagagaacaaagccccagagatttaccaacgttaacaccagccattaagatgttcaatgttccacgttctgcgccgcctttagtaatggcgttcaggatcgggatattgaaagcaatcttcatcgctttggactggtaaagcatccagcgtttttcatagtcttcgaagtaatcatgaccgaccgaactatcgaagctaatcgctaacgcttccgccatgatgtcagggattgccccaacgtcagggattttgttgttgcgttcgccagcaggtttttcagcattcgcctggatctcaattgcacgggacagagcgcgatacattgccttgtcacgacaataggtttccgtttctttcatcaaccattccagatcttccggcgcatttttcatgctgcggatcatctttttggtatcttcgtagactacatcactcaggctctttttgtccagagctacttctaaagcagtttgtgaaggaatgctgttgaattcctgtacgtgcttatccatcaaatcaaagagaatctgcgcgttcccttcgaaatattcacggcgtaaatggggccacgcctgaacaaaatacgtaccattaaaaaccagatttgaaaatattgtttcgacgatcattattacctcttaaaccagattagcgaacatctgaaagaaattatacagctttactttcaacgccgcccataaggtcttttcaggctttgggagattgggcttgatctgcgcgtagattgcatcgtgaaccagcggaatcagtttttctttgtcttcgtccggcgtactaaattcgactttcaggccgttatcccaatacaccttatggatgtacactaagtgtgcaacatcgttttcatcgttgatcaacagttcttgaataacgtcctgcattgcttcatcaagaatgttttttgttttttgttcaatgtccatgattcacctattaaaagggggcaaagcccccagttgtttattactcttctgacatatccacatcatcagggatatcgtcatcgagatcaaatttatttgacggttctacttcatcgtcagaataaagatcttcgagtgctgccccgtcagtgatctctttgtcaggaatacggtacttatcctgaatagcatcaaggaatggttggtgagtgaacagaggtttccagaactcaatagagttggtttccgattcacgccatttcttttcttccagttcaagttcgcctgtttccgtgttcaggaacgcacgaccgcgccagcctttcgttggagtctgaacgaagttcatttccatagccagatccagaagaccagagaacatactgataccgccctcataggtaacatgaagcgggaatttggatttctctttcacgaaacgagatttctcgatgttcatgatgaagtcataaccgacaacttccgtaccttctttcacctgctgtttgcccaggatgatcgcggtgtctgcggaatacatcagaccagtaccaccggaaatgactttcttgctgtacatttcttgtgtgtcgtatgtgtgacagatacacaccattggaatatccagatccgccaggtaaggcgtaaccatacggaacatacctttaagtgctttagcgcgggtcatgtcctgtttgtcgttgtcagacagggcatcagccagttcttttttactcgcggtgttgcctacagagtccacgaaaatgatcactttgtcgccacgttccagcgcgttaagctggctcacaacgtcatttcgaagttgctcaactgtcgtgatacgagtatacaccacacgatcggggtcaacgcccattgatttcaggtaagacttagttacgcctttctctgaatcgtagaacagacacacagcatcctcattcgctttgaggtacgccgcaaccgtcaccagccccagattcgatttaaagtgttttgacgggccagcaaacagagttaagccggaagtcagaccaccatcgaaagcgccggacagcgccaggttcaggatcggtacacgggttcgagttttggtgatgttattgaaaacatcgctttcagacagaattgacgcagattgactattcgagtttttgatcagttttttcaggagtgctttattagacatttatttttccggtttatatacacgcataatatattcctcacaaatttatataaatggggcatttctgccccgtcaggtcttaccagtcatcaccgaacagagtgttcagggatgcgcgtttttcgtaatcaattttacatgcttccgtgatgttttgcaacgggctaatcacatgtttttcaaataatccgttgtagtcaacccagttgagaatatcactttcgatctcaacaggtaaacgcgtaccggattgccatgcgatgcaatcggattgccacgggtttttatctcgcaacggcagaaccataaccttctcaccttccataatcggggtaattccttgaaaacccttcgtatatcggttaaagaacagaacgcctttgatgtggtttggtgtccctttgattgggtatccaaaatcatcacgatattttgagatattgttagcagatgatacaccagctatttcgcggtagtcaagcgccttatactcttcttcaaatactttgaagtgttcgtgtaaggattcttcaccttcttgcaggatgcgacggatcgcttctttcaagaactttttaaccgctgtcggtgtactacttcgctgggtttccattcccatgatctttaatttaggtttctcgtagcgggttccttcggagtcccatacgttagccgcatatcgtttcttagccgtccagaaactacccagacctttcgatcccagaggtggaccagaaatgatttcgcgatccataaacatcaggtgttcgacgttgttcatgtactcgcacagttcgcggtagcccttatcaatgataggttccatgcgttctttactgaacttatccaggaagtcaacccaatggttgttatccctgaacttactttcaccgccgactttcgcgatcacgttgtccatacaaacataaatggagtcggtgtcacagtaacgcacgtatgcgtaatccgtggtgttgcacagttcgttaaggtattcgttaaccttacgctcaatccactgaatagccaactgcccgaacatggtgatcgcgctggcgtttcgaatatcgaagtaacggaaatgttcgttacccaacgcaccataaagggagttgatactgattttacggttaagctgtgcggtgttcgcctgtgcgattttcttctcacacactttcttcacggctttaagcatttgcttagacagagttttcagtacagcttttgattcatcaccgaaatcttcatagaactcgaaatcagggttgatcatttggctgtgtgcgtctgtcaggtgttcgagttcgtgcttaatcagttcgagatttcgctcacccgccatcattctttttttccacgccttacgctgatcaaatactttcttgatctcgaccggaatcacgcctttaacatcgcgtcggaacatccacccgttaggagagcagctaaattcatcgctaggacgcggcgcagtcttattgatgtattcatgcatcggacgcactgcaaagctgttagcgattgtctcagggcttatattcacctgtcggatgatagatggatacagactggtcaagtcgaacgatacaatgtaacggtatggagcgacaacaggatctttaacgtatgcaccatcatacggcgttttagtatggcgtttgttttctgggattactttcttctcttcacgcagagagttgtaaatgattgcgtcccacgttttaagcggtgacataaccccagggaaattgattttcgcgtagtatgctacagacagaaccagttcgataaagttgcgtttaccgtcgatatccaacacgcggataacgtcaacgatgttatacgtgatgtatttctggtgatccgcttgacgcagttcagacagcgaaccttcgtaatcaactttgcttttacctgtttcgaactcagcgatcgcgcccagagcgtaagttggttgcggggtgaaactgaatttcttatagagatccattccatccatttgagcaacgccgtaaatctcatagcccagttgttcgttcccgtaatggtcggttgttgtcttcgcagtcactttcccgaacgggctgaaatgacgaacaacgttttgcccgaagatattcaggtaacgggtgatgatatacgcgatatcgaacttgtttgagttccagcctgtaacaataacaggtgtccgctctttccagtctttgatataagccgacatcagcgacttttcggtctggaatgaacggtaaacaattttcttcaaatcttcttcgctgatctcgttttcggtatcaacttttgacgctacccactcgtctaaaccaccctcgacaagatcgtacacaaagaatttatcttcaacgctgtcataatgggtgattgcgtcgatagcatattttgcttcgcgtggatcagggaattcaggcgcggtaacttcgatatcaagtgaagcaatgcggatcttttcgcgatcgtattcgatttcctttctgtaggcatcggagatatacgccagcctgaaatcatccatgcctagcgcttccatgcctacatctttcattcgctgcatccagttttttgcttctttaatgctttcgaagttctttttgatgcaggtcttgccgtaaatgtcgcgatatggcgagtctacacccgccatagcgtgttgaaacattgtaggcgcatattttgttttgcgaacctgttcgcgtccctcagagtcaatgaagcgctcgtagatgtgatcgcccatttgctcaacggatagataaaattcattcattacggttttctttctccgtgtttaatcgtgacaggaatgataccccagccagcttgatcagatcaagcgagcgttgcgctaatttgtgatagcgttgggtgtcaggccgatttagttgttcaaccagcacggtatattcttccatgatgcgggtatagaacttagggaagtgatcccgcgcgtatgcgtaggtgcgcagatcagagagattgcaagtaagagacagtttgatgtcttcgctatgcagacggttgatcaagtgatcaccggattcaatagctttgatgatttcttcaatacgaattttcataatttagtcctcacaagtggtgtacaaccaatataacaaagcccctgcatttctgcaagggcttttgattaatgtccgatccggtacttgtatttcaaagtccattcagctttttgtgcgtgagtcaatacgcggaagttgttctcttcggagaatttcagatccggcgtaaggatggaaaccataccccactcttccagaagtcgcgcaatgttattgcggcgcagttcgtcatcttcggtcatgtcaacctggcgaccgtccagcttcaacagttctttgaagtgtacgataaaataacgcccttgtttctgtaggatgtggcaagactgccacagcattttctttttgttatttgcgatcccgatacgggtcagcgtttcgcgaattttcaggaaactgtcatcgctggacagtttaatttcgagcatgttcatacatcaccatttctttattagttgttcaacctttttctggtcggttttatttttcacaacatcagccaacacagataaagcaactttcatatttttccgcttccactcgtccagtttttcaagctgtttgagttcttcgtaatattccattgctatacgtgtatttacaccgtatcgtttttggagaacatgaaggataactttcatttcgttatcttcggtgagtttagcccacgccccgaaccgcttacctttgcgcaccgtatgcaggtaataatcaaagtgcgcctggtctggtaaaccggaaccgatcatattcatcgtgtatgcagggatcagcgtttcgatatgctggctcattgcattgtcgatgaaaaacttatcgtatgaatcaagggcagagatccgtaatggtgtcttcccgttgttcagttcttcgagcaccataaacaaggtgttttccttgtctttggtgtactctttcacaagttcttcgatcttgtcccagtctttagaacgccaggccgcttcatgttcgttcagttcttcttcatcgagaaaagcagccagtgacatttttaagcctcccacgcgagggtaagcattaagcccatgaacaggtattgcaggtgaatctctttgttcactgccagcccgtactgtgcgttgttttcgcctactgcctgaatgagtgcaaccttagattcgttggtgacgatcgggtataccgcatccagaagtttagccaggaaagtttcatactcaggcgcgtacttgattgcttcggctcgcagtgctttgaagttcttcgctttaagcccctcaatcactggtgtgatgtccgaaccaacaatctcagacagaataccagcatcaattttgccacgcttagaatagaacccaagagctttaacgatggatcgcgcgtctgggtagtgcttcttaacgaatccggcgatcacctgctggtcatattcgattttctcgatttcgaggataccgaaacaacgtttgatcatttgcttcatcagttcaacgcgttcttccttcgacggggaaccgaacttgactaccggacagcgggagatcagcgcagggtgaatcccgttgatgttgttcgcggtaatgataacagtaacgttcttgctgtacgcttcgataaagctacgcatgtgcttctgtgcttctgccatgccagggcgatcgaattcgtcaatcagaatgattttaccgcctttcttctgcgtcatagaggacgcgtaacgatccagttcgttacggatgaagttcacaccacaatcggaaccgttgacaaacatcacttccgcatcaacttcgttagccagaaccagcgccagcgttgttttacccgtacctggggaatcagaaaccagagtcatgttgtcgatgcgtccagacttgatgaagccgcgcatcgtcgctttatcagcagcagggagaatgcattcatcgatcgtcgtcgggcgatagcgctgatcccatgcgaattcttcgggagactgggagattttgccgtatttggtttcgattaactgtacgttttcactaagttccataatattaccttcaattgattatcaaaaaggggcttaacgccccttgtgtactactttgtttatcttacttgaactggctggttgcttcaagtaccactacatacgcaacgccgttttcggacgagaatttcgcagcgccgcgagaagagatttcaactttgtaatcgctgttgatgaactgcatgttgtcaatcttcatatcgaagttgaacatgttatcaccttcgtaatcgcccacttctacagagaaggttgactgactttctttacttttcgcggtgattaccagcttgccgttgattggctcaacagacaggtcggtcagtttcatcatgcgtgacgctttgatcagtttttcgaaatcgttcgcgctaatctggaaaatcagatccgcaactggcatttccagacgcttcttaggctgtacgattgtggttggatcgcttgaacgctcaacgattttcattttctcgccacgaatgacgatttcgccagtggacaggtcgtgagttacttcggcatcagtgcctacaacgttcagcatgttcaggaatgagttcagatcgtagatacctacatcttcgtcaattacgtcagaaattgttgcttctgcgtaaactacgctgttgatggatttcgtcataatgaacgaaccctttttcagcattacagacgggttgatctgggagaagtttttcaggatgtcgatcgtttgtttagagaatttcatattcaacctatagttttcaattaggcaaaagtgccgttaatcagggattctacaacgcgatccgccgcattgtcaaggaattctttgcttttggactcgttgattttcgtacccgcttcgcgagcgtcgtgaatcagtccggtatgtactgcgcttactgcttcgtcgatccgtttgtaatgctcaaagcgttcagcttgaggcatcgcacggaaaatctctttgatgttttccggcactttacctacccaggatttgcgaacgttgttcagatgcgctacatatacgttttgttctaaattcatatctacctcaaactttcaaattgggggctttcgcccccgtaagcattacagatccagcagtttatccaggtcgtcatcaccggaaccaccttccaggtcaaacggaggggtgttgtcatcttccggtacgcttccgcctacgttcagttgacttacgccaccagattctttagcacctttggactggttgccattatcgaagtttttcagttcgttgtcaaatgagttcagttctgaatccagatccgcaccagcgcttgcgccagcacccattgcagcaccaccgaatactttggtgaacttcgcggtcagttccgcagttggtttgaactggtctggagcagtgattggacgcagatcgctcataccttcgaagatttctttctgacgcgcttcgtcttcgatgcctttgattgggccaggaacaccaaatttgctgtcgtcgtagttaggccagtcgcctactttcttcgcggtcagggtgaagttagcaccaccaaacggacaagttacagcgatacctggttcatccagatcagggttgccagcgatagcagcggtgatcttatccatgattttcttgccgaaacggaacttaaacactttaccttcgttttccggcgctttcggatctttaacgaccagaatgttagcccagaaggattgtttacgcccaatcatacccagcagtttatcagcttcgccgcctttattggctttggctttttcgaacagatcgttgtcagagatatactgacatacaggacaaccatcataatcgccgtgggtagacggacagttttcaatgaaccactgattgttctttttgaacgagtgattcaccaggcgaacaaacgccagttcgtcatcagagcggttaggcaggaagcgaatagtcgcagaaccgtttttctgtgcatccagagtgagtttccactctttttcatctttctggaagccggaggaacctttcagagcggcgacttgttcttgcagtttggttggatcttgacgtttaaagaatgacatatgttatttctcgtttaagttaattaaagtttgtttcattaagtttcggtattttacgatttcttcgttactgatttcaactaattttctgtatgcgtttagttttttactaaattcattccagacgaaatccgttgcgatttcatcgtgtttatttatgatgtctaaaaacgagtcgaggatcaagaatgattcataagaaatcaccccagactgtacgagtttgctgatatacgaggttgatgatttgacgctatacttaaacaccgttgagaggggaatacctttcatgcgggaaaattcatacaggttttttacatcgtccacgaaaatattatcaattcgcctcaacttgcctatgtattgacgataaaacacgatcgtatcttcgtctacatccccgacccagaagtcggggttagctaccatattgcagagtagtataagatatatttctttgaatgtaaacctttcggctaactttgcgaaaaaatatctatcctttctcttttggaacgcttgttcagtgatctttatttcccatttgtacttgatcgcgtcatacttcccagcaaagtgatttttcatcaccagatacagtttgtataccgcgatcggtttcaaacgggaattagcgtctgaactgtcaaacggggttttaaatttcacatgaaatcatccagtgtttgcgtcgtcgcgtggtctttagccacagaaggacgcagcagattgtttttaatggcttcgtcgctaatcttgtcgatgatcgctttcggtactgttttggacagcatagcataatcaatgctgttttcgtccatccattgtaacgtagcttccatgtaggttgccccctcagaggcaaccagattttcgatatacaagccgacttcggttttgtttccgatttcgctcatattacgccttatcgatcacatcgtacagttcgataagttcgttgttctgttcttcgaacgcggtacgtgcctgttcgtgatacagtttgaacagcttgccgaaggttttaccgtcgataccataatccgttttcgctttggatttgatgtctttgaaagaaccctggaaatgttcgatctgagttttcacgttcgacgcttctttgatcagttctttaaccgctttagcgatgtctgggttttcttgcagtaattctacactcattttgttacctcaaaagtcacttagtttttcatacatacgggtgagtttgcattccatgaagtatttctccatttttgctttgttcccgatttttggagcattatacgcttcttcgattgccgttgcaacatctttcggaataaaatcaaagtcgcgaagttcttcgttttctctgtatcggatcgcccactcttcgggcatacccacggtcggatcgtccgcttccagccaggcttcgagttcagcagccctgatttgtggggcgcgttctccttcaaccttcgtaacaatatagtcatttcgcattttaatgcaagcgatactatcttttttatcgcccttgatgatcttcatgcgcaaatcgttacgaggtgaaccatatttcggtgtaacccatttcttttgggttggcgaccactgacgcacaccctgatatttttgaagggctgcaaagtcaccatcagcagaaacgatcaggacacgtttaccttcggataccgctttacgcgtcaccacaccgatcacgtcatcggcttctgcgaagtcaacgcggatacctttgtacggtaaattagcacggatttcatcgtatgtcgggtgaaggaaaccattcaggcgatcccagtcccaatcagatgcttcttgttccatttttcgtttctttttgtagtaccaggctttacttctgcgccaatacttgttatcatcaaaggctagaacaatttcagggtactcgcctttgaatttaaccacattgtgacgaatggtgtcaagcactatgtgacgaacaatttgttggttgatgtcattctggtctttcggcttgaagttgttcatcaacgttgctaccgaaaggtttgaaatatctatacacatcacatcaacaggatcatcgtcattgctcattaagctgttcaggttgaacatacttgcaaatgaagacatttcaatacctcgttgttgttgaatgaaactgattatagtgatcactttttcaaagtcaatagatcatttcaaaaatctgagcgaagcgaaggacacgaacgtagtgagtgtctatgtactgaatgtacgttttaatatttttatattttatatatagagaaaacagtacatttccgtatactttttaaccaatttaactatccgtttcgcttcgctcacggaagcgcttcgcgctgattttattaaataatatagattggaagtaggtttgaaacacctgattcaatcggctataatgaatgtattcaatttggagaatataatgactacaaagatttatgcagataatgataagctgtatccagttatgtgtaagtggaaacagcaaatccgtgaaactggtgatcgtaagatgccggatgaactcggtattgcgattatgaacattgctcacggtttggcacgtcgatacaacttcaaccgttattccgaagactggaaaatggatatgatcgacgatggaatttcggcaacgatttccggccttcataactttgatgaaaccaaatatacaaacgtctacggttacatcaacaaggcttgctggcaagcgtttgtaactcgtattctctacgagaagaaagagaacgcgaagaaatacaaatacttcctggaacatgtctatgacagcgatgatactgatatgaccacgatagccgatgaaactttcattcaggatatccatgacaaacttaatcagtatgaagagtccgcgaaaaaacccaaagataaaatcgaggttgtggacgaatcgccaacattggaaatgtttctatgaaaattaaaattgacctgaacaaaattttagcagatgctaacgacgaaattgatctgcttccttaccttgtgaaattagagttgcagaacgtcggggttccgattatcatcgaccctacagatgtacgagatccagacttccagatagcagaaggtcgtctggactatgtaataaacgccgaaacaatgatcatggagatcacctactatgaacgtgcagcatgaagtaatcgacgaagtacaccaaaaatcagcgctggatcttcgtgaagaagaactggaatccatcaagggtacacgcattgaacaggaagccctacgcaaagcacaaaagttcatgcggaagaacaaagcggaatggaagcgactgcataaacacgcagagaacgcactcttcgaaggtaacaaagagcagtacgtatacgcgatcaaaaagatgcgtgatatgctcaagcaaccatacaacgatgaactgattgaaacgatgtggatcacttcgaaccagcagttgaaagacctgttcatcatggcttctgaaaaatacggcaaataaaccccttcgggggttttgaggtttatatgaactatgttttaattggggatacccatgccggacttcgccaggataacccctggaacgaagaaaacctgtatacggtattcaaacagatcgtagagtattgcaaagaacacgggatcacgcgcggcttccatgctggcgacttcttcgacgttcgaaaagcaaccacacaaacgacaatgaattttgttcgtgaaaagctggttcctcttctgattgaggcggggatcactctggatgttcttgtcggcaaccacgattgtcaatttaaggacaaaatacgccccaacgcgccacgcgagatactaagtcaatacgaatgctttaatgtcatcgacgaaccgaccacggttgatttaggtggcggaaattcgattgacctgatcccgtggatttgtcaggaaaacagccagcgtatttttgactacatcaaacaatcgaaagctaacttttgtttgggacacttcgaactgtctggttactatttctacaagaacagcaaagccgatcatgggctggaacctgatttcttgaagaagtacgatcgtgtttactctggacactatcaccacgctaacgagggtgataacgtgttttatatcggtacgcctctgactatgagcgcaaacgacgaagacgaaacacgcggattctatgtgttcacgggcaagcctgaattgactttcatcgctaaccctgtgtgtcaccatcgccggatcatgtatccagcacagaaagatgttgatctcgaacagttccgcaactgcgcggtgcgtctgattgtcagtgaaattgatcaggggcttgcaaagttccaaaccaaaattgaagaaattgcctatgaaatcaatatcatagacaaagttcaaacagattcggatgtcgataccgactttgaaatcaaaaccgttcgtggccttatcactgagtatatcgccaacatgcagatcaccgacgatgaaaaaaaggaagtgaataagctgatcagcgaactatacgcggaggtgtcaagtgcatagccgttatgatgaatatttcggggaaaatccccgatattctcacctgttgcgtatgttgggaatgaaacacatcatttccacatccgacgaagcaggggaaaccagcgcagtttgtttgaccatcatgaagggtgcatggcattcatcacgaacatggtcaatattcatgcttgatacactggacgacgatactctatcatatagtattgattcatcagttgttcaaatgatcactgaattatgtgaacggattttaaatgaaactaaacttcaaaaaaattaagtatcaaaatattctgtcggttgggaacaccccgatcgaactggaatttgatacggcaaagaaaaccctgatcacggggaaaaacggtggcggtaaatcgacactgatcgaggcgttaacctatgccctgttcggtaagtcattccgcgatctaaaagtcgggcagttggtgaacagcgtcaacaaaaagaaatgcctggttgaactggaaattgaatacgggaaagactcgtacaaagttgtgcgcggacaaaagccgaaggtgttcgagatctggaagaacggcgagaagttgccggaagactccgcagcaggtgattatcaggcacagcttgaatctatgctgaacatcaaccttgtgggcttcaaacaggttatcgttcttggtacagcgggctacactccattcatggaactgaaaacccccgaacgccggaaactggttgaagatttgctgtctctgtccgtcatcagtgaaatggacaagttaaacaagtcatacattcgcggtgttaatcagcagttggatacactctcaatgcagggtaatcacatccagcagcagatcgcaacacaccagcgcttcattgacgaacagcgagcgaaagcaaaccagaacaacgcccgatacaaagagatctacgatagccacgtagaaaccgcaaagaacatcaaagcacagcttatgcagttgcaagcggagattgcggaatcggtgatcactggagaagaccggacggaagatatcaacaaactccgtgacggttattcgcggctctcaatgactgtagaacagtttaaaaagctggaggtgatgtatcagaaaggcggtgagtgtccggcctgtaagcaagcgattaaacccactcctgagcgtatggcggagatcgcagagaacatcaaagcgggtacacaacgtttaaccctgatcaaaaccaaacaggacgagttacaagggatcatgaatgacttgctgcaacagcaacgcgcactcaatgccctgaaaaccaaatatgaagccctgaaaggtactctgcaaaacgaagttgccaacgctaaacgcgcacaggcgatcatggaacaggcaagcgcggaagtagtcattgatgaagaacccgtgaagcagttgcaacagcaggaagcagaactgaacgaaaaacgacaaggctacgtcaaggaaaaatatattcgtggtattgttacggatatgttgaaagattccggcgttaaagcgagcatcgttaagcgttatattccgtacttcaacaaacagatagcatattatctggatctgttgggtgctgattatcagttcactttagatgacgagttcaacgaatcgatcaaatcactggggcgcgatgatttcagttatgcgtcattcagtcaaggcgaacgcgctcgcatcaacttgtctattctgttcacatggcgtgacgtgacaagtaaagtatcaggcgtggatctgtctctgctggtacttgatgaagtgtttgatgggccacttgataaagagggttcattcgcgattaaatccctgctggattctgtagatggtaacgttattgtaatcagtcaccaggatcttgatccgcaggacttcgaccgccacatcatcatgtctaaggttggacggttcacaaaaccatcaatcaaagatatggcgatctcatgttagaacgtgaatttgatttaaagacctctcccgaagtggagaggttttatctccataatgaactattggaagaaaaacatgtagttacaatggcagatgttgaggaagcattcaaagataaccccattgaattgacccgcatcaagaataataaatcttcggtgtggttcctcgaaaaaatctattgacagtaaaacataaataccttaaagtcgcccgtgtactgagttgcacgggtttttattttgaggaacggaaaaatgattaacgaacaaatgtcacacagcgaagcattgaagattttgggcgctactggcgacgaatctaaagctgaactgtcaaaactctttaaacgtgcttctctgcgcaatcaccccgaccgtggtggtagcactgaactcatgcagaaaatcaaccaggcgtatgacgttgtaaccaaaacaaacagcgctggtaaaactttcagtgatgttcgcgcagaacacgcagcaaacaaaaaagcatgggaagaaaaatttgcagcgtatttcgtgctggcgaaaaactatttcagcacgaaattcaacgcgcaagaatttgcggaatatttcacgaaattcaccggacaaccaacaacctacacccagacaatcagcgaagttcgcggtcatacggttcacgcaacctatcgtttcacttctggtgatgcgttctttgacttctctttctcctgtcaaccgccgtcagaaggtaaaggtttagcagcgccggacgcgtccgcactgggtagcgtatcagttaatactctggttctggttggtacgaagaaacacaaaatggcaagccgtgattaccaatggggcaagaacccagacaaaatcacgccggaaagcctgttccctactaagaaactggaatccatctttagcccgactaagaaggatctcaagttcaaacgcgcggactacatgacatcctttgcccgtatcctgggtgcgaaggttagcggtaacgatgttattgttgatgttggacactataaagttcacttctaccgtcacgtattcatgcgtaaaggcgcgtatgtgttccagtatgttgttgacccaacggtgaacaaattcaaacctgctgaacgtctgaaaggtactatgctggaagatgaagacggtgcatgtctggatatgatcatcgacactttcaaagaaatgcagaaagtgaaaccagacgcaagcggcatcgcagcggtaatcgaccggatgaacgcagagtttgcagcggggcatcgttcagcatcttttgttaaacgtaccgcacagcaagcagcagctccagcgccggaagagaaaccaaaacgcaccgttaaccgcatcaataaagatgactatttcaacgcactgaaacaagcgggggcaaccttccgcagtaactacggtgagtttgataacggcgcgggtttgactttccacttcaaacgcgagatcagcaaccgtaaaggtttctggagtttcagcagctttgatttcatgcactccggtcagaaacatgtggaatggttgaaagatatcgacattgacgaggatagcaaaggcgcaagtatcggtttgctggttgataccctgaaacaacttcgtggtgttgctgactggtacacagcccgtaagatcctggaaggtatgcgtgataacttcaaggctggtaaattctccgcacctcatgtgaagaaagaagccgaacagaaacgcactgaaacgcaagctaaggacgagttaggcgcacagcctacgaaaccacaggcagcgaagaaagaatccccagcggttgataaggcgcatcaggcacagatggatcgtgagaagtcacagatgaatgcaaccattcgttctatgctctctgccctggttaaagccggacgcaaagacacaccggaagaaatcaaaaaagcagttgatgaagcaatcgctctttggcgcttgaaacactaactggttatgctataatgggaactgttgaaaagcagttcccttttttatgaggtgagtatgattattcaggtatcggttcagggcaacactctgacagtaacaaattccattatgaccgctatggctgcatgtcgtgatcatgtgatgtcaaaccctccggtaacggaaattctggaaattgatgtatgggaagacggtgtgatcgaagaatcctttggtttcactccgttagaggaagatttacgcaaaatggaacaatggctatggcaaactgtaccccaatgaaactaccaaaacacacaaccctgttaacccgcgaaaaacttcattctgttgaatggagtccgttagatgtgatggtgttcgatctggaatccaaaatcattaacgcgcatgttaacggattgagtatcttttctgttgaatttgaaaagattcgcgggtataatgaagcctgtaaagacaaattgcgtgtcatggttgaagctatgggctacatcgtgactattgaagacaacaaaatgtggattgcgctatgagcaaagtaaaagcagttttcgccgttggtcatgatatgtacgaagtggactatgctttcggttatgaacagggtttgccgtggggccactgcaaagaggatttgcagaacttcaaagcagaaaccgcaaatagcgtcctgatcatgggtgcgaacacttttacttctctgcctggtaaattgccagggcgagttcattgcgttctgtctgcatccggtcaacgtttggtaacgaagaacgggaataccgctgattacatcattcacggcggcgggttgtctgctgcaatcgacgtgatgaaagcaacgcatccagatcgtgatgtgtgtctcattggtggtaagtggttgcttctgcaagcaatcaataatacactggttgatgaagtggttgtgacccacatttacggacatcatgcatataatgcaccagcttttaaacgtgatgtttcgttcacggttcctgaattctgcgaagcggttctgaaatatgaactgactgatttcaaaattcaacagatcgaatcaaacgaacgagtcagaaaaattatcgtcgatcgacatacgaaaaaggcataaaatgaaacaatatcttgatatcgtcaacaccgttctaacacacggtactgaatcaaccgatcgtactggtgttggtacactgcgcatcttcgggatgcaagcacgttggaacctcgcagaaggtttcccagctactaccagcaaacagctattcttcaaaccgtgtaagcatgaattacaatggttcctcgaaggttctaccaacgtggaaacactgcgtaaaatgacgtggggtgaagatagcgataagcggacgatctgggacgataactacgaaaatcaggctaaagcgctgggttatacgcatggttatctgggaccgatctacgggcatcaatggcgctcatttggtgcggaaggttcttattatggtgttgaccagattaagaaagtcatcgaacaattgaaaaccaaaccagacgatcgcgggatcatcgtttctgcctggaacccgatggatctggatgatatggctttgcgtccgtgtcactgtttcttccagttcgtcgtaatcaacggtaaactgtctctacagtggtatcagcgttcagttgatgtcttcttagggttgccgttcaatatcgcctcatacgctctcctgacgcatattatcgctgatatttgcgggtatgaagtgggtgatctggtttggactggcggtgatgtccatatctacaaaaacgcagtagaacaagcgaaagagttgttgaagccggaacgcgcaccgcttccacttccgaccctttatatgccgaaggtaaatagcttacttgatttggatcaagaattctttgactccatccatttgaaagactataatcaccacggctcgctaaaagcagctatggcagtataaacaagggggcgaaagcccctttcttaacaaggtaagataatgagtgatattaaaacagtagtgaagtcttctggcgtaagtcaaacgttcgaaaaagaaaaactgttcaaagtccttaattgggcgagtattggaagaaatattgatgttaacgcattccttgaaagtgtcgttgacctgcttcgtgatggtatgactaccaaacagatccaggctgtagcgatcaagtatgcagcggatcgaatctccgcaaaagaacctgactggcagtatgtagcggctaacctcgaaatgttcgcccttcgtaaaaccgtttacgggcagtttgacccgatcccgttctacgaacacatcactaagctggttgaggctggaaaatacgataaagaaatcctgacaaaatggactcctgttgagattgattatctggaatcaaaaatcaatcacgataaagattttgaattctcgtatgctggcgttcagcagttgatcgggaaatatctgttgcaggatcgcacgtccggcgacatctacgaaacaccacagtatgcattcatgctgatcgcgatgtgtctgcatcaggacgaaaaacacgctgataaaatcagtcatgttgttgacttatataacgcgatttcggatcgtaaactgtcattgcctacgcctattatggcgggtgtgcgtactcctacgcgtcagttctccagttgtgttgtaatcgaatcgggtgattctctgggttctctgaacgctgttacgtccgcgatcgtgaagtatatctctcaacgtgcgggtattggtgtcaacgccggacacattcgcgctatgggttcaaaaatccgtggtggtgaagcagtacatacaggcgttatcccgttctggaaacacattcagacggcggttaaatcctgttcccagggcggtgttcgtggtggtgcagcaaccctgtattatccgatctggcatcttgaagttgaaaacctgctggttctgaaaaataaccgtggcgttgaagaaaaccgtattcgtcacctggattatggcgtacagcttaacgatttgatgtataagcgtttaatcaataacgattacatcactctgttcagccctgacgttgcgaacgatcgcctgtatgacgcgttctatcaagcggatcagactgagtttgaagaactgtataccagtctggaaaaagacccaacggtacgcaagaaacgcatcaaagcggtagatctgttccagttgcttgttcaggaacgcgcacagaccggacgcaaatacattttcaacagtcatcacgtaaaccagcagggtagtttctctgttccggttcgtatgtcgaacctgtgctgtgaaatcgcgatcccaacttcaccgctggatgacgatgataaactggctggcgaaattggactgtgtacgcttatggcgatcgttctcgataatgctgatataagcgaattcccagcccttacacgcatcgcagtacgcgcactggataacttgcttgattaccagaactaccctgttgcagcggctctgaaagccaaacagcgtcgttctctgggtgtgggtatcaccaactatgcatcctggctggcaagcaactattgcgactactccgaagcatacgccggaaacgttcatgagttgatggaagcgtttcaatttaacctgctggttgcctctatggaactcgcacaggaacgcggtgcatgtggactgttccacgaaacgaaatatgcacaagggctgttgcctattgactggtactgcaaaaacgttgatgaactggcatcacctgtgtataactgcgattgggaatggttacgcggtgaaatcaaaaaacatggcttgcgtaactcaacgctttctgctttaatgccttgtgaaagtagctcgcaggtaagtaactcaaccaacgggattgaacctccgcgcggccctgtgagtgtgaaatcttcgaaagaaggttcattcaatcaggtagtaccaaaccagaataatcagattgacttctatgattatctctggacaatggcaaaacgtggaaacaaaggttatctgtcgcacgtagcggttatgcagaagtttgttgatcaggctatctctgcaaacaccaactatgatccggctaacttcccagatggtaaagtgaaatctgaaatcatccttgaagatctgctgtatgcaaactatttcggcatcaaaacgctgtactaccacaacacccgcgacggtgcaggtgaggaagaagcggaagattgcgaaggttgcaaaatttgattcaatgccccttcgggggctttttataaggtaaatccatgttaactgtaatgaacacaaacccagatcacaaacacttagaacagcctatgttctttggtgaggatacgggcgtagcacgatacgaagaacagaaacaccgtgtattcgaaaccctgactgaaaaacaactgtcattcttctggcgaccggaagaagtggatctgtcgatcgaccgtatgcagtacgcgaaaatgccggaacacgaaaaaatcattttcgattcgaacctgcaatatcaaaccctgttggataccattcaggggcgcggccctaacctggctttcctccctatcgcttccgatgtctcgatggaaacgtggatcgaaacatgggcgttcagtgaaacaatccatagccgcagttatacgcacattcagcgcaacctacacatcgacccgtcaaaagagttcgataaaattctgcgcaacgaagcgatcatgaaacgttcggcttccatgacaaaatactacgatgacctgatcgcagaatgtcacgaactgaaaaacattgtgctcaaaatcgaaatgttaacgtcccacggatacccagacgaatcgatcgcagagtacgaaaagaaacgcaaagagcaaatgcgtaaatgcaaaatcgctctgtatctgtgtatgcacgctgtcaacgctctggaagcgatccgcttctatgtgtcgtttaccttcacgttcaactttgccgaacaaggtaagatggaaggtaacgcgaagatcatgcgtctgattgcccgtgatgaagcacttcatcagaaaggcactcaaagcaagatccgactctggcagatgggtaaagatgacccagaaatggcggaaatcgcttaccagtatgaagaagaagcgacaaagattttcctggaagtgtacgaacaggaaaaagaatgggctgaacacctgttctctatcggtgatgtagacggcgtatccctgaaaagtacgatcgcttatatcgaacacctgacagatcagcgtatgcgcgcggttggcttgcagtctccatttaaaccaacgccgaacccgtatccgtggatgaacaaatggttgaagtctgacaacgtacaggtagccccacaagaagtagaagtgagttcttacctggttggcaacctcaacaccgagatcagcgacgaagcctatgcaaaatggcgacaaaaatacgcttgattgtcgcgtcgtaaacaagtataaaggtagttgggatgtcgatattcagagaggtacgaaattcggtaatcccttctacaagggaacacgggctgaaaacatcatgaacttcatcccgtatttccaaaacttgattcgaactggcgtgatcacaatcgacgaactgaaagcattggacgggaagcggttaggatgtacatgcaaacctctaccgtgccacggtgattatattgctcactgcgtcaatgtgttgaccggaaaggtgaataagttggatatataatggacgatgtaacatttggtgtaatatttcctttgcgtctgggttcagacaagaggatagaccggagtttcgttaaatgtggcgaattccggcattgtgtgtattttattgaaatcgacggtcggatagtgtatgttggaaaatgtcgtgatttgtggaagcggttagacacataccgcaattcgaaatactggcgggaagcaaaccccagtaatattttgaaaaccgcacgtctggaaatggcaatcaaaaaacgtaagcgtgtaaatcttatcgtgacaacacacgatgaagacacatatcatgattttgaaataaacatgatccgaaaaatcaatcctgaatggaacaaacagcactatgacaaagctaaccaaaaatcagaaaaccctattcaaccagctaatgacgctgtgtaacgaaagcgaatgcttctacttcattgatcaaaaaactgtgatgcaaaccagtgttcgcatctttaactatcgcatggcgagctattccgactggttaaaacctggtgcgctggaatgtcgcggtatcatgtttgcgatggatggggaaacccccgtaaaactcgtcagtcgccctatggagaagtttttcaactatgccgaggtaaaggcatgggaagcactgaaagcctctcctgtgacgattggtgaaaccgtagtggatgtgatgattaaggaagatggttccctgatctctaccttctgcgattccggctatctgggcgttaagtctaaagcatccgttcaatctgaacaggctatggacgctatgagcgtgatccagactaaccgcgcattgttcgatcgtctgaccgaactggttcgcgatggtttcaccgtcaacatggaatacgtcgcaccaacaaaccgtatcgtaattggctatcaggaaccagcagtggtgatcctgaacatccgtaataacgacacgggcgaatatgttgattatcaggatatcttcgcagatggtgtattacgtccgttcctggttgagcgcgagaaaatcgaagtcaccgatctggatgcattcattaccgaagcctactcgaaagaaggtttcgagggttacgtaatcaaaactgataaaggttttgtgaaagcgaaaaccaactggtatgtaaacctccaccgcacgaaggatagcatcaacaataacaaagatctgttcttaaatattgttgaaaataccgtcgatgacctgaaacaaatgttcctcgatgatatgtacgcactcaagaaaattgacgcattcgaaacgttattccttgatagtctcaatcgtctgactgcaaaagcattccaggcaatcgaagacacgaaaggcaaatcacgcaaagactacgcgatcgcactgagtgctgacttaacccctgacggtcgtattatctttgggcctatgatgcgttatttcgatgataccgataagcaaaagctggtcgataacatcgttgcattaatggcgaagaactacgaacagtttataccggaagaatataaatgacattaccagcctttccaaagttaacttctttggtgtggcctgtcattgtagccctgtctttggcagggcttttgtacatgacaatcacgctgaaaagtgaaaatgataaattggctaaagatatcaaagagttacaggctgatatcaaaaaagtcaaagagacaaacaacaccaatacggtgatctatgtcgaacaaaaaggcaaggatcagcagttggtcaaggatgccggacgtaaagacctgctgttcaagaaaccaggactgatcgaaatcaagatcaataaatccttcgaagagtatatggcggagtacgacaaatgaaaattgcaacgttagcccttgttctgggcgttctgttggttgggtgtgcggagaagcccccagaaaagattttgcctacactccccgctaaggtgaatcctgttaatgtgaaatggaaagtggttgcagaagtccgagagattgacggtaaaaaataccttgtcatgccttatgacggaaacccatacgttgccctttcatatcccgattcgttaatcttccgtagctggatgaatgacgttaagcgtcagaaagaccagacggataacattctgtgtaccgtgggataccctgagaaatgcaagtcaaaataatcaagtcatttttccgtgacataaccgaaggaaaggtttatgatgcgaagaaggacaaagaaggtctctggatcgaaaatgactggaaccgtgatatgtggctcaatctaacgaatgagcataacaaagaactgattgaatatgagattgtgaaatgaatctgtttattactgtaggcgtaccaggtagcgggaaaactacatgggcgaaagaaaaagcgcgtcaactggggaacactctgactgtttcccgtgacgatatccgcaaaaccctttactgtgctggcggtgatctcactggttatcgcttcaccgaagagaaagaactgtttgtttgccgtgtgcaagaagatacagttcgtaatgccctggcgagtgggaagaacgttatcgttcacaatacccatttacaccaaaaagatcatgatgtgtggcgagagatcgcgaaagagttcaacgcggatttccatattgaatggatggatgcggatattgtagaactcctgaaacgaaaccacaaacgcggtgtgaatgctctacctgtttcccgtgtctgggcgatgttcgaacagtaccgtaaactccgtggctgggttccagctatgagctatgcagatccgagcaaaccgaaatgcgttatcttcgacgttgacgggacattaaccaaagtcggacaacgtagcccgtatgacttcacgaaagttatcaacgatccgcctaaccctcctgttcaagaactgttcaggatgtataaggccgctggctatgcctgtgttgttgtgtctgggcgtgagggtactgtacagtgcgcacatgataccgctgcaagcctgatcggatatgatgttgacctgagcgatggtatctacatgcgcgaagaaggtgatcatcgtcacgatttccacgtaaaagagcaaattcttgttgaaaagattctcgataagtattatcctgttcttgcagtggacgacagggatacaccagtcgggatgtggcgaatgaacggtatcccgtgtttccaggttgattacggcgacttctaaaaaacagttgacagtgagtgcgggtgtgataagatacccgcacaaacaaaggagaatattatggttattcgtgaaaatgaaaatgtgatggttgaactgggtgatcgtgttaaagttgagaatcctgttgaacttcaactgaaactcaaccagttaggccagcgcattgctgataaaattcctgctggttatacagtgaagattgtccgcgatggtcagttctccttccttctgggtattttgagtcaacgtaacatcgttgaacagcagttcgggattcagtggaatccggtaactaaattcgtaacatgggcgggggtattatgagcgacaaaatcagaaagattcatcaggcatggttctgtactgaaccaacgatgcttcgttatggttgtgtgtttgggttggttgataacgatcctcaacaggacattgcaacaagtccggttgttgaatacgcgattccggcgaacaaatcgtttgttgaagtggtgacacgttcaggtactacgtatcacatcgtcaaccctgataacgatttcatcaaagacattctgaaatatatggatgaccgttaatgaaattcaaagtaatgaatatgctgagagcaatcgatcggagtcaacgttctcaatgtatttcgaatcgtgtaggtgctattatcgcgattggtggtcgtgccgtcgcgtggggcgaaaataatacggttgaccttgattgtcgttgcaactcatgcaacaatcatatggtgaatgatgacggtaaactgaaatcggttgatcgtcctgaacattcagcatggtcaaacgataacgaaattcatgcagaaatgaaagcgctattgagtgcgcacacaagaggtgttatactcaaagacgcagcactttacacaactgcatcgccttgccctaactgcgcgaaacatatcgaatggtatgttgctagcggggcgattacatcggtgtattatctcgataaatacgatcgtggtaatgatgaatggatttcacgcttgcagaaatatggctgcgtcgtggaacaaattaaacgggaagagttagaatcgtttatcgacttttccaaagtagtgtttaacaacaatgagtaaagaaatgtctgaactgaaagtaaaagcatccggcgaatatgtgatcatcgaagctactgcgcgtccgcagggttccgaaatcaaatctgaatctggtatcgtggttggtgtacgccagcacggggaacaacctttttatggtaaagttgtttctgtaggcgtagacgttccagcagaagcggcagaacgaatcctgggtaaatatatcccactgccaagcgctcacatggcgaatgttcctgaccctgatctggttgcgggttacatttccgaaaaagaagcaaaagagaaggaaacaaaatacgtttccgcacattacaaagcaatccaggcaatctacgagatctaaaaatggctaaatcaattcaagcaattatcgctgataccgtcagcaaatccaaaaagctgttcgacaaaggcgaaattctggaagccccagcgcgtattgacgtaatgacagcaatgatcattgatgcgcatcagggtaaacttaaatcccgtgccgatgaagtcatggcgtacatcgtccagttcgaagacgtatgtaagtacgcgaaagatgttgatccgctggttcgcgaaatctatcgcaaacagttctaaaaaatttgcaggtgtagttcaattggtagaatatctggtttccatccagattgttgagggttcgagtcccttcacctgctccaattcgggtgcgtagcgcaatgccgttaaatggttcggaatatgcaaccatatcccacgggataggctctgttggtatccggtaataggttccccggaatgcggggtgaagtaaagaaacttccagcccactaaacaatgtgagatctatatgagaattcgtgaaaagacggtgtatgactctaagttaggcaaaacaatccatacgttcaaagagattacgccagcgcaattcaaagagcggtacggcatgacattcaacgaatggaaagcggggttatgtaaaaatgactaccgatataaattaaaattccgtgaatgttatgttgatgacgatccttatgcagcagatgtatgtggtgaaattgcaccaattatcgagaattcgcccgacgcactaatacaatcttgcatagatgcagcatacgaaatttaaaagagaaaaatatgaaaggtcttcaaaagctgtttgaattaaccccgaaaattcgcgaaatcatcgcttcatcaaatgaacaggaaatcaacggtaaagtgatgaaactgtttaccgaggaaatcccagatttcgataacgaattccgtaaagcgttcgatgcgtattctgttgatggtttctttgcatcgccgcaggtgaatagcaagcgtgaacacagtcaccgtttattcgactggtctatcgtgaatatcgttcgtcgaactgatattgaacctactaatcatcagttggtttctatggatgcttcggtattcttcatccagtatcttattactggtggatttaaagcagaaggtattccgttctgtaacgaagctctgtacgaagaattcgcagaagcgtataagtatatcaaagcagttcgttaatcaacaggctatcttcggatagccttttttctggagaagcacatgcgctttttaaaatacgcaagctggtttgtactggttccccttgatattctttctggtgttctggctattctgctggctccttttgtggttccgttctacagtgaagaaaccggacacttacctaaagggttccgttggatggaaacattcgataacccgatcgatggtgatggtggacatatccggcgttgggctaacatccggtatcacttaggcgatctgggtgtgtatgcgcaacgtgtaggctggttgtggcgtaacaaggcgtacaacttcgcttatcacgtcttagggcgtgaagcacaatcagacttcgcctggaagggcaacccgaaaacagaaggtggttccgatccttcgcgtcacggttatctgttgatgtggaatgattcggcatgggggctttatgtcttcaagccgtggcttaaagtcggaaaggttcagttctgcttacgcgtgtattgcgggtggaaactgaaacaggaagtaactgaccctaacgggctggatcgtgtaatgctggcgttccatatcaacccgttgcgttattatgtcgtagaaaggtaatacaatgaaagcatatcagattttagaaggtttacacactggcacaatctacctggaagaaggtaatgatgttcgtgtggtggtatccaaaaccctcgaaatggattcagtgatcggtaaagctcgcgttgctccattcgcaaaacgtgaagtcgatattgaatttcaacccactgttaaagtggaaggtggacaacacttaaacgtaaacgtgttgcgccgcgaaactctggaagatgctgtgaagcatccagaaaaatacccgcagttaacgatccgtgtgtccggctatgcagtgcgtttcaattcactgactcctgaacaacagcgcgacgttatcgcccgaacctttacagagagtatataatggcgattgaagacgtacagggctataagccccactcgaaagaaaagatcgacaaagtaaaccgcatcaaggccgcagaagttgccctgggcgaaatcttcaaagaactggatgaagagtattcaagtgattacgcggtatcagataccgattcattcactaccgaagaactcgatgcgatgcttgaacgtatccatcaaatccaaaaggcgaaagaccgactgaaagaagcctctatgtgggcgtgtcgtgcggtgttccagcctgacgaaaagtattaaaaatcaagccgttgccgaaaggtagcggcttttttcgtttttatgcaaaataatgcttgcactgaatccgactttcttgtatctttaaccacgtaggcaagacaacttaactttgaggatgacattatgaaaacttacaacatgaaagaactggtttgcttcaacactcgtcgtgaagcccgtgcgtatgttctggctgctggtaaaaatacctctgctgtaatcgacctgggtactgataaagctgttggcgctcgttgggctgctgttgtagttatcgctgctcctgtgactcctgttaaaactctggttctgggtgcgcgtaaagccgaaactctgaaaaccagcacttgcaataacagaggtgttcataatgtcaccgtcatcaaaaaacgtagctttggtttgagggcttaacatgagtaccaaagaattagaacagaaagtaatggggttcatgagtaacagcgaagatcgctatgcaaaacacctcattgtcgaactgatcaccgcgttacgtcgccgcgacaaagagatcgaagaactcaaaaacgcatcggttcaggttgtctataaagatcgcgagcgtagtagctgggaaaaagaatgggatgcaaacccccaagaccgccaccttttcgggaaataagcatgagttccattaacatagaaaaagattttgtgatgtttgttggggtacagactgtaaagaaagatatcttcggtaaactgtacctgtcgaacgacgatcgcaaccccgcatcattcgaaaccgaagatgatgcatatatcgcgaagaacaccagcgataacgaagacattcgccagtatgcgcggatctataaccgtgaagtaacaacccgtctggagagagcgtgatgcgtgaaggtattgaagtaagaacgtttcagttcgaaatgcgtcgtatcccagaagcatcaatgaatctcattcgagaacacaacgcgaaaatcgtagaaattgatgcatacgcgggtactgatctttataatgatgcgaaggttgacagcattgatttagaccttgagggtgatatcggggatctgaataagctggctattgcattgaatgcagaaaccaacaaatacgggtatacaatcaaatgaaatatattctcgaatatcatgagcatcaaattaccgaagcaatgatcgataagatgcgggtatataaccaaaacattaccagcattaaaccgctatcagtgtgtcgtgaattcgggggatactccttcgcgatgtacacaaattctgaagacgacgcaaccgcgtatctgaaaagtatcggtgcaatattcgacaaattcgaaaaagtatggaaggtaggtttctaatgaaaaagtattttattgaagcggcagatcgtatcgttcttgctctgttgaactggaaccgtcgccagaatgtctctatcatggcatcaaccaacgggacaacatatgaccgttatgatccggcgcgtggactccataagccttacgaggttaaagcgtgaagtattacggattcaaaacgagtcattacggtaaagcataccgcactgacaacatcgatcgcaaacgtccgtactatgattctctggtacgtgctggacgcaaacgcgctcgccaggaagggaagaaggaagctgaaaatgaaacagaatagtgaactggctttgattgcttttggttttgctctgggttgtatggtttctgcattactcgttaacttcgcggggtgattatgggttattacatccgatttcctcatggttatatatccagtagtgtttttgaaatgatcgaaacacacaaacagaaaatcaaaaatgtttccgtttctaccgatgacggtggcggatttgattacatcagtgctcactttgaaagcgaaagcaagggacttactgattatttccttcgtaagctgggtgctaagttgatcgacaaaaataataaagtgtatgaggttattcgataatggatatcggatcaggtagtcagtatccatcatgcgcattgagcaacttcgccccacatccgtttacgtttgacggggtagaatgtgcatcaatggagggctttttacaaagtctgaaattcagcaatccagatatgcaagcgcatgtgtgtacgctggttggtaaagccgccaagttcaaaggcaagaaaaagaaatggtatcgcgatcagaccctatactggaagggtatgccgattcaccgtgaatcagaagcgtatcaaatcctgattgaaaacgcgtacaatgctcttttcctgaatgacgggttccgccgtgcgctggctgcaaccggaaaaagtaccttgactcattcaatgggaaagaataagatgaatgaaactgtgctcactgaacgtgagtttgtccgaaatttaacccgattgagagatctgttatgataggttataaagattatgatgaaagagtagaatgcgcgttcctgttcaaaggcgcgattaacccgttggcattactccacgcacagggtgctttgagttctaccctgattattggtgttatctacaaagcgggtgtgtattacgttaccatcggcgcgaacaacattaacgtgatcaacagctacgttgaaaaatgtaagctgaaagatattgtgttcgataaagtcgaaatggatgttcctggcttcgacgctgtttatatgtacaagggttgatgatgggttacgtggtttatttcgattgttcggatcttgatccgttcgttctgcaacaagcaaagaaatatcatcaagatatcactggtatcagtgtcacgaacgatgatatgctgtgtatcgaatttgattattatcgtacatttgagcgtgacaaattccttgcggatattgaagcgtttaagagtacccttttctttgatcgttatgaggttaaatcttgaaaccagttattcttaccgacattgacgggatcgccgtaaaatggcaaagcggcctcccgttctttttgtcaaaacacaacatgccgaccgatatcgcgctggatatggttacggatgaaaagttccgtgatatgaccgaaatctttgggtgtgatcaccaactggctaaaatcctcatggaagaatacaataacagttcgtttattcgctatctaagcgcgtatgacgatgcgttgattgtgatcaaccgtctgaaagccaaatatgatttcgtggctgtcacggcgctgggaaccactcctacggcaagccttaaccgtattgcaaacctgaacacgctgttcccttctgcattcaaagaagtgatggttgtcgggcatggtgaaaccaaagtacaccgctacctggaagcgaaagccaaatatggcaatcgtctggtttgcttcgttgatgatcttgcggtaaacttaaacgaatgtcataacgtcatcagtcagttgccgttattccatatgttgcgtggtgaacgtgaaaccccgtggtcgcctcaccagtcagttaaatcatggtttgaaatcgaagagaaattaaatgatcttacagattctaaatgaactcgcttcgactctgaaaatctcagagaaggaagcgatcctgaaacgtaatgcaggtaatgatctgctgaaagagattttccgcattacgtacacgaaacagattatgtttcacattaagaagtttccgcaggtggacggtaagccaggcacaaccccgctatcgaatgctatcgcggatttgatgtctgatttggcaacgcgaaaatatacgggcaacgcagcccgtgatcgtctgctggatatcgtatcatcggtgaacgagaatgatcgcgaagtgcttcgccgtatcattaaccgcgatctggaatgtggtgctggtacaacgttaccgaaccgcgtatggaagaaactcattccagaacagcctcaatgcctcgctacgccgtttagtgagaaagccttaaaacgtattcgcttccctgcttactcgcagcttaaagccgatggtgcgcgttgtatgtccgatctgttagagaatcagatccgcaaagcaacccgcgcgggaaatgagtatgaaggtttggtgaatctggacaaggatctgaaaaagattcgtgaatatctgggttatgatgttgtacttgatggagaactgatttatgtccctgctgaaaaaactgctgtcgttccttcaaacagcgttccatttagtcttgctgggtttatgggcgatgacgacgattctgtttctgaccttgtggcagatgttaggcgggaagctaccgagaacgagacacaagcggaagcgaaacgcgaagagggcaacgggattgtaaacaaatccctgaaaggtactatcagcgacgaagaacagcgcaatatcgtttatgttgtctgggatatcgtaccgtatgaagtatactatggcgatgctccgagtgttcaaccatattgcgatcgtttctctatcctggaaggtgcgctggctggctctggtgtaacatcggttaagttgatcccttctatcctggtgcagaactacgcggaagcgaaaaaggattacaacaattaccgcaatgacggtaaagagggttcaatcctgaaaaacgttgatttcaaatggaaggattcacgcgttgcggatcaggtgaagttgaagaacaaaaccccgattgaactgcgaatcatcgacgtgtacgaacacaccaaagaagctcataaggtcggagggttcgtggttgaggacttatcaggagaagccagaacaaacacaggttccggtctgactgatacggactaccgatacgatgaagacggtattaaccgcgtgtacatcccgttagaagaacgtggtgaactggatcgcgaatacatcatggcgaacaaagatgactatatcggcgctatcgtcgaaatggaagttgacggactccagaagtctaaaacgcgtaagaagggcgaacctgagttcagtttcttcttgccaatcatcaagaagatccgacgcgataagaccgaaccggatgatattcacgttatcttcgctgatctgttttaaatagcactttttgctaaaaagccccttgcatgagtaaggggcttttgttatattacaaacatcgaaacgaaacagacaaaaggaacatcccatgcaaatcactaaagaactcgaaggcaaagtaatcgttctggtaaatgaagaccgtttggcacaactgggtaacggtggtgaaaaactgccagcagacgcactcgaaagcctttctaaaatgcgcgtgatgcgtgttactgacggttgggttacttgtctgcctctgaacgacgaagacaaagccgtatacgatgcacaagcggattcatgggatatcgaagtacctctggtaaacatcgaagttgaagagtgctacgaaatcgaaaaataatgcttgcttactgggtaatgtagtggtacattacccatatcgaaacgaaaggagaaacatcatgaaaattatgcacactgcaaatcaacttcaaaacggcaactacgctatccacgatgctatcggtgcgctggttggggtttatcttcatggtatcaaactccttgaagtaagtgggaataccttttatggtgttgaaaacatcgaagcagcgatggaaattatcggtgacctgaaatgagtaagaaactcgaaatattcgaaactatcagcgaagaccctaatcatcgctggtgctgtgcgaaaactggttttgatgctgcatggggtgatactccagaacaggcgcgtaaaaactgggaacaccaacaattgttttttgcctgtcgggttcctaccaattatgaggggagtcaattgttagcatgaaaaataaagaatatgacccaatagaagttaaagagcggttatcggtagcaagaagattccttgaatctatcgaccctgataaacttggaaaatgccctgatacgatttgccttaattgtgggcgatccgtaatggttggaaagtgctgtgataatcagaatatcgttatcatggacaggaaagaagtttcaccggaagtgtgggatcggattcaagagatcatcaaaaacccacctgaaccgacgaaacgtttacgcgaacttatgagcaggaaaccacgttatgaaaaatgaaccaagtaaaactatccgcctgatccgttgggaagggcaagaaatccgttatgaagacgacgaccgcgaattcgtccatgaaatgcttgcgcataatctgggattcaaaaacgccgcactggtgatgatgcaacaaaccagcgatgaagacacctggcaatgcgtcattctcgatctggacaaaaacaaggaatacaccgaagatgaactgtttgcgctcacagagaacgctacagcgcgtcagaagtgcttcatgatcgatatgcctcgcgagaactacgagaatatcaagaaagcccgtaaacagaacaagaacaacgtgttcgacctgttcatgggctatcatgaagaaactacggcctaagcctcacttgttttgctggtgtcgttagtagccgctgccacctgtacacattccaatgtttgcaggtggaaatcttttgatacgtcgcggacacattcaacgatcagatacttccctgaatattcatcccctaacacctcaatcaatgcccccactttaacatccattcgaccctgattgatatcaaaccgaatacgtttttcatagctggataacgtctgacacttcacagcctggaacggttgaccctgtttgtctgggttctggaagttgttctcatataccgcgtttctgttcatggtgatccatgcgttttcaatatcggtactcgcaaggatatcactatacagttttttatccgtcatcgagaaactaaagaaacttgcatcccctaacagggtagtgttatccttatgggtaatgtattcacctttcgtgaataccaaagcgtcacctaaaaacgggttacttacgttgaacttgtaagcctttaacggggtttgtgcgaggatctccgtattgcttttcataaagataccggaaccatcttcccacagataacagaagtcagacgaatctacgctctgcccgttgtcacggatgtaatcaaacacggtttcatacgtcccgctcaggcaagccggaggaatacgcacgtttgatgcgtcgatatgcggcgtgatcaacttcatatcgttatacagtgccgtcatgcactctgtaatcgtctgtacggcgttgttactgaacgaacgggaaaacttacgacgaaacaccgtatgcaccggagaaaggtttaggcgcagtatagagcggttcatatcatcggtttcgacgtttgaatacagaacaccgtagtaatgctgttctaacgtttcgttatactggaaggatacctgaataatcggtttttctgtcaactgatagattaactggttatcatagatctgcatcaatgtttcagaagtaccgttaatgatggttttctcactcattgagacaagggcaggtaacaattcaagatagacgttatcagcgaacttttcatatgttggatataatttaaccgacacgacgcggtttataactttactggacattagacatcctccctttatattctatttactaaatagtaaatatcgggatacttgaggcgatcatgaaagagaagaaaaacacacttgataaatttatggttacgcgtttaaacatcaagaacagcaaaaataaagtagtcacgttgcctactggtgaacaggttacgatcccccgtctgggctatcgtcatttcacccagattaaagcaatgaaagacccaatgcagttgcttgagtatatcatcaaagagattcaaccgcgcgaattaaccgcagcagaaaccgaattccttttgattcacctgcattatcacaatgacgataaagcaatggcgatactgaaagagatcggtattaatctggatgatatgaaaatcagcgaagctaagtatgaacatacttttgataaccttcgattggtcttcaataaaccgaccctaatgctggatgatctggcattactgcttaaagaagcgtatgacaacgggaagccgatcgaactgacggacgaaaaccgtattcaattaattaactgcctgtatcgttatgaatatgacgatgtaaaacgtggcgtactccaggaagtctatattgtgcatgaggggaaaaccattaaagggcttaacatcatcggtgaatgataatggctagcaatccatattttaacgaagaacaacgtcgccggatgcagaatccaccaaaaccacaggcgcaaccgactgttcgtaagatccaggcaacgttagataaagattcgatgcgcgagttaaaggatatcaatgataatacccttgaaaccgcgctgaatacactggacatcaaagacagtgtgaaatcctttgaggatcgtttcaaagagaaattcgctggcttccaggaacaatacgaacaggatcagcaaccacttgctgaacagttgcccgattttgttgggccagcgcgtccaccatcattaacagacaacagcacaaccagtgttgataactccgtcagtgtatcgaaccagcataacccatttgcgaaaatcgaaacatacaccggaacgattgcagaagcaatcaccaagtttatcgaactcgctgaaaagaaaccagcccccgcgccggaacctgaaccagtaccggaagaggaaccggaggtcgatcgggacaagaagaagatccgcgataaggataaagacgagaagaaattcagcaagaaagtattgtctttgctgggtgcaatcaaggataatacatccggtcttctggctcgctttatcggttattctctcgaagcgctggcgaagtttgcaaaatggactctgattatcggtagtatcgtatttgcgatcgacgtactgagtaaggttgttcagaagtggttccaggatattcttgcagagggtgaagcctcgaaagatttgtttggttcatacttcgggaatatcaaaacccttgctgagaaaatcaacgaaggtctgcaaaacttcgatatgagtaatttgggcgaatcgctgaaaaacttgttccttgaaccgtttaaggttctgggcgataccatcaaaaccgcaatcacggaaggtatcggtaatctgatttacgctctgggtgaatataccggatctgaaacaattaccaacgccggacgcggaatgaaagtatcagcactgcgcgacaaacaaaaatacggtcttgaaattgatcccgatgacctgattctgctgaaacagcaggagatccaggatcagaatgataaagtggttgaggcacgttctaaggttgtcgaacaggttaaggctacccagggcgcattctcatatagtttcggacagcaaacagacgcacagaaagcattgtctaagcaattggaacagatgcgcgatcgtgtggctattgaagaaaagatcaccgaagagaagaagaaagaactgaaagcattgcaggaaaaccccgcactgttacaggctgaggttgataaagagaataccgctaatcgtaagcgcgtggacgaaaccaaacagatcgaagccgcgcaagcgaaagcgaaacctaaagcggataatgaattcgatcagggcgatgaaatcctgaacaaagacaatctgacgggcaacgataaaaaggtaatggaaaaactcatagaatcgcttgaagagaaaaacaattcgaacaagctgaatgaggacgacaaagaccgctatcgtgatatgatctcccgctggcaggaaaagatcaccgcagtaccggaaacgagtgcaagtattgacaagcaaccggaagcagtgaaagcccctgttcagcctacaacgcctaacagcgttcaggtcaacaacaaaacagtaaacaacacggttcagcattcagtacaacgaactgaccgtaaaccattgattgcattagcttaaaggaaatttaaatgaaaattacagtattgcaagacactgtacaatcatttgctgaaatcaaaaatgctggcatcccctctgggggtgctgcaacaactaaaaacgcgttgactcaaccgatcgtaacagcggaatttccttcccaacgtgcagcaggtattgataacgcttataatgcatcaagcctgtataataacggcttgctgttcacagcatatgatttcacgggtggacttgcaccaggcagtaaagacaactaccgctcattacgtcaggcagcacagaacgcgcaacagatccttagtgctaacactgggaacgttcgatacaaacaggttttgaatacccgtactatgggtacacttaaccccatttgtcaaatacttttaccgcgaagcctgaacgataacgaagtgaactcacaccgttatcaggatgcaaccgatagtattgttgctaaaggtttatcccgtgcggtatcaaacgttatctggggcgctgtagaatccgtttctggtggtattctggcagaccgtagggaagcaatcgacatcggtacgaaagcagcgtttcaaggctctgataagcgcacaaagatgtattacaatacattcgttatcgaaagccgttatgacctgctggaactgattaaaatctattacctgttcacggtgctgggttatggtactacttctggcggtactccagcagaattagccggactggttaaacaagcgtataattccagcgcttcgaaggttgcaaacgtttttgcaccatcaacaaaccagacgacagcaagcgatttcaacggcagcatcggggatcagattgttgacttcgtatctaacgttgaagttattaaatcgcctcctgtgtggtttattcgtgacttccagacaggagacagtttgcggttccctcattccacgttcgggccagcaggtattaccagcgttcgtttcgggcgtacaatggacaacattgtaaatacgttgagagaatcaccgaacaccccgatcgcagttgaaatcgaaattcagtttatggaactgatcgatatgcgtcaggattcgatttttgatacgcagtattaagggggaacaatgttctatagcgtagatgaatttttgtcaggaatggcaaatagagactttcagcgaagcaacctgtttagtgttgtattcgcaaccagtccagcatcacgcattctcgacagcacgatcgggagtatccgcgatactttaatagatggtactatgagttccattaacgcgaataacccgaacgagttcatgaacgctattacagggggcgtaagcaagctattcagctatacagttgataaagctattatgtccctgaacaaaacaggtttcagtaaaatcatgggggcgttaagccctcgtttaattacttccctgtttggtgatagtgtttacggacagatgctaacagaattccgtgacaaaatgatgtataatatggggttgagcatcgttggtgttcagttgcctggtaaaacactgggttatgaatacgtgtataatggcggtgtaccccagatccgattcacccgaccggagaatggagaattatcactaacgttccgtgtggattcagaagcgcgtaacctgaaagtattcaacgaatggttatcagctattcgtgatgatgtatcaggccagttcgcattcattgatgaagtatcaagcgcgatccaggtaaacttacacaatcgcgatggtgtcccgcacagcacgtatgtattccagaagtgtttgcctgttaaagtcagcaatccagaactgagttatgaaagcaataacgaaatctggacattcactgttgactttgcctataaaacaggctggcttgttgaagcagataaagaaggttgggacggattcaaacaatcacttatcgaaggggcagcaattgccgttcgtggtgtggttactggacaataaggggcgaaagccccttttgaggttaaaatgattgacataatccgcgtaaaactccctggtggagtgaagcgattccctatgtttaccgtgcgcgatcaattgagtttcttgctcaccagcgcggacatggaagggaagacgctcacagaacagcaagaaatgctggatgaaattttagatattctgtatccgggttattcccgcaccgaacaggaaaacatattcactaaggtgtattgcgtatcgttcggtaagaacgcaataaagatccgaatcaaaggaagcagcggacaatcagaagcattcatgcatgtaactgattacgttttgcaaaatgaatatgcccttgatgactcgcttactctgggattcaaattcccgaaacatcgtaacaacagtgaacaattattccttgaatgtatccagtatgtcaagcaggacggcgaaagatacgaatggaatgcattagacgaggatacaaagaacgcgatcctggatctggtgtctattgaagatatggaaaatatcgttaaactgttacgcaagtcctgtcatgttaccgtgcgtgatattgagttcagcgacttattgacactgtacaaaatcctgttcaacaaatcagaactgaatgagttcttcaaaaccaactatttgttaaataagaataccgtacagattgaacctataatgaatggaagcccgatggaacgttcaatttacgttgcattgctggcggaagacttgaaacgaaaagagaatgcaaatgcgtaaacatacaccccgacatatcccaaaatataatgtgacttatcgcccgttaaccattggcgatcttgatgacacggataacttcattattgaaggtgatgtgttcaagcatcagcgcgattatgtttacattatggctctgttcgacagtatcaacaaagagactgtagatctccaaatcaaatgccctgattgcggggaactgattaagtttgtgctcaatcgtcatcatatcatggtggacgaatacgaagaaaagctgtacggcaatgagatcaagatttcagtcgaaccacaccgcaccggaaaggaagagttaccagaactgattaagtttgtagtcatcgacggtgaacaaatcttatgggatgactgtaaagagtcagagaaagaagccgttctggatagtatcgactatccggtctttaaatcaataaatagcgctctggataagccagcaatcgttgcaaacattccggtaaggtgttcgtgtggctacgagcatatcgttgcactgagaggcttagaggcgtttctaaaggtggttggataaaatgggtgttaaccttcgcttactgtatagcgatatcgatcccaacttaacaaaagactggaacaatgacgtaaccgcctcgaaaggggcggcagcggtaaagaatagtctgatcggtatcgtaacaacacaaaaaggcacacggcctttcgatagcaactttggttgtgagatcggggaacagattttcgagaacatgaacccgctaacagcggaagcagtaaggacttcgattgtctccgcgatccgcgcatacgaaccccgtgtttacaatctggatgttgaagtgattccgcagtatgacgaaaacgcaatcaccgtgacgatttactacagcatcattgatgaaccggaagaagtagaaagaatcaaactccagctatcatcctcataacaaaaaagccccgaaaggggcttttcttattccatcacgatccagcccattagctgttgatatcgcaattcgaacggggtgatgaaagagcggttattgataaccttcgtcccgttataggacttaatcacttcctcaccacgaagcacatattcgtatacttcgtccatcgtatcataacgaacttcttcgacttcgaagcagaagttggaatattcaatcattccgatcttgttcgcgtaacggcgttcgatgcatccctgtttttcaatctgagtgatcgcagtatcaatgaactgcgcaagtgcttgcatgaaattaccacattcgacttcacgacccccgcttgagatagccaggtaaacgcggctcaatccatcattgccgatgtaaccgatacagtcaccgccaatatagacagaccagactttacccatcggccccatacccatacgattctcactacgagaaacacctttcagtaacagtgccatgatacctccgcgaacgtaattcattttcatgataagccccttattttttcaggttgattaaccaagatggttgggtttctaaactaaccgctttccaagcatatgcaacactataaccggaatacgtctgacatacaacagcattttcatttaaatatttcactttgtgatctgcctcttgttcatccagggcagcacacacgatattcttttcatacactccgccgtttggctggataatggtttcttcaatcagataaacgctgttcatgctaattccttctcgattgcttcgatgatgtggagaacgtaaccgttcagttcttttgctttatcagcggcttcaaccataccgtaacgaggaacttctaaaacgttcgcaccttcgagcaggttgctttcgatgtctacgattacgtagctctcaccgattgtcgcgccttttctccagtcttttacgaacttcatcattttagctttcatgttctcgttccttttggctgttccgtttcgatatgtgtaatataacaaagccctcacgcgaacgcaagggctttttgggttaactgaatttattatagagagtgaaattaatccctatagaattcaatgctttacatgttgcatcaagatctgttggttcgatttcgatgatgtatttcaacgctgtgtttactggaatggtttctggttcttcgaaagatgccagggttggcgctttcaccgtttctggttcagcaagcgcggttttctttacgtcaaacgcttctttgaacttgttgaccctttttagcagatcatcaatcaattcgatgttggctccgtcgaattgtttggtttgttccagcatactcgtaatctttccgtatgtagtgcgtctggtttgttccgtgtaattccctacttcataacggtcgatccggtcgatgattgcccgaatatgtccaagattcgcgcgatcgaaatacgcaatcaacttagattttctgaacacgaacatatatggagcattaccgacaatgtaatgagttgccgttagaccaaaactaggatcgatcagaattttaaccgtgttgaaatacgggattaaatttatttcacgttcaggtaaacggaaaacttcatctttaaagttcttcccaatccggtcgatctcttccagagttttacccatcatcgacgaaattatttcaatttttttagatacataagccatttttcaattctcatttaattaatgcataaaagatttgacgtacttcacgatttcttcacgacacatatcgaccggagtatcctcagcaatagcagcatgacagaagatttcaccatccagccagaacgatagcatgtactgaatatcccgaccttcgttttctttctggtgtttcttgatgcgatcaaatgcatcatccatactttcggtagctgtaagcatttcagattcacccgctacagcagccatttccccagcttcatcactgaattcgctttccagttcttcccagtatactatcgttatcatggattaccccaaacagattttacatttacagagaggacattccgcctctttaacgcgcaagcgctttgttgctgttcgcttcgctgtgttgtgatcatacacatgcaaacagcggtaacagatcaccaatcgtttagccgtcataaccaccaccgcaacgaacatcaccttcaatgaacagttcgcggttatctctcaggagattgtatttcttttcgagttccggcccgaatgcgtccgcgtcgtcataccagtcatagtcataacttccggtttcatcgtcgtattccggttcgtcgccgcgctcattgaagtgaacgattttaacatcatccagattcagttctttcaacttgtcccagatgcgggttatttctacgctattacatccgaacgcttccagtgtgattgtaccgtcatcgtgtatttgaggtaaaccccagcgaggacgagtatcatcaaacatatccatcagagattcaacgtttgactcaccgtaaatctttgcaacttcctgttctttaccagggcggacaagtcctatcccgataatgaaactactgcttgagctattgctcacgaacccagaacggatcttcatcgccttgcctcgtatttcgcgttatctgcgattttctcatgatacaggttgtatgacaacaccagcgggatacaagctactataagcccgatgatagccagttgatattcgcgtttatcgaacgccatgaatgtaatcgtagcgcccagaataaacacacctaacgcaatgatgaagaataatgtcattttggcagggtatccatttcacgagattttgctttcaggatgtcaatcacagtagtcatcgcctgttctacatcaccatcatagtgaatcaggaatgttttgtgaagtcccatgatcagacgattgatgatataagccatttctgacggtaacagtttaccattctgtcgattgtacttctcaaacaagcggtagagttctgcgctattgcctggcttctcgatgctaaaattatgcatcccagacagaataccatccagatacagaacagttttgttatcactgcgcaggtgtccgccaaccttgtagtagttgctgaatacatacggcttttcgcggatatcttcgatatcgaaatcaccatgatcttcgatgttgccaacatgggcgaagaaatgatgatcttccagttcgagaaggattgcaccctttttgtaagggaatccgactaaatcaatctgccagccattttcaccgacaaatacatcatcaacaaccacgaaatccggcagcataggcgcgtatgcgtggttcttttcgttgttttcacgataggcttgtggttcggacaggtacaggatatcgccttttacaacttcaccccagaatacgttacgtgacatattattttcctcaatatgccccctttcgggggcggtcattgttagattttgacttctttttcttccaggacgatttcacattcgaatgatgtggtttcccagactttccagaaatcggatggaatattatcttctttcggaagaatatcttttgcagcgatagaaactttggtttcttcgaagtccagatccgcgaaccatgcatgggctactacaacaccgtacattacgcgacttaaacgggcattcagtttacggacttcctgaatcgttgcctttgtctgcttatcaagatactcgactacctgatctttgtcaagcgcatccagttcagatttcacctgatcgtaagcccacaggataatcaggtcgccgttgttcagtttcttcttaccttcttcacgcttcgcgacggtagccgctacagcaggaagggaggaaacacccttgattttcacgttcagttctttcgacatgtaaacatcagtcgattctgtgcgctcaaccttcggagagaacccgtaatcacgaataccctgttcagacagccattcacccgcagcctcaccaaagcgctgtttcagcccttctgcgttgcgcagtccgatcgcgttgtcacggaagaacttcataaccttctgacgacctttcaggatttctaggcgcacgttatcagtcacgaactctttaccgcttaacccgcgagtcatgccacggttaaccagaggcagagaggtaaagtctaccagaaccgacatacgatcatcaccgattttttcgagcggcttgatagtcaggccagaagcacgaaggtttttcagtgtcggaatatcggtttccagcggcagaactttaacgttcacgataccatctttaacgatggtgaagttacgcacctgcttagtttcgactttttccggcagaccgaattctttctgtttgctttctgggatagtcacatacccttccagatccgtgttgatggaaatgttaggacgggaactgttacccaccagatgtttaaccgatactttggttgtagtctgggtgaacttcggaacccatacttcatgcgctaccatttgcgccgccagtgctttacgttcttctggggttgcagcgtttgcgatctgttcagacagttgatccagtgtatcatcttctttctgtacagtctgacggcctgtgcggttgtacgcccagtgttcagaagacaggtcgatcactgtgtcagtttgtgccagcagttcgagcgcatcaaccagagtgaacgcgttttcgtctggaaccatgctgtaatcaataccatcaacgaaacgctgtgacggatcaacaaccgcttgtgcaatcaggtctttcgcgttggaatagtcctgcttagtaaagcagttgtcatacgccttgatcagacggacatcacccagcttttgaagcactttccatgccagatcagggttcattgtgtgtagtgcatgataaagcacgacatacagaacttgctgttcgctggcgatgttcggatcgaagccgtcaacatcattgatcgcgttgtcacccagcgcccagatgtttttgatgtgttctggaaccagtacaacaccgtttgcagcgttcaggacatacacgcgcccttcgtccaggtagatcgcatgggtagcatcagcaacgttgacttcgatacgcgcggaagtctgcgcggtgataatttcgttaaatgctggttcgtatgcgtcgaaaccttcaacgaatttgtgcaatgcgttggttgcttctgccattttttccagcagaggacggtttacataataaccgtattccaggaacgcgatactgttgaaagtcagtggcagaaccgcacacgctttcagaatatcatcggtacgccagcagttgtcataaccgtctgtcaggaagatcaggctgttcaggttgccgttttcagattgcagatcggtagcgatttccgcagccagattcaacggctcaacaaagccagtacaacccgtaggtttcaggtaacggtcgatagccgcgcagatgttagacaggtcagagacattgctaaccttctcaccacggaacaccgtgccgtaatcgcctttgctggagaagtacaggatcgaaacggtatcatcctgtttaaccagactcgccaggtttgctttcaggtgtttacggatcttaggcagttcgttgtacattgaaccggatacgtcacacacgaaaacgtggtttgtcggggttggcttcgatacagcgtttttgaattcgatatttgtgattgacatttaaattttctcgtatttgaatttttctaaaatttcgttaactttattgcttactgcttcgactgtacgatcacacccaaacttacgcgccaggagttcaacgtattcatccatcgtagtgagtttggattctgcaatgtcaaatgcgagcgcatacattaccggattccatacccgaacgatttggagagtatactcgttcagttcaaatcgttcaagatattttcgcaaagaaaatacatcaaacggtgcggggcgatcctggctaaaggggatcgactcccctaatgcatagcgaggcataacaacacagacttcggtttttaacttatccatcagtgatgactctttgatgtgtgttcaaggttacggaagatgtttccatgttccagttgagttccgatcgggccgcattcatcggagtacgtgaattcatagataaacacgccgtcctgattgccgaacttcgtgttgtactcttcgtacaaccacattttgatcagagcgtctttctcttctgtttccagatcgtaccagtctcgcccgtcatacgcaagcgcaatttgaggatttgaacggtaacggttttccgcgctttcttcggtttcccagtcatagcgcttatcgtcgtagaacgattcaaagctattacccagatgaccgcctaagtcacgatgaacgtgattgaccacttcttccgctgtcaacggcggatcgtagtaaccacaatcagggacgcaatcacccatcatttcgcgcaggttgtcgatatcagtcggatctttcgggaaccggacgatgaaactacttgatgaactgttgctcacaaaaccagaacggattttcattttacatcctcaaattgtaagttttctttggttgcgttcgcaatggctttttcgttgttcagtgttactatgcgcagacgttcgccagtaaagccgtcgcattcagtgatactcacccagtcaaaatgtttagccatttcaatcgcacgttccagcgatacggtagaaccaaccaaatcactaaatgtatagtaatcttcgcttaaactttcaacagtataaattttcatgatactttaccttttgtttcggatttcaggacgatgttactgtaaggatcttttgctaccagttcccacaggtcgccaggatgttccccgctacggtagacggatgaacggatgatttcgttaaacttgctcagggcttcgtctatgtcgtcatacccgcatttgagaggcttacggttgcaacgaatgaagaacatttcgttggtattctccccgcgttcggcgtttttaaccttcataccgcctccattttaccaatgacttcttcgtatgtcacagggttaggttcatagccgttagcgcctattgtatcgcctactctgtttcctactaaagaagcaaccgcaactttcttgccgtctttccacgcagtgaaatgcagattatccgcaacatacgggaaggtttcgtgattgttcaccgcgtcgatgcagtccataacggtatcagacgcgcagatcagattaccaggttcataatcaaccaaacattcaacagtgtaaatcataataatttcctcacgaaaaagcccctttcggggcttgattaatcagtgtccgaacacaccacgaatagactctgcgaacgcgtacagttcagggtttttcgctttcactgtttcgatttgttccaggatgtaatctggtttgtatttcgcaccgaaccagcagtaagagaaagaacgatcccacatgaacacgttgtagtattcaccgttacgcacttcaaccatcacgtaacctggattagaacccagcgggtaatctttcagtagattaaatttcgcaccagcgccagtacatccgttaaacaggtcattaaaagtcatggtatgttccttttcagtttcgtttcgttaaagctaagataccactatcaactactggatgcaaacacttttttgaagaattttgtttccggtctttctttgtacggacgcattaccaaatctttaccgtccagcacggttggcttaccttcgagttcgatcaggatgaagtttcctttatgatacttcaatacgccctggctggcagaccattcatcattatcccagtggttgtaatgccattcaacaacggtatcgatcgggatttctggttgatttctcataatactttcctaatttgtttcgctatggcttcaatcacgggtattgaaactgaatttcccgcttgactatatgcctgttttttactatccggtatgataaatgaatctgggaacccttgcaaacgaaaacactcacggggagtaagtcttctggggttttttccatcttgtagaactaagcactgaaccccgtccttccaatattgagcagtgatagtcccagtgtgcgtagaatcgcttgtgacggcctgataaccgaaacccttaccgtttgccttatttcgttccttacgctctctaaagcccttccatgcgttatctgacagggtgaacgaatcatcagcatcttcgaggatgtcgcctacgcgtgtaggggtacgcgggggaaccggaaacgaaaagaatacatcatccaggaagcagacaataaacacgcgttcccgtctttggggtagtccgaaatcctttgtgttcaggcgttgatagaatacgttatatccttcggcctccagaagcccgtaaatcgttttaaacgtcttccccttgtcatgggttagcagttcaggcacgttctcaaagaacaacacacggggctttttagcgcgtataatgcggaggatttcgaagaacaccgtaccgcgtacatcatcaaagcccagtttcaatccggctttactgaacgcctgacacgggaaccccgccagcaggatatcatgatccggtacttcgttttcatcaatctggaacagatcaccttgtaggttatcattgccccagttttcgatatatgtttgctgtgcgaacttgtcgatttcagacgttaaaaggcattcgacaccgccgaatgccttatcaaatcctaatcgaaccccgcccacacccgcgcagaggtcaattattttcatacgtcaaaatcaatctcgtcaattttgtatgagttttcgtcaatgtccgcccagagggttacattaacatgtttgctatcttcgtacaactgacgaccatcaattccgcccgtgtaattgctttcggtacgttcagtaacttccaggcggaggctatcgcgcatgatctgaacaacagcctgttccagtgtaaccgcgtctgggtttttggtatcgcccagtacaacatctttaacgttcaaaataatatcagtcattagtaaaacttcccgtaggtgttgaaatttacatgtgttgggcttgcttcgttgatactgatttcataatcgtaatcctcatttgttacggaacgatcatgtttgataacatcaacgacatatacccgaaagaatgcatgatacagagcatcgcggatcttttcagcaagcaccggaggctcactgtacaggttaatcatatcggaaacaatatcatctacgcgaggaatatcacgtttctcaatgtaacctacatacaaacttacgtctttgaccattagtgccactccgttttaataccatgtcggtatgcgtcaacccccagcggggtaatcagcaaccatgctttcgaattatcgtgataacccgttactcttcgagcgtaacctttttgaatcagggcatcacgccctgatttgctgggtacgtcattgaaatctaagtctagcactttagttgcgtatccgtaaagtttatacagaacatcaatttcagcgccggacaatttaggatacatcatttgtaataccccacaacatgatcgctgtatacgcgttcgatgaaatcgttccagaattcgcgatcaacttctttcggatatgttgaaatcgctgcaaggcgttcgacttcacccatgacttcttccagtttttcctgtacggttgcgaacggtacgccgccagctttaaccagtttcaggaatgcgctatcaggcagaggataaacgatatcaccatctttgtaaatctggatcaactgcataccaccgcgcaacgcgtgacttaatgctttccagtcgatcccgttgttggcttctgcttgtcgtgcgcgttctccgtattcatcccagagtttatacacagacttacgcatttcatcggctttgatcgtgaactggaatttacgccccagcacttcatagaagtcctgacaaccagatttcattgtcgtgtcggtaacgaatcggcagaactcgtttgtagggaaacgatccttgatgtcagacactttcacttcacgcgtatagcgtttcatatctggcgtgaattcctgaataccaccgatcgtttcggtttctttcagtacatcgacaacttcgcgcagtgcagccagtcgggaacccttcacgccatatttcgcggcttgcttacgaacataaccgaacaagccagttagttcagtggtgtaaaaacgccagcggttagcgcggatatactgccagatttgagagttagcgatcagcttgtcatccgaagcgtgaagcatatcgagcgctacggtatcaccatcacacgcaagactaatgaacttagtcagactatacaactgacggtcaacgtcgtctacggtgtttttagagcttttatcgcctgtgctggtgtcaatagtcttcggggctttccccaggagaatatcgcgcgggtgcgggagaaagatccctttatagtctttgtcgcttgtcggtgtgttcagtccgtacaggtgagaaccgaacacggtttccattacagttttcaaaattcaacccccagggtttttgcgataccgcgcagttcagcggtagtgatatttggtacacgcgttacatgtccacgaccgaacgcgtctttgattttatcagtaagttcgatacggtacaaatgttctttgtattcgtcttcgctatgataaccctgtgtatgattattccagtcattagcgctacctgtttttcgatcaagtcgctcaacacggaaatctttaatatcggtgatatttggatcttccgacgcatacaggtattgacgggcaaccttgatcacatacaaggtgcgaggtcgtggggttttgtgatgactgtatcgacgaataccaggatcaaacagggtatcacccactttcacatcagttaaatctatcatttcattttccaacgttttgacttttcacagtagaacaccggaagacgtgccagaactggcttcactacgtcttcccctgtgttcgtgttatgaactacttcgattgtaagggattgcccttcggacggccttacgatgtccagttccaggatctcacgattaccctttgtattgatttccgctacgtagtaatcgtgtccgttgatgtttacgacatcacccataataacgctaattgtgtgaatcatgagtatgcaaacttaattttaacattcagggaatccagcaggatcgcatcacgtccatcaatgatagtcaatcccatgtatttgttatcgtctgcgctcttacgggagtacatgcgacaaaccagagaaccatcttgtgcgatgtattcaacgtggtattcacggcgttctgacgtgaagatgtcaccaactacaacaggacgatcaacactttggcgtttagtcccttcataggacagtttgccgttaccgtctggggtacattccgcgcctttcaacaggatttgtgtcactcggacagattctacggttcccgcaatcaacattgctggatcagcggttcccattttcaggatcagcgttgaacttgttttgtatcgtgatggttcagtgacgaacacgtaaaccatatcgttcttatcacgggcaacagattgcagcgtgaattgcatttgacccggaatacccgacatcgcaatgtgaacacgattaccaggttccagcgccatacgacattttacatcagtgatcccgctaagggttgctactttcatgatttaattccttcaaagtcttcattagatttccagtacacgttaaagttacggcaatcgtgatcagaagtcaacgtatatttttcttttgttttctcgtcggtgatcaccatcgtttcattttcgatggaatccacgccatagacgaacactttatcaccgcgcttattcaggaacgcgtcacctgtttgaatcaactgccagcagttgacaggtaaaccacccgcgcagataggacgggttactaaacagtaagggtgtttcatcaatcagccagccttatattgtttggatcaggaacgaatgtatctttctgggtaatcatgaacaccaggaaagcagcgacttcgggatcttcaatcacattgaacttgcgattgcctttccaacgtaccgcgattttaccatcatcgagttttctgatttcggctacttctgatttcttgctcataattacctccttcgtttcgatgcccctaatataacaaaagccctcacgcgaacgcaagggcttttttcatcttttatcagagtcccgtaaacgctacgataatctgatagtggtcatcgaagaactcaccacgattttgtttgacttcgtgcataggcatccagaacgcgtctaacgcatcgtcagaaccgcccataatacggggcagacttccatcattgttaggttctaacttgatgtactgcgccacagtcggttttgagaagtatacggaacgtttcggatgatcgaacagcatcgaattacggattgaaccacgaataaccttttcaggaaccttgattcgtacctcttcgagcagttcgcggattgcacaatccaggaacgtttcatttgcgtttttgtgtccaccaggaagggctaacgcgtctttacctggtgcgaacttacgacgaattaccagcaggtgattgttacacacaaccacactatcacccgtgcagcagttcagcgcgtcggggtatgggtagtttttgaatttctccaattcgctttcccatttctcgtattcgtagaataaacgccagaacgtgtcttccatcatccatttgtcgatataatcgacggttgcttgaggaacaaagcgcaacagtttcttatcccatccgtttttgtggttgaagataatcggacgcagatcggttgctgatagatccttgccgtcaacctgaacaggatcaacaggtacgtgtgtccatccgaacgctttaagccagtatgaacccgcatctttttcgtaaccgtagatagcgattttgtcgcctttggtttccctgatagcagtacgaacagaggttttccatttctcttcgttgtaaagataatctggaatatgttcaaactgaacacgaacaacatcttcgatcgggaagttagcgtttaaccatgagaagatcatcgtttgacgctcacgcgctgtcagagggtttaaaacgttagggtaagcatatgctgaacccagaaggatgtaaacgatctttgcttcttcgagtgctttacgcaccattgctgcatgaccattatggaagggttggaatctgccaattacgacagctttatcaaattgtttcataacgtgctccacgtttaaaggttaatcataaaacagacgcaatcaccaatacaccaagaaaaccgccaataaagccgaagaatagcgaaatgaagatagtaaggatgatctgttttatgttcattatagtattctcgttttaggagtcaagcccccagagtgggggctttaaaaccttatttacgagaatcgaaaatcacttgtccatcgtaacccgcacccattacggtatgtggaacaccgccctggtatttctctgcgcgtttcatctgaacgtcaagttctttccagcgaatcatttctggtgtaatggtacgctgcaacacggcgttcgcttcggcttctttcttagccgcatacagacgggcatcagcatcacgctcgttagcctgtgcagcattgctacgggcttctttatcggcaattgcctgaacaactgcctgttgagcgatttgctctttacgtgccagttctgctttttctgcgttcacctgttcttcacgaatttttgtgttttcaacctgtttcttaatcgcttccggcaggtcgatgtcctgcaagaatacctgtttcacggtgtagccgtaaggacgggcatactcttcaacttcctgctgaattgcgatctgtagctggctttgaacttctgcgttatacagatcctgtgctttcggtacagatttaccgaactcacggacggtagacagaagtttttcggtcacgtacttatcaagcgcctgatcctgattacccgcgttgatacggttgatcggggctttgttaccatcgaactgcaacatcacggtcatatccacagtggatttgaatttatcctgggacggaacctgcaatttgtcaaacttcattgcgatgtctttggtgttgaacacctcgaaatcagccagtgggtttaccaggtggaagccaggcagaacaggcttcggtgaaactttacccatgaaggtttgagtttttaccgtaccatcctgaacgatagtgtacgagttcggaaccagccacagagcggcgattacgcccagagcgatcagagtggttttcttcgggttgtttacgatagtgtttaagttcatcattatttccattgggtttatgtttcaattcgatagttattctatcatcactttttcgcttgtcaaactctttttaagaaagttttgtcagcttgtaaatcgtttgatagcacaagcctttgatctcgtccaggacgttcttcaatgaactatctactgaatcatagatttcgttggcttcatcggctattttacggagatacgcgaccgtgtcaagcacattttctgtttttaatacgggtttgtatcgaccagtaatgcctatatggatttcggtgaatttatcaaccaaatcctgcatatcttcgtaaaacccttcaaatgctttatgctgtgaatatgaaccagtcgcaaaatgtgcgctgtgcatataggttacagacattaagcaagtgccaataaaggcatcaattttactcgcggtatcgcgttctgttacttcgttaaacgtctgcatcttcatcccttatgaacgatgaatagcggcgaattcacttgcaacccgtagccctaaacgtttacattcgggttcggatttacattgcttctgctgccattttcgttccatgtaattatagaatagttcactggtatttacgctgggagggatggtgtcaagatatacctgtagcgccgcattgatatagtaatcgaactctttggctactactgacctatcatcagcatgtgatgacggagacaagattaacaaaccaaacatcagcgctttagatatgcgtttaatgttcataagcaattctctacgtgcttacggatcaacaatagatccgttcctgtatatatttatagcaaaaaaggggcgaatcgccccttatgtaaaattagtctaaaaatacatcaagttatctcataccagcataagctacgctcaaaagcgcggatcttatttgcgttctcgatattttcatcccatccaattacgccagctttcatccggcgtaattcctgacgcattttagcgcgtactttcgaatcaatctttttcacagcgattgaaagcatcgcggagatatcacgatgagctttgttaccgtcgcgattcaggtttttatcgaaccggatatatgcgcaacctgatttgtgtttccagttggttgtataccaacgtaaaccatcaggactttccccgtgctgtgcataatactctgaaaatgcttttgtctcttcgatctgttcgatggaggacttatcacggactggaacatatttcttacggtaagtacggctcatagtgttctcctttgtttgtctgaatacaccttaacagttcagaccaacattatcaagaagtttttcgtgataatgtttgcgacagagcgaaacgtatttgtcttcggctccgatctcaacctgcgccccttcggttacgaagttgccttgtgcgtcgatacgtgcaaccgtagttgctttacgcccacagtgacacattccccgcagttctcggatctcgtctgcccaggccaacaaccagtaagaaccctcgaacagattcaactggaaatcagtacgcagaccgtaagccattacagggatttcgagttcatcaacaacgcgacatagatcgaaaacatttttcttcgaaaggaattgcgcctcgtcaacgaagatgcaagcaattttattccggcgctgaatgtcccagaacagatccatatcaggcgcaatcaattcacacttttcgttcagcccgatacgcgaactcactgtgtttgatgtgcgggtgtcgattgctggcttatagattacaacacgcataccgcgttctttgtaattgtgcgcgtccgtcaacagtcgcgcactctttccagcgttcattgatgcatagtgataatacagtttagccaattgtaaaccatccgttacccatgagttttttgttacgtcgcgcaagatgctctttgatttctggcatctggatcgcaatatcatactcttctttcgtcatagtatgatttgcgcaacccatacacccgcacacctgcgcgttacaccaacggagtgttccgtatgtcgcaatcaccttcattgctttagctttgattttgtcagtcatgattataaccgcccatttcgctatcttgtgctttatggatatcaagataccacatattgattttgcttttcagttcgcccatttctttatccagtccttcatcaacaagacaaagaatgtcaaccaccgttttacgctgtgtgatgttgattttgttcgctttcatggactgcgccagcgcttcacaggttttcaccagtgcggcgcgttgtcctttgattgcggcgatccgtttgttcgctttcttgatcgcccgacctgctttgataggatcaatcatgattagctcgctccactgctaccgcatcacgaaccgcatcattgatttcattttcaacgaaatccagaatatccgccgtaatgtcgtcaatacaggattgattgtagttgcgtgaatcaggatcgtcatcttcggcataatcctgatacgcttcgcccagttgtttcagtttatgttttaacagcttttgttcttgcggtctcattctctcgcctctttacgtccggcatcaaccaggtcatccacaaagctaacgatatcatcccaccaatccagcgcttcctgtgatgctttcgcgtcaccatcaaggaaacggtcacgagcgctcgcaaacttctctattttgctatagagcttttctttatttgcttcaatcatgataagtccgccttacgtggatcaaccgatggatcgaagtgaacaacgatgatcgggtaatctcccgtacactcgtcaataatagcgctaatacgcaaccaatcgcccccagcaagccccgcaccgataagaggggtaatgataggcaatttttcgggaaacgcactggcgcgttctacggcgctcacaaagcatgaccggattgcatcataatccacttgtgggccagtaccccagaatttaaactgagtgtaggcattgaagacaatctgaccttcttccgtcatgtagatggagttagtgcctaacttccgctgatcgcctttcatagtcagtgcatcaattttgaacgcaccagggattttttgcttcacttctttagcaatacccgcgcccatgttgcaataacagttacacccatgaatcaagtgtacttttcgtttcaggaacaactctacagcgttccctttgatttctttaataatcattttcatcacctgtatagtggcggtaagccagcacagccagccccgcgatcacaaccacaacacacattaagatataacctgtgttcatttaaattcgtcgtcccatctttgccaggcttccaactcgtcatcatatacagggaacgagctttcgtttggctttttaacgtaataccagataatgattgcagcagcaatcacacacccgtaaaagattactaatcccatcatcagtataatcctatgccagcaacatattcatcaaccaggtaagtacggagtttttcacaacgttccttatttggcgcattggtacagaggttcatcattggttcagactgtaaaaactcatgcagtttaaccaacttctgacgcttgaagaggtgcgcgttttcttcgccccacacataagccgcgtccagttgttcagcgattacctgttcacataccgcaacgtctttaatgtcacgattattgcagagttcagccagtcgatcatcagcatgagcaaagccagcaaacagggtgagtaacagcgcaagttttttcatcgttttaccttagtatgaatcttcttcgataggggtataataatgggtttcgcagatatacgcaagcactgatcgcaaactatcgctttcaaattccggcttttgattgcgtttcaggttccagccagtgaaacacatccagcgttcctctgcaacatcaaaggctaaccaatatgtgctgaactgtgaacatgtatgttcgaagatatcgaacagcaatttaccgccgatcggcttcacatatggtttcacgcgttgaagcgatttcaggactgtttcgaggttactgcgatcctcattcatcgcaatgcggagaatatgctgattggtttctgggttatacccgtcgatcgcaagccccatatcctggaagaacttagtcgcatcacggaaaatttcatgtccgctgttcggtgaattgatgtaaaactccatacgttgttttggagtcatcgctcggacacgggaagcggttttgtgatcgatctcgtctttgacctcctgacgggctttcagcaacccgttcagcttttcctgatagggttttacaatcgctcggatttcgtcgatacgttcatcaataattgctaactgctgttccggtgtcagtttagtttccatgttaagcccctacgcgcacaaagcgatcttcaattgcatcattaacacattcgtaaatgctaacgtcattcgggacgtgcttacgaatacccgctttcacgatatccatgatctctttgttgctaccccacacgttcaggttgaagtaaacaccgccgctatgaattgtgttgttgccaacatcaagatacgtatcttgactttcgcagataaacagtttgcgtttttcttctccatatgcgaagtagatactgaacgattccatacgatgacgatcgaccgtgatggtttccactttaacctttggatctttgttcagttcatctaacacaccctgaatgatgtgcagcatgttcggcttgatgatagtagggtgactggtaataactcgatgtgatgtgctcataatttaatcctcaatagttggtacacacataataaaaaagcccctgcgaaattgcaagggctttttatcagataatgcgtttttcttctaacagcttcgcggtatggttaaccatgcgagcgtaatcacgggcttctttctttgaatacttgaatcccgcgttgtaactcgccagcgcctttttcaagtcgcctttgtggtaatcaagccagtattccagttcgtgaagtgcatacttggaaccaccccgaagggtttcgagcttattgattactacgcgtttggaatatgatttatccattcgtgcggacgcgctacgggctgttacttgaaaacaaccataagcatgatgattctttttgcctttccctacgttctcacatgcgcgagactcgatccaggcaatagccgctaaatgatatcccaaacgtttcgatgtttccgattcaactggctttgcagttttgcgatcgtactcatttccgatcctgaaagcgtactccaaaacctttttctgctttggtgtaatatcatccaattccttaacatagctgggggcattggctggcgctttcttcattactgttgcttgttgtagcggtaaagttgacttcacagcggggagtgtttggataaactctcctaacggatcagtcgccgcgttgccagaaaaagagcataagaaaatgctggcagcaaagataattttcttcattgtaatacctatttgtaacaagagagggctatgataccctcgtcttattatttatgcaacgattttacgctgttttgcttcggtcagttttttctcgatgaattcagcaatgttatagtttgaaatcgaaacgttcggatcgtacagttctacgatttcatcaaacgatacctgaaccacatgtttaaagtgaacactccagccagtcgtaaagatttcgctgttgtcgaacccgcaatcagggctgaacatggcgcggtatttgtatccgctgtaatctttcaaacgattcgggctgtgtgcgtcactggtgatcaggaatttcccctggtgagtctcaaccacgaagaaataacccagacgttctttgttgtccagcatcgtttcgaacttgcggttgttatcttcacggtcaacgcgagtttggatcttcttccagacctgttcatattcaggccaatcatgctcgacaacaaccccttttatgggttctttgccttgctctttacgatagcgatcaattttattcactaccgcagagagaagcagtttgtcgctatcacttaacgccgcatcaatatctgcatatttaagcactgcataacgttcttcgcgtttcatactactacatccttatcacagactggacaccggatcacacgatacacatcacgaccgccagtgtaatcagtagataccttttctttgacatcctgcgcagtgtatgacagaacagcaccacaacgacaggtagtttgttttggggtaatgcttacaacttgaaccataataacctcacaagaatagtttcacttcgctaccgcatttcgggcagacgatatgttttttcacgatgtaatcagcagcacggaagaaaccgttgtagaacacttcgtttttcttctgtacatcagacaattcatactctaacccacttttgcagttagcgcaaacggtaattagctttggactaacaataacgctgatcatgtatacctcacgaaaaagggggccgaagcccccttaattaaaagttctcttcgacgaatgcagccagtcgcccacgatatacggtatccaggatcacatgacttgaatgaccgtactctttaagtttttcaaccgcatacacaaagccgttgttaacagcagtgttgcgcgggttgtcaatctgtttaatgttcccgcatagtatcagaagggtgttctcaccgcaacgggaaataatggatttgatttcgtgattgctcaagttttgacattcatcaacaatcagaaccgaacctttacccggatcaggatgcccgattgagcgcccacggaagtaatacaggctagggaactggacaacgttcttctccagcagcccttctacgtatttgtcaacttccggttgatccttaaacagaatgttcaggctcgtaatacatggttctacagcaggacgcagtttttcgccaagagtaccaggtaagaacccgatttcgcccgacagagggctatctgccttgacatacatcaggtttgcgaagtgtcccgcgtttaccatgtgcattgcaccagcaacagccagcatggttttacctgaacccgccgcgcccatgatggtcacaacgtcattgtttttgtccagaatagcatcaacgaatgacgcttgcagagcatcgcgaggctggattgttttcatcagcttacgctttaacgcctgttcgtgcttaataggcaacacttcaagctgaaactctccagcattcaccacacgccctacaatctcaccacacgatagaatgtattggttagggtagaaatccgcgtcaggaagcgatgaatacgttataacggcaacaggcccgacatactccaggacttcaacagtttcccagaacagaggcaggtcgatataacctgaatacaacacatcactatctttcagcgagtcatcgccagtgtattgaagaaccgaacaacctttagacatcgcgatcaacagcatgttaatgtcacgagtcaccagagttgcgccctgctgaatacaagttgcaatgatccgcgcatcctgtttatccagagggaattcttcggtgccgtcataatcgacgattttcagtgttacgctttccggtactgctgggttcgataagtttaacgaaacccctgtttgggtaattgcttcataattttgtcccaggattgctttggacaaaagccggatcgccagtcgtgcttcatgagcggttcgctctttgcttttcaggtgatccagttcttccatcgttgcagcggtgataatgatttcgctgtcaggttcgatgtaagaatagattgaatatgggttactaatcaaaacattggtgtctaatacgtattttgacatacattaaccttatgtggtttcgttaaaaaatgtgccgaaaacctctttcgctttccggtcataaacggcttttgcttcttctggagtggtataataccccaaaaattttctttttccatctatgtttatctgcgctttatacttcccatttgctttgtgataagaaacacctttcaaccccgtactgctgtttgaattacatttctttttcatcgcgttttgttggttcgtcgctttctgtagatttcttgctgtatctccattttcaacaccatacacatgatctacgataggaggaagataaccattctcaacgtaaaacactattcggtgtcgcaaatacatagaacctttaaaatgaatttgggaatactcgttcttgcttccggcttcacttccaggagacatagggccgcgctgaattttccaatacacttttcccgtagatgtatcaacatctacataactcagaagagactcaatcccttgaatctcttcctgtatggttcttgatgaataaccatgacttttcattacatacccaaacggataatatggatatatgggaacggatgaagatgacttgaacgcatacacaaggtcagcgtttttgccagttcaaaccgttcgtcgatcgtcgtgtcacattcatcgaaaatcaggttgattgcctgatacttgatcgtttgtccacggaaaatggtattcagatcttgtcttttcgacagaatgaaagacgaatcagcgcccttatccagtccatgttctaccgcagcacaaatacccatctgctttgtcggtgcaacgtagatgttcagtgtccctttcgactgcttgatgatatcgaaagccgctttggttttacccgacatccggcccatatccagcgcagtttcgaagatagacacaccgccgcattcttgcccccaacgccaatcaacgattcgcgcaaggtgcaggttacgtgactgctttacagcgtcaacatagaattgtgaaatcatgttttcgccttatgcaagttcaacgtgtggtgcgtcgataaacttcgtttcaatcggaaggtttggatcgttcttccagttgataccgtaacgcagttttacgccctgttcatcagcggcttgtttcactgcattcaggacaggcaaccacactttcgggttagtctgccagccagcagggagaacgctaggatacagatccacagcatcaccagtgatgtgttttgagttcatggtctgggaaacacccttgcggacgttttcgcgctgttgttctacggtgcgcagaccttcgcgtacaccgaaatcaacaggtgagagttccagagcacgttttaccaccttaaccagttccggcttcacgccttgcaggttgttcaggcttttctgactaaatttaaacatacatacctctttatgaaaataccctatgggctacacagggtatttacggtttaagaggcgcaacgttttacatgtaaccccaaatcgattcttccgcgcgatcgcgtttccagcgaatcgtcatttcaacactttcctgtttgtcatcaggaggaagtttatcattattgatttgttcaatatatgcttgcgcatctgcttcgctacggaacaacgcatggaaattataatggttgcgcccagttacgttacgatcatccagagagaatttacctttattttcccaatcatcatacacagtgattccgttaacaaacagccccagcccacgatgttcacgcgggaagccagtgatgatatgttttcgacccatctgtgccttttcaccagtgatactgattacttcgtacaggattgcgccaggtttgatatctttcaggacagcacgtttttcaaaagcgttcataatgtattcctcacaattagttttcatatacagattaccacaatctgttttgatgtcaacaaggtctatcgtttttatttgggaaagttaacgtgaaaagacgatcgtgtaatgcttcgatccgttcatacgcttgtttcaggatcgtcttatcttctgggttcgttgtctcgatgcagatcagttcgtccgagtcgatagcgatcacatcatccatcagtgaagcgaatacgttcacgtcagggtgagtcaattcctttatctccgcttccatcccgtcatgctgggataacagttcgatgatatcgcgctgtaaatctccctggtacgggaatccggtttgaagatggttgataattctttctgcttcggtcatatttcacctacaaaaaagcccctttcggggctgggattaaatgtctttgcactggcaaacaccgtatttggtgaaaggcttgtcgccgctcaggtaagaccagaaatcgcaagcctgttcagcggtttcgaagattgccgcatcatagaagccgtgttcttcgttaccatctttattgaggaacacaggaagccagctttgcggtttgaagcagtcagtaacaactacccaaccttctttcgctttcattgcttctttgttcgcttcaaccatttccagcatttcgttcagtaagttcattttaatccccttgtttatctgtttcgttgtctacgagagagatattatcacaacggggattagtgtcaacagttattcgaaacgaattgtgctatttttgaaaaacattccagagcacacagatcctttgatctgcttgccgttcacaccagttgcttcgaatccggttgagtatgtgtctttttcagaacatgcaaaccacttgtaacccgtgaactggatgttcgtataaccctgtgcttccaggatacgatgtgcctctttctcgtcagtacagcttgactgcaagaacacaacaacgacaaccatcaaaatacacacaacaattttccacataatttatactcttttaaggttagttttgctggcttcgatccagcttacttggttagatccaatatcacccagacatacagttgtatgactaaatgtgttcggtaaagaaacatcatcaggagataacaacaaatcatgtacacttacgctggttgcatacaaataaccaccggacgtatacagtgtttttatgaaatcatatgaatcgttgggccacttgaaacggtatttctggttccagagttcaacttcatgcacatcatattcatcgaacaggggatcgttgccctttgtcgcttcgtaaagcgcaccgcgccattcaactaaatccgcttcgatatcacttacacaaaactcttcttttgcgctaagtttatcaagcatcatttcaatagtgcggatagccatgcttaattcacgatcgagtttcatacaataccctcttcttcgagcacttcccagatcaggcgatccaggtgcatcaggttccacataacggagtcatacgaacccagcgagcgggagtaaatcactccccatgaacgataagccttttggaatgattcagcactgttttcatcgtgcggcatatcgtcacccgaagcgatcagcagtttcagaaccatcaggctattgagcgcctttggcgtgaattcctgttcgcttaacttcatcgcgtaccgttcgatgatcgcgattgacttcggatctttaatacgcccatctgtacgacgcgttttaaacgcgctcattaattcatcaactacggcggcacacttcatatgcttcatccttttcctgtacagacatccgattatagcggatctcttcgcgctgttcaacttctctcacggcttcggctttcttttcagcggtcagtatgtgatgtactacagcgtttcggattccccagagatattcaatcatctgcatatcttcaacggtgtgatagcctttcgcatcacattcaaatacaatttcatcgcgttctgccattgccacctgtgcggtagaaggacaaataaccattccagagtatttttcaatcaacgattccagtgtacgcggttttgctggaatgtcaatagataccggaaccattcgcatcgttgaatcattatgggattgataaatcatcagaatgtaatctccgcaaactgcattctacgctcaatcgcatggatagcgttatcgcgctgttctttgttttcatatccagcccaggtaatcggggttgaacagatcaggtgaaaagtgattgctgggtgtctcttcccttcaacaacgattgttgcatcatcttcgatccaggttacgtgatccagattcaccggatagtttcttacggtaacagtttcaccaaccaaaagcgacacgtccagaatatcacgatcgcggacatatgatttaatacgagatacgattaacattatttcaactccactgcatatacatcggtttcaggggctttgtgtacgcgcatatctttaccacataccgcataagccggacagttacggcaaccgttatgatccttgttgccagtcagttctttacggaactgttttgttttcgggtgttcccagatatccttcacaaaatcttcggcttccagaacatccagaccttcttcccagccaccttcaacccaacgttcggtaaacgagcaagggaagaactgaccacgttcattaatgtaagagctaaacatcgtcgcttcacagtcttcggcgtattgcttgtactgttcgaagttcgggtgtccctccatcgcttcaacgaaagcgggggctgaacagctatcgaatccaaatcctacaccagaatcgaggcaatattcaacaagttttttatattgttcgcgggtaacggtgtcccagttcttaccgcgtcctttttgtttcagtcccaggaacacgatcgcgtttacttgtttcaggcgcggatcattcttcacggcatcaaccacgttaaacgcgtcatcataggttttcgagctaaccatgaagtgaaggttgatttgctgttgtccggcttctgtcaggttcgctactgagtcgaaagcgacatcaaaatcagcgtgtttataaaccgataccgcaacagccccagcaaccgccgctaaacgcgctgcaacgtcttttgatacgtcagcaatggtaaggttcggcacaatgcctttagaacgcgcatacgccatcatatcgaacatatcggggtttgtttgcccctgtgcatcagcaccgagtgcgcattgagtaagccagggcattttgtcgatgatttttttgaagttggcaagatccatgttgaacccgttcgggttattggacttgtagcagaacccgcagagtttacccgctggcccgttgcatttggtagtgatctcgatatcgagaatttcggggaatggtgcgtattctggatcgtgggaatatgttgcaccccagcgagcgaattcaccagtatcaacgttgaaattatagttgtagaacttcgagcgagcgaagcgcatattgccgtgttgatagatgaacagggacggcgctttgatgctggtaacgatatcgacagttttcataatataattctcaaaatttaacatgggattggaagacagcgcgagcaaggctttcattgtcgaacggtatcgactggtgtttctctttgctgtcaatgttaacgcgccagaactcactcgaaccgtttttggtggagtaatgcatcagcgttaccgttttattcttttccaggaaagtacgtttgtcaatctctgttttgatttcgtgctgcatcattttacactccgtttcagtttacgttcgtcagccagttcttttttgtacagtttaatgtacttcccgttaagggtgcgaagctgttggaaaaccttgttgcacaaagcacgtttcgctttgtattccggcgtattgcggattgattcgatcgtcatacccatttcgtttttagggtaagcgcttaactccgcgccgatctctctgtaccagttgcttaactgatcacgctgtgctttgtactcttcaaaagttaacattataactgatctccgtaatctttcgctgcatcttcgggggttgcatccagtcggtaaagctcaacggctaacggactgggtttgatttcgcggttcaggatctcactgataccgcgaaggaattcgatataaggacggaatctcatttgatacgtaccgcgttaaaagcctggttgcgcagttcataagcctgttcaagctgttcagtagtgaacagagggctatcggtattagtggtgaaactgcaaatggttttgttgtcggcgttgacttcttcaacaacgatttcataaccccatgccccgctatactcacatttcacgttccggtacttgatgtaaaccgctgcaacatcttcttttttgtagttccggcttttgtagatgatttccatgatatcctccttcgtttcgatgtgtgtacaataacagatcagggttatggagttttagcaattcgtgctaattatgccattttcttagcgattttccatgcggctttgaacgctggaacatcttcaacatcaacccagaaaccagaaccgaaaccatcgttgtagcaagggcaaccgtcgcagtagttttcccaggtcatcactttaccaccaacagaagcaccagtttccatcgcacgtaatgcatcttcaactttttccagtttttctgcattgtcgtcataaatgatgaagtaccatttgccgttgtattcgttacccagtttgattgcttcgcgaacaagtttcatgatgatttcctttttgtctgtttcgtttcgatgtgtgtaatataacaaaagcccctggcggttacaaggggctttttaaacaaaaagtgctattttgtttcttcgaggattcgaaggatttcggcgcgggtgatcggatgttttgccagctcacggatcgcgtggtcaacgtgtatcttacacatcaaaaacttctccccgcacttgtcgcatgttgcatacatatcgccatgtatacgcccgatcccatcggttacggaatgatgcatccaggcgtaaggagttccccgcatccatccggtagcaacatgtttacattctcgttttcgtccgaacatattaccacccgttaggattgcggaaatgtgtttgccagtagcgcagttgttcgcggttcatgttttgggtatcaatcaccataccctgaatcatctgcaacatcatgcgggtttgattgacatcctccaggctcgctatacgctgttttaaggctttgttttcctcttctaactcaaccatacggttgtatgcgttgacgcgctccagaggcatatcagggcgctctttgaggacacgggcgcgggatacttcgcattcgtgatttgctttccagtgcgcggcttcattttctgctttttgcttatctcgcagcgccaatgacaggtcatcaaccagatccagaatagtttgcggatctacagtttcgagatattttccgagatcctcttcccagcttttaatctgtgtagggctgtcgccatatggaacaccatatgagaatgcgcgtttatactctttgcccctgaaaccatattcctgatttccctggatgcttaaattttcaacgagagtccacttactacccatcatagaagaaatcgaacgggctgatttttcaatttcttcaagtttttcacttgttactttcattttgtactccacaaatcatattgtgcgcgaaggatagcgtaaaggctaccgatattgattgaatcgaccggacactggaacaaatcagagcgcatcatattgaactcaatattgttctgttcaacgaagttaccgatcattgatgtccagcccatcaccaggttatatccgtcttcggataacccgtaagccaggttaaccctgatacaacgcttatcagccagttctacgctgatacagttacttgaatgcatagaattgcatgggaatttgctaggaaacttacggaacatctgggtaaggagtttagccgtttcaatgttgatcgcgcgttcctgatccctttgcgcctggttgtcatgaaggcgattcagatacttttccatttttgggttgagattcacatgttgcataatatattcctcacaggtttaaagcgttcttttccggttccattacatgaactgcatttcggagatcggtcgctatcatatcgccccgatccgttacatgcaacacatttccgtaatttccagccatacacgaaccgcatgtaataatcggttcgtgcggccttgcgttcgtggaagttcatactttgttgtaaacctgaaccagccacatttcgatgttcggcgcgtaagtaacgtttaccatcggcatagtgcggtatttgtaagcggctttgtacgcatcgagttcagtcggaacacagaaagagaaaccgttgtcataacgttctgcgttagaaacttcacaaccaactacagcggcaatgtttttgttcatgttcatgatgttttcctttctctgtttcgtttcgatgtgtgtaatataacaaagcccctgcatttctgcaagggcttttttcaagttattcgaaatttgttggcaactgatctacaattacctgagtttgatggatttcttcactcaatttatcgcggtaatgaaccagttcacgggttcttgatgcggaatagctaatgattttatcagcggtagcggtgtaaccgtaaccagcacatgcgatttccagttttgcgttatcgccattcggtacgcggatatgagcatacgtcagcaagtttttaaccgcttgtaacagttcatgatcttctttaccgatgataaactgatttggttctactgaatcaatgttcagttcttcgtctttgttcattttgcagccttatacatttcaaggacgcggttcatatgctcttgtgattgaggcacacccgcgaagttcagtttgatgaagaattccagacgatcctttttggtgcattcatccagccccagtgcaggtaatgacatattttcaaaggttcgctgttcgtgtcggggtagttcatgccagaataaacgggaaccgtccggcataggaagaccaatttcaccttcgtaaaatttgataatcgtcgtcaggcgttgtttaccgtcgatgacttctacccagtgagtttcattgaactggctatcaaccgcgatcgcgatgacaccacaagggaaccccgtcattaaggtagtcagaaacgcatcttgttctttctgcgtccacacgtaggggcgctgataagatggattcagatccagatcattatgcttccaccagttgagataactcccaaccatgatcgcatgatcgcgactacgaaaagttcggagttcccgaagtcggttatgaaccggaatatcatctttagacatgattcaccacccaacccaacaaaccagtattgatagccgcaacggtaaggcaaatcaccgcatacacccgcgcgttgtgaactttggttttcagttctgcgatctcctgatccttttcactttcgaactcttcgcgggttccatagtaaccaggatcagcagcggttgcgggacgaactgcatctttttcaacgatggttgcataaccactcgttacttgcgttgcgccgtaccagtcaccgcgatcggtgttgatgatcaagtgatcacccttcgcgttagctttatgcttcgacttgccaatgacaattacacgttcaccattcataatataatcactctttcacgttttgttgtaagaactctaacagctttccttcggcctgtaaagcataaagtttattcaactttgcgatgttttcaaagtctgatttttcgctgaacgaccagacaccatcatcggaaaccagcgcaccgattgatacgccagtttcaggatcacgcgtcaacgccagccccaggggatgcaggatatctttattgattttccataccagccccaattgagataaggtgttgaaatcaacgtgactcatttaggcaatgccccgaaagacagcagccccatacgatgatcgttatctgattcaccagtgctaaattcaaattcttcaccgctgatactgatagcgcggaaaccgtctttcaggtatggcaacagatacagagggatcagcatcatgtttgaatcgtcgctccacttacggaagcccagatttttcatttcttccagcgtcaaatcattcggatcgacgggttcgaaatcaggggaagcgtaaaggcgtccaggcagatcgcgaatatttttcacggtgaatgaatcaccccatgactgatacgcgataggttcagcggcgcgggttgcggtagccagaaggatcatttgacagatttgaaaagttgttgctttcatgatgtatatcccacaagtttagatagaagatgtcccatagtcttacgcgcatgatcgcggatctggctatacggaacatatttgaaaccgtccatttctgtgatggttcgcccgttcttcacgaacgttgacgcacagaagcatttatcggcttcggggtaattattgcctttatacacgaataagtaaagctcttttttactggtataatccagtcttccgaggctttccagttcgtgcggttcaacaagaactccagtttcttcgaagcactcacggatcgcagcgtgaataggttcttcgcctttttcgatatgcccctttgggatgtcccaatgaggcgtttcggttgcgtggcccattaaaacgctgccgttattcaggaagagaataccagcagaccgttccattactgtgctccgaacttacgatcgtatgctgccagcgctttatctgctgcatcaactgcctgagtgtgtttgttagcggatttctcgctgaacacttcgcggtaaatgacaacccagagggatcggcgggtctgttcgctttcttcattgacgcgagaagccgcaaaagcgttatgttctttgatcagttgtgcgaattcagcatcatgatcaatggtttgttgttgaatagctgtagaagtcataattcacctatttctttcagttcagttttgagtttttcgagagtcgattggtactgaatgccgttttctggatttggcagacgggcataatacagcgtaccagttttgttgatgtctgacaacacctcttgatcgagggtagccggatcgatgccaaaagccattttaaacatggtttccgcgtctggggcgaatccgtgagagaatgcaaaccccagctttttatcaaactgcatcagggatactttgttacccattgatatcttattccccataatgttcttcgtaatcctcgcattctgggagataggtttcgcagaacatacacagcgtgaagaatgtaggctggcgaattccgatattatcgggtaagtacatccagaacgtgttagcaaacacgatgaacgttttcaggttttcaacggttacggtactgataccgtcataaccggattgagtaattgcgcgttccaggggaacagggtattgctcgcagtagttggcgtaatgttcgcttgtcaccagcgcattagccgcttttacgagatcggtaattttcattcaatatatccccaacgaatttttacgttatcttctgacgccggacttgtaggagttgggtatggataactttgcgcttcccacagataaacaatggcgtgttttgtcaattcttcgataacttcatcgaaagtaccgacactggtttgtaaaggcaacgagaaaggtttatcgttggtttctacttgagcgattggcccatctaccaagataacacgaaccgttgtgtgctcagacatatgagcatagattttgtttttcatgcgggtacatattccactttgacaggttttgcgataaggcgttctttagtgaagccttgcccgttacagatatcacaagtaacattgaagtcttccatctgatcaacccagccagaatccggtaagccagaaggatacgtgttaacacgtttgacttcgaaccctttaccctcgcatttcgggcatttgtgtgggtactgggatttaaccatactcagcagttgccccagcgttgttgaacgatcgaagcgttcgaccagtgccattacatcagcaatacgaatcgaaccagcatcaataacggtatacaggtttttcggtacatttgagcgcatagtatatttctcacttaaaaaattttttgatgaaagagaggaacaagccaccaccgaacatgatccagtatcccgcgccgtcaccgttaaacaggacatacacagcgacaccatagcaaaagatttccgcgatattcagtaagtttctcataactccctcctttgtctacaacaggtattttaccagaaagtagattactgtcaacaacaaagttttatcaacccacttatcaccagtcattagtaatcccctacaggttgagaagatgcaacgctcaggatacggaaagagcattcattccatttgcaataagttttcgcacagtgaacagtgcctttcattacaaacccgtttgagaacaccagccagtaaagtttcatgattgcctcctttgtttcgacacccctaatataacaaaagcccctgcacgaatgcaagggcttttttcaaatatttttcaacatgtgtagttgaggcggacaatcttttgaagcaatcaggcgatccaggcgtgacataacgcgtctgtagccgtcatactcgaacttgattttgggtgcgatgtaatttacatgtatcgcgtttcgcgtgttcaggctcaacgtgtactcagggataacggttcggaatcgtaaagcaatcactggcttttcgtgagcaaccgaatcatccatgttttcgaacatctggacggtgaacgcacaggcaaacactttgccattaatccggcgatatgcaatgacttcctgcataccttcgtttttcgctttcaccgcgtaatacagaacgttacacgaataatgtttagcgagactattaagaatttcactgtagatctcaaagtcttttttgactgacgcggaacgatcaaggaatcggtctgcgatgtgatctgtagtcattgaaacctttgtcacataccaatcacttaacgctttactgaaattttggttaacttctctgcgtaagttattgataacatacatcaatcgtgctctgttcataaatcacccattatgtttaaagtattcgatttgacgcagacgtttttccgctgcctctttcgaatcatattcaccaagttctttcgtgcgatcatggttcagtataacccacttatcgccgcgatgttcgatgtgctccgtgatgtcttcgactttcttatccagatccagcggttcagcatcttcctggatgatagtcaaatctacgggcaatgtcaacagtcttttaactccgctgatatcttcgatgcgggaatcatacgcgagggttacatgtggtttgtaatcgtcataatcgtatgttgctccagcatccattgcatctttgaagcggctatggagataatcagactccagaacacccacgatcgtattaccgtatttcgtttcccacttctccacgtcaaccagtcgggcaggttcagagataccggatgcagggaacagatcaaccgtcttacggctatacacaatcgttgtatgcagctttgcagcggaaacaggattctctacacccagaagtttttgcaccttcgcgagcgcttcacaggaagcctgatcgaacttcgcacacatatagatccccggatcaactacgggtttcgctacttcaataaaacttttcatgtgtactccaaatgaaaaaggggctttcgcccccagtggttaaacgcctaagcgttaattatgcttttgatgcatcaatcgcttcatcgtcgccagcggtttctgctgttgctggcagaagtgctttgatcgcgccgaccagggcatcaggggatacaccctgcgaaccgtcgatttccagaagactgcaaatttggcctacgagttgacggtgatttgccagttcttgttctttaccctgaatgatttcgttcaggtcgaatacacgggctttcaggatcaggacatcgttttgaagctgttgggtttggttttgttcagtcattgtttacactcttaaaagattgaatacattaagcacgttacgtttcaaatcgtctaacgtaccattatttaggattgtataatcactcaagccaggtgtcaacccttgctccgttgaatgattatcttcaataccagtttcacgttcaaggaacacaaagcgagtcccgaacttgctcaggtatttatattcatgcggttgacgcacatcggtaatgataaagtgatccgcgtaggatttcaacattttttgaagcgcaattgaagtccagatagacggatctattttacaaacaatatcagtcccgaacacctgcatcaaacggcgaatcgtccagggctggctgttttcttcgcaaattttatgagcgataacatctgcgttactcatgaagaacccgcgagaacttaattttttgataccgctagaaaacagcgcgtatgcatcgttattggacatcaccagcggggcttcacgatcaccctcatagaatgggttcttcgctgccagcgctcgcaattgcgtgttatcgtgatgttccatagaacgtttcaggatagctttgatttcgtcggctaacgcgataacttcaacattgcggaagttatgcacaaccatttgagcaacggtatctttacccgttcgctttttaccacaaataccataaatcatttttgcgttttccgtggagtaggcacgatcacccgtccgtcgatctcaatttccatgtgagcgaagttgaacatcgtcatacaggatacggcttcatccgaatcattggtatacataagctcaagctctccgaggttggagggccaagcgccatagaagcgaaatgtcgctacagtttttgactgcgagttatccaggatatgcaaagccattgcctgttgtggttcactccaacgcacggaatcgaaggtgttaaaatcgacagtaccgagcatccaaaggtaaaccccaagatacgatcgcagttcttcatcaacagcaaaacgaatagtcagtggatcgaactccattgcagatcctgggatcttccctcgaatcattgggttcagtgggacatccgtaattggaatgttgatagcaggtagtgtaacaccctgaacctgtagtttcaacccttttacataatcattgtcaggaatatctaacatgaagttagtaggtgaaatctggttcaggatcatagcagttgtattcatgatgatctccattttatagatatttagatcaagaccgtgagcgaagcgaacacacgaacgaagtgagtgttatgtacgatgtactgtttataatatttatattttatatatagagaaaacagtacatttccgtatactttttatacaatcgttaactatccgtcttcgcttcgcttgacggaactcgcttcgctcgcgatctaatttttagttgatctattcaataaataggtatactatacctatactttcaaaagagattgaaaacatgaaatcattcaaagaactactttctgaatctgttcagaacaaaaaatttgctaagaccgttgatctggttgaccgtggtaacgctgcaaaaggtcagattggtttcctgcattttgcacatggtgctgattacgatgtgtatgcgccggactcccacgatctcgcttacttcggtaaaggtgttgtccgcctgaaaggtaaaaccactggcaagactcaggcagcgtatattgactgggcgaaaggtactgtttcattctacagcggtgatcctgctgatgacctgaaattcgacaagccactgaaattcaaaggcgcttccctgtacaaagaagccgaagaaaacctggatctgtacaatcagttggcggaagatttcgagattgatctgcctctggatgaagcattggtgaaaggaaaggtgtacaagctcccaagtaacgatatgtgcttgctgtataccggacgtaccaaaaccaaagaaacaggtgaatacgccgtgtttacggttgtagatgcctctggtaagcctcgtctggtatcgggtaaacgctttacccaggaatacaaaggtgatgttctgtctaaactggttctagctgaatcagaagatttgaacgaagccgctaaagatattcgcgaaaaagttattgcggtgttggtgaaacgtgggtttaacgaaaaagacgcagaaaagatggttgataaaaacctgaaagatgcgatgaaggttcgacctggcgcaacccctggcaaactcgcggaaatcgtgagtaccctgtaaaaataaagccccttcctttcggttggggctttttgttaatatctgttccaaactttcttcgcgctgtatggttttcctttggactggaaagcctgtgtaggcaaccaaactgctttcgcccaatcttttggggcgatctctgcaagtggtgaacgtagatgggctggcaggtaggctttgatcatttgatcagccccgcgcattcccttcacgttgttccaattgattttcagtctggttttgttagaaagtcgatctgttgatccgtagccacgtttcaggagttcttctaaaaactcttgacgtgctcgcggtggcgcatagtgcaagttcagcccgtacagaaccaagttacccgctttcgaacgtcctgaacccaggaaaatgatcagcgggaaccgatcccagtatggaagggtgtctttgtatttcgcatcgtagatgaacgtatacaagcgacccgttgctggtttcgcaaccctgtgcgtcttaatgctggttttgatgaaatcaccaaaccaatcggtcgaatctttctgacgtttcgcagcggttacaccaacagtcattttcttcaaactgttgcggaaatcgtttacgatatcaaccgcgtgttttttgcgatagtcattacgtttgcgtcgggcttcggtttctgctgtacggcgttcgatttcatcatcaatctgctgcttatagcggtgcatagactttgtgaacgttgcgtatgcaatcccgttttcgtccgcgaactttttggctgtcatgccttttaattttgcgcgtcggaatttgataccaagttcaacccattcacccagctttcgcttcggtggtggttttggcttgtcttcttctgcgatgatctcgaactcaaaaataaaactcataattccctccgtttagggtatttattgccctttccatccgaacacacgtttcaatgtgtcctctgtgatgatcttgaactcccagcccttttgttttgctgctgcattcgcggctttccatttgtcaatgtttaccgcataagtatacagcgcatcaacaaatttctttttgttgtgaacgttgttgttcgctggcttaggtgggggcaacgtttctttcatcggtttgacttcccaaaggtaggtcacaccgttatccatttcgacatagaaatccatgaagtagcgccgtcgctttccgtctgcgttgctgaaataagggatcacaacctcttcactgttccagcgtttcacatgcgggtttctatcaagccagttcataatatatttttcccagcttgaacgatacgttatctttcgcggatctcccttatatttctgtatgttctggggcataaaagaccccttgtatgtctgtcttccagccattttagatcctaaatatagtaaacattagataggggaaattacaatgttattttcgttctttccaccagttgattacaaaggcacaccaactactgatatctaccgcgattatcgtttttactttaaccgcgtgatcaggaattataagccgcgtacatatcaactgacaggttcattaagacccgaacaattagcggaaacgctatacggaaaccagcaatactactgggttatcctgatgcttaacgataattacgatccgttttacggatggattaccgatcaggaaacggcttatcaatgcgctatccagcgttattcaaaagcaggtggtgaacaggttctttatcatatggatggtaagggcaaccgttattacaatttggttgaagaccctacgaatcccggtcattggtatgacaaaggcgataagaacatgcgttatttgcagtaccagggaacattagtccctgtagatatttatgaagatgcggtgcttcaaaatgaagcaaaacgaaccatcaagattattaacccctctgatattcaatcgttcgtaagcgattatatcaaggaaatggaaaaggcgaatctatgaaattcggtggaaatatgcattcccctttctttgagggggtggtcgaaaacgttgatgatcctcgtctactggggcgtgttcaggtgcgtgtatttggtgagcatccggcacagaaacaaaaatctgaaactatcggtattccggttgaggaattgccgtggatgatgcctattcaggatattcgcagcgccgctatttccggtgttggtttttctccgactggtatcacgcgcggtagtttcgttatcggttactggcgcgataaatggcaccaggacggcgttatactgggaacctttgctggtgagtaccgagagaaaccggacacccagaaaggcttctgtgacccgtttggtgagtatcctcgttatgtaggtaacgatgtcaacgtactggctcgcggtggcgcagaaggacgcggttcttcaagcgtgattattcgtgatgctaacagttcgttagctgtcaatccagacgatcgcccattggacgagatccccgaagataaccgacctgatactggtgggtttacgatagaaaaaatgatccgtggtgatgaaggtattagattgacgtggtattatgatgttaaaggttataccatcgggatcggacactttttcttaaccgcaccacaaggaacagacccagcagttgttaacgctgcgttatctaaacaaattggcagaacggttactggtgttcctggatcaatcactgctgatgaagcgagtgttttatttcagcaggatttagctaaagttcataacgatattcagaataatagcaaagttcgcgaagtgtatgtgacgttaaaccgtcctcgtcaaatggctattgaaaatatgtgcttccagatgggtgttggtggtgtcgccaaatttacgaatgctctggctgctatgaagcgtcaggactggcaaaccgcttacaacgaactgcgaaactctacatgggctaaccagacgccaggacgttcttcacgcgtatctaaaatcgtgctgacgggcaaccttgaatcatacggtgttcaggttccagatccagaagggcgttcattgagtgctgcttataatgcggtggttctgcaagcaagcaacccagaagatccttttgttcctggtgatacccgcgtaatgttcgaggaacctaaatcggcatacgctgctgcatatccatacaacatggtattcgaatcccgttctggacacattcaggaattcgacgacaccccaggctttgagcgttacaaccgcgttcacccagcaggatcatacgaagaaattcgtcctgatggaacccgtgttgttaaaatcgttggtgatgattatcaaatcgtcatgcaaggccgtaaattaaacgtcaagggtaatttgcaggttgttatcgagggtgatgcgttcatttacaatatgggtaacgttcaacagaccgttgatggtaacgtgaccgagttcgtgcgcggtaacgtgaatcaaaccgttgaaggtgaatatgtggggctgattaaaggcaacgcagaattaaccgttgaaaaagatgcaaccgtaaacgtgaatcagaatttaatggctaacgttaaacagaatgcaaccgttgccgtaacagaagatgcaacaattacagcaaaaaatgctctgattgatattgagcaagatttggatattggcgcacgtaatatcaacatgcgagcatcgaataatactttcattgattccggcgcactgactaagatcactggcggtactgtacaggtaggctaaaaatgatcatggattatgaaaccatcattgatgggattatgcaaaactttcagcatccttgcgatgctgagatccccgctggatattacagacgcgttatctggcagggacacacagaaaattaccccgctgttggggtagaatgggctaccgaaatcatcccgatcggaactcacctgtatacgagttcccctttcgggcagaaaagcgatccgcttccggtggtgaactctccaaacgtacccacaaacccagatggaagccctggagtttctactgatattctggttacgaaaattggttattatttcgccactcaagcggatattgatgcctatatcgcatctatcggggctactaagctcgcgggtaatgactggtacggggcggatctgtcaaaagcgaatctgttcaagaaccctggcgaactcgcgatgtacaaggtggaaaactccggtggttacttgctgacttccggcccccgttgcgatcagcgaatccgacaggtatacaatcagactacaggcgcgtttaccagcattgattactactggaatggtaatcgtattgcgtacatgaaacacgacgaatccccagcgcaccagtgcaagtatacagggatgtcagtaaacacgaacgcagatacaagcattcctccggttcctccggcgttaccgtcaacgtatggggcgctaccgagtgaagccagattgttttctgctcgttctggattgggctgtattccggcgaccgtagggttcccgtatacgaatatcagcgatgctatgctttccgcgtggaacgagactcgtaaaacgttcaagctggcttttgatatgctgactggtacgattaagaacggtacgggcattgcgacgatgtttgatgggctttcgatcgggatggaagaaatcacagcgggtgctctggcattgtcacagcaagcatggcaaaccgcaatgaaagtattccgacagatcattagctctgcgtttaacatcgtgggcggggcgtgggatttgatcaagaatttcctcccgactgttgcgatcatgggtgttgcgatcaacatttacgatctggtgtttggtgatagttcggttcaatccctgaaagattctttccaggctctgattgattccggcgcacaaacgtatgaaagcgtcataaacgcaatctacggggctataggcagttcttacaactacgccgttgaatatgtcaaggctggcgctcgcgaccttgtagacgcatgtagcgcgttatttgactggtgtttgacgatgttccaaaacggttgcgttgctttggtagatttgtacgggcgcatgatgcagatctggtcaatgcctccagaaacaccaaacccgctttggtctgcggtgctggctatccgtaacatcatgaaacagattaaacctcttgatgtgattctgggcggtaacttcccagggtttacagcaatggatctgtatcaacaggcgcaatcgaaagtgaaagcgttcattgatgcatcctatgcgcagatctccgcattgtatgatcaggggcaagaactattcaacaccctgaaaacacagacacaggaaagggattcgattaaacgcaagttcgatcagtacctaaactggatgtgggaacctgtaacggaagcaacaaccgctgcttatcaggctgcacttgatgccgctaacgctgctgtgaatgcgactaaggccgcatatgagggaatcaaagcacagattgctactttgcaagatggtatgaaagacacctacagcatggcaatggctgaactcaagaaactgcctgtaatggctcagattaaccagttcttaggttactgtggggttgcattcgatgacctgttaaaaacgtatgagaacgcgctgacgggcgcacaatcgctatataaaaactttgttgacagttcccgctcgtttaaggacacatgcaaggtgatttataaccagatttgtacgcttgctctaagtaaggtaactcaatacgtaaacaaattactgtcattaatcggactcgcgatcacattcggttcaattagtgtttgcgtccctatggttcaatactaaatacccgataacgaggggtaataatggctactacaaagaaacaaattaatcagatccccgatatctttgtcggggctacttttgacgaaatcaaatctgacttaatcaactggctccgaggtcaggacgaattcaaggattatgatttctccggctcgcgcatgaacgtacttgtggatctgttatcatactgtacactgtacattcagcaaatgagtaacaccgcactgttcgaatcgtttattcgtaccgctgcattgcgtagttctgttgttcaacaggctcaggatttgggctatatgccggactcccgcaccgctgcaaatacttcgatcctgatcactgcgaaaaacccactgaacccaacatcgatccgtattccacgcggtacgaaattcatcggtacagtgaaagaaacaaacagtttcccgttcgtcgtatccgatgacgtggtgatcgttcgtgacaaaaacaataactatgtttcgatgttgaacatcgttcaggggcgtttagtccgtaccgaagtcatctttgatggttcgactatcctgatccgtgatccaaacatcgaccgtagccaggttcgtgttaccgtcaacggcgcacaatgggatgactggacaaacgaaagtatcgtaaacgcaacgggtgcatcaactgttttctatatgcgtgaaactgttgatggacataccgaagtttactttggtgaaggtgaaaccagccaacaggtcgcgggtggtgctctgactgctgattacatcgggggcttgaaacctgcaaacggttcaaccgttgttattgaatatatttcaaccaacggcgaagaagcaaacggtgctgaaaactttgtttacgtggatacgttgacaaacattagcattacgagtattgttgagaacccgactaattcagcggactatgtaggcgctgatggtggtggtgaaccggaagatatcgaacgtattcgcgaactcgcgcctatcatgcgtgagacacagcgccgttgtgttactgcatcggattatgaatcgttcttgtctcaccgtttcggttctgttattcaggcggttcagtgctttactgataaagaaaaacctggctatgcgttcatcgcggttaaaccgaaatcagggttgcgtttgacctctgttcaaaaagaggatatgcaaaactatctggcgaagtataaccttgcgacgattacgccgtcgatccttgacccgaactatctgtacatcgtacaaagtatcaaagtaacgtatgatatcagtaagttggttgaatcagaggaatggttgcgtggtcaagtaatcaatgaggttgacagatattatactgataacgttgaaattttcaacaaatcattcagtaagtccaaaatgttaacctatgttgataacgcggacgtgtcgatcattggttcttctgcgactattcagctattgcgtgaacttgataactattacagcgctccgatgtctggtattcacttcttaaaccaggtgaaatcacgttctgttgtttcgaacgggttcaaatacacaaacgctgctggtgattcgtatgatgtgcgttatgcatcaaccgatatgaacaccacaaccggacgtgcaaaaattgttatcgggccattcaaaaacggtgatatcagtatcgcagcctatacaggaaccgattttgataaatatcctggagtgaccgatcgtaataaatattacgaagtcggctatgtggaacactacactgatttcattagtttcgatctgggtgtcctgaacgttccatccgagcgattcagcgctgcttatatcgaactgactggtacaccattggaagagaacattttcacccgtgatggttctctgattgtgtttgaaaacgatctccgtcctcaatatacaacattgacaatgaatccaatcagtcaataattttaacccctgtcatccggcaggggttttttgtttgctaaatatgggatataagtaacgcaaatttggagaaacataatgattaaagcgccgtcaattaccagtttgcgcgttgataaactggctgctaacttcgtttatttgaagtgggatagcgtcggcatggatttttactatgtcgtggaaatggcagaaactcgcggggcaggtggtgttactattccagatgaagatttaacctggttccagttgggttacgcttttttgaatgaatggttttcttccgatgtccagccaaacaatttttataaattccgcgtcatggttacgcacaagggctttgaaccgtctgattgggtttatacagatgaattatggacgttcagccttaacgcctacgcatattcaacaatgcgtgaatttacgccaagtgatgcattcataaacgaaaaattcgcaaaggacaatcagaactacgttaacttcaatacagatgtggtaatggcagcgttgatgaaagaagactttgtgttttctccactttacactgacgtatcccagatcagcgataaaattcttacacaagaaaactatcacgaaatccaggatcatattgaacacgtttgtaatgacattaacagaactttcctggtagcgtcaaacggtttattgtacctgtttgaacgttttcagaacatggcgaaggtgtcaaacgacaaaggacaaacatggcattactacaaggcgtttaacgaccgcgtaggaaaccctgtatcgcgctctgttgcgtaccaaagccgaaacacaacttatgtactgggttacgatcgtatcttctacggacgcacctcaacggatattcgctggtctgctgacgatgtgcgattctctgctgatgatgttacgtttgccaaactggggaaccaaactggtcttgatttcgacgtagactcatacaacacgtttgctaaactgcctggcaacgtgtcgaaatatgcagaagcaatggcatgttccgatgactggctttatgtggttgcgaaaaacgttgtgcgtcgtatcgcactgaaacagacaccaatcgacaccgatccgagttctccaacgttcggagaaaagattttcgatacagcaagctatacagttgtccctggaaatgataagatcgttgtcaagaaaatggatgtgatgaacgggattctttatgcactcgttacgggtgaagtgaaaaccgctctgcaagatcctacaaaacccgctaacgtggttccgtccgctgctgctggtgtgtatcaatggcaagaagacacgaaaacctttgtgcgtctgtatgggaacactgaggaagaacgtttctatatccagcatgaatacaccaatatgtcaacgaacggcacggagatttttatttccgtagcaaactacaaatatccaggcacacttcccgatcctgaattgttgatcgagaaccctgctctggttggtgctgtaaaatatgatctgcgtcctggctatactgccagccttgcaattaactttgcgacgattcgcgctcatatcgacgacccgactgtttggaaatttggtgcgcaggaatattacaacgaggcgaattatagctggttcttccgcgactctgtgcgcacatggatcaccaatgataaccgtcctctggtggtgtatcctaaaatcacctacagccttgtaaccgatagtgctggcccttcgtcatcgcttcgtgtgaacaaagaggtatgggatcgcggacatgttacgatttacattaacaacattaagtttacaggattcacgaagtatacgaacggcgtgttgctgtataagagttcaggcgaaatcatcgggttctttgaactgagttaccgcgctcgcgacaacttaacgattttctggaaaccagacaatacgttattgattgccgatctcattcagcaggaacgcgaaaaaccgtatcaaccggatctgtcgcctggtttgattgacccagatttaagccatatgattacgcgctttgcgcctcaaagctatctggatcagcagtatttcgagaagttcggggaatactatttgcagttcgtttcgctgggtgaaaacacctactataacaagctgctgaacctgatcaggaacaaatatccgcgtgagaagaacagcgtagaatatctgtggtcggaagtaaaccgccgtaatatctacctggataaaacgaagcgtgatcaggtggttcgtttctttgaatctcgttgtagtgatttctattcaacgaaaggcatcgaagcaagctataaattcctgttcaaactgttgtataacgaagatgtaagtgtagaaatcgaaagttcgaatactctggaatatgatattttggttcattcaacaaatatcaaccaggacattgtaggccggacgatttacacaccaacagcgagagcaaacgtgacgtatatcgaacgccagtatgatgacggtcaattacgttggtcagtaacgctgcacaacgtgatcggtaacttccttgaagggcaggttgtcaagtctgaaaagactaacttcacgggtactattctgcgtggtgtgcgtggtaaacaaatggcgaacaattcgatcgactacttcaaccgtgggcgttcttactacgtgatgaaaattcgttcgaatctgccagcgtcccgttataaggatgacgttttacgattcgtgcatccggtaggctttggctttatcgggatcaccatgctaacggtgttcatcaactccggtttgtctatgacgcatagtgaaacgatcattgacattcttcgaaattatcgcttcgatagcggttatccgaagtattggcctgatcgcgtagcccgtctggacggtaacggaaaccagacatttgaccttgtaactggtgaagcattgtacgacccgcacccgaaagcgggacaaccgtttgatgttccgccacaatatgacattgatgaaaaaccgctgaatggtgtactgccgtccgcgcgtcgatttgatcaaagtcctctgttcgatagttcagcggttaaatactctcagttccgtaacttagtggaaaaacgattgaaagacgatgcgggtaatcctcgcgatccgaatcaaccgactcagagaaaggtagcataatggctcaacaaaacatctaccgtgcggtcgtaactggtaagttccgcacggaaaacatgatgaactttcgcgaaatgatcggggacagccccgatcgtaactcgatttatatgtcaatcgggcgtaccgaacaatgggcggataacgaatccgaccctgaattcgctcccccttatccgaacgatgatacagatggtatcgttgatatgtggacgcatatgatcgggatgacgaaagtaccaggcgaaatgattgatgcaatcgttccgcgtaaagactggggcgatactcgatatccaaaccccaaaatcttttacattaatgacatcgtggttgtaaactccgcgccgtataaccgtactgactacggtaaaggatggatggtataccgcgttgtagacgttcctgatattggctcttgttcaatctccagtatcacgggtaaagttgaatgtgtgcgtattggtggcatttggacaccgacccacgaatcgatcgaacctccacgcggagaagcgaacggtatcgacatgggcgacggctatatctgggaatatctgtatacaattccaccagatgttgttatcaaccgctgtacaaatgaacatatcgttgttccgttccctgatgaacttgaagaagatccggttcgttggggttatgataacgtgatcaaatggtatcctgatatgtacgatttggtgtaccgaatgaaggttcactcaatgcgattccgcgcgtatatggattccctgttctttccgcaagcctctttacctggcaaccgtgggttccgtcaaatcagcgttattgtaaatccgctgttgaaaaaggcgcaaccatccgacccagaagtaaaagcaacggggcagtattacacgaaaggacagcttgaacttgactcaggacaaatgatctacatggaaaaccgtcaaccgattattcgttctcctgatcagaccgaagaagtcagtattattttcgaattctaaggaaaccataatggcatatcaaactggtaaaaaattaattgacgtggggcaaatcggcaacccgtcaactggtgacccgctgtatgacggcggtgttaaacttaacgaaatcatcaccaacgtatacaacgcgtttggtgatgtgcgtttactgactgcgaatgatggtgtgggtacaatgttactccacgcgaccggatatttccagaaattaccgcgaacctattattcaggaaacccgattgaactgggttcattgcatgatatggatacttcaacagggccaattactgttgttcttccatcgggtaaacccggcgaagggttctatttcataaatagtaacggtagtatttctgttgatcgtcctgttgtattccgtccgcaagttggtgatggtatcaaaggggttcaggatcaactttacgtgacctctccatatactcagattaaaatctggtgtgtgaagaaagaaggttccgttactacatgggattattctgttgaatcaatgtttggttcaaaaacaatgcctgtagatactactaaactcattctgaaagcatcaccgaccgcaattcctttatttggttatagtgaattcagtggggcgaaaattctcgtgtacgcggaaaatatgacaggcacagtcaataaaatggctgaaattcttttgtctgttgaccgtgtcgctaagggcgtgtattcaactgaatacgcagttctcaaaaatagcgaagatgaaatgtacacgcttacgttcactgttggtgcgagtgatattgtttacgcaaacgtacaatccaaaaccgaggatcgcattaaattctcgattaaagcggttgacaccattaaatcagggatcgcagcatgaaacaagaaattcttatcggtaacgtggttgatgacggcgcaggtgattatctgcgtcgtggcggtcaaaagactaacgccaactttaccgagttatataataaactgggtgacgggagtatcccgcacccagcgggtgcgtggaaaacgcacacagcgcctacgctgacccctattttcggtgaatcatgggcgctgaataccagcaacaaccgtattacggtaaacctccctaaaggcagtgtaagcgattataacaaggttattcgcttacgtgacgtatggggtaagtgggcggtaaacaacgtccgtatcgtccctgcaagcggtgataccatcaaaggctcaccgacttacaaagaactgtacaaagacctgatggacgttgaacttgtttattgttctcctggacgttgggaatatgttgaaaacaaacaggttgacaaaatcacaacttcggatctggcaaccgttgcgaaagaaacgtatatcgcgactcagggacaaactgacttcctgaacgtgttcggccctggtaactcgtacaacgtccgcgcactggaagtttactatcgcggtaacttgctgtacatcgacgacaagaacgggtttaattcatcaaacagcgattacggttcacctggtgcgagcgccggacaactggtagatctggatggtgtaaatatccgtcttaaaaacccgtgtaacgctggtgacacgcttcaattcgttacctatctggatggtattgccgcatggcgagcgacgtatgaagcgcataccatgcgcgtatataacacgggagacacagaacaggttagtatccctggtgaaatctgggttggtgatctaccaaacaaacgcacgttcactaatgctgaatttggtatcagtccgcgaattttgattaacccgaactcgttcgaactgctgcttaacggtcgccagcttgttaaagcaggtgatgcggatctcccgacatttgtttgtgagggcgcagaaggttatgatgaagatagctgtattgcgaactccggcgcgtgggttccttctggacaggattacagtctgatttttgttgactccgtggttacgggcattaaatttgctcaacctctggaatcccgtgatgtggtaactattcgctggttcaacaatgatatcggtactgtaatggaatgggacggtgtaggcggtattaaagaacacaccgataagatttacctgaacaacgaagaagaagtgacgctggttaatcggatcgaatatactgattataacaacccaacgcagaaaaccgctcgtaaagtagcggatacatttagcggtcgtctgttggatctgcaagcattctttgatgttattcatccaatcgggacagtctacgaaaacgcgcacaacgattcaaacccaggcgattatatgggctttggtatctggtcacgttacgcggaaggtatgttccttgcaggttggacaaccgatgcatcggatagcgattttggtctgaacaataacgatctggatggttccggtcaaccaactcacacttctggtggtactggtggcgaacgtggttatgaaattaaaccgatcaacgttccacaaattcagtcaaccgataaggtgttgattaaagatgacaacggtatcattattattggtggctgtcaggttgacccagatgcaacagggccaggttacactaaataccgcgaggatgtattaaaagtaaatcgggggaacactactccagataaactaaaaacgctcccgccttatattactgttcaccgctggataagggtagcataaatgactcagtttatttccaaaacaagggagggggcgaaagtcccttcccgcgaagcagactttttgcaatatgaaatgggtacgaaagaaccgctgattggtggtaaacgtactattggtggtgcaaacgtcgatcagcttcgaaaaggggtagattaccctaacgtacaatcagcaattgatgacctgtattctttgtctcagcagatcccgatcaatggggtaatcatgatgacggaagatagccccccttctgcggtgcaacaggtagaatcaattacgtttgatgggacggtttcaaacccagatccagatcaaacacaggcgactattcacgtttatggtttcccgttcgttttcgacaatacaacgaacgcctctaccgtatgtgagacagtctataacaaattcgttgaattcgtcaacgatgaaaaatatttcgatttggttactcgtaaaggtctcaacggggaaattctggaagttcgttttattgattcagttccgcatccggttactaataaaactgaatatggaatttcgatggtaggaacaatcgacgtacaggctaaatctggttacggtacatggacaaagttaggtgaaattgaccttgctgttactccagcagttccgatttattatttcaagcgtattgcatgaggataacaaatgaacaatacaattaaccacgtaagcgataaatccgtttacgtgacatttgatcctgctggtacgcaatggcctagcacgtttaagaacgtacaacaggcattagccgctattgggccgtgggcgcgtactgatgttggtttgcctaatgccgcgcctggtgtgcgcggtattgctgctattgcgacacaggcaatgattgatgcgggtactgatacccagacgatcgtaactcctgctttgctggaataccgtctgcaaaaccctcatgcatcacaaaccgtatggggttacactcgttacgcaactgatgcagaatcagtaacagtaacaaacgatctggtttctcttactccgcgctcgttgaactatgtgtttaacacccgccatgcaaaagaaaacgtttggggttctgtgaaactgtcaacaactgctcaggcaacatccggtactgatgacactaccgcaatgactccgcttaaagtgaagcaagcgatctctgctctggttccggtacaggcaaacgcaacagaaagttcgtttggtcttgttcagttagcaactgttgcagaagttcgcgcgggtactattcgcgatgggtttgcgatttcaccatacacgtttattcgtctgactgcaagcgaaagtgatttaggtttactccgtatcgctacccaggcagaagtaaacgcgggtactgataacaccaaagcgatcaccccgcaaaaactcgctgctgtgaagggttccggctctactttcggcatggttaaattaacaacagatatcaataccggattagcgaatactgctttgtctgctggtgctaacgtagtaccgagcaacaaaaacagtgcaattactggtggtgcgttgtatcagggttcgattagtgctgacaataaataccagacaaagacagatgttgacgcaaatatcccgatcggatgtatgatgcttgcagcgtttaacgccgatgttggtaacttgtttatctgtaacgggcgagcgatgaaccgcaattcaaacccagaactgtttgcccgaattggttatacatacggcggttctggtgatattttcaacttgcctgatatgcgcggtcttgtagctcgcggctttgatggtggtcgtggtgtggatgcaggtcgcggttttggtacatatcaggctgatatgtttgcgtatcacgaacatgatctccagatgatttaccagaacggcggtaatcttcctaagagtcaagcagtttatgaactgaaaggcgcggaaaaaaatgaccaacgtgttatgcacctgaataacgattacagcaaagcattaggtactggcggaaatgaaacgcgaatgaaaaaccttgcggtcaactacgtaattcgagtacgataaaggggttaatccatgatttcaaaacttaacccgttaccaaagatcccgtttgttgatggtgtccctgcggacaccacacaaacccagatcaattggattgttaacggcgaaactctcgatggtgcaaaaaccaaaaccactaacgagggttctttaaacagatgcggtgttctggttcaaaagaacgcggtacaattagaagcaaatacaactacccagacatcaaaaatcaacgaagttatcgatcaggttaacctcattactgaaaacctcgcggcgatctctgatgatagtgtgatcgacaaactggataaagttgtcgctgatgttgacgtgctgaaagtagatatgtctgctgtacaggcaactacagcaagcaacaccctgaaaattcaggatatcgaaaaggaaattggtgtatgggatgcgtcaaccgatcctaaacatcgtaccattcgaaaagatattattttcctgaaagatgaactgggtgcatatcctggctttaacgaagatggtgatgttgatccgtcctctactggctccggcgtgaaatacaaggtaatggctaacgctcaggcggtatctatccatgaagcacgtattactaagctggaagatgactgggtaaactcagatgtaggtcatttaaccgatgaagttaccgatctgcgtaacgaaatggggccgaagcatttagccactttcgaatctgtgtatgttcgtctgaatggtatcggtggcgatatcactggtattaataccgaactgtcaaacatcaacacttatatcgggcgtacaggctcaggtggttctggtagtattgattcccgtatggaaactgcggaaacgaacattactactctgcaaacccagatgaatgatccggttgttggtgttctgcctcgcgtaatccttctggaaagcgctgttggtaactcacaggttccaggtagtatccgttacgatatcagcacaatgaaacgtagcattagcgatctgaatatgatcgttggtgaaacaagtgatgatggtctgcgcggtgaaatggcacaggttatgaccgatatcggtactgactcccagccaacaagcatcaaaggccgtctgctgaatgtggaaaacacacagcgcgacgatcaccaggcactggttgatgttaccgcaattgtgggtaatacgtcaactggactcgttgcggctaatatcgcgatgggtaaagctgtttatggtgacgcaaccagttctgatccattcctcaaagatggtattcagaaaacggctcgcgataacaaaactgcgatcggcgttaatactacaggatcagaaacagggatttataaactgatttccgatctgactgcgcgtgttgctgctctcgaagctggcggtggtggtaacgttgaacaacgtctggacgatctggaacagaataaagcctctcaccaggatgttactgatgctctggttccgtatatcacagaagttgaagcggataacaaatacgaagcgaagaaagttccactgtcatttactcaaaatctggtcggtcgtaacgattatatcgagggtgatgatatttctttatctgttaccgttacaggtggtaaactgccttatgtgtaccagtggaagaaaggaaccgcaaatatcggtactgattcaccgagtgtaatgatccagaacatcacaacgagtgattccggcgtatataaagttgtcgtaaccgacgctgaaaataccgtgattacttctgatgaacttgacatttcggtacatacggttcctcagttcgatacaaacttgagcgatatttctgttgttgatggtgacccattgactctggaagtagtgtttagcggtggtaaaactccgtacacttacgtatggcataaagacggttctgtattgactggtgaaactggttcttctatcgttaaatctgctgcaaccagcgcagatgcgggtgattactatgtaaccgtaactgacgcgatgaacagtaccaacgattcagcaaccgcgactgtgactgtaactactcgtccggctctggcgtttacaacggatcttccggcaacgaagagttacacaacaggcgataatatggatttagccgttgttgttactggtggcaaaacaccatatacatacaaatggtttaaagatacggttgaagttactggggaaactggcgcaagcctggctacagtagcagaagcgggagtatataaagttgaagtgactgatgcactatcaaccaagattacctctgctgaatgtactgtgacggtagcataattttaacaaggggcgcaagccccttttgaggatcatatgattacgaacaatccagaacagttaaaggatgaaattcttcgtcgtctgggcgcaccaatcatcaaaatcgaaatcacacaagatcagatttatgactgcattcaacgcgctttagacctgtatgcagaatatcattataacggcacaaacaaaacgtatctgattttgacactgggtgatgataacccgcgcaacgtgttcgacttgagcaaagaacacatcttcgcgatcacgaaggtgttgcgtacaaacatgggttcattgaccacaatggacggtacagcggtttatccgtggtttaccgatttcctgatggggttgactggtggctctctgggtgggcgctgtgcatcgagtgtgtacggtatgaacgcatacggcgcggatatgggctactttacccagatgatgtcctatcaacgctcaatgcaagacctgctggctccactgcctgattactggttcaacgatgatactggtcagttctgcgcatgggggcaggtgaacaaaggtgacattatcgttattgaagcgatggttcgttccttcgttgatgtccctagctccgtaggaagcgtcgcaggatacgctacagcgggttctaacgctgtagaagaccaatccatagccgacatctacgaaaacccgtataacagcgttgtaggcggtgtacgagcgggacagggttcaactgttacgagcggaacgtctgcatataacaaccgctgggtaaaagactactctaccgcactggtgaaagagatcaacggacaaattctggctaaattccaggggatgcaattgcctggcggtgttgctcctgatggtacgcgactgatccaggaagcggaaaccaaactgcaaagtctgcgcgatgaactgatttcgatgtctgacgcagtaccgatcattatggtgtagggggaataatgcaaaactgggatgaaagtttattcgctcagttgtctacgggggaaggggttgatcgcaacttaaaggatcaggtcactaacccgtatgtaaactggtacaaatacaacccgacacaacagctacacgattcactgacagcagaatcaatccagatgaaatcgcctgatatgtattacgtccggcgtgacttcgtgaatattgataagatcctgggcgaagaccgagaatccaaatttacgaagtcatggaaaattgctgcatatattgaatcgtatgccaactatgaaggacaacgagatttctttagtaaatttggtctgagttcaaacgatgaaatgacgctggtaattaaccctcgtttgttcgcacatcaaactgatggtggtattcctgttctgggggatctggtttattttcctatggacaatagcctgtttgaaattacgtgggtagaagccgatccgttctatcagttcggtgatcgtcctcagcgtaaaatcaacctggcgaaattcatctacactggtgaagaactggctcctgaattgcagcgaaatgaaggaatccatatcgaacctgatgcagaactggatctcgaacctatccgaaatcttgacgggctggctgatatcaacatcgaacagtacgaagaagacaaagaatttgaaagagaaggtgatgaattcatcgaatcttttgatgttgtcaacggacgcggttcaccgtttgcaagtctgccataaatacgttatatgggtataggcggaagtctatacccaacaacccatacaggaaaataaaatgtttggttattggtataatagttcgctgcgtaattatatcgtcctgatgggggcgctttttaatcacgttcaggttaaaagagtacgcggcgatcaagaaaaatacatcaaggttccgatcacctatgcatcgaaagagaagtttctcgcttccatgaacaaacttaactacacgttgagtcaggaaaacgttgctaaaacggaaacgattttaccgcgcatgaacttatcactggtggatctgcaatataacgcaatccgtaaaaccagtatcgcggtcaaccaaaaaatgacacagttagcaaccccacgaaaaacgatcacacagtttaaccctgtgccatatcgtctgattttcgaactgggtgtttacacgcgatatgaagatgatatgttccaaatcgcagaacagattttgccatattttcaaccgcatttcaactgtaagattaccgaactgcataagaacgatatcacagttgaccgagacatcaaaatcagtctccaatcggttgcgccggataccacattcgagggcgatgcaaatcaacgccgtcatgttgagtggtcatttatgtttgaattacagggttatctgtacccgcctgtaactgatgttaaaggcgaaatcagaaccgtttacacggatttcttcgctaacatgaacccgttagataaagataactttgaatccgtggatagtcaagccgatccggtagatttgcctatgcaggactacacgggcgaagaatatattcagacgtactcgcacgataagccgatcccgtctggtgatgaacctcctaagccgagggaatgaaaatggatgaaaaattagatttgcagcaattgctgaatattgattccctccctggcggcgttgagtctggggaggatgtggttgtttacgagaaacttgaactggttgacgttcaatcacatccagcagaccggaaaccggatctggaagaggattatacgctcgcgcgtaagactgcgcaccatatgaatcagatgatcatggatatggcgcagatcgcattacacaacgcaaagaactccgaatcgcctcgccacgtcgaggtattcacaagcctgatgaatcagttaaacgtttcaaacattggcctgatgaagattcacaaagaaatgcgtgagattacggaagagactacaaaaccaggtgctgaaaaaggcggtggtggtagtgaaatgaatatcgagaatgcaaccgtatttgttggttcccctacggaactgatgcagaaatacggcagtgcatatgaacccaaagagggcttcattaatggtgaagctgtagaggtaaaccctgatggaaatggaaccgacgatcgatccgagtaaggaatcagatcaccctatcggattaatgcatcccaaatatctgaaaaagaaaattgatgaattggggatggagtggacacaaagcgaacacgataaaaaatggtatccgacaacgttcagtgactacctgaaaattaacggcattcaaaaggtcgatattcagtctaaggacagttcgaactttgccacgtacaaaaataaaggcaacaagaaaacccgatataacggcaacccaaacctgaaacgtgcgtatatccagactaaatggacgcaacaaatgttgatggagtgggtgaaatgtcgtgatgatatcgtttattttgctgaaacatattgtgcgatcacccacattgactatggtacaatcaaggttcagttgcgtgactatcagcgcgaaatgctgatcgaaatgcacaaaaaccgtatggttgcctgtaacctgtcgcgtcagttgggtaaaacaaccgttgttgcaatcttcctggctcatttcgtgtgtttcaacgaagataaatatgttggtgtgctggctcacaaagcctcgatgtctgcggaagttctggatcgtaccaaacaggcgatcgaactactgcccgacttcttgcagcctggtattgttgaatggaacaaaggttctattgaacttgacaacaaatgtaaaattggtgcgtttgcatcttctcccgatgcagtgcgtggtaactccttcgcgatgatctacatcgacgaatgcgcgtttatcccgaactttgttgatgcgtggttagcgattcaaccagtaatctcttctggtcgtaaatcgaaaatccttatcacaacgacacctaacgggcttaaccacttctatgatatctggaacgctgctatagaaggaaaatccggtttcgtgccttacacggcgatctggacatcggttaaagagcgattgtatacagacggcgacaacggtacatttgatgacggttattcgtggtctgcgaagatgatcgctggctccagcaaagaggcatttttgcaggaacactgcgcggaattcatgggaaccagtggaaccctgatcgctggatggaagttgtcaaaactcacatggattgatattgatgaaacggaaacgaacttctatcagtataaacgtccagtagaggggcataaatatgttgcggtacttgatccagcggaaggtcgcggacaggattaccatgcaatgcatatcatcgacattacgacgatgccatttgaacaggttgcggtgtatcactcaaacaaaacgtcgcatcttattttgccggatatcctgttacgttatctgaatatgtataacgaggcatggatttacattgagctaaatagcacagggcattcagttgccaaatctctgttttccgaactggaatatgagaatgttatttgtgacagctacaacgatctgggtatgaaacagactaagcgatcaaaagctatgggatgttcgacgctgaaagacctgatcgagaaagataaattgatcataaataacaaaaagacaatactcgaatttcgtactttctcagaaaaaggcgtttcgtgggctgcggaagaaggatatcacgatgacctcgttatgtcgcttgcttgtttcggttggcttacaactcaaatgaaatttgccgaattctgcgagaaagacgatttaagactagccaatgaagtttttgcacgggaacgcgaacagctatacgaagacgcattatgtccggttatcgttacaagcggtgatgaaacgatttcggttggttctcacggtatttcgtttatataaattagaggaaattctataatggctttacaatctccaggtattgaaaccaaagaaacatcggtacaatctaccgttgttcgaaattcaactggtcgcgctgccattgtcggtaaattttcatgggggccagcttatcagatccgtcagatttctaacgaagtcgaaatggtaaactattttggttccccagacaacttgaccgctgactatttcatgagtgctgttaacttcttgcagtacggtaatgatctccgtgtggttcgcgttgtcgataaagatgccgctaaaaacgcaagcgcaatttttaaccagatcaaaacaactattgcatcacagggttctaactacactgtaaacgatgtgattaaagtaaaatacaacaacgttgttgtagaagaaaacggtaaagtgtccaaagttgacagtaacggcaagatcctcgcggtaatcatcccaagcgaaaaaatcgttgcccgtgctaaacagattggtacttacccagatatttctactggctggactaccgaaattgtttctcagtcttccggtgtttccgcgtctattacgattgacggcatcgaaagcgattcagggatcactctgttgaacctggatattgcaaaagaaacaattcagggaaccgcattccagactcttacccagaaatatcagatcccgtctgtcgtggctctgtatcctggtgaactgggttcaactgttcaggtggagattatctccaaagctgcttacgattctggcgctatgatttcaggctacccttctggggtttccgttaagaatagcggtcgttctgtaatgacctacgggccacagaccgataaccagtacgcttttgttgtgcgtcgtggtggcattgtacaggaatccttcatcgtgtcaactgagaagaccgataaagatatctacggcgtaaacatcttcatggatgactttttcgctaacggtggctctcagtacgtttacggtacttccctgaactggcctaaaggcttctccggtatccttgagttaggcggtggtttgtcctcaaacgacactgtaggcgctgatgaactgatgactggttgggatatgttcgctgatcgtgaagcgctgcatgtacctctgctgattgctggtgcgtgtgctggtgaaactgtagagatcatgtctaccgtccagaaacacgttatctctatcggtgatgaacgtcaggattgtactgtgtttgtgtcgcctccgcgctctctgatggtgaatattccactggcaacagcggttgataacatcattgaatggcgtactggatataaactcagtggtggtactccggttgacaataacctgaacgtaagttcaagttatggcttcctggatggtaactataaatatcagtatgataaatacaatgacgtgaaccgttgggttccgctggcaggtgatatcgctggcctgtgtgtttacactgatagcgttgctcaaccgtggatgtctccagcaggttacaaccgtggtcagatccgcaactgtatcaaactggctatcgaaccgcgcacagcacatcgtgacgcaatgtatcaggttcagattaacccggtaactggtttcgcgggtggttccggcttcgttctgttcggtgataaaacattgactaacgtaccgagtccatttgaccgtatcaacgttcgtcgcttgttcaacatgatcaagaaagacatcggtgataacgcgaaatacaaactgtttgaaaacaacgacgatttcacccgttcttcgttccgtatggatacaggtcagtacatgactaatattcgtgcgctgggtggctgctacgattaccgtgtaatctgcgacaccacgaacaacacgccggacgtaatcgaccgtaacgagtttgtagcaacgatctacgtgaaaccgcctcgttctatcaactacatcactctgaacttcgtagcaacgtctacgggcgcagatttcgatgaactggtagggccgcaagccgtataacgtcaagggggctgaaaagcccccataaataatccgaggttaaaaatgcttactgacattttacgcgcctttgaatccggtgatttcgcacgtccgaacctgttcgaagtagagatcccgtatctgggcaaaaactttaaattcaagtgtaaagcggcaaccatgccagcggctacagttgaaaaagttccggtaggataccaaaaccgcaaaatcaacgttgctggtgaccgtacctatgatgactggacaatcacgatctataacgatgacgcgcataatacgcgtgacgctctggtagcatggtcaaacatgatgcacggaatgggcgatcagattagtggtgatattccagcgaactacaaaaaaaccgctacggtgaaacagaaaaaccgtaacgatgaaattaccgccgaacataccatccacggtcttttccctactaacgtaggcgaagttaccctggactgggacagcaacaacgaagtgtcaacctttgaggttactttcgcgctggactggtgggaataaaggctataaatacaggggtagcaatacccctatcattatttttcggagttactatgaactttttgggctttggcaatgtacttagctttttcaagaatttcgcccgtgaggacgaattagatcttgaacagcaattaaaaaatgatacaggttcggtcgcgcctcctaaaaataatgatggtgcttatgaaatcgaaactgatctgactaatcagaaatacgcaagcgtattccagcagttttattctggacaagatccggcgattcagaacaaagaacaattaatcaatacatatcgcggcatcatgtcttacccagaagtagaaaacgctgtttctgaaattattgacgatgcgatcgtgaatgaacagggcaaagatatcattactttggatcttgccaaaacagattttagtaaggcaatccaggacaaaatcgtagaagaatttgataacgttctaaatatctatgattttgataacatgggtgcgcgtctgttccgtgattggtatgtggattcccgtatctacttccataaaatcatgcataaagacgaaagcaaaggtatccgcgaactgcgtcaacttgatccgcgttcgatggaactgatccgcgaatctatcactgaaaccctcgatggtggcgtgaaagtattccgtggttatcgcgaatttttcgtgtatagcgctcctaaaaatggctatacatacaacgggcagatctaccagcataaccagaaggttaaaatcccgcgctccgctatcgtgtatgcgcattctggtctggaagattgcagtaacaacattatcggatatctgcaccgcgcagtcaagccagcaaaccaattgcgtttactggaagatgcgatggtcatctaccgtatcacccgcgcacctgaacgccgtgtgttctacatcgatgtaggtcagatgggtggcaacaaagcgacacagtacgtaaataacatcgcacaggggcttaaaaaccgcgttgtgtacgatgctaaaacgggtactgttaagaaccagcaaaacaacctgtcaatgacagaagattactggttaatgcgtcgtgacggtaaagctatcaccgaagtagacacgcttccaggcggtgcgaacttctctgatatggatgatatcaaatggtttaaccgtaagctctatgaagcactgcgtgtgccattaagccgtatgcctcgcgatgatgggggtatgcaaattggtgggggtggtgaaatcacccgtgatgaactgaaattcagtaagtttatccgcacactgcaaattcagttcagccctgtgctttccgatccgttaaaaactaacctgatcgcgaaaaaaatcatcacagaggaagaatgggaagaaaacgttagcaaaatttccttcattttccagcaagattcatattatgcggaagtgaaagatattgagattatggaacgtcgcctaacgttaatgtcacaggttgaaggtgtagtagggaaatatgtctcccataaatacatcatgaaagagattcttcgaatgtctgatgaagacattgacgaacaagcgaagctgatcgaagaagaatccaaagaagaacggttcaaaaatcccgaagaggaagaggaaaacttttgatgaaagaatttatcgaagcaatcaaaagcggtgatctggtggaagcgaagaagcaattctattccatcatggaagaccgtaccgaagcccttcgccaagaaatgcgcgttgaactcgcggaagctgtacgcatcgaaggtgaaaccgacgatgacgacagcgatgacgatgacgacgacaaaggcggcgatgataaaggcgacgacaaagacaaaaagccgtctgataaaaaagacgacgataaagacgaataagaggtgtaaataatgcaactcgaactcgaagaaatcagcgtcgaagatctcgaaccccatttaaccgaagcgaaagcccgtgttgatgttctggggatcgatgacggcactgtgaagatcatcgaaaatttggcggtcaatgaacctcatttagccctggctatgatgtccattgtcgagggtttgagtttagatgaagtcattgttaaacacgtagattcgcgcggtaatgtggaacgtaaaaaagaccgtaaaacccgtgaacgtaatgcgtatcaaacaactggtttaactaaatctcaacgtcgccaaattgcgcgtcgtgcgctaaaaacaaaacgtgcaaacccttctattacaacccgcgcacagcgtaagcgtaaaaaagcgctccgtaaacgcgccgcattagggctataaatatgaatgaatcccaactcaatgaaaacggcgatatgctgctaatcgaggaatggggtttaccttgtgcggatatttccgattcaattttagaatcggtcggtgagtcgaaaaaagacggtaaacttcggattgaaggtattttcctccaggccgaaaaagttaaccgcaataagcgactgtatccgaaaaaagtattagaagaagcagtaaacgattatatcagaactcaggttaatacccgtcaagctctgggtgaaatgaatcacccgccgcgaccgaatgtcgatccgcgtaatgcttgcatcctaattgaaaaattatggtggaaaggtaatgacgtttggggtcgcgctgttgttgtcgaaggtgataacggtgatggggataaactcgcggcgttaattcgcgcaggttgggttccaggtgtttcttctcgcggactgggtaaactttccgattctggaaaaggttacggtatcgtacaagaagggtttaaattggcggtaggcgttgatgttgtttgggggccaagcgctccagatgcttacgttaagccgattaccgaatctcagtcaagcaaaacgcttgttgagaataatagtgctgatgatgacgctttcagaaaactctctgaacgtttgaaaagtctatataaataatatcatatcaaacaggaaacttagaaatgcttaaagaacaactgttggcagaagcccagaacctggataccccagttgagttagacagcattttcgaatcagttgaactttctgatgatgcgaaagcaaacttcaccactgtattcgaacaagctgtaaaagcaggtgctgcgaaactcgctgaaacccacatcgcccagatcgcggaacgctccgatgaactggttgaagcccaggttgccgaaaaagctggcgaaatcgaaaataaactgtacgaagatgcgaataaatacttcgaccacatcgcgcaggaatggctctctgaaaacaaagaagctgtgtcccgtgatatcaaggccgatctgttcgaatctctggtaatgggaatgaaagaactgttcgttgaacacaacgtagttatcccagaagcgcaggttgatgttgttgcagaactcgaagatgaactgaccgagaatcagcaggaagttaaacgcctgttcgaagctaatcaggctcaggctaaagagatcgccaacatgaaacgcgataccatcgtttcagaaaaaacaaaagatctgactgaatcgcaaattgaaaaggttcagaacctgatcgaaggtttggaatattccgacaagttcgaatccaaactgaccgcaatcgttgaaatggtagcgactaaagcggaaaaacaggttgaagagagtaccactactcagacaaccactaaagatgactttgttccggtgaatgaaaatacacctccagcagagaaatcgaagatcaataaatatgtacaagcggctaaagccctttcctaatcttataaggtaagaaacaatgtctaagaaaaacgaattgatggaaaaatggaacgatcttctggaatctcaggaaggtttaccggatatcgctaccaaatccaaaaaacaactggttgcagcaattctggaaactcaggaaaaggatgctgatactgatccagtatatcgcgacgaaaaaatcattgaatccttcggcggtttcctggcggaagcagagatcgcgggtgaccacggttacgacgcaaccaacattgcctctggtaaatccagcggtgcaatcaccaacatcggccctgctgtaatcggtatggttcgccgtgcgattcctaacctgatcgcattcgacatttgcggtgttcagcctatgactggccctactggtcaggtgttcgcactccgtgctgtatacggtaaagatcctctggctggcggtactcctgcaaacgttcgtgaagcattccatccgatgttcgctccagacaccatgtattctggtgaaggtgcaaacaccgcgtttgctgctatcgcaactggtgttgctatcgcttccggcgctatcgttaagcacgtattccaggaaactggtgtcgcgtacttccagaacgtaacctccggcaacgtaaccgtaactggtgctgatgctgctgctctggatgctgctgtaatcgcagaaaacgagaaaggcactctggctgaaatttccgaaggtatggctaccagcgtagcagaactccaggaaaacttcaacggttccagcgctaacccgtggaacgaaatggctttccgtatcgacaaacaggttatcgaagctcgtagccgtcaactgaaagcacagtattccgttgaactggcacaggatcttcgtgctgtacacggtatggacgctgacgccgaactgtctgcaatcctggcaactgaaatcatgctggaaatcaaccgcgaaatcgttgacctgatcaactacaccgcgcagattggtaaaactggtttcacccagaccgtaggctctaaagctggtgcgtttgacttccaagatccagtagatattcgcggcgctcgttgggctggtgaaagctataaagctctgctgattcagatcgacaaagaagcgaacgaaatcgcgcgtcaaactggtcgtggtgctggtaacttcatcatcgcttcccgtaacgtggtttccgctctggctcgtatcgacagcggcatcactccggcaggtcagggtctccagaaaactctgaacgtagacaccactaaagcggtattcgctggtgtactgggtggcacttacaaagtgtacatcgaccagtacgctcgccaggattacttcaccgtgggctacaagggtgataacgaaatggatgctggtatctactacgctccatacgttgcgctgactccgctgcgtggttctgatcctaagaacttccagccagtaatgggcttcaaaactcgttacggtatcggcatcaacccgtttgcgaactctcgctctcaggctccggcagatcgtatcacctctggtatgatcagcaaagaaatgtgcggtaaaaacgcatacttccgtaaggtctgggttaaaggtctgtaatcgactttacactaaaaggcaacctacgggttgccttttttgttggtgtaaatagatacaggtaaaaagccctctaattcaggaaccaaagaaatgagtgataaacactacacaattcacaagttgatgcgtcagtcttcgcttccgtctggtaaacgagaaaaagttatcaacgaagcaacaggcacgaccgacatcaacgtacagaacacgcgcccagaactggtttctttgactcgcgcggttaacaacctgatctatcatgaactggttgctgtacaagaaacagaactccctgttgcaacactgttcggtgttcgctatcgcaaccctaatggtgatatgactttctccagtgctgcaacctattcaggccgaatctctggacgtacagacatcgacgaaatcgatctgactaaagcctacgttaaaggtgatttgttcaagcatgatggtactgacgttgtttatgaggttatcgcaccgattaccctgaacactctggatactgacaaagacaccgcgatcatgaaagctgtgttccaaagcaaaattcgactggttagcgaagccgctgatacttctaagtatgaaaccagtgaagatatcgcgtcaacctccttccagatggatcgctggaatattccggtacgctcgcgtaagtttaaaaccgaaatgacggttgaactgatgcaggatttggaagcgaaccagttcgaagctgatggggtgatcgaagacattctgggaaccgtggcaagtgaagaagtcaacaaagacattattcaaacactgatcaccgtttccaaacgttacaacgttgatggactcgttacggatggtatttttgacggtactaccgcatacaccgcgaaggatgctccagcattgggtcgtatcctgtaccaattagcgtgtgaaatggggcaggaaatgaatagaacgacttcatttgatgctacctacgtcctcgcaacagcgcgtgttgtaggcattctggctgcgtctggttggatgcacgaaaccgacgaacaacacccactggcaacaggtaagctgaacaacggttattatgtctatacagacaccaacagcccgttcgattatatgctgactggttgcaaatatgatctgggtgatatggatcacgtaggctctctgttcttcgctccgtataccgaagctgacgaagcaggttcaatcaaagtatccgtagatccggcatccctgcaaccaaaagttgctattctgatgcgttacggtctttccgtgaacccgtatactgctgaaagtgattctgatcgcctgatcaaaggtgatgattggtctgctcttgcaggtaaatctaagctgagtcagatcgtaggtattaaattacctaaactgggttaacaagttttgttttgagaagaccattatagtaataaagatctataaggtcaaacgagcgaagcgagttttcacgaacgaagtgagtgatgggtaagtacgatgtactgtttataatatttatattttatatatagagaaaacagtacatttccgtatactttttaaccaacattcactcactacgttcgttcatgtactcgcttcgctcgtagatttgacttcttgatctaactggttataatgttactttgttttgaggtgatacatggctgaactaaaacttgaagatctacaggctgaacttgaagaggatatgcgtattgatccgttgaagttacaaagcgaatcagcagacattccgaagatttggtcaaaatggcttcgataccattcgaatgctaagaaaaaacttattcaactccaggcgaagaaagaagcgattgtaaaagatcggttactgttctacactggtagacacgaaagcgaaatgaccgatgtcatttacactggttcgggtgaaatcaaaattgctatctccggtgatcctaagaccgttgaagttaacaagctgatccaatacttcgaactgattgcagagtttaccggaaaagcgctggatatcgttaagaacaaaggctactccatcaaaaacatgttggagatccgtaaacttgagagtggtgcataaaatggcagaagaatttgattgcaaatgcgttgtgtgcaaacaaccgatgaactcccgtaatacggcgtttgtcaatgaagctggcccgatctgcggtgtcgtatgtttgcaatatctcaacgaaaggaatgatcgcggtatcaatgaagccgacgatctgaacgaagttcaaatgttgctgtaggtgtgaatatgaaagactattcaaaaatcgactttaacgaagtatttcgtttgctgggattgatggaagaatgtgtgaccagggttcatgcacttcgaatttcgtttgaaagcggttgtatcgaagacgaacgcccagatttatagcagtaaatagatgtgtaccccttgtggggcttgggcttaccgtgtggcgtacccatttgcgccgtccgatagaatttactttcggtggggtgattggtaagataccttcgagtaaaggccagttaattgtaattcagaatagtacagcactgaaataaaataaatgtacgtgtcggaacaaacggtttccgaaattaaaaagccccttcctttcggttggggctttctttttaaaacttctcttcttctccggtttcaagttcggctttcagttcttctcgccgtcccttgatcgcgtcacgcattgaaatgtcatcggatgctgcaacctcgacttctttcacgcgggtgttgtaatacttttcaagttctttcaaaccttctagtgtccggcacgaagcaaccttattcatgaaatcatcaatcgctgcttcgtttacgaatgtagtaaaacttttcattttggcctcttaaatttctacctgtttgatcgcgtagtcgaatcgttcttcattgtagatccgcacacgttccatagcatgtttcataccgtagtttgtcgcactgtatttatttttggctgtcttagactttgacagcgtagccaggttatcaacgatatcccatacagtagcgagcgctttcgatccgtgcttacgaagtacacgaccgatagactgtttcaccacaacagcagatttgcaagggtgcgcaaaaatgatgtggtgtaggttcttgattgagatacccgtactcagtaccccgatcgaaccgatgacgattaaacctttcgtcgattccgcgattttcttcatttcgttacgatcgtcaatgtctgtatcaccattgaccaacaccacgttatcgtaaaccttgctcaactgctcgtacagccattttccgtgctctttgtaccggaacatcacaaaggcgttttcgttcttctcacgggctaatttgagcgctaattttagaatccacgcgttgcgccgtgtgtggctggttacgtacttgatttccgtctggtagtccgcacccttcaattttttgacctcttcttctttgtatcgaaggaagatcgtgttaattttcaggttggtgacttgtccatcatccatcaaacgacgcgtatcaactggtttaaagactttgccgaacgcaccgatgtattgcatcatgttcgttttcccttctttcagggaaccggataaacccagtttgaagatacattgatccatcgtgtcgataatctttttgatgctcatgcctgttgagaggtggcattcatcaaccatcaaacacatgaactgttggaaccattcggcaggcattttaaccgctgattgccaggtagaaacgtaaatcagtgcattactgtttttcgctgtaccggaacggatacccagcattgccgatttcgggaacaaacgatagtttgcgatgtcctcgatcatttggtcaacaagtgcggtagtcggaacgatgatcaacactttcccgctgtaatgttccagacaccaacgagagataagcccctgaatcagagatttacctgctgatgttggcaggttcagaacaccgcgacggtttttgataccgtggaacactgattcgcgttgataccagtacgggtcgatctgtttgtcgccgtcataaaccggatgttcgctaacccacttatcaaaatcttcttgcgtgatatcctctgtttcgtggatctttggatcaacccagattgaatacccgcgtgattctgcgaatttggataccagataggctaacccatacgggagtttcccgttgtagtccatcaagtaaatgtaaccgttccatccaccatatttgtatttggcctgatactgatagcctgggggctggaagctgaaatagtcacgcagttcatagacaatgtttggttctgcctgaatctgtacgtggcttgtgtttaaaaatttgacttcaatatccactatgattaccctatgtacaaagtatatacgtatttatgtcataaatattggataaacactggagataccaatgaacattgattacgaaaaagttgatgggttccgtaccctcgacgcaaaagaacagaaaggcgctttagccgattacgctatgactgtgtttgcggttaagctgaacaaacaaaaatccttcgataacatgctggcggatctggttgctgctttaccggaagatgaagaaaaaccggaactgctgatcgattcccctgaaccggaaatcgttgcatataaaggtgaggtgactatgggtgaacctgtcatcgaagccccgaacgttcccgatgtggttattgatgcttctgcggattttatggagtacgttaaagaggtcgcgccggaagtagccgatcaaatccaattagtacctgatgtcgtagaagctcctgtaagcgcttctgacgagtccaaaggcgaactggtatggttggaagggtttagcccgacaatcttcatgatggggcgctctgcgagttctaacgggtattatacctgtccgtggtggatctatgactggattaaacaaaccccagactggtacaaagatcctgatagctgtccacatgcaagcgcaatcgacacaatcaaatcacttgcgttctatatcgtgcgcgatggtgaagttcgtgttcgcgaaaccagaaatagccgattcgaaacatttaagttttagcactttttgctaaaaaacttgttgacgcataccctcgtttaaagtatatttgtactcgaaggcgggggaatggctctcgcagtgaagaaggaaagcaaaatgaaaaacgaaatgatgaaaaacgcttattacccagttctgtttgtttgggctgatggtaaagtgaagaaagtagtcaattcaaatgctccttactatactgttgaagaagcactgcgccacgcttacgaagctgattatcctgtccctgctgaacctggttatgctcgttggaacggttcaaaatgggttgctgatacctgggacaactacgaagaagcaaaaatggaatgcgatcctgattatgtttctcgccaaatggaagcgcacatgattgcagaccgtcgcctggataacgaagctcgcggtttctattaaaattcaaagggggcgtagcccccttttttgtaggtaaaatatgactgaattaaatcacgaatgcctgaaagacttatcagaaggtaaagagatcggaaacgtcatcttccttgatatcgacggcgttctaaataatatgcggtgcatgaaatttggtgagcatatggacattgaatgtgctcgacacctgcgccggatcgtaaatcatgcgaactgtgatattgtcatttcctctacatggaggatcggcaacacaacccatactctacgggaaatcttctacccgtggggattgtatcgtatcattgggaaaacctgtacgaatctaacagaccgacaagcaggacgcggtgatgaaatcaaagcatggatcgacaccttcggatgtaagaattaccttatccttgatgacgataccgatatgctgccggaacagagtgaacatttcatcaataccgatgggttcgtagggctgacagaagaacaatccacttacgcgatccgtaatgtgttcggtgtaacaaacccgttctgtcctgaatgcaacggctatgggcgcgtgaaccaatatgataaatgtccgtcttgtgacggcaaaattttacttctctaaatagagaaaaactaagaggttttgaaaatggctacagaaaaatggactacggtacacccgatcccgtggcgtaacaccagctttacctatctgccgtggtggatctttgatatcatcgtggctgcgaatgctgcaagcgaagactggcgtgattatgccgaagaaaaatatgcgaaagaattcgacacactgaaacaggcgtatattgattacaccgatgttgatttcatcgaatctcgtaacggttatctgtataagctgagtgattttactcctgctgatcctgtcgtaacaattacaccaaaaaccgctcctgctgatttcaaagtaggtgatgcggatctggctgcaactgatctgtttaccatcgatccttctggtacagaaatgactctgagtgttgactcttccggtcatggttctatcgttggtggtaaacttcatgcggttagtgaaggtgatgttgtcgtaacagcaacctctggatctgttactgcaactctgacggtaaacgttaaacctgcaccataataacaactaagaaggtaaaaatgctactatttgaattcaatgatgtattcgcaaaattcagcgacgcaatcgaagccaaatttggcaaacgcccacaaaacatgacagatgcagaatatgaagctgctgtatcgtccctggttcgtacagatttctatgaaaaactggcgatcgaggtgttgggttgggatatgatgaaatggggcatgacctatcgcgatcgcgaagtcggttttattctcgtcaacgaagcaaaaagcccgtcctgggtgaatagtcaaaaaatcgcgtacatggataaagtatgcgcacagatgggtattgtacgtttagacttctggacttgtcgggatctgaacgaactgaaagcccacgcttaccgttgccctctgatctcccgcaatgataagcatcgtcaagcatgggatagcgcagggaaatatcgtagtgttttcctgaacgacgatatgaacatcactattcaggatgtgaaccgctcctttgcggattacacaccataaacaaaaaagggaaccgcaatggttccctttcttttatgcaatttttctgatttctttcaatgcttcttctttgctaccaacgaagagaatcgctttacctccggcttttctgaatggcaacacagcttttgccctgtcatcaatcagtatacctttgtccgcatatgctgctttctctccgctgcttttggtgtagtggaattcaggcagataaccgaacaccttcatcaacgcttttcttttttgttctgctaccgcatcggaattgtatttccctacgctggttaagatcgcaacctgacctaaagttctcaaatgacagaacaggtcgatgccctcttgtaatggttccagattttcgtagaagtcagtttgtgatatagcctgtttcgcttttttcaattcttcttccggcattctcgccgggtcaccgtacatcggaacaaaagaaccttcccagttgaacagtacaccatccatatcgaacaaaaactttttcatatcaattcctcggtttgtgtgtgcatcatattcatatatgttcctattgtcaaccccatgtatcagttttcggtgcgtatgctgcaactttcgccactaactctttatcaagctgatcaatggatttctgcggctttccttttgccttaactttgatgtagttagacttaacgacaaacataccgcctttgtcagatttcttgatttcgctgtcaatgcctactttgttgaagctgatccagatatcgccgtccatgtactgtttcagagagtcgcccatattcaggatcttcgccatagtgagcgctgccccttcgtgggtatccatgaggatttctttaggcactacacgatcgcgtttaaggttctgctgcatagcaatatgaacatcgttcataacccaaacgatatggatgttttctttctgataacccagcgcttcaacatcacgggcgatacttgccagcttgctcatgcttttcagggttacgtcaaagatcaggtttggtttacggtcttccggtgctgctgtgataccagcgtacacacgcgcctggtttttgttggatacgttgaacacgtctgcgatcacatgatgcagtgttgctacgttgtccgggtttttcaggttcattgttttgacatcgtgaccagttttcgctttgatctctgctgccagtttggtactacccatgaccaattttttgagtgcgtcaacgtccagggtgatcccttcgatacctaacagcttttcgagggtgaaccctttaccagaacccgcgccgccagccaggatgactacctgaccaaatttaggataagccttaccgccgaaggtgatcagcgcttcatcaaggctcgtaaagtctttgaatgatttcatcttagaactccaggtgtttatttaaaagtatttattgacacggtttatgagtgtgtttatagtgcaattgttcgacggataggccggaagaactttaaccataaggtaacaattatgaaaaatgaactgcatgaattcatcaacgccgctgctcttggcgaccagtcaaaatataaatcccgtcgcgataccctgattgacgatttctgtaatctcttggggttcaagcgctggcataccccgtctatgcgtccagattgtgatccaaaatgggattacttcaaatggagtgatcgcgatcgtggttacgtcgataacgtccgcgtaatgtctttcaaccacttatacgcaaattcaacaattgctgttgctaaacgcaacgattcgacttatccgaacgggtggagtgttgctaaagtcatagaaacacttcttcaactgcgtcgcgaatataaatcagcataccgtgtcaatcccaatcctatctataatgaatggcaaatcgtcgcgaaatacctgctgaacatcacctattctattttctgtcgcttcgggacaaaagagattggatttggctctcatgatataattgcagaagcacgtcaccgcatgatccatgcaatcctgaaaattcaaaactctggtgggcttgttcttgctgcgttctgtgatgaaattgtttactacggagaacaggtcgaagttgatgatgttcaccacgaaaaattcaaaagatttgtattcgggcaatataacagctattcatatggaaacgatattcgtgtgatgaggcacccgcgcattatgttggatatggaagggtgggaaccaggtcacggaattggtgatgccgaaagccaacgtgaacgccgtgttcgttcagttgctaaaactcgcgaattgatgacaggtagccttactgattacctgttcagaacaaaagaagacgttgaaaaagaatttgttgacttgtcgggcgaatagcgataagctgtaatctctgaaaacaaggagataaccatgaataccattcactgccgcaaagagttcgttgagttctatcacggatcatgtactgctgccggaatcgaaagcatgttgttgcctccttgtgattctgatactctgtctgaaaaaggcagaaagaaaaatctggatcgtgttttcttcactgctgatatcgggctggctcgtatctatgctggaagggctgcacgttcaataggtggtgatccggtactttatcgggttgtgtgtccggtagatgtggtatgcatgaacgatgacaaaggcgcaagcgtttatcatgctgcatgggctttctgtgaggaattatgaaagataaggtgttagcgtatctcgttttcttgctgggatatcgcgttgaagtgatgggtggttattcttctttgtatggggatttaaccgcgatctggatggttgcgttgggggttatgtttacctttatggcgatctgtattgcgaatgaggctgatcaaaatgcttgaattttatcctgctggttgcaagtcaaatccgcctgatgcatcgttccaatcgtggatttattttcacagggaactaaacgacatcatcgaaagtcagtggaaagaccatcctgaacgaagtgcccccgatttagtcgatagcgtaacagatgtacgcaccctggaaaaagggctgtatgattgtctggttcagggaatggtgtgtaaattgattttgtggtatgctccgatcggttcagatctaactcgcaaaatcgcccgtggctatatcatgacgaaacgtgagtttgaccagatttggaatgaacccgactgtttcgagcgcgaaaaatacgaaaatgaggttagttgcatatgaaactatttcatgttgtgtatggtgggatgaaaaatatcgacatcaccgcgttatctgctggtatgttggacgaactcgaagcacagatcgggaaacgattcaaagccagtatcaccgaaacgcaaactttgtttgtcgatcaccctgcggatatggaaaaccttgtcaacactctggatgatctgatgatcccgtgtgctgatggttggaacgaagcatccggtgttcatgtagttgtaacttttgttcttaaaaatgttgacagcagaaatgccgaagtgttagagtttattcgtaaaattgattctactaaaggaaagtaactatgaaaatcgttcagcgtaatatcagcgaagttagccagcaggaaaaagtacagattcatttcaaattcaatgatctgaaactgggctatgcacagatcgcccgtgagcacatgctcgataacggcgacatttacgtgattgttcaggaaattgagcgaattcgtgctttccgcgcagaaaatccaaaagtgaaacatgttctgcgtcgtgtgtatatcaacaaacatcgtgaagaacagcgtaaacctaagaccaaagctaaacgcgatccgcgtccagataacaaacgtaaagcaatcaacggcgctatggcgctggcgttccaggaagcgggtttggtgtaaggggtttatatgtcttcaatgatgaatcgctggtcgggcgtgataacttcgactatcaaaaaggatttggtgaaggttgaagcaaaaccaaagccagtagaaccggaaaaagttcaaactatggtatcactcgatcctgctgagttagaacaccgccgccgtgcaaagcaaattgaattcgatctacgtgtcgctcgttcatacaacagtaaaaacgatgatgcgcgtaaccgcaaccttcaatttgctctgacgttaagcgactgggcgaagctaatgagtgaacccgtatgttcttactccggcagaccgtttagcaacaaaggcggttgctctgactcccgaacaatggaacgaatcaacgcttctctgggatacacggttgaaaacacgatcgcagtaaccagcgccgcgaatagcgagaaatcaaatctcgatgcgtttatgaagggttctgtgatccttccagaagtaaaactgaaactgttacgcaaagctgcgtatcaaattgaaaaacaactgaaaatcaagggttaattatgtttgtgaaatattcttctctgactaaccattatgaaggtaaattcatcaatggtgtgatcatgaatggtttgactggtggcgtgtgggtagcgcgtgaaaagatccacggggctaactttagcctgatcacttcggacggtatcaaagtcattccggcaaaacgtagcggtgaaattctccctgctgaacagttctacggttgcgaacccgtagttgcgaaatactccgaacctgttcgtaagatgtgggaaatgatctctactgcgcgtcagttaagcggtgagtatagcgatgaactggtgatccaggtatacggcgaattcgcggggcgtggtgtacagaaagatgttgactacggagaaaaagatttctacgtatttgatatccgcgtcaatggtcagttcctccctgataacgttgttgcgaattacgctgttgctgttggcttgaaaatggctccactgctggcatacggtacgtttgacgagatccgcacactgcctatcacctttgattcggtggttaacctggcgaactccggtgcgatccctgcaaagaacggcgttgaacctgagttcaaaaacttcatgacgctgaaagatggtgaaggtgagaacatagcagaaggtttcgtgatgaagcctgttcaacccgctttcatgccgaacggtgaacgcgttgcaatcaaatgcaaaacgacgaagttcacagagaagaagaacaagcaagcgaaccgcttcaatgctccttctgaactgtcagaaacagacaaagtgaagctgaacgaattcacctgctacctgactgaaaaccgcgtgaaaaacgttctgtccaaaattgacagcgcgaatctcaccgctaaagatttcggtcgcgtgatggggcttacggtacaggacgcgctggaagaaatcgaacgtaactacgggcctttcctggaacagttcgaaaatccaacgctggcgaagaaaaccttcactaacgaagcgtcaaatctggttcgtgagaactggggcgcaatcctgaacaatgaattttaaaactgttctcgaaaacgcaaaaacggctaccctgatcggtagccgtgaaccccctgaacgtatcgcgagtatagccataaagattggacgtgctttaagtgatcgggggatattcgcttactctggtggtgctcctggaatggatagccatttcatgtttgactactcaccagaaagacggcgtataatcctccctgagaacggttttaacgggttgtattcgaatggtaaggatatcatcgactatacagaatacgacacgtacaaagccgctgacgaagcgagaaaggtagctggacacttcgacaaccaaagcgaatggacacaacgccgatacgctcgcaattcaatgcaggtattaaccgaaaacctggacaaacctacagattttgttctattctgggcggtagagaaagatttttgtgttaaaggtggtactgcgatcgctgcaaggcttgccagattgtataaagttccaacgttcaacctttggaatcaaaacgttctggatgaagtctgcgatactttagggattaacactaaacctcctactctggattttctctggtgataactcccgaacaatcacgtaattacgaacgcctctctgttgaagaggcattaaaaaaggcgaaacataatggtagaaatcaatggaatcggtgtgaacgcacaggcgggaagcgggacatcgtgggtcaaacgcgaaacacaagatgatccccgctgtggacgtagtccgacactggcggaacgtgcgcgtaaactggttgatgaaatcaacgcgaaaatggtcgaagcatcccgtaaagacatttccgagtatgtcctgaaatatccgactaaacaagcatatacctttgatatgaaacgttttatcggtaaggttatggatcaggaatgtaccgaaaaagcatatgcggatctgggtgaatggctggcggaagaagggtttactttcgatacccagcgcaaccgacaagctgcgttactcaataccttcgcgggttcgcgtcgtattaccaactttagcgatcctaagcgtgacggatatagcgatctgacttattacatcacctggtgaaaataattcgaaaaacttgttgacgggagttatgagtgtggtaatatagctcccgtagacaagacactaacctaaaaggaaaacatcatggaaatcaaattagtacctacttgcgctggctactgcttggcactgaatggtgtagcacacaacggtaaaggcttacgggctaacgttgaagcaatgctgaacgaactgggtgcggtttatgaatatgatgacgttgcaaccagcgttaaaatcataagccttgaaaaagatggtgttaactgtgcgggttggtgggattgctacatcgactatagcgacaaccgggtcttcttactgaccagcaattaaggatcgaacatgtttggaatgaatgagtgttcagaagcggaagcgctcgaagattgggctgactttgatgaccttgatctcgataatgaagatggagaattcttctgtgttgggcgcggggttgaaagaacaaagcgtgaacttcgaagccgtttagcaatggggcgtactgttggatctggaaagaaacaacaagttaaatattccgatggttcgattcgaaatgaaacggttgtcaaagaagtaaacgggcgtgtcattacgtccgagcggcagaaggacatcaaacaattgtacgatgttgcaaaagccgctaaagtaggaaccatgatcacttgtcctacgtgcaaagagttgcacaagaagacgacatatcataaggtgttctgctctaatggtaaaaaatccaggaaagactgtaagagtaaatactggaacacgatccatccagaacgtttggatcgtatcttttaaatcaaaacgtggagtacgtttaaatgaaaacttttaatgaactgaatagcctgatcacctcaactgattcctacaaagtgtcccactggttgcagtatccacaaggcactgatgcagcgatgttctatattgaatctcgcggtggtaagtttgatgaagtagtaaccgctggcgttaacttcgttgcgcgggttcttgctgaaccaattaccatgaaacaagttgagttggcacgggtactttaccgtaagcactttgggaaagagattttcaactacgaagggtggaagaagatcgcagaactgggttatgtccctgttactttccgtgcgatcccagaaggtacggttgttccggttaaaaatgccgttgcgactgtgtacgccgaacatgaattctcatggttggctgggtggctggagacaatgacgattcgcggtatctggtatccgtcatctgtagcaacgctatcgcgtgagtgtaaaaaggttctggctcattaccttgatatgacttctgacctgactggtgaagcatataacatcacactgggtacacgtctgcatgatttcggggcgcgtggcgcgacctctgctgaatctgcgggtattggtgggctggcacacctctataacttcatcgggactgataccgttgaaggtatgattatggcaatcagtctgtttgctgactatcaaactctgtttgatgaagttgaaaacgtcgaagcaatcggtgtttcaattccggctcgcgaacattcgactacgatttcctacggtaaagagaacgaagacgaagcatacaaaaacagcatcgaaatgttcggtacagggttctacgcttgtgtgtacgattcctgggactacaaaggcgctgtagatcgcatcgctgaatataaagagcaaatcattgctgcgggtggtactctggttgttcgtcctgattccggtgatatgattgataacatcatgtacaccctgcgtaaactgggcgaaatcttcggttacaccgtaaacagcaaaggttacaaagttctgcataattcagttcgaatcatccagggcgacgagatccacggacctgaaacaatcaaccgtgtgttaagttggatggaagcgaacaagtgggcgagtgagaacatcgcgttcggtatgggtggcggtttgctgcaagaagttacccgcgacactcaaaagtatgctgaaaaactgtgcgctatccgcgtgaatggtgtgtggaaaggcgtttacaaatgcccgaaaggttccgaatggaaacagagtaagaaaggtttgctgatgaccatcactaacggtgtggaattcaaaacaatcgacactctggaaactgagattcctgacgggtggcgtgatgcgatgattacgtattacgacaacggtgtattaaacacctccgatacagtaggggttatccgtgagcgagcaaggatttaatatccgcgccaacgataacggatcggtagtcttctacaacaatcagccccttgtcgctcgcaaggggcttttttgtaagttggtgggctacgggttcaagttggaacaggtggacaacgcgacactaaaagaggttgttcgaattgcttatctactgaaagataaaaaagatgaacaccgtgctattgcaatgcttgagaaactaggcgaaaattattgcttcgtggtgaatcgtgggtataagtacgaaacgatcgccttatttgagaaaggacttggtgaattatgattaccacaattaaagaaggggttgacctccatttaggcgactccgtaaagctgattaaacagcttgaatctggttctgttgacttgaccataacttcgcctccgtatgacaacttgcgccattataacggctctggtgatgtctggggtgaacacgtatggaaagagttgatatcggaactgtaccgcgttaccgcgcctggtggtgtggttgtgtgggttgtgggtgacgcgactatcaacggtagtgaaacgggtacatctttccgtcaagccttgtacgcgatcgaacaaggttttcggttgcatgatacgatgatctatcacaaaaccgctctaccgaagaaccataaccgatacgaacaggactttgaatacatgttcgtgtggacaaaaggcgcaccaaaaacattcaacccaatccgcattccgtgtaagttccctgaaaaggaaaccgcacgacaaaacagctacttttccgaaaccaacgaaaagaaccgttcagcccgttccggtaagaaacgtaaacctgttggcaaggataaaattaagggtaatatctggtattacgctgtagggcgcaatcactcaacgaaggacgagattgcattcaaacacccagcaatatttcctgaacaactggcagaagatcacattaaaacgtggacggttgaaggggacttggttcttgatattttctctggttctggtacagttatgaaaatgtcgatactaaccaacagacggttcaaaggcttcgaactgatggagaattattatcacgattctattcttcgtgttcagccatacgttaacaatctggaatcttttctatgagttatttgggtgttatcccgtatacaggtaacaagcaatcgctattgcctgaactcttcaagctgttccccgaaagaagttcatacatgcgtttcattgattgtttttgcggtggccttagtgtgtcgttaaacgtccctaaacccgttctaagcaacgattacgataagacgctgattgatatgtatgagcgtcttaaaacgcttcctgacctgtctccggtgcgagaattgattgcatcaaaggggctggggaaagacaagaaagaagagtatttgaaattccgtgatgaatacaaccagaacaaagatccgttatggctctatgtcctgatcctgcattcattcagcaacgttaaccggacaaacgacaaaggcgacttcaacgctaatttcggatgccggacgctcaacgatgcaacagtaaaacgctttgaacatttcaaaaagaatgtgaaaggcattgagttttccagtggttcattccgtgacattgatatctgtgaaaatgatttcgtgtactgtgatcctccgtacctgatcaccgatgcagtgtataacaagttctggaacgaagatcgcgaacgtgagttatatgctttcctggatgaactgcacagcgaaggaatcatgttcggactgtccaacgtgactcaccatgccggaaaacaaaatgatatcctgattgaatggatgcagaaataccgcgttcataatctggataaaaagtatctgttaggccagcataccgactcttacgagcaaaacaaaacgcaagaagtctacgtgtgcaactaccagaaacgcgacgtaaatacattccctttaacactgaacgatttaatgtaggttaacatgtttaaaatttatggctatatcccttctgtgtataactgcgctccatgcctgaactcaaagcgcttgctggacgcgaaaaaacatccgtatgagttcgtgtctgttgcggattccgtggaagacggtaaacctgtactgaacgaagcggtgatcgatgaactcgaagcgcttgttggtacgcgccggatgaccatgcctcagattttccatgacgggaaacatgtaggcggattcgaccaacttcgtgagtacgtccgcaccctgtaataaataatgacaccttactgaatggtgttattatgctgacgaaacgaattaccaaaaaagactacccaactatcaagcaagctctctttgaaaaacaggggggctgttgtgctatctgtaaacgtcccctggagggcgagatcgagaaacatcaccttgaccatgaccatgctttagacggcgaaaacgccggacgtgtgcgcggcctactttgtaacctatgcaacggtacagaaggtattgtgaagcacaaattcaacagatccggtctggtgtcccgtgatgtcgattacatccagtggttagagaacttgcttgcatatctgaaacaagactattccgaaaaccgtattcatgacaaattcataccagataaggtaaaatggttttcaagacttaccaaacctgatatgattgccgaaatggtttctatgggcttcgagtacgccgacaaagacgaacgcaaagccttaaccgcgaaatatagaaagcaattaatgaaggcaacgaaatgaaagtagaaaaacgcgacggtaaaaacgtcgatttcgataaagaaaaaatccgtattgctgtagaaaaagctggcggtactatgacggatgctgatgccgcaatcatgctggttcagtacaatcagatccgcgatggtagcgcaatgaagatcgcccgtatccaggaactcgttgaagaatccctgatgaaaacgaacccagcggtcgcccgtgcatacatcgaatatcgccacgatcgcgatattgcccgtgaacagaaaagtaagctgttcaaagatatctccggcatggtgaatctgtccaacaaagagatcaccaacgagaacgcaaacaaagacgcacgggtattcccgacacagcgtgatttgctggcgggtattgtagcgaagcatttcgcccgtaatcatatccttccgaaacatatcgtagaagcgcatgactccggcgacatccactatcacgatctggactatagcccgttcaccccttacactaactgctgtctggttgacctgaaaggtatgctggagaacggtttcaagatgggtaacgcggatattgaaccgcctaaatcgatcggtgttgctaccgctctcatggcgcagatcacagcacagattgcctctcaccagtacggcgggacaacctttgcaaacgtggataaagtgctggctccatacgttgaaatgacattcttcaaacatctgcgcgatgctgaacattacggtatcgaacactataatgaatatgtgtatgcgattgaaaagactgaaaaagatgtgtatgatgcgttccagtcctatgagtatgaagtaaacaccctacatactgccaacggacaaaccccgtttgttaccatcactttcggtactggtacgagcgattatgaacgcatgatccagaaagcgattctgaaaaaccgtattcgcggcctgggtaaagagggtattactccggtattcccgaaactggttatgttcatggaaaaaggaattaaccttgatccagaggatcaaaactatgacatcaaacaacttgccctggaatgtgcttctaaacgcatgtacccagatatcattagttcagctaacaaccgtgttattactggttctagtgttcctgtatctcctatgggttgtcgcagtttccttagcgtgtggcatgatgataacggtaatgaagttcttgatggacgtaataacctgggtgtggtgacaatcaacctcccacgcatcgctattgaagcggaagcacaggaagaagaagacgcacacgacgcattctggcgcatccttgatgaacgtctggaactgtgttttgaagccctgatgactcgtatcgaaagcctacgcggtgttaaagccagtgttgcgccgatcctatacacagaaggtgcttttggtgttcgactcaaaccggatgatgaaattctggaactgttcaaaaacgggcgtagctctatcagtctgggttatatcggactgcatgaaactctgttgatgtttggctcaggccagcatccattcgatcgtatcggctcccagaatatcggcagattgatcattgagtacctccgcgctgcaaccgaagcatggaagaagaaaacaggatatggtttcagcctgtattcaaccccagcggaatctctctgccatcgcttctgtaagctggactttgagaagttcggaagcgtcaaaggtgtcacggataaaggctggtacacaaacagtttccatctggacgttgaccgcaaggtaacaccgttcgagaaaatcgactatgaagccgattatcattacatcgctactgctggtcatatcagttatgttgaattccctgatatgaaaaacaacctgcaagcccttgaaaaagtctgggattatgcgatggaaaaactggactacttcggaactaaccttccggtcgataagtgctttgtatgtggctctgatgacgagttcacgcctacagaagacggtttccactgcaaacactgcggtaatcaagatccggctaaaatgagcgtcacacgccgtacatgcggttatctgggtgctcctgctgttcgtggattcaacgaaggtaagaacaaagaaatgatgcaccgaactaagcatcaaaattaatcaaaaagccccttgcgaaagtgaggggcttttgttatattgcacataccgaaactatgaggtattgaaaatgatgtactggacaaaagattattttgaatttcgtgacgaagaaagttttgggacggtgtaccgcaatttagctttgcgtggtagtcctctgtcgcctaatcaactatcatctgtcgtgtttcctatcaaggtaacgcactgcaaccggaaaggtgttagtgggatcgttgatgctaatggcacaacatggtattccgaagattcttatctgtttgataacgaggatcgcggattctttaaaaagtttgtcgcgcttaaacctgctgttgaaaaagccgacgcgcaacaactgctggattgttctcacctgctgggacggatttacgtagatggtaagctggtgacgaaaccaggtgatctggaaaaattcttgcgtaaggcgcgggaaactaccctgaaagacaccgaaaagcgttacgatactgcaaccgccaatctacagcgtttgtctggtgaactgaaagttctacggggtgaatgatgtttccattaaaggcgcgggtacgcaacaaaaccggaacacaagaatggatggagtgtttacgcgaaactaaacactactacatttcacaggctgtaggctatgacggaaagaacatccgttataacaaagtaggtggtaagcgtgtggggatggaacaatatctccaattagaaaccgtccggcctgtgaatgttcctttcgatctgaaactaccaaacggaaagccaacgatatgatcgggaaaatccttgatactctgtttccctcccgtgtacgcgcacgggtagaaagagaaaacagactggaagagatccgcttcaataagttccttgaggacaagaagaagcgcgaagacgagaaacacccaaacgcaaaaatggctgagggtgtatcgaaatgttctgtcgggcggttctgggttgaaaaggattatcttgacctgataggtgctattgcccctggtgttacgctggaagacttctcccgcgctactgggcgttcgtatactggttgtattaaccgcttgcgtatgctctctatagtggtgcgtagtgcgcatttcggctatcgcgacgttatccgtccggtgatcccagtaagcagattaaaattttacatggcgggtggaaaaagacttgacttgaccaacgaactatgtaaaatcggttatatcagagaggggaaagttgttaaagcccctgaatggttcaccaatcaatttgaaatcaaataaggtaaaattatgttcaagaaaatcgtagcattcgtgactggtaaagttgaaactgcaattgaacaaaacacttccccagaagaagcctggcgcagtgctgcacgtatcctgatcaaagagatcgaccgtctgcaacatactcgcgtttctgctgttcaggaaatcgtgaagttgaaaaagaaagtcaaagaacacaaagaccttcacagtggtaaagagtctgagatcaaaaaactgctggcggcggggcaggaagtgtccaacagtcattacgtgctggcgctgcaacaccgtaacatctggcagggcttgcagacgaagatcgaagaactggaaggtatgaacaaagagattgatctctctgtcgtcgaactggatcgcaaactggctgatgtcaaaatcaacctggagatcatcgaactcaacaagcaaaccgaaagtctgggtctgactgtaccggaagacgtgatcgccgctgtaggccacacctccgtaagcgtcgataccatcgtgacgaagatcgatgtgttgctgggtggcaaaaatgccgcttctgtaacctccgctgacgttagcgcttacatcgactccctgaacgcgaaataagaggaaggggcgcaagccccttttttgctatgagttatactattcaaaaatatggtaacgaccattggataatcaaccatgctcgtaattttcgggtaaaacttccgtctgattggtggtgtcttcctagtgatgaatgcgaccgattgatacggatgttgcatgatggggcgattagccagcaagtttttcaaggaatggtagaccatgcagcatcgcggtcacaagaaaagtattgtgctgaactcacgtttgatggtatggttaattttcatcttaaagaatcatatgaaagaagtgcaacggaagttcttagcgagatttacgaaaaagagaggaaaggtgaaatgatgttcgaagatggtgcatttaaaccagcacgtaaaacgtatccagactggcgcaaacagtacgcagaacagttatggcacattgacattcccgaagcgctcatgaaagcgattagccctgcggttgactactattcaggctggaaagatgaatatgagttagaggtcggttcgtttaaggcgcacgtcatcaaagcgaccagaattcttgatttcgttgaagctgttgcgtcatgtgatatcgttgaagatattcgtattccttcaatcaacgtttctcggtatagttctcctggtaacattcgcggggatcgttatgcgaacctggcaagcactacggataagctgaacttccataaaatcaatgaaaaaggatttgatggttgtgttctgatctcaatggtggttgtcacgacacaaggcgagtacaaactgatcattgattgtgacaaagcggctcgtgcaattcccacaatcaaacaatgctttggtgaagatttcaaagtattgatgaaagcccgtgcgatggaaaagttcatccattcgtgcaaaaagaacgtgctggagaagtatgatccggcgctcacatacaccaaaattgataaagatctggtaggtgatttatgctgattaacaaagcgcagtgcaaagcgattaattttctgctacacgaactgattgaaaacggtatcagatttgaattcgttgatccgattaacggtgatgatcgtcatctgctccgctgggtgtctggtagcaatcctctggattcagtctcccaggttgtagagtctgcacttaaacatatgccttgtcgtgttctgttgggtagcgttaacgcctccacatggaatggatctgatgcttattatgtcggattcaaaaaagagttgacggacgacgaatgatgttataatatgcccctgtagacaacaaactataggggctaaatcatgaaaatcaaaaatactgctactgaaaatctttgtaacgaaatcgcggtgacttactggaaagaaggtcacgtaaaagcaatgaaggattttcaacagtggtgtgatacccagaagttagccaactgggaatacgccgtaatcgtggaacggatcaaagaactgatccttgagaagaaaggcactataaaatgattcaactgaaattagacacacaggcgctgaacaacctgttcccagaagggacacaagcgcgtatggatctgcaagccgctgtcatcaagaacgttgttgacagcgttatcggtaagcgcgtaaccgaagaaatcgaaaacatggtgatcaagcacgtcaatttgatgatgccagccaatcacgaaatcgaaaagattgtgcataaagagtttgctgattacattcagaaacgttacgcatacagcaatgttttcgatatcaattcaggcggtatccgccagatcaaagaactgatcacgacaaacgttaaaaaacagtgcgccgacctgctggattcaatcaagctggaagcaatcaacgatgcaaccggaaacctcaaagcggacgaagaagcgtttattgctcgcgtaaccaaaaacctcgaagtaacggttcgtcaggaaatcgttaagcgcgtgaataatgaattcccgcaaattatcgacgaagcgatcaaagcccgtctgttcccagaggcgaaaggctgatgaactttgaccgcatctataacatggatgtggttaacggtaaaggaatccgtgtagtgttgttcgtgactggatgtaatcataaatgcgaaggttgctacaacaaatcaacatggaatccccgcaacggtacaccatacaccgaagagactgaaaacgagttgattaaactcctttcaaatccccatgtggacgggttgacgcttacaggcggcgatccgttttaccgcaccaatcatccgacgctcttaaaactgctccagcgcgtccgtgcgacgttccctgataaagatgtgtgggtttggacgggttacaccctcgaagccttacagggcgatacagaacgctctaagctgttaccattcattgatgttctgatcgatggacggtacgaaaaggatctaccgactaagaaaccgtttcgcggttcggataatcagcgaatgattgagttcaaaaagaattccatcgaaattaaaaatatcgcttgacctggttggtagttctgttaagatatccacatcgaaacaaacttgaggacgagaaaatgaaaaacgcaatcatcaaagaaatctgtgaactggttgatgtgtatggttggagtttgggcgctgcaaaagcagaagccaaatctcgtctggaagttgtaatcaaagcccgtagcaaagatgaatttgttactaaattgcaagccctctatgagagataatatcatgatcctgaatttcaaaacccgtaaagaagcccgtgactattgctggaagtggtcgatcccgctgaaaaacatcaccaaaggaagcggttcacatccgtggacggtgagaacaaaagaaacccgcttcgaaactggcaaagattacaagctggttgatgccgaaggtttcactgacaacggcaaaaacattgctaacagtgttcagtcaaaacagatccaccaattgctgaacggtgttgtacatatcgcaagccgtaacggtgatcgctataccttcgatgctccggcaggtgttgctatgaacacccttcgtgcatgggaagcgaaatacttcacagaagttgctccggctaaagccccagcgccaaaacgcgctaaaaagccaaaaccagtaggcaaaccgtccgttgctcctgcaccagctaaaccagatctggattcagaactcgacggtggcgttaacctcgctccgacaatcgaaccagttgcgaaacctgttgcaccacagccagcaacggttgaagcgatgcctggtaactttgttgcaaaccgtccgtatgttctggtagatgtagatggtttcctgcgctctcataccgcgaataaacgcattgtgcaacacatcaaaaataacaacggagttctggtgtttgaatccgttgatggtgacggcgacgcggtgatttataaagatcgtagcctcccgtttgtaatgcatcgtgagcgtaagttcttccgtgaactcggtactggcacagttcaggcagataccccagcggttcagactgttgacattgccaaacagcaacgcgataaagagatcatcgaagctgcacaggcagtagaagatgcactggcagaacaccagaaagcgatcgaagttgtcacacagaaagctcgcgcagttcgcgaagccgctgcaaaacttgcactgctggcacgtaagtaatataattcgggggtgcttacgggcatcccctttttatttgaggtaatcatggaattattcgctggaaaaacttacggtttaaccgtatccccagaagtctttgcagaaaagacctggaaaacaggtatcgcaaacatcgttcgtgaaaaaggttatgttacaattgatcgcacctcgatcggtgagttcgaagaccgcgcatttatcatggacggtggctacgaatatgaactccctgcatcactatggaaatggttcaaggaagtaacgccggaagatggtgaattcaccccagaagaaccagaagaagttaatctgggtaaaggtgtagaggctgaaaacgttatgcgtatcgctacaccggaagaggtttccgctggtgtcactggttcggatctgtgcctgatggatatccctaaattcacgtatcgccctgtacaggaaaatcctttgcgtgatctccgcatcgatccatcatttggggctaacctggaaacgttgagcatcgcaccgatgccagtacgtaaatctgatgcaatgcttcgtttcgccttgcaacatgttttcagtggtggtagcatctatcaaatcaacatggaatctgaactgaaaatgcaggaagaccagattgcaaacctgttcgatctgcacactcagttaaccgctgttgaaaatatcgaaaaactgttaggcaaagagaaaaagcgtattttgcaggatctcaaaccatacgggaagaagaatgaaagtcgaaatatacggaatccccgaaagtcttcataactgttacgggtgtatacaagcacaaaagctgttgacagaaaaagggatagaatatacattttatcccgttctgaaagaagcgaaaaacgatctgggctttgaatacgatcgcccacgtatcgaagagttagcaaaacgggtaaggcaacgcagtttagcgtttcaatacccgcgtatttttgtcgataacaaacttatcggcggttatctgcaattgaaacaacttattggtgattaaatgagccgtgaaattttactccctgctgcaaatgctgttcatgctgaaacaatggaatacatggagaaattcgttgaacgcgataacaccgcgatcatcactcctactcacctggacgcgctcgaagatcgtcttcataagcagattaaagatcaatttcctgaaaaggttagccgcaacttcattcgtcaggaaatcgttgcaatgatactgaaacattacggcgttgaaatcttcggtgtcgaaccactgaaaccgaagaaagcacgtcaaatgcctaaacagatcaccgacgaagcaatcaagaaataccagaagaaatacgctaagaataaatgatctttaatacgattgaatgtgttccttcaagcggtaaaacaaaggcgattctgaaccatatcaatcaaacgggcgaaaaagcaatcatcgcttcgatttccatgatgttatcaaaacagtcttatgactattacatcaaccaggtaaaaggaaaacgggcggtgattgtggacacggatcaccgaaccaaaagaaccaataacgatgcgctgcgtgaagtagtcaatgattacgatgtgatctttatcactcatgcagcactcaaaaacattgatgactttgatttgtataaggatttttccctgtacattgacgaagttcctgatttggttgcgttcgaaagtctgcgatttaatagcaatatcaagcacatacgcgagatttgcttgccgtttagttgcaatgccgatgatatcgttgatttaaaacttgacgaagaaaaacgagaactggttacacgattagcctatgatgggcttcgtaaacgtgatgatatcgcaatgaagatgttcccgctttaccgtgctctgttaggggctattccggtgaagatgcaatgtagcgattcgggatatgtctgttacttcgtagaggatcatgacgtaagccagtggaagttcaaaaatgtaaccattgcttcatccaacatcaaagacacgattacagggaagatcctgcaaacgtttcatgatgtggagttcaaagattcaccgcttcaaaagctggttgactttaagcaatacaaaaacactgggcgcatacatatacatgtgctcgcagagggggattattcgcggtatacgggcgatctctctcaatctgggacgacagtatacactcagattaaaaaacgcgtggaggcgcttttagggggcgaacagttcatctattgcaccaacacatacagatcgaagtttagcgaggggcaggaaatcccgtataactcgcacggattgaacttctattcaagttatactaacgtggtggcattattcagttacaacccgttaccctggcttcgtcaaatgttgcgagcggttgcggtgtcctctggacttgaagaggaagaattagttgatgcttatgttgtcagtaaatattacgaaccagcctttcagttatgcgctcgttctgatatccgacacaacaacagcaaaagaaagattaatttatttgtgcctgatatgcggttagcgaaatacatgaaggaaaaatattttcctgatgccattatcgaaaccacagaagcagttcaaacgaaaaggcaacgcaaatcatttcaaacccttttccaaatgacggacaaagagaaaaacgcttttacgccatacaagaaaagaaacaaattagattatgcgaatcctcttcatcacgcgattgttaaagattggctgaacaattaccgtgagaaaaaggcgacttgagggtcgccttttttgtttataaatatcagtattgaataagataaaggaaaacgataatggtagctaaatcattccgcgccacaagtggccttgatgctgctggcgaaaaagttatcaacgttggtaaagcatcacgctctgtgttgagcgacggcgtgaacgttgacttttttaacgaatttaacacgatccaacaatacgattctacccgtggttatgctgcgtttatggctatcatgtacgcgcgtcgtatttggtacgctcgcgcagatattccatcaccagcgggtgctttcgatgaaacaaaatggatctcaacccgtaacgatccaaaatgggtatataacaacgtaacgagcactgacggtctccctcttgaatccggtacgtacttaatggctgatggtcgtttctctgaactgacctatattctgccagatgcccctgttgagggtgatattatcaccattaaagacggtggcggtcttgcaggggttaacaacctgttagtacgttcaaacacccgtcagatccgtttacgtgatattcagtcaagctcttatcgactgactcacccatatataaccgttgcgtttatttttaacggcaacttatggcgtgttgctgaaatgcgtgataaccgtgattcgcagtttgttaatgcgactggtttaaccgctttccaaatgcaagcgggtatggtaacattccgtaacagtggaacgggtaaaattacgttgcagttgcctcgttacgcaaatgatggtgactcaatcacaacttacgatctggatcgccttgcttcggtgaacgttgcgactctgcaagtttatcctggtagcggacacacgatcagttatgacggtatcaataacgtaccctctgtgacttcacagcgttccggttatggtattttcatgttcgatcaggctaataaccgttgggttgtttatgacggtgatcagcgcgttcgtctgcgtcgtatcagtgatgacctgaacatgttgccgaacgattacgtgttcattactcctgttgctggtagtcctccaactgtgcgtaacgttacgctgactcttccgcaagatgttgccgaaggtgatcgtgtgtatatcagtatgtacatgatggggaaaacgcagaactgcacgatcaaagttaaagatggttccggtgaaaagatccgcaccaacaaaaacatgatgcagttcccacagcgtaaggattatccgcctaatgattggttcagtgttgacactctgactttcaatgccgatactgactatcttccatacatggaattgtcgtatctgaaagatacgaaagaatgggtagttgcacagtatcgcccgatcattgaacgtgtcgatccaacaaaccgttctcgtctgggtgtgattgcgctggctacacaggcagaagtaaacaagaaccatgaagatacgccgtctgatgaactggcagtaaccccgcgtacactggcgaataaaacctctactgaaacgcgtcgtggtatcgctcgcctggcaacaactgcggaagttaaccagaacacgacagcaaccttccttgatgacgtgatcgtgacgcctaaaaagctgaacgaacgatcagcaaccgaagatcgtcgtggggtgctggaaatcgctacccaggcagaaacaaacgctggtactgatgacactaccgcaatcacgcctaaaaagctcgatacacgccgcgcgaccgaaaccctagcaggtatcgggaaactcgttacaacgggcgctacgacagcggagggggctttacgtggggatgctggtacgaacgtctacaacttcaataacggtgttgatctgatcaccccgaaatcattgaacgagaagacggcgaccgaaaagtcaaaaggtctggttgttctggcgactgaaaacgaagtggtaactggtgctgctgcgggatctgcttcaatgccgatcgtagtaactcctgaaatgctgcatcgtaaaacgtctactgaaacgcgtatcggattgattgagatcgcaacccagacagaaacaaacacgggaactgacgatctccgtgctgtaacgcctaagaagctgaacgatcgtaaagcgactgaatcacttgatggtattattgccctcgctaccactgcggaagttgcagcaggtacggtaacgaataaggcggttgttccggttaagctgaaagagttcttcgacgttacaagtcatgttgcggttgctaccgatgacggtttaactcagtccggcactatctggacaacgattaacctggggattgcgtctgctactgaaacacagcgcggtactttacgtgttgcgactcagggtgaaactgatgcgggtcttctggataccgtgttcattacgcctaagaaactgcaagcgaagaaagcgacggataccgccgaaggtattattcgttgtgcgactaacgcggaagcgggtgcgggtactgctactaacctagcaattactccggctaccatgcagttcttgaacggtactgatccggcgtggggtgcgacgacaactcgacgcggtgcggtgtttatcactacccaatcaaacactttcatcggtgataatctggttggttctactcaggccgttgacgattatctcgaagatttctatgctgtatcgcctcgcggtctgaactttgctctgcaaaacttcttaccgaaaatggcaacggcacagaatagtttgagtctgggcggtgtggttgctgcaagctggatgcgtcgtgatgcaaaccagacggtaactggaaataacacgtttaacggtacaagcaacttcgttggtaacgtaaccactaacggaacactgacggctaacgctgcggtaacggttaacaacaccgtaaccacgaacaataacattaatcagtctgcgaaagcaaacactgtttatgcaaatactgttctgagtggtgaggctgcgggaaccaaaaacttgcttcgtaccttccgtggtggtgtggcggatacgatctggcatgaaactgttcaggcaagcacgtatcgcctggcgacgggtacaacggatctggttgacgttctgacagtaggtgatgtcggtaacggcacaatggcgtattccggtacgaacattcgtctgaatggtaaagccctggctaacatcaacacggcgggtgatttgtttgttgcaagtacagcaacgcctacggtacaattacgaaccgctgcaactaatggttggaacggtgtaacaatcagtaatgacggcggcacaaccactgcaaccgtgatcaacacccgaaactttacccagcatcttgacagtacctatgtcaacgtagcgggtgatactatgactggtgcgctgtcagttagcgtaaacggtacgggtggacgctttaccagtgtgagcggtacggcacatgttcaggcaggtgatttctctgggaacgtccagaaaatgcgcttaactggcattgacgataaggtattgactgagttcaacatcaatatcaccgattacaacaaagcgatgatcaacggaaacctgatctatcatgcgggtcgtaaaccgactccggcagaaatcggggcggtagcggtagcgggttcaaccgtcgatactctggttgtacgtaactatatcaaaatcggtaacgtgaaaatcttcgcaaacccagcaactaagacttgtgaatttgtgtgggaggaataatttaaatggcgaataacgaatttatggcgttattcggccctgatagtttcacggcgaatgtgttttcagaagcaaacgccgtgaaatatcgccttgttgtccgtggaacgaataacgattctgcggtcaactcggttgaggtatctattaacggggctgatattattaacaggcggacacaagttgctcgcggaattaacctggcagtcattgatggaacaactttagcattattggattacaaatcatttgatatgtatggtgatcctgctacgaacgggaatgcgattaaagactacctgaattcacttccagcgaacagaattgtgtgtttttatactttcgatgcgatcagaagtgatgataactttttagcgacaatgaggaaaattggttctgttgcgtggcccgaaactcggttctttaatatcccgatcaccacaaccaactattctcaccgttcatcctattcagctatctattcatcaacgatgaaaaagatttgcatggaaaactttgtcggtggttctggtacggggttgaaagacaatacaacgagttttgttgaagttgtgtttgatgaatttagtgatatcggggtaactggtattcctgaaagaatgctggatgatcctcaaacgtatagcggtaatggttatccattcaaagcatacggggtttggaacgttgggagtgatgtttctcgtaatgatattttcaaaatcactgcggacatctatatcgatcaggctgcacgtaatgcgggggcagaatgttatctgtatgcctttactcatattgcgtctggacagtggatatcatcaacagttcttagaacaactggacttgctgcggatacatggcattcggtatcgggatattacactattccagataatgctgatataactcgtttgggtgtttctgcttatcattatccgtcaacagttaccacaggtcaggcccgatgccgaaatatccaattctgtaaagtccctcgcgaagaggtgaacagaaacggggcggctatcggtgtcaacggtattaggatgcaaacactttccgaagtcactgatgctggaaccgtaaacccgattgaacaattgctttctctgcctgtttcgcctgttggggttatcagtgacaagaaaattagttcgcataactttgctgaacttgattatattgtttctgatccgactgaatatacttctaccaatacagcggagtaccagttcaaagaatggactgctacccagcaagcggcggtaacgaaagcatcactaagcagttatggaataaaacctggtgatacgatccgtatgcaatgccaaatgaaacgtgatgcaacagcaatcgcaaatagtaagggcgcgtacatcgtaatgcagttctgggatgcaaacaatacgtatatctctggaattaacatgcgtgatgttggtacgatcccgaacgtatattcattctataaaaacgaaggggttattcctgctggtgcggttacgtttgatttcggtttatatcgttatccaaacaacacaaacatcggtacggtctccgctaaagacgttaaactgtcaattgtgcgttaaaggggcgaaagcccctttttcataaatacagtcattacaggagaaatttttatggctgatttgaaattaggtacaacgctgggtggtgcgggtatctggagtgcttctaaccttcctctattgccctctggtggacaattaacgtataaagggtggagagtatacacagagaacgatcgcccaacagcagaagatataaacgcactgtcgatgattaacggcggtactgttgcgaagaatactacattcagtcagaacgtgaatgtagggcaggtgttgacagcaaatgatattctttctaatactcgcgtacaaattgcaagaacaggcggtgcgggtgcaaacttaacatttcgtcgttatgacgttaccggaaccccttcttcggaaattggtatcatggatatcaacgtacacaacggttcaggtcagtttgttggtgcatttaacgttaacgcacgtccagacggcggtaataaaatatacttccgtgcatacaaagacggaacacagaatacattattaactctggattctcaaacccaacaggtaacagttgagcaaggttctttccgtgtaatcgggacttctaacctcggcttaacgaatgctacatcaatggcagttagtggcgcggttactgcgaatacagtaactccgtcaaactgggctaaccatgatgaacgttatatcacgggtattcctcgcggtatgtctggaaacagtttcggggctgctgcggttactgaaaagaacgatgttctgtcggtaggtggtaacgtaacggacggtccatatggaaacacaacatattacggtcaggttgccacatatcgccgtactctgaatagtggtgtttctctggttcagacttactatgatataacatcaacatggattcgtgctgcgacgggttctcctggtgcatggtcttatagtgcgggtgatgctaatggatggagaagaatttatgatacttcgcttcctccgactccggcggaagtaggggcagtcaataaatccggtgatgcgatgactggtgttctaacactggcaaacatatctcaaccacttaaaacacccggcggtggtattctggctaatgacgggaacgtgtatatcaacaaaagcgggttttcaggatggatcgatgcactgttcttgaaaaatacaggaggcacggtaacaggaaccatcaaccaaacaggcggttattttgatgcatcgggggaaggtagaggttcttgggcttctcaaagcactgcaaaagctccgattttccagaatattaacactacatcgacatctgaatactggcctattattaagcaatattattctcaggctggcggtgcgtggtctatgggtacgttggtaaacaccaacaggtttacagtccattaccgtactggatcggtagatcgtcaatggtattttgataactctggtgagtttgtatcttatggtgatattatttccaactcagccaacggattgcgtattgcatacaataaccgtggattctttatccgaaatgacggtggtaacacctatttcatgttaacaaactcaggtgatgcatggggaagttataataacctacgtcctttgtatataaataatgatactggtaatgtctcgatgggacatacgttatcagtcaacggacgtatcagccagtcaagcagttatattgacaatggaaatttaacattaaacggtagcggcaacggacgcgttgaatttattcgcagtggtgcaaaccctcgcgatatgtatatcttccatgctggtgatgctactcgcggaaaccgtatagaactgtcggattcatcgtcatatctggtttattttgaacgcaacccttcatccggcattcaaatgataatgaacggtaatggtagctttaacgatgtgtatattcgttctgatgaaagactgaaaagtaatttcagtaagattgaaaatgcattggataaagttgatttacttgatggtatggtgtacgacaaagcaaatcatatcgggggtgaagaaactacccgtgaggctggtttagtcgcacaacaactgcaagaagtattaccggaagctgttaagaaaggcgttgatggtgaacagaacgagatcttaactgtttcgtcttctgctgttattgccttgcttgtcaacgcgattaaagaactccgcgaggaagtcagggaactcaaatcccgctaattaaaagcccttcggggctttttctttttataaatatcataaaagcatttgaggatcttaataatggcagatttaaaagcgggtactaccgttggcggtaatactatctggagtcaggctaatttgcctttactcccttctggaaacacaatcacatataaaggctttaaaatctacaccgaaaacgataagccaacaaaggcagaaatcggattaggcaacgtaacgaacgatgcacaggtgaagaaagctggcgacgatatgaccggatctctgaaccttacaggaccggatagtcaattaactgttccgtatcgcctcctgatgaaacgagcggcaaatggcgatccctatgtgttgtttgtacgtccagacaacaacccaacaacggtcggttatccatcaaacacacttcgtgtaatgactatcactgctcgtgccgcaactacagcagatccggtttctggtgctcaattggctaacgtattagcagatcagacagcacagggtaacggatcactaacattgcaagcatttgcagccccaaatacaaccacaggcgcaagcggtgcgcgaacagcagagatttacctaaacggcaacgggcaagtatctatgacgggttccggtttaacgataggaatgcagactgttgttagtggtactatttttggtacacaaatggctattaaaggcgattcgaaccgaaacctatacttccaggatgctggcggtaatgagcttggtttgatctatgctgatacaggaaagaacttatatgttcgtactggcggtggtgcatatgcaactcgttttgcatctgatggaactttagttctcgctaaccatctaaccgttcctggtcaggctacatttaatggtctgggtgtgttcaataaccgtgcttctgtaggcgtagattatgattcgcaaggaataaactcagcgattcttcgtgttgaaacaaacggtgatggaaacggggttggtgatggtgttacccacttaggctataaagacggcaacggacgatataaccattatttccgtggtactggttcgacttctatcaacaccaaattggggcttaacgtaaacgtaccatcgtattataacgacgttccacagggcacaccagcgcaatatttcttacctactgttggacagggcgggaaaaactatttgcgtcagttccgaggcggtaacgcggacacaatctggcatgaaactgttcagggtggtgtgtggagactggcaacaggttctacagacggacaggaagaattgcagatttctactgcgggttatgctcgattccgtaacgaagttcaaagcgctacgtctggttctggtggacagttccgcgcggtacaaggaaactacggggtaatacaccgaaatgatggtggtaactactataccttgatcaccaactccggcgatccttatggaacatggaacagtttacgcccgattactatcagcttgactactggtattgtttctataggaaacggcgcgaacattaacggttctgttaactttgg

SEQ ID NO: 9-20 - skipped (12 entries)

SEQ ID NO: 21 - DNA, 40344 bp, Unknown
  source: /note="Description of Unknown: KP2-14 Bacteriophage Sequence"
atctgttatcctcctaaagtaaaccctaaagccatcacctaaagccaccacctaaagaccagacctaaagccaacctaaagccaccacctaaagaccagacctaaagccatcacctaaagagtgccgctatcttaaagacaaccagaccgatagacccattgttaacctgtagtgatgccttgtagttatctgtagtcatttcataaaccctcactaaagggaataagggatacttaaagagggaataagggatttaataaaaagatttaatttaatggttgactttaagtaacccttaaggctattattcatcacgtcaacgggacaacggccttaaagccactccctgagatactggagtcaaccggataagtagacagcctgataagtcatacgaaaaacaggcattgacaacatgaagtaacatgcagtaagatgtaccacataacgttaaccaccgctctggtgtcttctaggtgacttaagcgcaccacggcacataaagcgaaacaaaaatggttgacaacatgaagtaaacacggtacgatgtaccacatgaaagacaccgagtgtcgtaggtgtaaaaacgcgacatagtggatagatggcgaaagcacaagcgaccacgataataaagagcttgtcgcacttataacgcaagtgacggctaacactgaaatagcctcggctcaacgaaactgtagcctaaagttctttaacaatctggataatagctcttgagtgtaccgatgtataagcgaataactcaaggtcgcactgaaagcgtggcctttatgatattcacttaacacgaactaacatgaggtaacaccaaatgattttcactaaagagcctgctaacgtcttctatgtactggtgtcagcattccgttctaaccttgatgatgaggtgaacatgagtcgccaccgccacatggtgagcgaattacgtgccgcaccgggtatctacggcgagcttgagtctaccgatttgaccgggtgctatcgtgagagtatcgcactggctccaaccgaggaaaagaccatgcgtgtactctgcaagaacaaagagcaggcactacaggtagctcgcttagcttgcaatgagtatgagcaagattgcgtactggtatacaaatcacagactcacacagcgggattggtgtacgctaaaggtatcgacgggtataaggctgaacgcctgccgggtagcttccaagaggttcctaaaggcgcaccactgaaagggtgctttacgattgacgagttcggccgccgctggcaagtacagtaagtgatagactcaaggtcatgcacgatgcgtggcctttatgattatcactttttgactatgaaggaatcacaccatgcgcttaaataaagacacagcggtagctatgcggtcagcaatcgaatcaagagccgcacacaacgtgggagggattgctgatgttgcacgggtttataaggagaaagggcttacattccgcagattcatgtgggactgttatcatgcagtgggctttaaagagactacaagaatcatcgcagagcacaacacggtgacagttatcggcgggcacataacagatatcaatgattcgcacatcgaaactatgctcaaggttgcactgaaagacatagcttattagtaattaactacaggtcgttagctcgtagcggcctgaatgataattactaaacaaacctgagaggatatgactatgaaacaatacgccatccttattcccggctggtgctactcaatgacctgctacgggtacaacgaaagggacgctcgtgccagattcagggatcaacaaggcttcggcaagcgtttacctaatggtacggctgtatgggaggttatgtaatgagtaagttactggcaacctctaaaatcaaaggccaatgcactgtaacgctgcgtgagtattaccacgggtcaatgggatgcacctatgttgtgcgatacggtaaacaggtcacgcactgggtaaaccttgttttggcacaagaggagtaccaagcctgtgtgatacaccaagcaacatgtgcaggctggaacgactgacaacagacttcaagtctatcaggtggtaaactcaaggtcgctccatgcgagtggcctttatgattaacattacgatagaggatgagagtatgggatacgaagacacgaagaacctgataattctctgtatagcaatacccgctgcaatcaactttgtgtacgaggtatggattaagaaatgattatcgcactaatcgcactggtctatctgtgcatcgctatgtactttatgcgagactttaagcgcggtctggcaatacacaaggcaacgctgagttactttaagtggggattcatcccacggtttacggttcgtgaacgtaacggacgctttaaggccaacaaggtgggagtattctacattgctacgcactaactcaaaacacgtaaagattgcactgtatgcgatggcttatggtgcatcgaaacgcaaggtcaaacgcatcttaacgagacaccgcaagatgaccgcacgacaggctgcaagcgctgtcaaatgggctgaatttactctttactcttcttacagataacaggacactgaacaatgactttcaccgaagcacaagccgcactcgaagctatccgcaacctgccgattgaccgcttggatgaacgccagcccatgctggtggctcttgcggctgctatcgtgaacgatgagactcaagacggcgaactgacgcaggccaaaggcaattggggcttggagtctatggactactggcagacactggctgagcgtatgcgtgatgttggatttgtacgcttgggtaacggtcactttagcgcagcatacgagcacgcattgttaccgggcaaggttatcaaggtaggctttaagaaagaggactcaggcgctgcctatgctgccttctgccgcatgaatcagggtcgtgagggtatccctacggtgtacgacattcagcgtcatacaggctgctacacggtggtcttggactatctgacaccgcttaacgattggtgctacggtgaaagcgataagattcgtcaccactttcaggccgcacgggaaatcattgaggaggattgcttcgataccgccgaagagtacccgataagtgacgggttcattgagacctgcaaggatatccgcaagttcttcctaggcattgcatcgttcgattgtcacagcggtaacatgatgaaagaccaaatgggccgattgattatcacagacccggtatcgttcagcgcagacaacaagttaaagccgggtgagtttcactgtgacccggatgaactaatcgctgagattgaggcgctgagggcgcaggaagcgattgaccgctgtaaggcacgcaaggcacgccgtgaccctaaaggagactttcaggcagcacgtaaagcccgtgccaaatggcgcagaaaggcctctaagcgtgctaaacgtgacgctaaggtaatcgctaagatgcgcatggatgacaacgagcaacgcagggccgagccgagggcgcgcatgttgtggggcgataagcactggcgtaacgcttgggtgcagcacatgaatgttgacttcgcacggctcgaactgttagcagccgcacagatggcacagatagaccacaaggctatcgtatggggcaagccgttacacatagacgcataccttgacaagagactgcaaggttgatagagtcttttcttacaggtcatcatgaggtggcctgaataggaacgatttatccatagtgaggcaagcaatgaacatcatcgaaactatcgaaaagaatgacttctctgaaatcgaactggctgctatcccgttcaacacgctggcagaccactacggcagcgcactggctcgtgaacaactggctttagagcacgagtcttatgagttaggtgagcgccgcttcctcaagatgctggagcgtcaagcgaaagctggtgagattgcagacaacgcagccgctaagccgttactcgctacgcttctccctaagttaaccgcacgcatcgttgagtggctcgaagagtacgcctctaagaaaggccgcaagcctagcgcatacgcgccgctccagttactcaagccggaagcctccgcgtttatcaccctgaaagttatccttgcatcactgaccagcacgaacatgacaaccattcaggccgctgctggtatgttggggaaggccattgaggatgaggcacgtttcgggcgtatccgtgacctcgaagcgaagcacttcaagaagcacgttgaggaacagcttaacaagcgccacgggcaagtctacaagaaagcctttatgcaggtggttgaggcagatatgattggtcgcgggctgctgggaggcgaggcgtggtctagctgggacaaggaaaccacgatgcacgtagggattcgactgattgaaatgctcattgagtccacgggtctggtggaattgcagcgccacaacgcaggtaacgcaggctctgaccatgaggcactgcaactggcccaagagtacgtcgatgtgttagcgaagcgtgcaggagcactggcgggtatctctccgatgttccagccgtgtgtcgtaccgccgaaaccttgggtggcaatcaccgggggcggctattgggctaacggtcgcagacctttggcactcgttcgcactcactctaagaagggactgatgcgctatgaggatgtttacatgccagaagtttacaaggcggtcaacatcgcacagaacaccgcatggaaaatcaacaagaaagttcttgcggttgtcaatgaaattgttaactggaagaattgcccggtagcagacattccatcactggagcgccaagagttaccgcctaagccggacgacattgacaccaacgaggcagcgctcaaggagtggaagaaagccgccgctggtatctaccgcttggacaaggcacgagtgtctcgccgtatcagcttagagttcatgctggagcaggccaacaagtttgcaaacaagaaagcaatctggttcccttacaacatggactggcgcggtcgtgtgtacgctgtgccgatgttcaacccgcaaggcaacgacatgacgaaaggtctgctgaccctcgctaaaggcaagccaatcggtgaggaagggttctactggctgaaaatccacggtgcgaactgtgcgggtgtcgataaggttcctttccctgagcgcatcgcgttcattgagaagcacgtagacgacattctggcttgcgctaaagacccaatcaataacacttggtgggccgagcaggattcacctttctgtttcctcgcgttctgcttcgagtatgcaggagttgcgcaccacggtcttagctacaattgctctctgccgctggcgttcgatgggtcttgctctggtatccagcacttctccgcgatgctacgcgatgaggtaggcggtcgtgcggttaaccttctgccaagcgaaaccgtgcaggacatttacggcatcgttgcacagaaagtaaacgagattctcaaacaggatgcaatcaacggcacgcctaacgagatgattaccgtgaccgacaaggacaccggggaaatctcagagaagctcaagctgggaacctcaacgctggcgcaacagtggctggcatatggtgtaacccgtagcgtaactaaacgttcggtcatgacgctggcttacggttccaaggagttcggctttcgtcaacaggtactggacgacaccattcagcctgcgattgacagcggtaagggcttgatgttcacccaacctaaccaagcggctggctatatggctaagctgatttgggacgcggtgagcgtgaccgtagtcgcagcggttgaggcgatgaactggctcaagtctgccgctaagctgctggctgctgaggtcaaggacaagaagaccaaggagattctgcgccaccgttgcgcggttcactggactacgcctgacggcttcccggtctggcaggaataccgcaagccactccagaagcgtcttgatatgattttcttagggcaattccgtctgcaaccgacgattaataccctcaaggattcaggcattgacgcacacaagcaggagtctggcatcgctcctaactttgttcactcacaggacggtagccacctacgcatgacagtcgtttatgctcacgagaagtatggcattgagtcctttgcgctcatccatgacagctttgggactattccggcagacgctggtaagctctttaaggctgtgcgtgaaacgatggttctcacctacgagaacaacgatgtgctggcagacttctatgaccagtttgcagaccagctacacgagacacaactggacaagatgcctccgcttccgaagaaagggaacctgaacctgcaagacattctcaagtctgactttgcctttgcataacaagcacttagcattaaccctcactaacgggagactacttaaggtctcccactttaagacactttaggtactaagagattaaatttatgattaacattaagactttccttaagaacatctttaagttaaaccgcttgacttccgttaagttctacgcttggatgcccggtagtgatgacctccgcaagactgaatttaagttaggcttaggccgtgcggtaaggtggtcacgaagttggaatgttactcaacggcctccgggatggtcatcttccagaccactgaggacaacgaaatgaaatccttctactacccgaaaggttcaacatgtggtcgtatcgaacgggcatacagttaaccctcactaacgggagagttaaacttaaggtcatcaccagcggtggcctttgtgattaactttcaatacacatcaacatgaggtaagatactatgcgtaccaactttgagaaatttaccaagcgcgattcagtggtcaacgagcatggcgaacagtggcaagagcgccgtgaccgcatgaagaaactccacaagcaacagcgcggtaactcacagaaacgggagtggaactaatgatgggacgtatctatagcggcaacctgaacgattacaaagatgcggtagagcgtctacaggaagaccatgacgtgaccgtgaaggtggagtcattcagttatgaaaacccagcgaagatgtgcaggtcatccggtgaggttctccgtgtgttcacacgctccgggcatctggtggcatccagaaccttcgagcacagcgacagcgatgtacaaatcaacgcgcagactgcacggctccgtaaggttcacagcgatttgaaacactggaagtaataaccctcactaaagggagaacgaaaggaggaaacattatgagaatttcatttgacttaatgagtccttcctttctctcatgggatacgggtcgtcacactggcggctctattcgaaacggctatagaagggttcgttatgaaggtaagtggttaaaccatcacatactcatttgggaacacttcaacggtgcagtcccggagggaatggaagtagaccacattgaccgtaacaaacttaacaacgcgcctagtaaccttagacttgtgacccgctctgagaacaacagaaatcggtcagtacaccggaacaacaagtcaggaatcaaaggtgtctactggcacaaacaccgacaagtttggtacggtcagtgtcgaagaggaaacaaaacatttatcaccgctggttgctccacgaaggaacaggcggcagaacttttagagaaactcaaagaggaaattaattatgatgattttcaaaaccgtcccgtataaggctgtgtcattcgtagagtctgccgttaagaaagcgctggagacctccggctacctaatggctgatatcaaatatgatggtgtgcgcggtaacattgtggttgacaacgtggctgaggccgcatggttgtctcgcgtatccaagttcatcccggcgctggaacacctgaacggtttcgataagcgctggcagcaactactgaacgatgaccgctgcatcttcccggatggcttcatgctggatggtgaactgatggtcaaaggcgtagacttcaacacggggtctggcctactgagaaccaagtggctcaagaagaacaacttcatgtttgaccgtggtggtgttgagccgctgaaaggttccaaagtagcctttgagttggacactaagcgcctgagcgtgcgcctgtatgcggtcatgccgattcacattgcggagtctggcgaggactacgatgtacagaacctgctgatgccgtatcatgtggaagccatgcgcgctcttctggttgaatacttcccggaaatcgagtggcttatcgctgagacctacgaggtctacgatatggattcgctgactgaactgtacgaagagaagcgtgccgaaggtcacgagggtctcattgtgaaagacccacaaggcatctacaagcgaggcaagaagtctggctggtggaagctcaagcctgagtgtgaagctgatggtatcattcagggtgtcaattggggaaccgaaggtttagccaacgagggcaaagtgattggctttagtgtgcttcttgagactggtcgtttagtagacgccaacaacatctctcgcgcactgatggacgagttcacagccaacgttaaagcccacggtgaagacttctacaacgggtgggcctgtcaggtcaactatatggaagagaccccggacggctccctgcgtcaccctagcttcgagaagttccgaggcactgaggacaaccctcaagagaaaatgtaaccaactcactggctcaccttaacgggtgggcctttcttcgttctagggaattaaccctcactaacaggagacacaccatgtggcttatcctattcgctatcgtcgcaacgcttggattaatggctgccgacgacaacatttggcctgattgttaaggagacaacatcatgcgtttacacttcaacacatcaaatggtatcttttcggttcgccgtgaagaccgctctacagcagtggcctctgagcgcaacgccaagctgccgctgattggttcggtcgtcccattgtcgccgcgtgttcacctactgatcactcgtggagagttcattaaggcgatgaacaaagagcgcccgcatctggaagccgtggtcacttactggcctcgcatccgtctgttcgttaagtggattaaggaggttctgtaatgctacaacatcattggaacaaaccagacttagaggctcgcttcccggttaactctgctgtgcgatactccggcgacttcctcaagcgcttcttaggcatgagcggagtggtcactggtcactcgaacacaggtcgcgttaaggttcgcttcggtaatcagcacgctgagtttcttcctgacaacctgattccgctgcctaaagctgacgttaagactccgaacgtggaagcaccgaaggcagaattcaagtctgacgtgacccacccgaaccattacatgctgttcgacaacgtggaagccattgaggttatcgcccggtcaatgaccgtcgaggcgttccgtgggtactgccttgggaatattttgaagtaccgcctgcgtgctggcaagaaatctgaactggcaactatggagaaagaccttaagaaagcggctttctatcaggaactgtttgataaacataaggggctgtgttatgacgcttcgtgaatgctgcgattggtgtgccgctaagtggaaccaagctattgaggatggtgataaggcggctgctgacgcttaccaacaattgtacgcgctgtgggagcggcgctttaaggaggctcaaagtggagcaacgtgaacagaaatacctcctgacgatagaaggcaacaccgagtcctttgaggttccggtattcgcccggtctctcgaagaggcaacgctacaggctgaacattatgaggacgctgggttcgtagtgactcgcatccgtccagaagtgaaagcctaattaccctcactaaagggaacaacccaatcattaaccacaaaggagaaacattatggctggtttcaagaagaaaatctacacctctggtcttggcactgctgagccttatgcttacctgagtaagccggattatggcaacgaagagcgtggcttcggcaaccctcgtggtatctataaggtagacctgactctttccaataaagacccgcgctgtcaggcaatggtcgatgaaatcgtgaagactcacgaagaggcttatgctgctgccgtggaagagttcgaggctaaccctccgcaggcacagcgtggtaagaaaccgctgaaaccttacgagggcgacatgccgttcttcgataacggtgacggtacgactaccttcaagttcaaatgctatgcgtctttccaagacaagaagaccaaagagaccaaacacatcaatctggtagtggtcgatagcaaaggtaagaagattcaggacgttccgattatcggtggtggctctaagctgaaagtgaaatactctctggtgccttacaaatggaacaccgctgtgggcgcaagcgtcaagctgcaacttgagtccgtgatgctggtcgaactggctaccttcggtggtggcggtgaagatgagtgggccgatgaagtcgaagacggtggttacactgcgagtgaatcccgtcagtcccgcgatgagcaggagtggcaggaagacgagcacgaagaaaccccggatgaggatgaggatttttaaatggaacttaaagagaaactaaaggcttacagcgaagtttctcataacgggtgctgggagtggcaacgctaccggatgccctgtggttacggtaggattagacacggaggccgaatggaactaacgcatcgtctatcctacctagcattcaacggggatatacctgagggtcttgttgttcgccataagtgtgacaacaaatgctgcgttaaccctgagcaccttacgctaggtactcaaaaggacaacgttaaggatgcaatagaccgtggtcaattcgtctacagggagaacccgaaaggcgcaaagcaccacatggctaaacttaatgagaaacaggttatggaggtttacaactcgacacagacccaaagcagcctagcagagacctatggtgtatctcgacaattaatcagcgcgattaagagaggtaaactatggcagcacgttacgcagcacgtggagttaaacgagtagggtcatatagaagcggcttagagcagaagaacatggagatgctggaacgtaagggaatcaagggacagtatgaaatgtggtctattccctatgttgtccctgcatcgaaccacaagtacacaccagacataatcctacccaacggaatcattattgagaccaagggtctatgggatagtgaagaccgtaagaaacacttactgattcgtgagcagatgcctgagttggacattcgtttggtattctcttcgagccgctctaagttatacaaagggtctccaaccagttacggtgagtgggccgaaaagcatggtattctatttgctgacaagctgattcctgtggagtggcttaaagaacctaagaaggagataccgtgggataaactaattgcaaagaaaggagttaagaaataatggctaaggtacaattcaaaacgcgcgcttctacggaagcaatctttgtgcactgtagtgcaaccaagccaagccagaacattggcgttcgtgagattcgtcagtggcacaaagagcagggctggttagacgtaggatatcacttcatcatcaagcgtgatggcactgtggaagcaggccgcgatgaactggctgtaggttcccacgttaaagattacaaccacaactccgtaggcgtatgcctcgttggtgggattgatgataaaggcaagttcgacgccaactttacacctgcgcaaatgcaagcgctgcgtagtctactggtcacgctgctggcgaagtatgagggttcagtccttcgtgctcaccatgacgttgcacccaaagcctgcccgtccttcgacttgaagcgctggtgggagaagaacgaactggttacatctgaccgagggtgatgccatgaggatgatttgtattcgctgtgataaaccgttgaagagtcgtgtaccgtcacgtcagtgtcagtgcaaagacccaatcaaggcggaggaacacaccgaggaataattaacactcactaaagggagacttaacggtttccctttgttctcgcaactgattaaggaatgtacaatggaacgagaagacgatagtatctttctgtttcatgctccatgtgaaaactgtgggtcttctgatggtaactctgtgtactctgacgggcatgaatggtgcttcgtgtgtgaacatcgagtacccgcaaacaaagagcgtgaagcaaagttatcaacgagaagacgcacaggaggcagtaagcctatgagctatgacgtatggaatttcggcgacagcaacggtcgatactctgacctgactgcccgtggcatctcgaaggagacatgccaaaaggctggctactggctggcgaaagtggacaaccgaatgtatcaggttgccgactaccgagaccagaatggctccatcgtgtcgcagaaggtgcgcgataaggacaagaactttaagaccaccggaagccacaagagcgatgcattgttcttgaagcacctctggtctggcggtaagaaaattgtggtcacggagggcgaaattgatgcgctcactgtgatggaactccaagactgtaagtacccggtcgtatcattgggtcacggtgcctctgctgctaagaagacatgcgccgctaactatgaatactttgaccagttcgagcagattatcttgatgttcgatatggatgatgcaggccgtaaggcagttgaagaggccgcacaggttctcccggctggcaaggttcgtgttgccgtgttaccgtgtaaggacgccaatgagtgtcacatcatgggtgaagacaaagcaatcttggagcagatctggaacgcgaacccttgggtgcctgacggtgttgtttccgcgttatcactcaaagaccgcgttaaggaagctatgacctccgagtacgctgtaggtttattatttgatggctgtcaaggcctgaacgatagaaccttgggtgcccgtggaggcgaagtcatcatggtcacttccggttcaggtatgggtaagtcaacgttcgttcgtcaacaggctctgacttggggcaagcgaatgggtaaacgtgttggcctagcgatgctggaggaatccgttgaggataccattcaggacatgatgggcttgaacaataaggttcgtctgcgtcagtctgatgaagtcaagaaggctatcgcggaggacggacgtttcgatgaatggtatgatgaactatttggagacgatacgttccacctttatgactcctttgcggaggccgaagctgacaggctgttagcaaagctggcctacatgcgaacaggcttagggtgtgatgttatagtgctagaccacatctcaatcgtcgtgtctgcctctgaggaatcggatgagcgtaagatgattgaccgcctcatgactaagctaaaagggttcgctaagtcaactggtgttgtgctcgtagtgatttgtcacttgaagaacccggagaaggggaaagcgcatgaagaaggacgcgctgtgtctattactgacctacgtggtagcggtgccttgcgtcagttatctgatactatcatcgccttggagcgtaaccagcaaggtgatatgcctaacttggtgttggttcgcctgcttaagtgtcgtttcactggcgacactggaattgctggatacatggagtacaacagagaaaccgggtggcttgaaccgtctagctacactggcgaagaaggagaaggagatactggctggactgaacaagacggacagtcagacttctaaaggatgcccgtgtgggcattccgattgcgatggaatcatgtaccactaattaaccctcactaacgggaacaacctcaaaccataggagacacaccatgtttaaattcattaacactttaggcaagctggtagtaaaactgtacttcatcgaagccaagaagctggacaagaaggccaaagctgattcacagcgagccattgagttggcgaaacagtcccgcgagaaatccgatgcggctgttagtggcatccacaagtcggcagcgattgcagccaaagcacagtccatgagcaaattctttgagtaaggatcgaacactatgagcaagtcaatcactcacgcaaacaccatccgtctgccagacaccgccgaccagttctcccgccgagtacacatcaatgtgcgcggcgagaaggtcacgatggtctaccgctggaaagaccacaagtctccgaaagcacacactcaacgaatgaccttggatgacaagcaggtcggtcgcttgatgggtgcccttactatggctgctgacaaggtggtcggtgataaccgtgagcgtctggtagagttcggcgctggtatgcaagagattatcgagaagtgataaactcaaggtcgcccaagggtggcctttatgattatcatttagcacgaaaccaaaggagggcattatgctcgtaagtgacattgaggccaacaacctcttagagaaagtcaccaagtttcactgtggcgttatctatgactaccgtgatggtgagtatcatagttatcgtccgggcgacttcggggcgtatctggatgcgctggaagccgaggtgaagcgaggtgggcttattgttttccataacggtcacaagtatgacgttccggctttagagaaactcgcaaagctgcaactcaatcgtgacttcaagttaccccgtgagaattgtattgacacattggtactctcgcgtttacttcatgcgaaccttaaagacacagacatggggcttcttcgttccgggaaactacccggtcgtcgcttcgggtctcacgctctggaggcatggggttatcgcttgggcgagatgaaaggtgaatacaaggacgacttcaaggctatgctggaagagcagggcgaagagtatgttgatggtgctgagtgggtttcgttcaacgagccgatgatggcgtataacgttcaagacgttgttgtcactgtcaagctcttagagaaattccttacagacctccactacttccctgctggtatggacttcacgaagtacgatgcggatttattctggcgtgaagctggcgagtctgtggatattgaacatcgtgcagcgtggctgttagcgaagcaggagcgtaacggcttcccgttcaacacacaggccattgaggaactttatgtagaactggcagcgaaacgcgccgaacttctgcgaaagttaaccgaaacgtttggctcgtggtatcaaccgaaaggtggtaaggaactcttcaagcacccacgtacaggcaagccactgccgagttatcctcgcgtggtctatccgaaacagggtagcgtgtacaagaagcctcgtaataaggcacagcgcgaaggtcttgaaccttgcgacttggacacgagggactacatggagggtgctccgtatactccggtagagttcgttacgttcaagccaagtagccgtgaccacattcagaagaaactacaggaggccggatgggttcctgagaagttcaccgagaagggtgcgcctgtggtggacgatgaggtcttggagcatgtacgagtagatgaccctgagaagcaggcgtgcattgacttgattaaagagtacctgatgattcagaagcgtatcggtcaggcggcagaaggagacaaagcgtggttacgttatgttcaagatgacggtaagattcatggagccgttaaccctaacggtgcagttactggtcgtgctactcatagtttcccaaaccttgcacaagtacccggcgttcgttctccttacggggagcagtgtcgtagcgcttttggtgctgaacatcatttggatgggattactggcaagccgtgggtgcaagcagggatagacgccagtggcttagagttgcgctgtctggcacacttcatggctcgattcgacaacggagagtatgcgaatgagattctcaacggtgacattcacaccaagaaccagaacgctgcggaactcccaacgcgagacaacgccaagaccttcatttacgggttcctttacggagccggagatgagaagattggtcagattgttggggcagggaaggagcgcgggaaggaactcaagaagaaattcttagagaacaccccggcgattgcagcgctacgagaagctatccaacaatctctcgttaagtcttccgcttggattggcggtgagcagaaagtacagtggaagcgccgttggattaaaggtctggatggtcgcaaggttcacgtcaggtctccacacgcagcgctcaacacattgttgcagtctgctggtgctctgatttgtaagctgtggattatcaagaccgaagagatgctcattgagaaaggcttgaagcatggctgggatggtgactttgcgcagatgggatggattcatgatgaagtccagattgcgtgccgaacagaagagatagccaaggtcgtcgtagaggtagctcaagaagctatgcgctgggttggtgaacattggaacttccgttgtcgcttagacacagaaggtaagattggcccgaactgggcggtttgtcactaaggagtatttatgggaggcgtggctacactaaggttccacaagatgccgaccgggtgtgtagtctgcgtttcacataagcgcaatcacgatggctacttccggtacagtatagggtcgtccagaaagggcgagaagaaatgctttatgtttcaccgctgggtttgggaacgacaccgtgggcctataccagaagggtatgagatagaccacttgtgtctcaaccgtgggtgctgcaacgtagaacacttacagtgcataccgaagcgtgaacacataatcaaaaccaacaaagagcgcagtctcgtaaaggagaaacattatggcaatgaccaaacactttaaagtaaccttcgacgttaccgctgtgattgacagtgaatccgagaagaatctgaacgagttgctggtagacctagctaagaaggccggggctggcgagaagctgaatccgttcaaacaagaactgcttattcaaggtctgacacacgggccggaaggtgctgctgcgttctgtatcaagcaaggtctccgtgagtttatccgcgatggtcacagtgagttaagctctaccgagcagaagctgatgagattctcacctgcaaccgtgcgcgaggtgttcaaatgagtgaatacctgaaagttctggcagctatcaaaggttgccctaagtcctttcagtcgaactatgtgcgaaacaatgcggctctcgtagctgaggccgcttctcgtggacacattagctgtttgactgtgggtggtcgaaatggtggagcatgggaggtcacagcctctggtgtgcgcttcctgaaacgaatgggaggttgcgtatgattatgcctaagagtgacaccgtaacgatgacccgtgatgcgtggaacgatgttagcgcgtatattgataagctggagaaagacctagagttcctgaatgcgcttaaggcgtgtggtgtggataattgggacggatactctgatgcagtcgaaatggtttacggggaggatgacgaatgagcctaatcacattgaaagacttcgtggagatgcgtgaaggtaagcctatggagaatggagtgctggtcatggatggtgactggttggtatatcagtcaatggctgctgccgaagttgagacggattggggagatgacatttggactcttgagtgtgaccacgccaaggcacggagcattctcgattctgcaatcgaatcgtaccgaacccgtaagaaggcttggagtgacgctatggttgttctggcgtataccgacgatgtgaactggcgtaaggtactggttgatgagacctataaggagaaccgtaaggcgacccgtaagcctgtgggctaccgtgacttcctgtcgaagttgtgggagcgcgatgagttcattcacatcaaagaggacatgctggaaggtgatgacgttatgggtatcattgggtctggtcacgaggtcttcggcttcaagaaagctgtgttggtctcctgtgataaggacttcaagactatcccggacgttgacttcctgtggtgtaccactggtaacatcttgacgcagaccaaagataccgctgattggtggcatctcttccagaccatcaagggtgatatgactgatggctactcagggattcccggctggggcgatacggcagaagccttcctgaatgacccgttcattgtggagcctgtagagtccgtgttgaagtctggtaagaacaaggggcagacagtaaccaagtgggtgaagcgtgctcctgatgcgactgagacgctgtgggactgcattaaatccattggtgccaaagctgggatgaccgagcaggaaatcatcaagcaaggccagatggctcgcattcttcgcttcgaggaatacaattacattgacaaggagatttacctatggacgccgcaaagctgattaccgtcgctgtgctggtaggtatgctggcgcgaggtctctggatgttcgctctcatagtccgagacgttaatcgagactccgagattaagtgataaactcaaggctctctgtattaaccctcactaaagggaagagggagcctttatgattattactttaagacttaaccttaagaggtgaaattatgttacaaccaattaatcatgttttaactcatcccgatgatattcctagtatgcctcgtgcagctaaagagtatctacaggtgcgcttcaatcaggcctatgtggtggagtccggggagtaccgtgcgctccgcgctgcgggttactctgagtctttcattgctggtgtgatgcatggtctgtaccttgcctctcgaacacttgatgagattgaggtgcgtaaagagcaactgagacaggagtaattatatgtgctggaaaccgaaggtgaaagtccctaagatggacactaaccagattcgcgctgctgaaccagcacctttgactgaacctccgaagtctgtggtatggggaggcgatgatgacgaggacaccagcgtgtcttcctctgaggtgccaacctcaccgagcagcggtaagagcagtctcaaggtaaagctggatgacagcgcagccaagaacaagagtaaatcctccattcgctcaaaggcgtttgggtaactgagtcatagtatagggagaaacatcatgggattcttcaagaaaatcaagaaggctgttaagaaagttgtgaaggaagttagcagaccagtcgagaaggcaggtaaggaagttggtaaggttgttggaggcgcgctgggtgcaggtaagcaggagattatccaacaagaggctccagcaccagtagtagctgcaccgccaccagcacagattgtagacgtacctgaacaggataaggctgagggcgaggatgaggcgcaaaccgagagcgcacgtaagaaggcacgcgctggcggtaagaaagcacttagcgtagctcgcagttccggcggtggaatcaatatctgaggaggactgaatggctgattcaaaacgtacaggattgggcgaagacggtgctaaagctacctatgaccgcctgacgaacgaccgtagagcctatgagactcgtgcggaaaactgtgcgcaatacaccattccgtccttgttcccgaaggagtccgataacgaatctaccgactacacgactccgtggcaggctgtaggtgcgcggggtcttaacaatctggcctctaagttaatgcttgcgttattcccgatgcagtcgtggatgaagctgaccattagcgaatatgaggcgaagcagcttgttggagaccctgatggactcgctaaggtggacgaaggtctgtctatggttgagcgtattatcatgaattatatcgaatccaacagctaccgtgtgacgctctttgagtgcctcaagcagttgatcgtggcaggtaatgcactgctttacttaccggaacccgaaggtagctacaatccgatgaagctgtaccgattgtcttcttatgttgtccaaagagacgcatacggcaatgtgttacagattgtcactcgtgaccagatagcctttggtgctctcccggaagacgttcggtctgcggtagagaaagctggtggtgagaagaagatggacgaaatggtcgatgtgtacacccatgtgtatctcgatgaagagtccggcgattacctcaagtacgaggaagtagaggacgttgagattgatggctccgatgccacctatcctactgacgctatgccctacattccggttcgcatggttcgcattgatggcgagtcttacggtcgctcctactgtgaagaatacttaggtgacttaaggtctcttgagaatctccaagaggctatagttaagatgagcatgattagtgcgaaggtcataggtctggtgaatcctgctggcattacgcagccccgtagattaaccaaagctcagactggtgacttcgttcccggtcgccgagaagacattgatttccttcaactggagaagcaagctgactttaccgtagcgaaagctgtgagtgaccagatagaagcacgcttatcgtatgcctttatgttgaactctgcggtacagcgcacaggtgaacgagtgaccgccgaagagattcgatacgttgcgtcagaactggaagatacgcttggtggcgtatattcgattctgtctcaagaactgcaattgcctctggttcgtgtgctcttgaagcaactccaagcaacctcgcagattcctgagctaccgaaagaagccgttgagcctactatcagcacaggtctggaagcaatcgggcgtggtcaagacctcgataagctggagcgctgtatctccgcttgggctgctctggctcctatgcagggagacccggacattaaccttgctgtcattaagctgcgcattgctaacgccattggtattgatacttctggtatcctactgacggacgagcagaagcaagcactgatgatgcaggatgcggcccaaacaggtatcgagaacgccgccgccactggtggggctggtgttggtgctctagcgacctcaagtccagaagctatgcagggtgcagcagcacaggctggcctagacgccacctaataaccctcactaaagggagacctcatctttgaaatgagcgatgactaaaggttggagtcctttggtttccctttatctttaacaacttaggagatttaacaatggctgaatctaatgcagacgtttatgcgtccttcggtgtgaacaacgcggtaatgaccggaagtacacctactgaacacgaacagaatatgctgagtctcgatgttgctgcccgtgatggcgatgatgcaatcatacttagcgaggaacctagttcttatgacgatgacccttatgcggctggtgaagacccattcgctgatggtgaagacgatgagggccgcattcaggttcgtatcagtgaagatggtaacgaagctgagttcgacactggtagcgataacgctgaggtggataccgaaggtgaggccgctgagtttgagccgctgggtgacactccagaagaactgagccaagtgactgaacaattaggtaagcacgaagaaggctttcagtcgatggtcgagcaggccgttgagcgtggactgagtgcagagtctgtgactcgtatctacgaagagtacgaagccgatggcatctctgagaaatcctatgcggaactcgaagctgctggatatagccgtgcctttgtggactcctacatctccggtcaggaagcccttgtagaccagtacgtcaatcaggtggttgcctttgctggtggtaaggagcgctttagcgcaatctatacgcaccttgaagcgaccaacccggctgcggctgagtcccttgagactgccatgatgaaccgagacttggcgactgtcaaagcaattatcaatctggctggtgagagttacacgaagaaattcggtaagccagccaaccgtagtgttaccaagcgtgctactccggttaaacctgtagctcgtcagaaagagggctttacgaatcaggctgagatgattaaagctatgagtgacccgcgttaccgtagtgatgctgcctaccgtcaaatggtagaacagaaggttatcgactccagtttctaattaaccctcactaaagggagagaccatagatgactacaatggttgaatcacctgagcacagaactttgtggacgctcccgtaggtgaaacattgagaaccaactcgattcaagtagtaaccaaacttttctttaaattaacataaggagattcaacatggctaacattcaaggcggacagcaaattggtactaatcagggtaagggtcagtccgcagcggacaaattggcgctgttcctgaaagtgttcggcggtgaagtcctgactgctttcgctcgcacctccgtgaccatgcctcgtcacatgctgcgctctattgcttctggtaagtccgcacagttccctgtgattggtcgcaccaaagccgcttacctgaaaccgggtgagaacctcgatgacaaacgtaaggatatcaaacacaccgagaaggtaatcaacattgatggactgctgactgcggacgtgctgatttacgacattgaggacgcgatgaaccactatgacgttcgcgctgagtacaccgcacagttgggtgaatctctggcgatggcggctgacggtgctgtgctggctgaactggctggtctggttaacctgcctgacgactccaatgagaacatcgagggtctcggtaagcctaccgtactgactctggttaagcctaagactggcgacctgactgacccggttgagctgggtaaagcgattatcgctcagttgactatcgctcgtgcgtccctgaccaagaactacgttccggctgctgaccgtaccttctacaccactcctgataactactctgcgattctggccgctctgatgccgaacgctgcaaactatcaggcactgattgaccctgagcgcggtactatccgtaacgtgatgggcttcgaagtggttgaggttccgcacctgaccgctggtggtgctggtgatacccgtgaggatgccccggctgaccagaagcacgctttcccggctacttccagcgctaccattaaggttgctctggataacgttgtgggcctgttccagcaccgctctgcggttggtacggtcaagctgaaagacttggctctggagcgcgctcgtcgtgcgaactatcaggctgaccagattatcgctaagtatgcgatgggtcacggcggtctgcgtccagaagctgctggcgctatcgtgctgccaaagacttcgaaggcttaatggtagcgcctttgagtatgaacgcggagagtgaagtggagccgacccaagaggtagccgccgaagtagctctcacgcctcaacagaaggccgccattactcgtgctcgtaacaaggcacttaagtctcaataacaacaagcaaaccccttgggttccctctttgggagtctgaggggttttttgctttaaaccctcactaacaggaggtaacatcatgcgctcttatgagatgaacattgagaccgcagaagagctatcagccgtcaacgacattctggcttccatcggtgagccaccagtatcaacccttgagggtgatgcgaatgctgacgttgcgaatgctcgacgtgtactcaataagattaaccgacagattcaatcacgaggatggacattcaatattgaggaaggtgtgactcttctaccggatgcgttctctggtatgattccatttagctctgactatctgtccgtaatggcaaccagcggtcagacccaatatatcaaccgtggtggctatctctatgaccgctctgcgaagactgacagatttccttctggtgttcaggtcaacctgattcgtctgagagagttcgatgagatgcctgagtgcttccgtaactacatcgtcaccaaggcttcacgccagttcaacaaccgattcttcggtgcgccggaggtagacggagtgttgcaggaagaagaacaggaagcgtggcgtgcgtgcttcgagtacgagttagactacggcaactacaacatgcttgatggcgatagtttcgttcagggtctattgacgcgttaatagtaaggaggcacttatgccagcacatagaaaagaaataatcaacgggtgtaaagagtgctctaagtgcctcacagttaaaccgttggaagagtttggtaagtcgagcagaccgggtggtcaatcccaatgcaaagagtgccgtcagtcaggtaagcgcggcaggcctgtaagccccacacaacgtgagtctcaccgggcgtgggtgttgctgaacacctatgggataaccgttgatgattttaacaaaatgcttgaggatcaagcgggtgtttgtaagatatgcggtaagggcccttctggtcgattcaagcacctgtgcgtagaccactgccacacaactggacaggtgagaggactactatgccacgcctgtaacaagtcattagggttccttgaggatgaccctgataggattaaacgtctaatagcttatttaggaggtacacaatgtcactaattagccagtcgattaagaacctcaagggcggtatcagccaacagccagatattctccggttcgctgaacaatgtagcgtacagattaacggttggtcttctgagtccgagggtctccagaagcgcccaccgatgattcaccttaagacccttggcgctgctgggtatgtgggtgcgcaaccttacgtgcatcttatcaaccgcgatgagttcgagcagtatttcgcggtgttcactggtgaagacattaaggtgttcgacctcgatggtaaggagtaccaagtacgtggagaccgctcttatgtacgaacagccaacccacgggaagaccttcggatggtaacggtggctgactatacctttgttactaaccgcaaggtggttgtgcagagtaacgaccaatcggtcaaccttccgggctttaaagaccaaggtgatgcgctgattaatgttcgtggtgggcaatatgggcgtagactctcaatcgagttcaacggggctgagcgtgctgctattcaactaccagacggctcacaaccagcacacgtcaatgaggttgacggtcaggccatcgctgagaagctggcggctcagttgcggaataacctaggtaacccaaacaatgaacaaaacccaaataagtggcgcttcaacgttggccccggattcatccatatccttgcgccaaataacgataacgtttggggactacagactaaggatggttacgcagaccagctaatcaaccctgtaacccactacgctcagtcgttccagaagttgcctattaatgctccagatgggtacattgtgaagattgtaggtgacacctcaaagactgccgaccagtattacgttaggttcgacctcaaccgtaaggtgtgggtagaaacaatcggctggaacacaaggacttacctgcactaccacacgatgccttgggcgctggtacgtgcttctgacgggaactttgacttcaagtaccttgagtggggtgctcgtactgttggagatgatacaactaacccatacccatcgtttaccggacagacaatcaatgatattttcttcttccgtaaccgtttaggcttccttagtggggagaacatcatcttgtctcgcacctcgaaatacttcaacttcttcccggcctccgtgtcaaactactccgacgatgacccaatcgacgttgcggttagccacaaccgggtgtcaaccttgaagtatgccgttccgttctcagaagagttactcctatggtctgaccaagcgcagttcgttctgacagcttctggtatcctttcgagtcgctccgtagagttgaaccttacgactcagttcgacgtgcaagacagggcacgcccacatggtgtaggacgtaatgtatactttgcatcacctcgcgcttccttcacatccattaaccgatactatgcggtacaggatgtaagctctgtgaagaacgcagaggacatgacggctcacgttccgaactacataccgaatggggtattcagtatatcgggtacaaccgctgagaacttcgcggctatccttacgagcggagcaccgaaccgggtgtatatctacaagttcctctatattgatgaagaaatcaggcagcagtcgtggtctcattgggactttggggacaacgttacggtgtttgcagcacaggtgataaactcaacaatgactgtattgatgagcaatgaacatgctgtgtggatgggacgcttgcacttcacgaagaactccatagacattccgggagagccttacagattatacatcgacgctaagaggaaatacaccatccctgccgggacgtataatgatgatacctaccagacgtccataagcctcgcagcgatttatgggatgaacttcactaagggtaaagtgtctgtggtcttccctgatggaaagattatagaggtagacccgccaatcaacggttggagcagtgacccggtgttacgacttgatgggaaccaagagggccaagtggtttacattgggttcaacatcccgttcacttatacgttctcgaagttcctcattaagaagactgctgaggacggctcgacggctaccgaggatattggtcgcttacagcttcggcgtgcgtgggtaaactatgaggactctggagcgttcaccatccgtgtgaacaacctgtcccgtgagttcatctacacaatggctggcgctcgtttgggttctgacaatctgcgtgttggtaggtcgaacattggcacagggcagtaccgcttcccggttgttggaaacgctcagacgaacatagtaactatcgagtcagatgcgtcaactccactgaacatcattgggtgcggctgggagggtaactaccttcgtcgttcttcgggcatttaacttaaagtctccctgcggcgaattaaccctcactaaagggagacactaatagatacgaggggttaaagcattatgtacattacaaagtgtttacaaatccatgccgacaactttcagccgtccatagaggacattctggaagctgaggcactaggtgttgaaccaaaggtaattcctgatgagaacactgtggcaatgcttagcgataacgctgtgttggcaattggtggcaatcagggagaccgagtgtggttccttacctctaagtacgtcccactgtttaacttaaaggagcgcttagagtttcgcaagttaatagtcgaatatcgtgatacgatgctgaaccagtacgagtccatttggaacttcgtatgggtaggcaataagtcacacattcgtttcctaaagacaatcggagcggtattccacaacgagtacactctcgatggtcagttccaactattcacaatctcaaggaggcagcgtgaagagatgtaagaaatgcggagaacttaaggctgtctccgagttctataaggacaagaagagtaaggacggcctacggagtcactgtaagccctgtcactacgtgtattacaagaaggactactcaaaggcgcgagagtttaaccttaagcgactgtacggaattactctggaagaatatgaagcgatgctccttaagcaagatggagtgtgcgctatctgcggtcttaccgagagagttgagggacgggcgttagcggttgaccattgccacgccactggcgctgttcgtggtctcctttgctctgcctgtaacatcgctcttgggaagttcgaggacgacaccgagcgtcttcggaaggcaataacatacctaggagggaattgattatgtgttggatggcagcaatcccaatcgccatgatgggtgcccaagctctaagtagccagaacagtgctgacaaggcacgagtggcacagacagaagctggacgccgacaggcaatggagatggtcaaagagatgaatatccaaaatgccaacgcctcgctggaacaacgggacgcccttgaagctgcatcctctgagttgacttcacgtaacatgcagaaggtacaagctatgggaaccatccgtgcagctatcggcgagagtatgctagaaggcgaatccatgaagcgcatcaagcgtatcgaagagggcaactacattcgggaggcaaacagtgtcaccgagaattaccgccgagactacgctagtatctttgcgcaacaattgggacgcactcagtccacagcaagtcaagtagatgcagtgtacaagagcgaggccaagggtaagtctggtctgatgcgtgtactagaccctctgtccattatgggtcaggaagctgcaagtcaatatgcggctggtggatttgacaagaaaggcggcaaccaagcagcacctatcagtgccgccaaaggaaccaagaccgggaggtaataatggctagtaaactaaatagtgttttaggcaatatggcgactcccggtatggaacgactccggggcgtcaaaggtatggactaccgggcagcaaccattcaggctgaacaaccaagggcgagtcttctggactccattagtcgattcgctaaggctggtgccgatatgtatatggcgaaagatgaacgtgataagcaacgagccgatgagcgctccaacgagattatccgtaagctgacccctgagcagcgccgacaggctatccagaatggtacactgctgtatcaggatgacccatacgcaatgcaagccttgaagttcaagacagggcgtaacgctgcgttcctcgttgacgatgaggttcaacaggccatcaaagagggtcgcttccgtactcgtgaagagatggagcagtatcgtcactcacgcctacaggaacagtcgaagtcgttcgctgagcagttcggcatcaatgagatggatgaggagtaccagaagggtttcaatgcgaacatcaccgagcgtaacattgctctgtatggcgcacatgataccttcctgagtgaccaagcgcagaagggtgctatcctgaactcgaaggttgaactcaacggtgtcctgtctgaccctgacctactgtctcgtcctgagtccggtgagttcttccagaactacattgacaactccttggtgacagggatgaccgacaatcaggctcagcaggttatctcttcgtccttgaatgacgtgctacagcgtccgggtggtgccgccttcttgcagaacattgagaaccgcaaggtaactcttaatggcgctacgactacctatcgtgaactgatgggtgatgaacagtggcaggccatgatgattaaggcacagcacactcaattccagaacgacgcgaagttgactgagaggttccaactgagtatcaactctgcgcttaaccaagaggatactggcaagggatgggaggcgctccaaggtatcaaggcggaactcgacaagattcagcctggagaagaacttacgcctgagcgccagcagctcaatgatgcccaagcgcatatgcagacgcgcttcaaacaagaggccgctgagactgcgaagctgatggacaagcagcgtaagaccctgaataaatctttggtcatcgacaagcagttccagaagagaatcaatggtgagtatgtctcaactgactacaaagatatgccaacaaacgagaacactggagagtttgtccatagtgatatggtgaactacgcgaaccagaagttagcgcagattgacgctatggacattccagaggcgcagaaggatcgcatgaagttgcagtacctccaagctgactctaaagatggtgcattccgcactgctgtaggtcagttggtgtcagatgctcgtggtgagtggaaggcggctgtcatcaatggcgagatgcctgatagcacaccagcccttgactccctacgcaagatgcgcaacattgaccccggattgttcgcagcactgtatcccgacgatgccgagctgtttcacacaatggatcaattggatcgacaggggataaagccgcaagccctcattaacgccaccaaatcccgtcaagggaaaacgcgtgaaatgcagattgaggatgagcgtgcgttcagcgagctgatgaacaactctgagcagcccgaactgaaataccttccggcttccatgcgtgagtacgctcagattatttatgactctgagaagtacctaacaggaaaccctaaggatgccatatcagcggttagttcgttcctaaaggacactacctatacattctcttcggataacgtagatggtggaacctacggtgtaatccctcgcaacatgatgcaggtaacagatgaccctaaatcttgggagcaaggtaaggatatcattgagcaagctgttaagaagtaccaagagcaaaacccttgggttaccaacaaacagcttaaggttagccaacagggtaacttaatcaagatttacgataccactaccaacttgggcataagttatgataacgcactgctacgcaaggtgtataagaactatgctgagcaacaggctgcatcggctgagaagaaagccttaacggaagccaataagcgagcacctatcgtcgcggcaaccaaggcccgtaaagaagcagctaagcgtgtccaagagaaacggaacaaggttcctaagtttatctatggacgtaaagaagactaacagtaaactataaggaggctccatgagctacgacaagacgaaaccatccgagtatgatgggttatttcagaaagcggcagatgaacatggggtctcctatgacctgcttcgtaaattagcattcaacgaatctggcttcaatccgaaagccaaaagccctaccgggccgttgggtatcatgcagttcactaaaggtacggcagcggggcttggactcaaggtgacagggggagatgacgatgagagattcaaccctgagttggctgtggacgcagcagctcgtcacctgagcgacctcgttaggaaatacgacggggatgaacttaaagcggccctagcgtacaaccaaggagagggacgcaatggcgctccacaaatgcaggcttatgaccgaggcgattgggcctctatcagcgaggagggccgcaactacatgcgtaaacttctcgatgttgctaacagcccgcgcaagggagacttggaggcgttcggtgggataaccccaaaggctaaagggattcctgctgaggacgcctttgctggaatcggtaaggccgggaaggtaggaactgagcttccacaatcaactggctttaagctggagggtgtggaacaacaggaacctgccgtaccgttcactaaggatttctacgataaacatggaactaccgttgaggaatatgaaaaccgttcaacattcttcgggataaaggacaccacaagtgccgagcttcataactcgctattgggtgttgccttcaatgctgcgcgttttgatgatagttttgacatcttcaaggacgctattaccccaactcgatggaactcctaccagccgacagctgaggatcttgacaagctccgcaacagtgggcttcctccgagttactactcagtggtgacaggtggtgacggtgataactgggatgacctgattaagatggcgaagagaaactacgagatggacgtgaaggctgctgatgctggtgtgggagcacaattggttggcggaatcgtgggagctggtgttgacccattgagctatgtgccgcttgttggtgttgctggaaagggtctcaaggtggtaaacaaggcgttcgttgttggtgcccaaagtgcagccttgggcgcagtttcagaagctgttcgcacatccgttgctggtggtgaggcgcactatcaagatgcaatccttgggggtcttatgttcggggccgggatgagcgcaatagctgatggagtgagtgcagcattgggccgtgttcgcgctggtcaagttagtaacgacttcgaccgcatggctactcgactggaggcgcgtgagtctgcctttcaagctggtggcgaggacttaacacgtatgccaacagagggtcgtacatttgacggggaacatgcgggtgtaaactactctcaacttgaaactgaaccgggggctgtggtgctgccgcaaggtcaaatcttgagtgacaccaacccgattaaccctcagacacttcatgagttcgagcaggttaaccctgagcgagcggctcgtggtatctctttgggtggattcgctgagatcagcctcaagacccttcggtcggagaatgagactgtgcgctccattgcgagtgaccttgtgcgttctccgacagggatggaatcaggctctaacggtaagttcggtgcgactgcttctgacattaaggagcggctccacgcgaacaatcagcgcacctacaatcagctttatgatgctgtgcgtactgcaatgaaagaccctgagttctctacaggtggtgtgaagatgagccgtaaggaagtacgtcaggaaatctataagcgtgctgccttagcgattgagagaccagagctacaatcgggactcacaaagggagaacgtaaggtgatggatatcctgaaacaacacttcgacctcaagcgagaactcatggaaaaccctgctatcttcggtaacgccaaagctcgtagcatcttccccggctcacgccataacggaacctacgtgcctaatgtgtatgaccgcgccataaagttgtacatggtgagtcgctacggtaacgagggactacaacgggcaattgcagagtcgtggcttacatcttaccgcgctcgtccagaagtcaaggcgagagtcgatgagtacctgatggagcttaacggtctcaagacggtacaggaagtaacaccagatatggttcagaagcacgctatggacaaggcgtatggtatatcgcacactgaccaattcacttcctcctctatcattgatgaaaaccttgagggtctggttggcatcgagaacaataacttcttggaggcccgtaacatgttcgacagcgacatggctgttaccctcccggatggtagcacgttctctgtgaacgacctgcgtaactacgatatggctgacattcttcctgcttatgaccgtcgagttgacggtgacgtggctatcatgggtggttcgggtaagacgacgaaggaactgaaagatgaaatcatggcgctggacaagcagtctgagggtaacggctcactgaaaggtgaagtcgaagcactcaaggacaccgtgaagattctgactggtcgtgcccgcatgaacccagagggagctttcggtacgattcttcgctccatgactgacttggctttcttcgctaagaacttctatatgccgttccagaacttcactgaggttgctgctatgttgagtaaaggaaacacctctgcggtacttcatggaatcccactgcttaacgattgggttagccggaggaagcctatgagcggctctgagattaaggagattcacagtatggtgttcgggaaggaactagaccagcttatgcgtccggggcgcgaagaccatatccgtcgccttcgggagtctactgacactaacgcagtggtggctaatgtggttgggactattcgcttcggaactcaggaattgtctgcgcgctcaccttggacgatgctgcttaatggaacctctaactacatcatcgatgctgccagacagggtgtactgggtgatgtggctggggcagcgctcgctgggaaaggatctaagttcggtaaagcgaattaccttaagtctgcctctgtgtcacctgagcagtggaagggaataaagcagttgttccgtgaccacgccactcgtgatgctgacggtaagtttacaatccgggacaaacaggctttcgccaatgacccacggactatggacttatggcgtctggctgataaggttgctgatgagactatccttaggccgcataaggtttcctcacaggacgccaaggcttacggagcggctgtcaagatggtgatgcagtttaagaacttcgtaatcaagtctcttaactcgcgcttcgtcagattgttttatgacgcgactaagaacaacagggctatcgattctgcgctgactgcaatcatctctatgggtctggctggtggttactatgttgctcaggtgcacttgaaggcttacggcctacaggagcacaagcgtaaggagtacctaaagaatgctcttgaccctaaaatgattgcccacgcgtcattatccagaagttcacaccttggttccccactgtctgtctatgatatgattggtggcttgttcggtaatgatacctaccagtacacccgctcaacggtgttaccaaaggaaaagaccgaacgtgaccgaaacaaggcttggactggtaaggaggttgcgggtaacatagtaggggcgatatccaaccaagtaccagctgtaggactagttgggaatattgggtctaccgccatgaatgcctctacgctacttagctctgatggtaagcagagtgaggtagagttccgtactggtgtgttcaacgccatgcgtgagcttgtccccaatgacccgctgacacaacagttgattatgcacatcttcgaagagcagggcatcaagattaaggatgatgcaacacgccctcgccaataaaccctcactaaagggagagaggtcacattctggcctcttctctcttaatgctaatttacaaaggaggtcacatggctacaaatattaagaccgtgatgacttacccgctggatggctccactacggacttcaatattccgtttgagtatctggcgcgtaagttcgtcagagtgacacttatcggtgttgaccgaaaggaactcatcttgaatcaagactatcgttttgcaactaagaccacaatctccacaacgagagcattggggccagcggacggttataacatgattgaaatccgtcgatttacctccgctaccgataggctggttgacttcaccgatggttcaatccttcgggcatacgacctgaacatctctcaggttcaaacccttcacgttgcagaagaggctcgtgacttaacggctgataccattggtgtgaacaatgatggcaaccttgatgctcgtggtcgtcgtatcataaacgtagctgatggtgttgacctcggtgatgttatcactttaggtcaagtcactcggtggaacgagtctgccctgaactctaagaacgccgctgctacctctcaggccgctgccaagacctcagagaccaacgctaagacctcagagaccaacgctaagacctctgagaccaacgcgtaccaatgggcgcagcgtgctgaggactctccggtacagggtagcgagttctctgcgtatcattactccctcaagtccgcaaaaagtgcaacagccgcgcatacgtctgaggtcaacgctaagacctctgagaccaacgctaagtcctctgagactaacgctaagacctctgagactaacgctgcatcgagtgctgctaaggcttctgaggaggctgctaagctgactaacatgaatgactttgctgccgctattgattcagtcaacggtaacaatgttgtcatgaagggtgacttcaccattaaaggaaacggtaaagtatcaatactgaaccacagtgggctataccaagataagaccgttaatggcgtgaactatgccaacaggatttatatggatgatgcaggggccatgcacttcgagaactaccgtgtgtctggtgcttcatccaccttacgtgctggttttgttattacagataccaacaggtttgactttacagggccaacgcgagttaatggtgaatctaccgtatatgtgtatgcgccccctaatccggctattggtcaatacctcaatgctgtggcagttcgctcacagcttcggggccgtggtggtaatggtgatccacttggtgcgtactgtggtatgtatattcaggagcacgttggtacagaccacgcgataatccttaacctcaatggttatagcaaggatactaactggcagctattctccaatggtaaaatatctacaccacttggtgatgtgatgacttcaggttctgatgttagaatcaaggatgatatcactaaacctcttgatggtgctggtgagcgtattgacgcaattggcatagtggaatacacagagattgccaccggggaacgtaaacgtgggtggctggcccaacaacttgacacgattgacccgctgtacacatacctaacgaccaccgcagaaggtagtcttttgaataccaacgacagggcgttgcttgctgacgtaataactgagcttcaagcactgcgtcaacgcgttaaagaactcgaaggacaatcaacaaagccagcggacggcacaacataaggagaacacaatgctttcttttgacttcaataacgaggtcgttaaggctgcgccgattgttggcacaggggtcgctgatggtgcggcccgactcttttggggactatcgttaaacgaatggttctacgttgcagccatcgcctacacagtggttcagattggtgccaaggtagtcgataagattattgactggaaacgtgcaaataaggagtaacctatgagcgacaagactttaatcaagctgctggagatgctggacacggagatggcacagcgtatgcttgctgacctccagagcgaggaacgccgaacgccgcagctttacaacgcaatcggcaaactgttagaccgccataagttccaaatcagtaagctgaccccggatgagaacatccttggcggtctcgcggctggtctggaagactacaacaaagtggtcggccctaatggtctgactgacgatgagaccatcacgctacagtaagtgacatactcaaggttctccacgtggggagcctttatggatgttatttggtgcatctgtgtgaaatctgaaaattgatgggaggtgttatgctaaaacttttacgcagcgcactcccttgggtactcgccgggacactctttatgggtggctggcacttagggtcaacccatgagagagcaaactggaaggaggtaatccaaaatgaatacattgcgaaaacaaaagcaaccgcagcaactcaggcagaggtcagtcgggtatcccgtgagtaccaagaagagattgcagccattgaaggcagcactgataggatgcttaatgacctgcgtagtaataataagcggctgtcagtccgcatcaaaacccttaccggactgccagaagataacggtagatgcgagtttaatggtcgagccgaactacacgagtcagatgctaagcgtattatcggaataacccaagctgccgatgctcacgtaagagcgctccagcgtactattaaggagatgcagaatgagcgacacccaagcaaaccgtaatgcgctaatcattgcgcagcttaagggtgacttcgtggccttcctgttcgtattgtggaaggctttggctctcccgccgccgactaagtgtcagattgatatggcccggtgtctggctaacggagacaacaagaagtttatcctacaggctttccgtggtattggtaaatcattcatcacctgtgcgttcgttgtgtggacgctatggcgtgaccctcagttgaagatactgattgtctctgcatccaaagaacgtgcggacgctaactccatcttcatcaagaacatcattgacctgctgcccttcttggctgagctaaagcctcgccccggtcagcgtgactctgtgattagtttcgatgttggccctgccaagcctgaccactctccgtctgtgaagtcggtgggcatcactggtcagttgactggtagccgtgctgatatcatcatagcggatgacgttgagattccgtctaactccgcaactcaaggtgcccgtgagaagctgtggactctggtgcaggaatttgctgcgcttctgaaaccgctgccgacttctcgcgttatctaccttggtacgcctcaaaccgaaatgaccttgtacaaggaactcgaagataaccgtgggtacaccacaatcatctggcctgcgctctatccgcgtagccgtgaggaagacttgtactatggcgaccgtctggccccgatgctccgcgaagagttcaacgatgggttcgagatgctccaaggtcaaccgactgaccccgtgcgcttcgatatggaagacctgcgtgagcgtgagttggaatacggtaaggctggcttcactttgcagttcatgctcaacccgaacctgagtgatgccgagaagtaccccttacgcctccgtgacgctatcgtgtgcggtctggacttcgagaaagccccaatgcattaccagtggcttccgaaccgtcagaatcgcaatgaagagctacctaacgtgggccttaagggtgatgatattcatagttatcattcgtgcagccagaacactggacagtaccagcaacgcatcctcgtgattgaccctagtggtcgaggtaaggatgagactggttacgcagtgttgttcaccctgaatggctacatctatctgatggaagctggcgggttccgcgatggttattccgacaagacccttgagtccctcgctaagaaagcgaagcagtggaaggttcagacggtggtcttcgagagtaacttcggggatggtatgtttggtaaggtattcagccctgtgctcctgaaacaccatgcagcctctatggaagagattcgtgctcgtggtatgaaggaactacgcatttgtgatacgctggagcctgtactctctacgcaccgccttgtgattcgtgacgaggtgattcgtgaggactaccagactgcccgtgacgctgatggcaagcatgatgttcgctattcgctgttctaccagttgacccgtatggctcgtgagaagggcgctgtggcccacgatgaccgacttgatgcattagcattgggtgtggagttcttacgctctacgatggaactggacgccgtgaaggtggaagctgaggtgcttgaggcgttcttagaggaacacatggagcacccaatccattcggctggtcatgtagttaccgctatggttgacgggatggaactctattgggaggatgacgatgcgaatagcaacaggttcattgactggtagttatgcatattgagtgcataaggaagcatcgagaccacggatggtcactttaagaaactccttaagaatcaatgagtttgaattaaccctcactaaagggagagaggggacttaaagctactatataggttagtcattcaggttatgcaatgaccttttatgcactttaagtctacctctgtgattggtgatattatcattatataatcacctaccttagagcaactgaaaggaggtggctcaatgttacgcttgctgattgccctgctgcgtcatagagtcacttggcgatttcttctggtacttactgctacccttgggtacgcaggccttactgaccacctcggtcaactggaagtggccttttgctctatactctcttgtggggattaaattattgttgatgacagacaagcggctctgagggattcgtaggtatagtttcactacaccaactcatccctgtagagtcaaccctaaaggttatacctaaagatgccctgtagttcgtaatggtcttacagggtcttctggtgtctcctagctatcccttctggatgcgcctatggtctcacctatggtgtggccttacctaaagtggttgcctaaagagaccctttaagaatttaccacaaaaatctgaatgggtatctcacagttcaagaaaccaaagtacccccatagccctcctaaagccacctaaagccagccctacccctagggtttaaccttcggttaaccttgggtatctcctcaagtggcctataggatagcctaaagtgttgcataaagtcaatacctaaagaggcggatggcttaaagaggccttgaagagtgtcctagtgtaccagttcgatagtacatctctctctttgtgtccct

SEQ ID NO: 22 - DNA, 40394 bp, Unknown
  source: /note="Description of Unknown: KP2-15-1 Bacteriophage Sequence"
atctgttatcctcctaaagtaaaccctaaagccatcacctaaagccaccacctaaagaccagacctaaagccaccacctaaagaccagacctaaagccaacctaaagccaccacctaaagaccagacctaaagccaccacctaaagaccagacctaaagccatcacctaaagagtgccgctatcttaaagacaaccagaccgatagacccattgttaacctgtagtgatgccttgtagttatctgtagtcatttcataaaccctcactaaagggaataagggatacttaaagagggaataagggatttaataaaaagatttaatttaatggttgactttaagtaacccttaaggctattattcatcacgtcaacgggacaacggccttaaagccactccctgagatactggagtcaaccggataagtagacagcctgataagtcatacgaaaaacaggcattgacaacatgaagtaacatgcagtaagatgtaccacataacgttaaccaccgctctggtgtcttctaggtgacttaagcgcaccacggcacataaagcgaaacaaaaatggttgacaacatgaagtaaacacggtacgatgtaccacatgaaagacaccgagtgtcgtaggtgtaaaaacgcgacatagtggatagatggcgaaagcacaagcgaccacgataataaagagcttgtcgcacttataacgcaagtgacggctaacactgaaatagcctcggctcaacgaaactgtagcctaaagttctttaacaatctggataatagctcttgagtgtaccgatgtataagcgaataactcaaggtcgcactgaaagcgtggcctttatgatattcacttaacacgaactaacatgaggtaacaccaaatgattttcactaaagagcctgctaacgtcttctatgtactggtgtcagcattccgttctaaccttgatgatgaggtgaacatgagtcgccaccgccacatggtgagcgaattacgtgccgcaccgggtatctacggcgagcttgagtctaccgatttgaccgggtgctatcgtgagagtatcgcactggctccaaccgaggaaaagaccatgcgtgtactctgcaagaacaaagagcaggcactacaggtagctcgcttagcttgcaatgagtatgagcaagattgcgtactggtatacaaatcacagactcacacagcgggattggtgtacgctaaaggtatcgacgggtataaggctgaacgcctgccgggtagcttccaagaggttcctaaaggcgcaccactgaaagggtgctttacgattgacgagttcggccgccgctggcaagtacagtaagtgatagactcaaggtcatgcacgatgcgtggcctttatgattatcactttttgactatgaaggaatcacaccatgcgcttaaataaagacacagcggtagctatgcggtcagcaatcgaatcaagagccgcacacaacgtgggagggattgctgatgttgcacgggtttataaggagaaagggcttacattccgcagattcatgtgggactgttatcatgcagtgggctttaaagagactacaagaatcatcgcagagcacaacacggtgacagttatcggcgggcacataacagatatcaatgattcgcacatcgaaactatgctcaaggttgcactgaaagacatagcttattagtaattaactacaggtcgttagctcgtagcggcctgaatgataattactaaacaaacctgagaggatatgactatgaaacaatacgccatccttattcccggctggtgctactcaatgacctgctacgggtacaacgaaagggacgctcgtgccagattcagggatcaacaaggcttcggcaagcgtttacctaatggtacggctgtatgggaggttatgtaatgagtaagttactggcaacctctaaaatcaaaggccaatgcactgtaacgctgcgtgagtattaccacgggtcaatgggatgcacctatgttgtgcgatacggtaaacaggtcacgcactgggtaaaccttgttttggcacaagaggagtaccaagcctgtgtgatacaccaagcaacatgtgcaggctggaacgactgacaacagacttcaagtctatcaggtggtaaactcaaggtcgctccatgcgagtggcctttatgattaacattacgatagaggatgagagtatgggatacgaagacacgaagaacctgataattctctgtatagcaatacccgctgcaatcaactttgtgtacgaggtatggattaagaaatgattatcgcactaatcgcactggtctatctgtgcatcgctatgtactttatgcgagactttaagcgcggtctggcaatacacaaggcaacgctgagttactttaagtggggattcatcccacggtttacggttcgtgaacgtaacggacgctttaaggccaacaaggtgggagtattctacattgctacgcactaactcaaaacacgtaaagattgcactgtatgcgatggcttatggtgcatcgaaacgcaaggtcaaacgcatcttaacgagacaccgcaagatgaccgcacgacaggctgcaagcgctgtcaaatgggctgaatttactctttactcttcttacagataacaggacactgaacaatgactttcaccgaagcacaagccgcactcgaagctatccgcaacctgccgattgaccgcttggatgaacgccagcccatgctggtggctcttgcggctgctatcgtgaacgatgagactcaagacggcgaactgacgcaggccaaaggcaattggggcttggagtctatggactactggcagacactggctgagcgtatgcgtgatgttggatttgtacgcttgggtaacggtcactttagcgcagcatacgagcacgcattgttaccgggcaaggttatcaaggtaggctttaagaaagaggactcaggcgctgcctatgctgccttctgccgcatgaatcagggtcgtgagggtatccctacggtgtacgacattcagcgtcatacaggctgctacacggtggtcttggactatctgacaccgcttaacgattggtgctacggtgaaagcgataagattcgtcaccactttcaggccgcacgggaaatcattgaggaggattgcttcgataccgccgaagagtacccgataagtgacgggttcattgagacctgcaaggatatccgcaagttcttcctaggcattgcatcgttcgattgtcacagcggtaacatgatgaaagaccaaatgggccgattgattatcacagacccggtatcgttcagcgcagacaacaagttaaagccgggtgagtttcactgtgacccggatgaactaatcgctgagattgaggcgctgagggcgcaggaagcgattgaccgctgtaaggcacgcaaggcacgccgtgaccctaaaggagactttcaggcagcacgtaaagcccgtgccaaatggcgcagaaaggcctctaagcgtgctaaacgtgacgctaaggtaatcgctaagatgcgcatggatgacaacgagcaacgcagggccgagccgagggcgcgcatgttgtggggcgataagcactggcgtaacgcttgggtgcagcacatgaatgttgacttcgcacggctcgaactgttagcagccgcacagatggcacagatagaccacaaggctatcgtatggggcaagccgttacacatagacgcataccttgacaagagactgcaaggttgatagagtcttttcttacaggtcatcatgaggtggcctgaataggaacgatttatccatagtgaggcaagcaatgaacatcatcgaaactatcgaaaagaatgacttctctgaaatcgaactggctgctatcccgttcaacacgctggcagaccactacggcagcgcactggctcgtgaacaactggctttagagcacgagtcttatgagttaggtgagcgccgcttcctcaagatgctggagcgtcaagcgaaagctggtgagattgcagacaacgcagccgctaagccgttactcgctacgcttctccctaagttaaccgcacgcatcgttgagtggctcgaagagtacgcctctaagaaaggccgcaagcctagcgcatacgcgccgctccagttactcaagccggaagcctccgcgtttatcaccctgaaagttatccttgcatcactgaccagcacgaacatgacaaccattcaggccgctgctggtatgttggggaaggccattgaggatgaggcacgtttcgggcgtatccgtgacctcgaagcgaagcacttcaagaagcacgttgaggaacagcttaacaagcgccacgggcaagtctacaagaaagcctttatgcaggtggttgaggcagatatgattggtcgcgggctgctgggaggcgaggcgtggtctagctgggacaaggaaaccacgatgcacgtagggattcgactgattgaaatgctcattgagtccacgggtctggtggaattgcagcgccacaacgcaggtaacgcaggctctgaccatgaggcactgcaactggcccaagagtacgtcgatgtgttagcgaagcgtgcaggagcactggcgggtatctctccgatgttccagccgtgtgtcgtaccgccgaaaccttgggtggcaatcaccgggggcggctattgggctaacggtcgcagacctttggcactcgttcgcactcactctaagaagggactgatgcgctatgaggatgtttacatgccagaagtttacaaggcggtcaacatcgcacagaacaccgcatggaaaatcaacaagaaagttcttgcggttgtcaatgaaattgttaactggaagaattgcccggtagcagacattccatcactggagcgccaagagttaccgcctaagccggacgacattgacaccaacgaggcagcgctcaaggagtggaagaaagccgccgctggtatctaccgcttggacaaggcacgagtgtctcgccgtatcagcttagagttcatgctggagcaggccaacaagtttgcaaacaagaaagcaatctggttcccttacaacatggactggcgcggtcgtgtgtacgctgtgccgatgttcaacccgcaaggcaacgacatgacgaaaggtctgctgaccctcgctaaaggcaagccaatcggtgaggaagggttctactggctgaaaatccacggtgcgaactgtgcgggtgtcgataaggttcctttccctgagcgcatcgcgttcattgagaagcacgtagacgacattctggcttgcgctaaagacccaatcaataacacttggtgggccgagcaggattcacctttctgtttcctcgcgttctgcttcgagtatgcaggagttgcgcaccacggtcttagctacaattgctctctgccgctggcgttcgatgggtcttgctctggtatccagcacttctccgcgatgctacgcgatgaggtaggcggtcgtgcggttaaccttctgccaagcgaaaccgtgcaggacatttacggcatcgttgcacagaaagtaaacgagattctcaaacaggatgcaatcaacggcacgcctaacgagatgattaccgtgaccgacaaggacaccggggaaatctcagagaagctcaagctgggaacctcaacgctggcgcaacagtggctggcatatggtgtaacccgtagcgtaactaaacgttcggtcatgacgctggcttacggttccaaggagttcggctttcgtcaacaggtactggacgacaccattcagcctgcgattgacagcggtaagggcttgatgttcacccaacctaaccaagcggctggctatatggctaagctgatttgggacgcggtgagcgtgaccgtagtcgcagcggttgaggcgatgaactggctcaagtctgccgctaagctgctggctgctgaggtcaaggacaagaagaccaaggagattctgcgccaccgttgcgcggttcactggactacgcctgacggcttcccggtctggcaggaataccgcaagccactccagaagcgtcttgatatgattttcttagggcaattccgtctgcaaccgacgattaataccctcaaggattcaggcattgacgcacacaagcaggagtctggcatcgctcctaactttgttcactcacaggacggtagccacctacgcatgacagtcgtttatgctcacgagaagtatggcattgagtcctttgcgctcatccatgacagctttgggactattccggcagacgctggtaagctctttaaggctgtgcgtgaaacgatggttctcacctacgagaacaacgatgtgctggcagacttctatgaccagtttgcagaccagctacacgagacacaactggacaagatgcctccgcttccgaagaaagggaacctgaacctgcaagacattctcaagtctgactttgcctttgcataacaagcacttagcattaaccctcactaacgggagactacttaaggtctcccactttaagacactttaggtactaagagattaaatttatgattaacattaagactttccttaagaacatctttaagttaaaccgcttgacttccgttaagttctacgcttggatgcccggtagtgatgacctccgcaagactgaatttaagttaggcttaggccgtgcggtaaggtggtcacgaagttggaatgttactcaacggcctccgggatggtcatcttccagaccactgaggacaacgaaatgaaatccttctactacccgaaaggttcaacatgtggtcgtatcgaacgggcatacagttaaccctcactaacgggagagttaaacttaaggtcatcaccagcggtggcctttgtgattaactttcaatacacatcaacatgaggtaagatactatgcgtaccaactttgagaaatttaccaagcgcgattcagtggtcaacgagcatggcgaacagtggcaagagcgccgtgaccgcatgaagaaactccacaagcaacagcgcggtaactcacagaaacgggagtggaactaatgatgggacgtatctatagcggcaacctgaacgattacaaagatgcggtagagcgtctacaggaagaccatgacgtgaccgtgaaggtggagtcattcagttatgaaaacccagcgaagatgtgcaggtcatccggtgaggttctccgtgtgttcacacgctccgggcatctggtggcatccagaaccttcgagcacagcgacagcgatgtacaaatcaacgcgcagactgcacggctccgtaaggttcacagcgatttgaaacactggaagtaataaccctcactaaagggagaacgaaaggaggaaacattatgagaatttcatttgacttaatgagtccttcctttctctcatgggatacgggtcgtcacactggcggctctattcgaaacggctatagaagggttcgttatgaaggtaagtggttaaaccatcacatactcatttgggaacacttcaacggtgcagtcccggagggaatggaagtagaccacattgaccgtaacaaacttaacaacgcgcctagtaaccttagacttgtgacccgctctgagaacaacagaaatcggtcagtacaccggaacaacaagtcaggaatcaaaggtgtctactggcacaaacaccgacaagtttggtacggtcagtgtcgaagaggaaacaaaacatttatcaccgctggttgctccacgaaggaacaggcggcagaacttttagagaaactcaaagaggaaattaattatgatgattttcaaaaccgtcccgtataaggctgtgtcattcgtagagtctgccgttaagaaagcgctggagacctccggctacctaatggctgatatcaaatatgatggtgtgcgcggtaacattgtggttgacaacgtggctgaggccgcatggttgtctcgcgtatccaagttcatcccggcgctggaacacctgaacggtttcgataagcgctggcagcaactactgaacgatgaccgctgcatcttcccggatggcttcatgctggatggtgaactgatggtcaaaggcgtagacttcaacacggggtctggcctactgagaaccaagtggctcaagaagaacaacttcatgtttgaccgtggtggtgttgagccgctgaaaggttccaaagtagcctttgagttggacactaagcgcctgagcgtgcgcctgtatgcggtcatgccgattcacattgcggagtctggcgaggactacgatgtacagaacctgctgatgccgtatcatgtggaagccatgcgcgctcttctggttgaatacttcccggaaatcgagtggcttatcgctgagacctacgaggtctacgatatggattcgctgactgaactgtacgaagagaagcgtgccgaaggtcacgagggtctcattgtgaaagacccacaaggcatctacaagcgaggcaagaagtctggctggtggaagctcaagcctgagtgtgaagctgatggtatcattcagggtgtcaattggggaaccgaaggtttagccaacgagggcaaagtgattggctttagtgtgcttcttgagactggtcgtttagtagacgccaacaacatctctcgcgcactgatggacgagttcacagccaacgttaaagcccacggtgaagacttctacaacgggtgggcctgtcaggtcaactatatggaagagaccccggacggctccctgcgtcaccctagcttcgagaagttccgaggcactgaggacaaccctcaagagaaaatgtaaccaactcactggctcaccttaacgggtgggcctttcttcgttctagggaattaaccctcactaacaggagacacaccatgtggcttatcctattcgctatcgtcgcaacgcttggattaatggctgccgacgacaacatttggcctgattgttaaggagacaacatcatgcgtttacacttcaacacatcaaatggtatcttttcggttcgccgtgaagaccgctctacagcagtggcctctgagcgcaacgccaagctgccgctgattggttcggtcgtcccattgtcgccgcgtgttcacctactgatcactcgtggagagttcattaaggcgatgaacaaagagcgcccgcatctggaagccgtggtcacttactggcctcgcatccgtctgttcgttaagtggattaaggaggttctgtaatgctacaacatcattggaacaaaccagacttagaggctcgcttcccggttaactctgctgtgcgatactccggcgacttcctcaagcgcttcttaggcatgagcggagtggtcactggtcactcgaacacaggtcgcgttaaggttcgcttcggtaatcagcacgctgagtttcttcctgacaacctgattccgctgcctaaagctgacgttaagactccgaacgtggaagcaccgaaggcagaattcaagtctgacgtgacccacccgaaccattacatgctgttcgacaacgtggaagccattgaggttatcgcccggtcaatgaccgtcgaggcgttccgtgggtactgccttgggaatattttgaagtaccgcctgcgtgctggcaagaaatctgaactggcaactatggagaaagaccttaagaaagcggctttctatcaggaactgtttgataaacataaggggctgtgttatgacgcttcgtgaatgctgcgattggtgtgccgctaagtggaaccaagctattgaggatggtgataaggcggctgctgacgcttaccaacaattgtacgcgctgtgggagcggcgctttaaggaggctcaaagtggagcaacgtgaacagaaatacctcctgacgatagaaggcaacaccgagtcctttgaggttccggtattcgcccggtctctcgaagaggcaacgctacaggctgaacattatgaggacgctgggttcgtagtgactcgcatccgtccagaagtgaaagcctaattaccctcactaaagggaacaacccaatcattaaccacaaaggagaaacattatggctggtttcaagaagaaaatctacacctctggtcttggcactgctgagccttatgcttacctgagtaagccggattatggcaacgaagagcgtggcttcggcaaccctcgtggtatctataaggtagacctgactctttccaataaagacccgcgctgtcaggcaatggtcgatgaaatcgtgaagactcacgaagaggcttatgctgctgccgtggaagagttcgaggctaaccctccgcaggcacagcgtggtaagaaaccgctgaaaccttacgagggcgacatgccgttcttcgataacggtgacggtacgactaccttcaagttcaaatgctatgcgtctttccaagacaagaagaccaaagagaccaaacacatcaatctggtagtggtcgatagcaaaggtaagaagattcaggacgttccgattatcggtggtggctctaagctgaaagtgaaatactctctggtgccttacaaatggaacaccgctgtgggcgcaagcgtcaagctgcaacttgagtccgtgatgctggtcgaactggctaccttcggtggtggcggtgaagatgagtgggccgatgaagtcgaagacggtggttacactgcgagtgaatcccgtcagtcccgcgatgagcaggagtggcaggaagacgagcacgaagaaaccccggatgaggatgaggatttttaaatggaacttaaagagaaactaaaggcttacagcgaagtttctcataacgggtgctgggagtggcaacgctaccggatgccctgtggttacggtaggattagacacggaggccgaatggaactaacgcatcgtctatcctacctagcattcaacggggatatacctgagggtcttgttgttcgccataagtgtgacaacaaatgctgcgttaaccctgagcaccttacgctaggtactcaaaaggacaacgttaaggatgcaatagaccgtggtcaattcgtctacagggagaacccgaaaggcgcaaagcaccacatggctaaacttaatgagaaacaggttatggaggtttacaactcgacacagacccaaagcagcctagcagagacctatggtgtatctcgacaattaatcagcgcgattaagagaggtaaactatggcagcacgttacgcagcacgtggagttaaacgagtagggtcatatagaagcggcttagagcagaagaacatggagatgctggaacgtaagggaatcaagggacagtatgaaatgtggtctattccctatgttgtccctgcatcgaaccacaagtacacaccagacataatcctacccaacggaatcattattgagaccaagggtctatgggatagtgaagaccgtaagaaacacttactgattcgtgagcagatgcctgagttggacattcgtttggtattctcttcgagccgctctaagttatacaaagggtctccaaccagttacggtgagtgggccgaaaagcatggtattctatttgctgacaagctgattcctgtggagtggcttaaagaacctaagaaggagataccgtgggataaactaattgcaaagaaaggagttaagaaataatggctaaggtacaattcaaaacgcgcgcttctacggaagcaatctttgtgcactgtagtgcaaccaagccaagccagaacattggcgttcgtgagattcgtcagtggcacaaagagcagggctggttagacgtaggatatcacttcatcatcaagcgtgatggcactgtggaagcaggccgcgatgaactggctgtaggttcccacgttaaagattacaaccacaactccgtaggcgtatgcctcgttggtgggattgatgataaaggcaagttcgacgccaactttacacctgcgcaaatgcaagcgctgcgtagtctactggtcacgctgctggcgaagtatgagggttcagtccttcgtgctcaccatgacgttgcacccaaagcctgcccgtccttcgacttgaagcgctggtgggagaagaacgaactggttacatctgaccgagggtgatgccatgaggatgatttgtattcgctgtgataaaccgttgaagagtcgtgtaccgtcacgtcagtgtcagtgcaaagacccaatcaaggcggaggaacacaccgaggaataattaacactcactaaagggagacttaacggtttccctttgttctcgcaactgattaaggaatgtacaatggaacgagaagacgatagtatctttctgtttcatgctccatgtgaaaactgtgggtcttctgatggtaactctgtgtactctgacgggcatgaatggtgcttcgtgtgtgaacatcgagtacccgcaaacaaagagcgtgaagcaaagttatcaacgagaagacgcacaggaggcagtaagcctatgagctatgacgtatggaatttcggcgacagcaacggtcgatactctgacctgactgcccgtggcatctcgaaggagacatgccaaaaggctggctactggctggcgaaagtggacaaccgaatgtatcaggttgccgactaccgagaccagaatggctccatcgtgtcgcagaaggtgcgcgataaggacaagaactttaagaccaccggaagccacaagagcgatgcattgttcttgaagcacctctggtctggcggtaagaaaattgtggtcacggagggcgaaattgatgcgctcactgtgatggaactccaagactgtaagtacccggtcgtatcattgggtcacggtgcctctgctgctaagaagacatgcgccgctaactatgaatactttgaccagttcgagcagattatcttgatgttcgatatggatgatgcaggccgtaaggcagttgaagaggccgcacaggttctcccggctggcaaggttcgtgttgccgtgttaccgtgtaaggacgccaatgagtgtcacatcatgggtgaagacaaagcaatcttggagcagatctggaacgcgaacccttgggtgcctgacggtgttgtttccgcgttatcactcaaagaccgcgttaaggaagctatgacctccgagtacgctgtaggtttattatttgatggctgtcaaggcctgaacgatagaaccttgggtgcccgtggaggcgaagtcatcatggtcacttccggttcaggtatgggtaagtcaacgttcgttcgtcaacaggctctgacttggggcaagcgaatgggtaaacgtgttggcctagcgatgctggaggaatccgttgaggataccattcaggacatgatgggcttgaacaataaggttcgtctgcgtcagtctgatgaagtcaagaaggctatcgcggaggacggacgtttcgatgaatggtatgatgaactatttggagacgatacgttccacctttatgactcctttgcggaggccgaagctgacaggctgttagcaaagctggcctacatgcgaacaggcttagggtgtgatgttatagtgctagaccacatctcaatcgtcgtgtctgcctctgaggaatcggatgagcgtaagatgattgaccgcctcatgactaagctaaaagggttcgctaagtcaactggtgttgtgctcgtagtgatttgtcacttgaagaacccggagaaggggaaagcgcatgaagaaggacgcgctgtgtctattactgacctacgtggtagcggtgccttgcgtcagttatctgatactatcatcgccttggagcgtaaccagcaaggtgatatgcctaacttggtgttggttcgcctgcttaagtgtcgtttcactggcgacactggaattgctggatacatggagtacaacagagaaaccgggtggcttgaaccgtctagctacactggcgaagaaggagaaggagatactggctggactgaacaagacggacagtcagacttctaaaggatgcccgtgtgggcattccgattgcgatggaatcatgtaccactaattaaccctcactaacgggaacaacctcaaaccataggagacacaccatgtttaaattcattaacactttaggcaagctggtagtaaaactgtacttcatcgaagccaagaagctggacaagaaggccaaagctgattcacagcgagccattgagttggcgaaacagtcccgcgagaaatccgatgcggctgttagtggcatccacaagtcggcagcgattgcagccaaagcacagtccatgagcaaattctttgagtaaggatcgaacactatgagcaagtcaatcactcacgcaaacaccatccgtctgccagacaccgccgaccagttctcccgccgagtacacatcaatgtgcgcggcgagaaggtcacgatggtctaccgctggaaagaccacaagtctccgaaagcacacactcaacgaatgaccttggatgacaagcaggtcggtcgcttgatgggtgcccttactatggctgctgacaaggtggtcggtgataaccgtgagcgtctggtagagttcggcgctggtatgcaagagattatcgagaagtgataaactcaaggtcgcccaagggtggcctttatgattatcatttagcacgaaaccaaaggagggcattatgctcgtaagtgacattgaggccaacaacctcttagagaaagtcaccaagtttcactgtggcgttatctatgactaccgtgatggtgagtatcatagttatcgtccgggcgacttcggggcgtatctggatgcgctggaagccgaggtgaagcgaggtgggcttattgttttccataacggtcacaagtatgacgttccggctttagagaaactcgcaaagctgcaactcaatcgtgacttcaagttaccccgtgagaattgtattgacacattggtactctcgcgtttacttcatgcgaaccttaaagacacagacatggggcttcttcgttccgggaaactacccggtcgtcgcttcgggtctcacgctctggaggcatggggttatcgcttgggcgagatgaaaggtgaatacaaggacgacttcaaggctatgctggaagagcagggcgaagagtatgttgatggtgctgagtgggtttcgttcaacgagccgatgatggcgtataacgttcaagacgttgttgtcactgtcaagctcttagagaaattccttacagacctccactacttccctgctggtatggacttcacgaagtacgatgcggatttattctggcgtgaagctggcgagtctgtggatattgaacatcgtgcagcgtggctgttagcgaagcaggagcgtaacggcttcccgttcaacacacaggccattgaggaactttatgtagaactggcagcgaaacgcgccgaacttctgcgaaagttaaccgaaacgtttggctcgtggtatcaaccgaaaggtggtaaggaactcttcaagcacccacgtacaggcaagccactgccgagttatcctcgcgtggtctatccgaaacagggtagcgtgtacaagaagcctcgtaataaggcacagcgcgaaggtcttgaaccttgcgacttggacacgagggactacatggagggtgctccgtatactccggtagagttcgttacgttcaagccaagtagccgtgaccacattcagaagaaactacaggaggccggatgggttcctgagaagttcaccgagaagggtgcgcctgtggtggacgatgaggtcttggagcatgtacgagtagatgaccctgagaagcaggcgtgcattgacttgattaaagagtacctgatgattcagaagcgtatcggtcaggcggcagaaggagacaaagcgtggttacgttatgttcaagatgacggtaagattcatggagccgttaaccctaacggtgcagttactggtcgtgctactcatagtttcccaaaccttgcacaagtacccggcgttcgttctccttacggggagcagtgtcgtagcgcttttggtgctgaacatcatttggatgggattactggcaagccgtgggtgcaagcagggatagacgccagtggcttagagttgcgctgtctggcacacttcatggctcgattcgacaacggagagtatgcgaatgagattctcaacggtgacattcacaccaagaaccagaacgctgcggaactcccaacgcgagacaacgccaagaccttcatttacgggttcctttacggagccggagatgagaagattggtcagattgttggggcagggaaggagcgcgggaaggaactcaagaagaaattcttagagaacaccccggcgattgcagcgctacgagaagctatccaacaatctctcgttaagtcttccgcttggattggcggtgagcagaaagtacagtggaagcgccgttggattaaaggtctggatggtcgcaaggttcacgtcaggtctccacacgcagcgctcaacacattgttgcagtctgctggtgctctgatttgtaagctgtggattatcaagaccgaagagatgctcattgagaaaggcttgaagcatggctgggatggtgactttgcgcagatgggatggattcatgatgaagtccagattgcgtgccgaacagaagagatagccaaggtcgtcgtagaggtagctcaagaagctatgcgctgggttggtgaacattggaacttccgttgtcgcttagacacagaaggtaagattggcccgaactgggcggtttgtcactaaggagtatttatgggaggcgtggctacactaaggttccacaagatgccgaccgggtgtgtagtctgcgtttcacataagcgcaatcacgatggctacttccggtacagtatagggtcgtccagaaagggcgagaagaaatgctttatgtttcaccgctgggtttgggaacgacaccgtgggcctataccagaagggtatgagatagaccacttgtgtctcaaccgtgggtgctgcaacgtagaacacttacagtgcataccgaagcgtgaacacataatcaaaaccaacaaagagcgcagtctcgtaaaggagaaacattatggcaatgaccaaacactttaaagtaaccttcgacgttaccgctgtgattgacagtgaatccgagaagaatctgaacgagttgctggtagacctagctaagaaggccggggctggcgagaagctgaatccgttcaaacaagaactgcttattcaaggtctgacacacgggccggaaggtgctgctgcgttctgtatcaagcaaggtctccgtgagtttatccgcgatggtcacagtgagttaagctctaccgagcagaagctgatgagattctcacctgcaaccgtgcgcgaggtgttcaaatgagtgaatacctgaaagttctggcagctatcaaaggttgccctaagtcctttcagtcgaactatgtgcgaaacaatgcggctctcgtagctgaggccgcttctcgtggacacattagctgtttgactgtgggtggtcgaaatggtggagcatgggaggtcacagcctctggtgtgcgcttcctgaaacgaatgggaggttgcgtatgattatgcctaagagtgacaccgtaacgatgacccgtgatgcgtggaacgatgttagcgcgtatattgataagctggagaaagacctagagttcctgaatgcgcttaaggcgtgtggtgtggataattgggacggatactctgatgcagtcgaaatggtttacggggaggatgacgaatgagcctaatcacattgaaagacttcgtggagatgcgtgaaggtaagcctatggagaatggagtgctggtcatggatggtgactggttggtatatcagtcaatggctgctgccgaagttgagacggattggggagatgacatttggactcttgagtgtgaccacgccaaggcacggagcattctcgattctgcaatcgaatcgtaccgaacccgtaagaaggcttggagtgacgctatggttgttctggcgtataccgacgatgtgaactggcgtaaggtactggttgatgagacctataaggagaaccgtaaggcgacccgtaagcctgtgggctaccgtgacttcctgtcgaagttgtgggagcgcgatgagttcattcacatcaaagaggacatgctggaaggtgatgacgttatgggtatcattgggtctggtcacgaggtcttcggcttcaagaaagctgtgttggtctcctgtgataaggacttcaagactatcccggacgttgacttcctgtggtgtaccactggtaacatcttgacgcagaccaaagataccgctgattggtggcatctcttccagaccatcaagggtgatatgactgatggctactcagggattcccggctggggcgatacggcagaagccttcctgaatgacccgttcattgtggagcctgtagagtccgtgttgaagtctggtaagaacaaggggcagacagtaaccaagtgggtgaagcgtgctcctgatgcgactgagacgctgtgggactgcattaaatccattggtgccaaagctgggatgaccgagcaggaaatcatcaagcaaggccagatggctcgcattcttcgcttcgaggaatacaattacattgacaaggagatttacctatggacgccgcaaagctgattaccgtcgctgtgctggtaggtatgctggcgcgaggtctctggatgttcgctctcatagtccgagacgttaatcgagactccgagattaagtgataaactcaaggctctctgtattaaccctcactaaagggaagagggagcctttatgattattactttaagacttaaccttaagaggtgaaattatgttacaaccaattaatcatgttttaactcatcccgatgatattcctagtatgcctcgtgcagctaaagagtatctacaggtgcgcttcaatcaggcctatgtggtggagtccggggagtaccgtgcgctccgcgctgcgggttactctgagtctttcattgctggtgtgatgcatggtctgtaccttgcctctcgaacacttgatgagattgaggtgcgtaaagagcaactgagacaggagtaattatatgtgctggaaaccgaaggtgaaagtccctaagatggacactaaccagattcgcgctgctgaaccagcacctttgactgaacctccgaagtctgtggtatggggaggcgatgatgacgaggacaccagcgtgtcttcctctgaggtgccaacctcaccgagcagcggtaagagcagtctcaaggtaaagctggatgacagcgcagccaagaacaagagtaaatcctccattcgctcaaaggcgtttgggtaactgagtcatagtatagggagaaacatcatgggattcttcaagaaaatcaagaaggctgttaagaaagttgtgaaggaagttagcagaccagtcgagaaggcaggtaaggaagttggtaaggttgttggaggcgcgctgggtgcaggtaagcaggagattatccaacaagaggctccagcaccagtagtagctgcaccgccaccagcacagattgtagacgtacctgaacaggataaggctgagggcgaggatgaggcgcaaaccgagagcgcacgtaagaaggcacgcgctggcggtaagaaagcacttagcgtagctcgcagttccggcggtggaatcaatatctgaggaggactgaatggctgattcaaaacgtacaggattgggcgaagacggtgctaaagctacctatgaccgcctgacgaacgaccgtagagcctatgagactcgtgcggaaaactgtgcgcaatacaccattccgtccttgttcccgaaggagtccgataacgaatctaccgactacacgactccgtggcaggctgtaggtgcgcggggtcttaacaatctggcctctaagttaatgcttgcgttattcccgatgcagtcgtggatgaagctgaccattagcgaatatgaggcgaagcagcttgttggagaccctgatggactcgctaaggtggacgaaggtctgtctatggttgagcgtattatcatgaattatatcgaatccaacagctaccgtgtgacgctctttgagtgcctcaagcagttgatcgtggcaggtaatgcactgctttacttaccggaacccgaaggtagctacaatccgatgaagctgtaccgattgtcttcttatgttgtccaaagagacgcatacggcaatgtgttacagattgtcactcgtgaccagatagcctttggtgctctcccggaagacgttcggtctgcggtagagaaagctggtggtgagaagaagatggacgaaatggtcgatgtgtacacccatgtgtatctcgatgaagagtccggcgattacctcaagtacgaggaagtagaggacgttgagattgatggctccgatgccacctatcctactgacgctatgccctacattccggttcgcatggttcgcattgatggcgagtcttacggtcgctcctactgtgaagaatacttaggtgacttaaggtctcttgagaatctccaagaggctatagttaagatgagcatgattagtgcgaaggtcataggtctggtgaatcctgctggcattacgcagccccgtagattaaccaaagctcagactggtgacttcgttcccggtcgccgagaagacattgatttccttcaactggagaagcaagctgactttaccgtagcgaaagctgtgagtgaccagatagaagcacgcttatcgtatgcctttatgttgaactctgcggtacagcgcacaggtgaacgagtgaccgccgaagagattcgatacgttgcgtcagaactggaagatacgcttggtggcgtatattcgattctgtctcaagaactgcaattgcctctggttcgtgtgctcttgaagcaactccaagcaacctcgcagattcctgagctaccgaaagaagccgttgagcctactatcagcacaggtctggaagcaatcgggcgtggtcaagacctcgataagctggagcgctgtatctccgcttgggctgctctggctcctatgcagggagacccggacattaaccttgctgtcattaagctgcgcattgctaacgccattggtattgatacttctggtatcctactgacggacgagcagaagcaagcactgatgatgcaggatgcggcccaaacaggtatcgagaacgccgccgccactggtggggctggtgttggtgctctagcgacctcaagtccagaagctatgcagggtgcagcagcacaggctggcctagacgccacctaataaccctcactaaagggagacctcatctttgaaatgagcgatgactaaaggttggagtcctttggtttccctttatctttaacaacttaggagatttaacaatggctgaatctaatgcagacgtttatgcgtccttcggtgtgaacaacgcggtaatgaccggaagtacacctactgaacacgaacagaatatgctgagtctcgatgttgctgcccgtgatggcgatgatgcaatcatacttagcgaggaacctagttcttatgacgatgacccttatgcggctggtgaagacccattcgctgatggtgaagacgatgagggccgcattcaggttcgtatcagtgaagatggtaacgaagctgagttcgacactggtagcgataacgctgaggtggataccgaaggtgaggccgctgagtttgagccgctgggtgacactccagaagaactgagccaagtgactgaacaattaggtaagcacgaagaaggctttcagtcgatggtcgagcaggccgttgagcgtggactgagtgcagagtctgtgactcgtatctacgaagagtacgaagccgatggcatctctgagaaatcctatgcggaactcgaagctgctggatatagccgtgcctttgtggactcctacatctccggtcaggaagcccttgtagaccagtacgtcaatcaggtggttgcctttgctggtggtaaggagcgctttagcgcaatctatacgcaccttgaagcgaccaacccggctgcggctgagtcccttgagactgccatgatgaaccgagacttggcgactgtcaaagcaattatcaatctggctggtgagagttacacgaagaaattcggtaagccagccaaccgtagtgttaccaagcgtgctactccggttaaacctgtagctcgtcagaaagagggctttacgaatcaggctgagatgattaaagctatgagtgacccgcgttaccgtagtgatgctgcctaccgtcaaatggtagaacagaaggttatcgactccagtttctaattaaccctcactaaagggagagaccatagatgactacaatggttgaatcacctgagcacagaactttgtggacgctcccgtaggtgaaacattgagaaccaactcgattcaagtagtaaccaaacttttctttaaattaacataaggagattcaacatggctaacattcaaggcggacagcaaattggtactaatcagggtaagggtcagtccgcagcggacaaattggcgctgttcctgaaagtgttcggcggtgaagtcctgactgctttcgctcgcacctccgtgaccatgcctcgtcacatgctgcgctctattgcttctggtaagtccgcacagttccctgtgattggtcgcaccaaagccgcttacctgaaaccgggtgagaacctcgatgacaaacgtaaggatatcaaacacaccgagaaggtaatcaacattgatggactgctgactgcggacgtgctgatttacgacattgaggacgcgatgaaccactatgacgttcgcgctgagtacaccgcacagttgggtgaatctctggcgatggcggctgacggtgctgtgctggctgaactggctggtctggttaacctgcctgacgactccaatgagaacatcgagggtctcggtaagcctaccgtactgactctggttaagcctaagactggcgacctgactgacccggttgagctgggtaaagcgattatcgctcagttgactatcgctcgtgcgtccctgaccaagaactacgttccggctgctgaccgtaccttctacaccactcctgataactactctgcgattctggccgctctgatgccgaacgctgcaaactatcaggcactgattgaccctgagcgcggtactatccgtaacgtgatgggcttcgaagtggttgaggttccgcacctgaccgctggtggtgctggtgatacccgtgaggatgccccggctgaccagaagcacgctttcccggctacttccagcgctaccattaaggttgctctggataacgttgtgggcctgttccagcaccgctctgcggttggtacggtcaagctgaaagacttggctctggagcgcgctcgtcgtgcgaactatcaggctgaccagattatcgctaagtatgcgatgggtcacggcggtctgcgtccagaagctgctggcgctatcgtgctgccaaagacttcgaaggcttaatggtagcgcctttgagtatgaacgcggagagtgaagtggagccgacccaagaggtagccgccgaagtagctctcacgcctcaacagaaggccgccattactcgtgctcgtaacaaggcacttaagtctcaataacaacaagcaaaccccttgggttccctctttgggagtctgaggggttttttgctttaaaccctcactaacaggaggtaacatcatgcgctcttatgagatgaacattgagaccgcagaagagctatcagccgtcaacgacattctggcttccatcggtgagccaccagtatcaacccttgagggtgatgcgaatgctgacgttgcgaatgctcgacgtgtactcaataagattaaccgacagattcaatcacgaggatggacattcaatattgaggaaggtgtgactcttctaccggatgcgttctctggtatgattccatttagctctgactatctgtccgtaatggcaaccagcggtcagacccaatatatcaaccgtggtggctatctctatgaccgctctgcgaagactgacagatttccttctggtgttcaggtcaacctgattcgtctgagagagttcgatgagatgcctgagtgcttccgtaactacatcgtcaccaaggcttcacgccagttcaacaaccgattcttcggtgcgccggaggtagacggagtgttgcaggaagaagaacaggaagcgtggcgtgcgtgcttcgagtacgagttagactacggcaactacaacatgcttgatggcgatagtttcgttcagggtctattgacgcgttaatagtaaggaggcacttatgccagcacatagaaaagaaataatcaacgggtgtaaagagtgctctaagtgcctcacagttaaaccgttggaagagtttggtaagtcgagcagaccgggtggtcaatcccaatgcaaagagtgccgtcagtcaggtaagcgcggcaggcctgtaagccccacacaacgtgagtctcaccgggcgtgggtgttgctgaacacctatgggataaccgttgatgattttaacaaaatgcttgaggatcaagcgggtgtttgtaagatatgcggtaagggcccttctggtcgattcaagcacctgtgcgtagaccactgccacacaactggacaggtgagaggactactatgccacgcctgtaacaagtcattagggttccttgaggatgaccctgataggattaaacgtctaatagcttatttaggaggtacacaatgtcactaattagccagtcgattaagaacctcaagggcggtatcagccaacagccagatattctccggttcgctgaacaatgtagcgtacagattaacggttggtcttctgagtccgagggtctccagaagcgcccaccgatgattcaccttaagacccttggcgctgctgggtatgtgggtgcgcaaccttacgtgcatcttatcaaccgcgatgagttcgagcagtatttcgcggtgttcactggtgaagacattaaggtgttcgacctcgatggtaaggagtaccaagtacgtggagaccgctcttatgtacgaacagccaacccacgggaagaccttcggatggtaacggtggctgactatacctttgttactaaccgcaaggtggttgtgcagagtaacgaccaatcggtcaaccttccgggctttaaagaccaaggtgatgcgctgattaatgttcgtggtgggcaatatgggcgtagactctcaatcgagttcaacggggctgagcgtgctgctattcaactaccagacggctcacaaccagcacacgtcaatgaggttgacggtcaggccatcgctgagaagctggcggctcagttgcggaataacctaggtaacccaaacaatgaacaaaacccaaataagtggcgcttcaacgttggccccggattcatccatatccttgcgccaaataacgataacgtttggggactacagactaaggatggttacgcagaccagctaatcaaccctgtaacccactacgctcagtcgttccagaagttgcctattaatgctccagatgggtacattgtgaagattgtaggtgacacctcaaagactgccgaccagtattacgttaggttcgacctcaaccgtaaggtgtgggtagaaacaatcggctggaacacaaggacttacctgcactaccacacgatgccttgggcgctggtacgtgcttctgacgggaactttgacttcaagtaccttgagtggggtgctcgtactgttggagatgatacaactaacccatacccatcgtttaccggacagacaatcaatgatattttcttcttccgtaaccgtttaggcttccttagtggggagaacatcatcttgtctcgcacctcgaaatacttcaacttcttcccggcctccgtgtcaaactactccgacgatgacccaatcgacgttgcggttagccacaaccgggtgtcaaccttgaagtatgccgttccgttctcagaagagttactcctatggtctgaccaagcgcagttcgttctgacagcttctggtatcctttcgagtcgctccgtagagttgaaccttacgactcagttcgacgtgcaagacagggcacgcccacatggtgtaggacgtaatgtatactttgcatcacctcgcgcttccttcacatccattaaccgatactatgcggtacaggatgtaagctctgtgaagaacgcagaggacatgacggctcacgttccgaactacataccgaatggggtattcagtatatcgggtacaaccgctgagaacttcgcggctatccttacgagcggagcaccgaaccgggtgtatatctacaagttcctctatattgatgaagaaatcaggcagcagtcgtggtctcattgggactttggggacaacgttacggtgtttgcagcacaggtgataaactcaacaatgactgtattgatgagcaatgaacatgctgtgtggatgggacgcttgcacttcacgaagaactccatagacattccgggagagccttacagattatacatcgacgctaagaggaaatacaccatccctgccgggacgtataatgatgatacctaccagacgtccataagcctcgcagcgatttatgggatgaacttcactaagggtaaagtgtctgtggtcttccctgatggaaagattatagaggtagacccgccaatcaacggttggagcagtgacccggtgttacgacttgatgggaaccaagagggccaagtggtttacattgggttcaacatcccgttcacttatacgttctcgaagttcctcattaagaagactgctgaggacggctcgacggctaccgaggatattggtcgcttacagcttcggcgtgcgtgggtaaactatgaggactctggagcgttcaccatccgtgtgaacaacctgtcccgtgagttcatctacacaatggctggcgctcgtttgggttctgacaatctgcgtgttggtaggtcgaacattggcacagggcagtaccgcttcccggttgttggaaacgctcagacgaacatagtaactatcgagtcagatgcgtcaactccactgaacatcattgggtgcggctgggagggtaactaccttcgtcgttcttcgggcatttaacttaaagtctccctgcggcgaattaaccctcactaaagggagacactaatagatacgaggggttaaagcattatgtacattacaaagtgtttacaaatccatgccgacaactttcagccgtccatagaggacattctggaagctgaggcactaggtgttgaaccaaaggtaattcctgatgagaacactgtggcaatgcttagcgataacgctgtgttggcaattggtggcaatcagggagaccgagtgtggttccttacctctaagtacgtcccactgtttaacttaaaggagcgcttagagtttcgcaagttaatagtcgaatatcgtgatacgatgctgaaccagtacgagtccatttggaacttcgtatgggtaggcaataagtcacacattcgtttcctaaagacaatcggagcggtattccacaacgagtacactctcgatggtcagttccaactattcacaatctcaaggaggcagcgtgaagagatgtaagaaatgcggagaacttaaggctgtctccgagttctataaggacaagaagagtaaggacggcctacggagtcactgtaagccctgtcactacgtgtattacaagaaggactactcaaaggcgcgagagtttaaccttaagcgactgtacggaattactctggaagaatatgaagcgatgctccttaagcaagatggagtgtgcgctatctgcggtcttaccgagagagttgagggacgggcgttagcggttgaccattgccacgccactggcgctgttcgtggtctcctttgctctgcctgtaacatcgctcttgggaagttcgaggacgacaccgagcgtcttcggaaggcaataacatacctaggagggaattgattatgtgttggatggcagcaatcccaatcgccatgatgggtgcccaagctctaagtagccagaacagtgctgacaaggcacgagtggcacagacagaagctggacgccgacaggcaatggagatggtcaaagagatgaatatccaaaatgccaacgcctcgctggaacaacgggacgcccttgaagctgcatcctctgagttgacttcacgtaacatgcagaaggtacaagctatgggaaccatccgtgcagctatcggcgagagtatgctagaaggcgaatccatgaagcgcatcaagcgtatcgaagagggcaactacattcgggaggcaaacagtgtcaccgagaattaccgccgagactacgctagtatctttgcgcaacaattgggacgcactcagtccacagcaagtcaagtagatgcagtgtacaagagcgaggccaagggtaagtctggtctgatgcgtgtactagaccctctgtccattatgggtcaggaagctgcaagtcaatatgcggctggtggatttgacaagaaaggcggcaaccaagcagcacctatcagtgccgccaaaggaaccaagaccgggaggtaataatggctagtaaactaaatagtgttttaggcaatatggcgactcccggtatggaacgactccggggcgtcaaaggtatggactaccgggcagcaaccattcaggctgaacaaccaagggcgagtcttctggactccattagtcgattcgctaaggctggtgccgatatgtatatggcgaaagatgaacgtgataagcaacgagccgatgagcgctccaacgagattatccgtaagctgacccctgagcagcgccgacaggctatccagaatggtacactgctgtatcaggatgacccatacgcaatgcaagccttgaagttcaagacagggcgtaacgctgcgttcctcgttgacgatgaggttcaacaggccatcaaagagggtcgcttccgtactcgtgaagagatggagcagtatcgtcactcacgcctacaggaacagtcgaagtcgttcgctgagcagttcggcatcaatgagatggatgaggagtaccagaagggtttcaatgcgaacatcaccgagcgtaacattgctctgtatggcgcacatgataccttcctgagtgaccaagcgcagaagggtgctatcctgaactcgaaggttgaactcaacggtgtcctgtctgaccctgacctactgtctcgtcctgagtccggtgagttcttccagaactacattgacaactccttggtgacagggatgaccgacaatcaggctcagcaggttatctcttcgtccttgaatgacgtgctacagcgtccgggtggtgccgccttcttgcagaacattgagaaccgcaaggtaactcttaatggcgctacgactacctatcgtgaactgatgggtgatgaacagtggcaggccatgatgattaaggcacagcacactcaattccagaacgacgcgaagttgactgagaggttccaactgagtatcaactctgcgcttaaccaagaggatactggcaagggatgggaggcgctccaaggtatcaaggcggaactcgacaagattcagcctggagaagaacttacgcctgagcgccagcagctcaatgatgcccaagcgcatatgcagacgcgcttcaaacaagaggccgctgagactgcgaagctgatggacaagcagcgtaagaccctgaataaatctttggtcatcgacaagcagttccagaagagaatcaatggtgagtatgtctcaactgactacaaagatatgccaacaaacgagaacactggagagtttgtccatagtgatatggtgaactacgcgaaccagaagttagcgcagattgacgctatggacattccagaggcgcagaaggatcgcatgaagttgcagtacctccaagctgactctaaagatggtgcattccgcactgctgtaggtcagttggtgtcagatgctcgtggtgagtggaaggcggctgtcatcaatggcgagatgcctgatagcacaccagcccttgactccctacgcaagatgcgcaacattgaccccggattgttcgcagcactgtatcccgacgatgccgagctgtttcacacaatggatcaattggatcgacaggggataaagccgcaagccctcattaacgccaccaaatcccgtcaagggaaaacgcgtgaaatgcagattgaggatgagcgtgcgttcagcgagctgatgaacaactctgagcagcccgaactgaaataccttccggcttccatgcgtgagtacgctcagattatttatgactctgagaagtacctaacaggaaaccctaaggatgccatatcagcggttagttcgttcctaaaggacactacctatacattctcttcggataacgtagatggtggaacctacggtgtaatccctcgcaacatgatgcaggtaacagatgaccctaaatcttgggagcaaggtaaggatatcattgagcaagctgttaagaagtaccaagagcaaaacccttgggttaccaacaaacagcttaaggttagccaacagggtaacttaatcaagatttacgataccactaccaacttgggcataagttatgataacgcactgctacgcaaggtgtataagaactatgctgagcaacaggctgcatcggctgagaagaaagccttaacggaagccaataagcgagcacctatcgtcgcggcaaccaaggcccgtaaagaagcagctaagcgtgtccaagagaaacggaacaaggttcctaagtttatctatggacgtaaagaagactaacagtaaactataaggaggctccatgagctacgacaagacgaaaccatccgagtatgatgggttatttcagaaagcggcagatgaacatggggtctcctatgacctgcttcgtaaattagcattcaacgaatctggcttcaatccgaaagccaaaagccctaccgggccgttgggtatcatgcagttcactaaaggtacggcagcggggcttggactcaaggtgacagggggagatgacgatgagagattcaaccctgagttggctgtggacgcagcagctcgtcacctgagcgacctcgttaggaaatacgacggggatgaacttaaagcggccctagcgtacaaccaaggagagggacgcaatggcgctccacaaatgcaggcttatgaccgaggcgattgggcctctatcagcgaggagggccgcaactacatgcgtaaacttctcgatgttgctaacagcccgcgcaagggagacttggaggcgttcggtgggataaccccaaaggctaaagggattcctgctgaggacgcctttgctggaatcggtaaggccgggaaggtaggaactgagcttccacaatcaactggctttaagctggagggtgtggaacaacaggaacctgccgtaccgttcactaaggatttctacgataaacatggaactaccgttgaggaatatgaaaaccgttcaacattcttcgggataaaggacaccacaagtgccgagcttcataactcgctattgggtgttgccttcaatgctgcgcgttttgatgatagttttgacatcttcaaggacgctattaccccaactcgatggaactcctaccagccgacagctgaggatcttgacaagctccgcaacagtgggcttcctccgagttactactcagtggtgacaggtggtgacggtgataactgggatgacctgattaagatggcgaagagaaactacgagatggacgtgaaggctgctgatgctggtgtgggagcacaattggttggcggaatcgtgggagctggtgttgacccattgagctatgtgccgcttgttggtgttgctggaaagggtctcaaggtggtaaacaaggcgttcgttgttggtgcccaaagtgcagccttgggcgcagtttcagaagctgttcgcacatccgttgctggtggtgaggcgcactatcaagatgcaatccttgggggtcttatgttcggggccgggatgagcgcaatagctgatggagtgagtgcagcattgggccgtgttcgcgctggtcaagttagtaacgacttcgaccgcatggctactcgactggaggcgcgtgagtctgcctttcaagctggtggcgaggacttaacacgtatgccaacagagggtcgtacatttgacggggaacatgcgggtgtaaactactctcaacttgaaactgaaccgggggctgtggtgctgccgcaaggtcaaatcttgagtgacaccaacccgattaaccctcagacacttcatgagttcgagcaggttaaccctgagcgagcggctcgtggtatctctttgggtggattcgctgagatcagcctcaagacccttcggtcggagaatgagactgtgcgctccattgcgagtgaccttgtgcgttctccgacagggatggaatcaggctctaacggtaagttcggtgcgactgcttctgacattaaggagcggctccacgcgaacaatcagcgcacctacaatcagctttatgatgctgtgcgtactgcaatgaaagaccctgagttctctacaggtggtgtgaagatgagccgtaaggaagtacgtcaggaaatctataagcgtgctgccttagcgattgagagaccagagctacaatcgggactcacaaagggagaacgtaaggtgatggatatcctgaaacaacacttcgacctcaagcgagaactcatggaaaaccctgctatcttcggtaacgccaaagctcgtagcatcttccccggctcacgccataacggaacctacgtgcctaatgtgtatgaccgcgccataaagttgtacatggtgagtcgctacggtaacgagggactacaacgggcaattgcagagtcgtggcttacatcttaccgcgctcgtccagaagtcaaggcgagagtcgatgagtacctgatggagcttaacggtctcaagacggtacaggaagtaacaccagatatggttcagaagcacgctatggacaaggcgtatggtatatcgcacactgaccaattcacttcctcctctatcattgatgaaaaccttgagggtctggttggcatcgagaacaataacttcttggaggcccgtaacatgttcgacagcgacatggctgttaccctcccggatggtagcacgttctctgtgaacgacctgcgtaactacgatatggctgacattcttcctgcttatgaccgtcgagttgacggtgacgtggctatcatgggtggttcgggtaagacgacgaaggaactgaaagatgaaatcatggcgctggacaagcagtctgagggtaacggctcactgaaaggtgaagtcgaagcactcaaggacaccgtgaagattctgactggtcgtgcccgcatgaacccagagggagctttcggtacgattcttcgctccatgactgacttggctttcttcgctaagaacttctatatgccgttccagaacttcactgaggttgctgctatgttgagtaaaggaaacacctctgcggtacttcatggaatcccactgcttaacgattgggttagccggaggaagcctatgagcggctctgagattaaggagattcacagtatggtgttcgggaaggaactagaccagcttatgcgtccggggcgcgaagaccatatccgtcgccttcgggagtctactgacactaacgcagtggtggctaatgtggttgggactattcgcttcggaactcaggaattgtctgcgcgctcaccttggacgatgctgcttaatggaacctctaactacatcatcgatgctgccagacagggtgtactgggtgatgtggctggggcagcgctcgctgggaaaggatctaagttcggtaaagcgaattaccttaagtctgcctctgtgtcacctgagcagtggaagggaataaagcagttgttccgtgaccacgccactcgtgatgctgacggtaagtttacaatccgggacaaacaggctttcgccaatgacccacggactatggacttatggcgtctggctgataaggttgctgatgagactatccttaggccgcataaggtttcctcacaggacgccaaggcttacggagcggctgtcaagatggtgatgcagtttaagaacttcgtaatcaagtctcttaactcgcgcttcgtcagattgttttatgacgcgactaagaacaacagggctatcgattctgcgctgactgcaatcatctctatgggtctggctggtggttactatgttgctcaggtgcacttgaaggcttacggcctacaggagcacaagcgtaaggagtacctaaagaatgctcttgaccctaaaatgattgcccacgcgtcattatccagaagttcacaccttggttccccactgtctgtctatgatatgattggtggcttgttcggtaatgatacctaccagtacacccgctcaacggtgttaccaaaggaaaagaccgaacgtgaccgaaacaaggcttggactggtaaggaggttgcgggtaacatagtaggggcgatatccaaccaagtaccagctgtaggactagttgggaatattgggtctaccgccatgaatgcctctacgctacttagctctgatggtaagcagagtgaggtagagttccgtactggtgtgttcaacgccatgcgtgagcttgtccccaatgacccgctgacacaacagttgattatgcacatcttcgaagagcagggcatcaagattaaggatgatgcaacacgccctcgccaataaaccctcactaaagggagagaggtcacattctggcctcttctctcttaatgctaatttacaaaggaggtcacatggctacaaatattaagaccgtgatgacttacccgctggatggctccactacggacttcaatattccgtttgagtatctggcgcgtaagttcgtcagagtgacacttatcggtgttgaccgaaaggaactcatcttgaatcaagactatcgttttgcaactaagaccacaatctccacaacgagagcattggggccagcggacggttataacatgattgaaatccgtcgatttacctccgctaccgataggctggttgacttcaccgatggttcaatccttcgggcatacgacctgaacatctctcaggttcaaacccttcacgttgcagaagaggctcgtgacttaacggctgataccattggtgtgaacaatgatggcaaccttgatgctcgtggtcgtcgtatcataaacgtagctgatggtgttgacctcggtgatgttatcactttaggtcaagtcactcggtggaacgagtctgccctgaactctaagaacgccgctgctacctctcaggccgctgccaagacctcagagaccaacgctaagacctcagagaccaacgctaagacctctgagaccaacgcgtaccaatgggcgcagcgtgctgaggactctccggtacagggtagcgagttctctgcgtatcattactccctcaagtccgcaaaaagtgcaacagccgcgcatacgtctgaggtcaacgctaagacctctgagaccaacgctaagtcctctgagactaacgctaagacctctgagactaacgctgcatcgagtgctgctaaggcttctgaggaggctgctaagctgactaacatgaatgactttgctgccgctattgattcagtcaacggtaacaatgttgtcatgaagggtgacttcaccattaaaggaaacggtaaagtatcaatactgaaccacagtgggctataccaagataagaccgttaatggcgtgaactatgccaacaggatttatatggatgatgcaggggccatgcacttcgagaactaccgtgtgtctggtgcttcatccaccttacgtgctggttttgttattacagataccaacaggtttgactttacagggccaacgcgagttaatggtgaatctaccgtatatgtgtatgcgccccctaatccggctattggtcaatacctcaatgctgtggcagttcgctcacagcttcggggccgtggtggtaatggtgatccacttggtgcgtactgtggtatgtatattcaggagcacgttggtacagaccacgcgataatccttaacctcaatggttatagcaaggatactaactggcagctattctccaatggtaaaatatctacaccacttggtgatgtgatgacttcaggttctgatgttagaatcaaggatgatatcactaaacctcttgatggtgctggtgagcgtattgacgcaattggcatagtggaatacacagagattgccaccggggaacgtaaacgtgggtggctggcccaacaacttgacacgattgacccgctgtacacatacctaacgaccaccgcagaaggtagtcttttgaataccaacgacagggcgttgcttgctgacgtaataactgagcttcaagcactgcgtcaacgcgttaaagaactcgaaggacaatcaacaaagccagcggacggcacaacataaggagaacacaatgctttcttttgacttcaataacgaggtcgttaaggctgcgccgattgttggcacaggggtcgctgatggtgcggcccgactcttttggggactatcgttaaacgaatggttctacgttgcagccatcgcctacacagtggttcagattggtgccaaggtagtcgataagattattgactggaaacgtgcaaataaggagtaacctatgagcgacaagactttaatcaagctgctggagatgctggacacggagatggcacagcgtatgcttgctgacctccagagcgaggaacgccgaacgccgcagctttacaacgcaatcggcaaactgttagaccgccataagttccaaatcagtaagctgaccccggatgagaacatccttggcggtctcgcggctggtctggaagactacaacaaagtggtcggccctaatggtctgactgacgatgagaccatcacgctacagtaagtgacatactcaaggttctccacgtggggagcctttatggatgttatttggtgcatctgtgtgaaatctgaaaattgatgggaggtgttatgctaaaacttttacgcagcgcactcccttgggtactcgccgggacactctttatgggtggctggcacttagggtcaacccatgagagagcaaactggaaggaggtaatccaaaatgaatacattgcgaaaacaaaagcaaccgcagcaactcaggcagaggtcagtcgggtatcccgtgagtaccaagaagagattgcagccattgaaggcagcactgataggatgcttaatgacctgcgtagtaataataagcggctgtcagtccgcatcaaaacccttaccggactgccagaagataacggtagatgcgagtttaatggtcgagccgaactacacgagtcagatgctaagcgtattatcggaataacccaagctgccgatgctcacgtaagagcgctccagcgtactattaaggagatgcagaatgagcgacacccaagcaaaccgtaatgcgctaatcattgcgcagcttaagggtgacttcgtggccttcctgttcgtattgtggaaggctttggctctcccgccgccgactaagtgtcagattgatatggcccggtgtctggctaacggagacaacaagaagtttatcctacaggctttccgtggtattggtaaatcattcatcacctgtgcgttcgttgtgtggacgctatggcgtgaccctcagttgaagatactgattgtctctgcatccaaagaacgtgcggacgctaactccatcttcatcaagaacatcattgacctgctgcccttcttggctgagctaaagcctcgccccggtcagcgtgactctgtgattagtttcgatgttggccctgccaagcctgaccactctccgtctgtgaagtcggtgggcatcactggtcagttgactggtagccgtgctgatatcatcatagcggatgacgttgagattccgtctaactccgcaactcaaggtgcccgtgagaagctgtggactctggtgcaggaatttgctgcgcttctgaaaccgctgccgacttctcgcgttatctaccttggtacgcctcaaaccgaaatgaccttgtacaaggaactcgaagataaccgtgggtacaccacaatcatctggcctgcgctctatccgcgtagccgtgaggaagacttgtactatggcgaccgtctggccccgatgctccgcgaagagttcaacgatgggttcgagatgctccaaggtcaaccgactgaccccgtgcgcttcgatatggaagacctgcgtgagcgtgagttggaatacggtaaggctggcttcactttgcagttcatgctcaacccgaacctgagtgatgccgagaagtaccccttacgcctccgtgacgctatcgtgtgcggtctggacttcgagaaagccccaatgcattaccagtggcttccgaaccgtcagaatcgcaatgaagagctacctaacgtgggccttaagggtgatgatattcatagttatcattcgtgcagccagaacactggacagtaccagcaacgcatcctcgtgattgaccctagtggtcgaggtaaggatgagactggttacgcagtgttgttcaccctgaatggctacatctatctgatggaagctggcgggttccgcgatggttattccgacaagacccttgagtccctcgctaagaaagcgaagcagtggaaggttcagacggtggtcttcgagagtaacttcggggatggtatgtttggtaaggtattcagccctgtgctcctgaaacaccatgcagcctctatggaagagattcgtgctcgtggtatgaaggaactacgcatttgtgatacgctggagcctgtactctctacgcaccgccttgtgattcgtgacgaggtgattcgtgaggactaccagactgcccgtgacgctgatggcaagcatgatgttcgctattcgctgttctaccagttgacccgtatggctcgtgagaagggcgctgtggcccacgatgaccgacttgatgcattagcattgggtgtggagttcttacgctctacgatggaactggacgccgtgaaggtggaagctgaggtgcttgaggcgttcttagaggaacacatggagcacccaatccattcggctggtcatgtagttaccgctatggttgacgggatggaactctattgggaggatgacgatgcgaatagcaacaggttcattgactggtagttatgcatattgagtgcataaggaagcatcgagaccacggatggtcactttaagaaactccttaagaatcaatgagtttgaattaaccctcactaaagggagagaggggacttaaagctactatataggttagtcattcaggttatgcaatgaccttttatgcactttaagtctacctctgtgattggtgatattatcattatataatcacctaccttagagcaactgaaaggaggtggctcaatgttacgcttgctgattgccctgctgcgtcatagagtcacttggcgatttcttctggtacttactgctacccttgggtacgcaggccttactgaccacctcggtcaactggaagtggccttttgctctatactctcttgtggggattaaattattgttgatgacagacaagcggctctgagggattcgtaggtatagtttcactacaccaactcatccctgtagagtcaaccctaaaggttatacctaaagatgccctgtagttcgtaatggtcttacagggtcttctggtgtctcctagctatcccttctggatgcgcctatggtctcacctatggtgtggccttacctaaagtggttgcctaaagagaccctttaagaatttaccacaaaaatctgaatgggtatctcacagttcaagaaaccaaagtacccccatagccctcctaaagccacctaaagccagccctacccctagggtttaaccttcggttaaccttgggtatctcctcaagtggcctataggatagcctaaagtgttgcataaagtcaatacctaaagaggcggatggcttaaagaggccttgaagagtgtcctagtgtaccagttcgatagtacatctctctttgtgtccct

SEQ ID NO: 23 - DNA, 40420 bp, Unknown
  source: /note="Description of Unknown: KP2-15-2-1 Bacteriophage Sequence"
atctgttatcctcctaaagtaaaccctaaagccatcacctaaagccaccacctaaagaccagacctaaagccatcacctaaagagcagacctaaagccaacctaaagccaccacctaaagaccagacctaaagccaccacctaaagaccagacctaaagccaccacctaaagaccagacctaaagccatcacctaaagagtgccgctatcttaaagacaaccagaccgatagacccattgttaacctgtagtgatgccttgtagttatctgtagtcatttcataaaccctcactaaagggaataagggatacttaaagagggaataagggatttaataaaaagatttaatttaatggttgactttaagtaacccttaaggctattattcatcacgtcaacgggacaacggccttaaagccactccctgagatactggagtcaaccggataagtagacagcctgataagtcatacgaaaaacaggcattgacaacatgaagtaacatgcagtaagatgtaccacataacgttaaccaccgctctggtgtcttctaggtgacttaagcgcaccacggcacataaagcgaaacaaaaatggttgacaacatgaagtaaacacggtacgatgtaccacatgaaagacaccgagtgtcgtaggtgtaaaaacgcgacatagtggatagatggcgaaagcacaagcgaccacgataataaagagcttgtcgcacttataacgcaagtgacggctaacactgaaatagcctcggctcaacgaaactgtagcctaaagttctttaacaatctggataatagctcttgagtgtaccgatgtataagcgaataactcaaggtcgcactgaaagcgtggcctttatgatattcacttaacacgaactaacatgaggtaacaccaaatgattttcactaaagagcctgctaacgtcttctatgtactggtgtcagcattccgttctaaccttgatgatgaggtgaacatgagtcgccaccgccacatggtgagcgaattacgtgccgcaccgggtatctacggcgagcttgagtctaccgatttgaccgggtgctatcgtgagagtatcgcactggctccaaccgaggaaaagaccatgcgtgtactctgcaagaacaaagagcaggcactacaggtagctcgcttagcttgcaatgagtatgagcaagattgcgtactggtatacaaatcacagactcacacagcgggattggtgtacgctaaaggtatcgacgggtataaggctgaacgcctgccgggtagcttccaagaggttcctaaaggcgcaccactgaaagggtgctttacgattgacgagttcggccgccgctggcaagtacagtaagtgatagactcaaggtcatgcacgatgcgtggcctttatgattatcactttttgactatgaaggaatcacaccatgcgcttaaataaagacacagcggtagctatgcggtcagcaatcgaatcaagagccgcacacaacgtgggagggattgctgatgttgcacgggtttataaggagaaagggcttacattccgcagattcatgtgggactgttatcatgcagtgggctttaaagagactacaagaatcatcgcagagcacaacacggtgacagttatcggcgggcacataacagatatcaatgattcgcacatcgaaactatgctcaaggttgcactgaaagacatagcttattagtaattaactacaggtcgttagctcgtagcggcctgaatgataattactaaacaaacctgagaggatatgactatgaaacaatacgccatccttattcccggctggtgctactcaatgacctgctacgggtacaacgaaagggacgctcgtgccagattcagggatcaacaaggcttcggcaagcgtttacctaatggtacggctgtatgggaggttatgtaatgagtaagttactggcaacctctaaaatcaaaggccaatgcactgtaacgctgcgtgagtattaccacgggtcaatgggatgcacctatgttgtgcgatacggtaaacaggtcacgcactgggtaaaccttgttttggcacaagaggagtaccaagcctgtgtgatacaccaagcaacatgtgcaggctggaacgactgacaacagacttcaagtctatcaggtggtaaactcaaggtcgctccatgcgagtggcctttatgattaacattacgatagaggatgagagtatgggatacgaagacacgaagaacctgataattctctgtatagcaatacccgctgcaatcaactttgtgtacgaggtatggattaagaaatgattatcgcactaatcgcactggtctatctgtgcatcgctatgtactttatgcgagactttaagcgcggtctggcaatacacaaggcaacgctgagttactttaagtggggattcatcccacggtttacggttcgtgaacgtaacggacgctttaaggccaacaaggtgggagtattctacattgctacgcactaactcaaaacacgtaaagattgcactgtatgcgatggcttatggtgcatcgaaacgcaaggtcaaacgcatcttaacgagacaccgcaagatgaccgcacgacaggctgcaagcgctgtcaaatgggctgaatttactctttactcttcttacagataacaggacactgaacaatgactttcaccgaagcacaagccgcactcgaagctatccgcaacctgccgattgaccgcttggatgaacgccagcccatgctggtggctcttgcggctgctatcgtgaacgatgagactcaagacggcgaactgacgcaggccaaaggcaattggggcttggagtctatggactactggcagacactggctgagcgtatgcgtgatgttggatttgtacgcttgggtaacggtcactttagcgcagcatacgagcacgcattgttaccgggcaaggttatcaaggtaggctttaagaaagaggactcaggcgctgcctatgctgccttctgccgcatgaatcagggtcgtgagggtatccctacggtgtacgacattcagcgtcatacaggctgctacacggtggtcttggactatctgacaccgcttaacgattggtgctacggtgaaagcgataagattcgtcaccactttcaggccgcacgggaaatcattgaggaggattgcttcgataccgccgaagagtacccgataagtgacgggttcattgagacctgcaaggatatccgcaagttcttcctaggcattgcatcgttcgattgtcacagcggtaacatgatgaaagaccaaatgggccgattgattatcacagacccggtatcgttcagcgcagacaacaagttaaagccgggtgagtttcactgtgacccggatgaactaatcgctgagattgaggcgctgagggcgcaggaagcgattgaccgctgtaaggcacgcaaggcacgccgtgaccctaaaggagactttcaggcagcacgtaaagcccgtgccaaatggcgcagaaaggcctctaagcgtgctaaacgtgacgctaaggtaatcgctaagatgcgcatggatgacaacgagcaacgcagggccgagccgagggcgcgcatgttgtggggcgataagcactggcgtaacgcttgggtgcagcacatgaatgttgacttcgcacggctcgaactgttagcagccgcacagatggcacagatagaccacaaggctatcgtatggggcaagccgttacacatagacgcataccttgacaagagactgcaaggttgatagagtcttttcttacaggtcatcatgaggtggcctgaataggaacgatttatccatagtgaggcaagcaatgaacatcatcgaaactatcgaaaagaatgacttctctgaaatcgaactggctgctatcccgttcaacacgctggcagaccactacggcagcgcactggctcgtgaacaactggctttagagcacgagtcttatgagttaggtgagcgccgcttcctcaagatgctggagcgtcaagcgaaagctggtgagattgcagacaacgcagccgctaagccgttactcgctacgcttctccctaagttaaccgcacgcatcgttgagtggctcgaagagtacgcctctaagaaaggccgcaagcctagcgcatacgcgccgctccagttactcaagccggaagcctccgcgtttatcaccctgaaagttatccttgcatcactgaccagcacgaacatgacaaccattcaggccgctgctggtatgttggggaaggccattgaggatgaggcacgtttcgggcgtatccgtgacctcgaagcgaagcacttcaagaagcacgttgaggaacagcttaacaagcgccacgggcaagtctacaagaaagcctttatgcaggtggttgaggcagatatgattggtcgcgggctgctgggaggcgaggcgtggtctagctgggacaaggaaaccacgatgcacgtagggattcgactgattgaaatgctcattgagtccacgggtctggtggaattgcagcgccacaacgcaggtaacgcaggctctgaccatgaggcactgcaactggcccaagagtacgtcgatgtgttagcgaagcgtgcaggagcactggcgggtatctctccgatgttccagccgtgtgtcgtaccgccgaaaccttgggtggcaatcaccgggggcggctattgggctaacggtcgcagacctttggcactcgttcgcactcactctaagaagggactgatgcgctatgaggatgtttacatgccagaagtttacaaggcggtcaacatcgcacagaacaccgcatggaaaatcaacaagaaagttcttgcggttgtcaatgaaattgttaactggaagaattgcccggtagcagacattccatcactggagcgccaagagttaccgcctaagccggacgacattgacaccaacgaggcagcgctcaaggagtggaagaaagccgccgctggtatctaccgcttggacaaggcacgagtgtctcgccgtatcagcttagagttcatgctggagcaggccaacaagtttgcaaacaagaaagcaatctggttcccttacaacatggactggcgcggtcgtgtgtacgctgtgccgatgttcaacccgcaaggcaacgacatgacgaaaggtctgctgaccctcgctaaaggcaagccaatcggtgaggaagggttctactggctgaaaatccacggtgcgaactgtgcgggtgtcgataaggttcctttccctgagcgcatcgcgttcattgagaagcacgtagacgacattctggcttgcgctaaagacccaatcaataacacttggtgggccgagcaggattcacctttctgtttcctcgcgttctgcttcgagtatgcaggagttgcgcaccacggtcttagctacaattgctctctgccgctggcgttcgatgggtcttgctctggtatccagcacttctccgcgatgctacgcgatgaggtaggcggtcgtgcggttaaccttctgccaagcgaaaccgtgcaggacatttacggcatcgttgcacagaaagtaaacgagattctcaaacaggatgcaatcaacggcacgcctaacgagatgattaccgtgaccgacaaggacaccggggaaatctcagagaagctcaagctgggaacctcaacgctggcgcaacagtggctggcatatggtgtaacccgtagcgtaactaaacgttcggtcatgacgctggcttacggttccaaggagttcggctttcgtcaacaggtactggacgacaccattcagcctgcgattgacagcggtaagggcttgatgttcacccaacctaaccaagcggctggctatatggctaagctgatttgggacgcggtgagcgtgaccgtagtcgcagcggttgaggcgatgaactggctcaagtctgccgctaagctgctggctgctgaggtcaaggacaagaagaccaaggagattctgcgccaccgttgcgcggttcactggactacgcctgacggcttcccggtctggcaggaataccgcaagccactccagaagcgtcttgatatgattttcttagggcaattccgtctgcaaccgacgattaataccctcaaggattcaggcattgacgcacacaagcaggagtctggcatcgctcctaactttgttcactcacaggacggtagccacctacgcatgacagtcgtttatgctcacgagaagtatggcattgagtcctttgcgctcatccatgacagctttgggactattccggcagacgctggtaagctctttaaggctgtgcgtgaaacgatggttctcacctacgagaacaacgatgtgctggcagacttctatgaccagtttgcagaccagctacacgagacacaactggacaagatgcctccgcttccgaagaaagggaacctgaacctgcaagacattctcaagtctgactttgcctttgcataacaagcacttagcattaaccctcactaacgggagactacttaaggtctcccactttaagacactttaggtactaagagattaaatttatgattaacattaagactttccttaagaacatctttaagttaaaccgcttgacttccgttaagttctacgcttggatgcccggtagtgatgacctccgcaagactgaatttaagttaggcttaggccgtgcggtaaggtggtcacgaagttggaatgttactcaacggcctccgggatggtcatcttccagaccactgaggacaacgaaatgaaatccttctactacccgaaaggttcaacatgtggtcgtatcgaacgggcatacagttaaccctcactaacgggagagttaaacttaaggtcatcaccagcggtggcctttgtgattaactttcaatacacatcaacatgaggtaagatactatgcgtaccaactttgagaaatttaccaagcgcgattcagtggtcaacgagcatggcgaacagtggcaagagcgccgtgaccgcatgaagaaactccacaagcaacagcgcggtaactcacagaaacgggagtggaactaatgatgggacgtatctatagcggcaacctgaacgattacaaagatgcggtagagcgtctacaggaagaccatgacgtgaccgtgaaggtggagtcattcagttatgaaaacccagcgaagatgtgcaggtcatccggtgaggttctccgtgtgttcacacgctccgggcatctggtggcatccagaaccttcgagcacagcgacagcgatgtacaaatcaacgcgcagactgcacggctccgtaaggttcacagcgatttgaaacactggaagtaataaccctcactaaagggagaacgaaaggaggaaacattatgagaatttcatttgacttaatgagtccttcctttctctcatgggatacgggtcgtcacactggcggctctattcgaaacggctatagaagggttcgttatgaaggtaagtggttaaaccatcacatactcatttgggaacacttcaacggtgcagtcccggagggaatggaagtagaccacattgaccgtaacaaacttaacaacgcgcctagtaaccttagacttgtgacccgctctgagaacaacagaaatcggtcagtacaccggaacaacaagtcaggaatcaaaggtgtctactggcacaaacaccgacaagtttggtacggtcagtgtcgaagaggaaacaaaacatttatcaccgctggttgctccacgaaggaacaggcggcagaacttttagagaaactcaaagaggaaattaattatgatgattttcaaaaccgtcccgtataaggctgtgtcattcgtagagtctgccgttaagaaagcgctggagacctccggctacctaatggctgatatcaaatatgatggtgtgcgcggtaacattgtggttgacaacgtggctgaggccgcatggttgtctcgcgtatccaagttcatcccggcgctggaacacctgaacggtttcgataagcgctggcagcaactactgaacgatgaccgctgcatcttcccggatggcttcatgctggatggtgaactgatggtcaaaggcgtagacttcaacacggggtctggcctactgagaaccaagtggctcaagaagaacaacttcatgtttgaccgtggtggtgttgagccgctgaaaggttccaaagtagcctttgagttggacactaagcgcctgagcgtgcgcctgtatgcggtcatgccgattcacattgcggagtctggcgaggactacgatgtacagaacctgctgatgccgtatcatgtggaagccatgcgcgctcttctggttgaatacttcccggaaatcgagtggcttatcgctgagacctacgaggtctacgatatggattcgctgactgaactgtacgaagagaagcgtgccgaaggtcacgagggtctcattgtgaaagacccacaaggcatctacaagcgaggcaagaagtctggctggtggaagctcaagcctgagtgtgaagctgatggtatcattcagggtgtcaattggggaaccgaaggtttagccaacgagggcaaagtgattggctttagtgtgcttcttgagactggtcgtttagtagacgccaacaacatctctcgcgcactgatggacgagttcacagccaacgttaaagcccacggtgaagacttctacaacgggtgggcctgtcaggtcaactatatggaagagaccccggacggctccctgcgtcaccctagcttcgagaagttccgaggcactgaggacaaccctcaagagaaaatgtaaccaactcactggctcaccttaacgggtgggcctttcttcgttctagggaattaaccctcactaacaggagacacaccatgtggcttatcctattcgctatcgtcgcaacgcttggattaatggctgccgacgacaacatttggcctgattgttaaggagacaacatcatgcgtttacacttcaacacatcaaatggtatcttttcggttcgccgtgaagaccgctctacagcagtggcctctgagcgcaacgccaagctgccgctgattggttcggtcgtcccattgtcgccgcgtgttcacctactgatcactcgtggagagttcattaaggcgatgaacaaagagcgcccgcatctggaagccgtggtcacttactggcctcgcatccgtctgttcgttaagtggattaaggaggttctgtaatgctacaacatcattggaacaaaccagacttagaggctcgcttcccggttaactctgctgtgcgatactccggcgacttcctcaagcgcttcttaggcatgagcggagtggtcactggtcactcgaacacaggtcgcgttaaggttcgcttcggtaatcagcacgctgagtttcttcctgacaacctgattccgctgcctaaagctgacgttaagactccgaacgtggaagcaccgaaggcagaattcaagtctgacgtgacccacccgaaccattacatgctgttcgacaacgtggaagccattgaggttatcgcccggtcaatgaccgtcgaggcgttccgtgggtactgccttgggaatattttgaagtaccgcctgcgtgctggcaagaaatctgaactggcaactatggagaaagaccttaagaaagcggctttctatcaggaactgtttgataaacataaggggctgtgttatgacgcttcgtgaatgctgcgattggtgtgccgctaagtggaaccaagctattgaggatggtgataaggcggctgctgacgcttaccaacaattgtacgcgctgtgggagcggcgctttaaggaggctcaaagtggagcaacgtgaacagaaatacctcctgacgatagaaggcaacaccgagtcctttgaggttccggtattcgcccggtctctcgaagaggcaacgctacaggctgaacattatgaggacgctgggttcgtagtgactcgcatccgtccagaagtgaaagcctaattaccctcactaaagggaacaacccaatcattaaccacaaaggagaaacattatggctggtttcaagaagaaaatctacacctctggtcttggcactgctgagccttatgcttacctgagtaagccggattatggcaacgaagagcgtggcttcggcaaccctcgtggtatctataaggtagacctgactctttccaataaagacccgcgctgtcaggcaatggtcgatgaaatcgtgaagactcacgaagaggcttatgctgctgccgtggaagagttcgaggctaaccctccgcaggcacagcgtggtaagaaaccgctgaaaccttacgagggcgacatgccgttcttcgataacggtgacggtacgactaccttcaagttcaaatgctatgcgtctttccaagacaagaagaccaaagagaccaaacacatcaatctggtagtggtcgatagcaaaggtaagaagattcaggacgttccgattatcggtggtggctctaagctgaaagtgaaatactctctggtgccttacaaatggaacaccgctgtgggcgcaagcgtcaagctgcaacttgagtccgtgatgctggtcgaactggctaccttcggtggtggcggtgaagatgagtgggccgatgaagtcgaagacggtggttacactgcgagtgaatcccgtcagtcccgcgatgagcaggagtggcaggaagacgagcacgaagaaaccccggatgaggatgaggatttttaaatggaacttaaagagaaactaaaggcttacagcgaagtttctcataacgggtgctgggagtggcaacgctaccggatgccctgtggttacggtaggattagacacggaggccgaatggaactaacgcatcgtctatcctacctagcattcaacggggatatacctgagggtcttgttgttcgccataagtgtgacaacaaatgctgcgttaaccctgagcaccttacgctaggtactcaaaaggacaacgttaaggatgcaatagaccgtggtcaattcgtctacagggagaacccgaaaggcgcaaagcaccacatggctaaacttaatgagaaacaggttatggaggtttacaactcgacacagacccaaagcagcctagcagagacctatggtgtatctcgacaattaatcagcgcgattaagagaggtaaactatggcagcacgttacgcagcacgtggagttaaacgagtagggtcatatagaagcggcttagagcagaagaacatggagatgctggaacgtaagggaatcaagggacagtatgaaatgtggtctattccctatgttgtccctgcatcgaaccacaagtacacaccagacataatcctacccaacggaatcattattgagaccaagggtctatgggatagtgaagaccgtaagaaacacttactgattcgtgagcagatgcctgagttggacattcgtttggtattctcttcgagccgctctaagttatacaaagggtctccaaccagttacggtgagtgggccgaaaagcatggtattctatttgctgacaagctgattcctgtggagtggcttaaagaacctaagaaggagataccgtgggataaactaattgcaaagaaaggagttaagaaataatggctaaggtacaattcaaaacgcgcgcttctacggaagcaatctttgtgcactgtagtgcaaccaagccaagccagaacattggcgttcgtgagattcgtcagtggcacaaagagcagggctggttagacgtaggatatcacttcatcatcaagcgtgatggcactgtggaagcaggccgcgatgaactggctgtaggttcccacgttaaagattacaaccacaactccgtaggcgtatgcctcgttggtgggattgatgataaaggcaagttcgacgccaactttacacctgcgcaaatgcaagcgctgcgtagtctactggtcacgctgctggcgaagtatgagggttcagtccttcgtgctcaccatgacgttgcacccaaagcctgcccgtccttcgacttgaagcgctggtgggagaagaacgaactggttacatctgaccgagggtgatgccatgaggatgatttgtattcgctgtgataaaccgttgaagagtcgtgtaccgtcacgtcagtgtcagtgcaaagacccaatcaaggcggaggaacacaccgaggaataattaacactcactaaagggagacttaacggtttccctttgttctcgcaactgattaaggaatgtacaatggaacgagaagacgatagtatctttctgtttcatgctccatgtgaaaactgtgggtcttctgatggtaactctgtgtactctgacgggcatgaatggtgcttcgtgtgtgaacatcgagtacccgcaaacaaagagcgtgaagcaaagttatcaacgagaagacgcacaggaggcagtaagcctatgagctatgacgtatggaatttcggcgacagcaacggtcgatactctgacctgactgcccgtggcatctcgaaggagacatgccaaaaggctggctactggctggcgaaagtggacaaccgaatgtatcaggttgccgactaccgagaccagaatggctccatcgtgtcgcagaaggtgcgcgataaggacaagaactttaagaccaccggaagccacaagagcgatgcattgttcttgaagcacctctggtctggcggtaagaaaattgtggtcacggagggcgaaattgatgcgctcactgtgatggaactccaagactgtaagtacccggtcgtatcattgggtcacggtgcctctgctgctaagaagacatgcgccgctaactatgaatactttgaccagttcgagcagattatcttgatgttcgatatggatgatgcaggccgtaaggcagttgaagaggccgcacaggttctcccggctggcaaggttcgtgttgccgtgttaccgtgtaaggacgccaatgagtgtcacatcatgggtgaagacaaagcaatcttggagcagatctggaacgcgaacccttgggtgcctgacggtgttgtttccgcgttatcactcaaagaccgcgttaaggaagctatgacctccgagtacgctgtaggtttattatttgatggctgtcaaggcctgaacgatagaaccttgggtgcccgtggaggcgaagtcatcatggtcacttccggttcaggtatgggtaagtcaacgttcgttcgtcaacaggctctgacttggggcaagcgaatgggtaaacgtgttggcctagcgatgctggaggaatccgttgaggataccattcaggacatgatgggcttgaacaataaggttcgtctgcgtcagtctgatgaagtcaagaaggctatcgcggaggacggacgtttcgatgaatggtatgatgaactatttggagacgatacgttccacctttatgactcctttgcggaggccgaagctgacaggctgttagcaaagctggcctacatgcgaacaggcttagggtgtgatgttatagtgctagaccacatctcaatcgtcgtgtctgcctctgaggaatcggatgagcgtaagatgattgaccgcctcatgactaagctaaaagggttcgctaagtcaactggtgttgtgctcgtagtgatttgtcacttgaagaacccggagaaggggaaagcgcatgaagaaggacgcgctgtgtctattactgacctacgtggtagcggtgccttgcgtcagttatctgatactatcatcgccttggagcgtaaccagcaaggtgatatgcctaacttggtgttggttcgcctgcttaagtgtcgtttcactggcgacactggaattgctggatacatggagtacaacagagaaaccgggtggcttgaaccgtctagctacactggcgaagaaggagaaggagatactggctggactgaacaagacggacagtcagacttctaaaggatgcccgtgtgggcattccgattgcgatggaatcatgtaccactaattaaccctcactaacgggaacaacctcaaaccataggagacacaccatgtttaaattcattaacactttaggcaagctggtagtaaaactgtacttcatcgaagccaagaagctggacaagaaggccaaagctgattcacagcgagccattgagttggcgaaacagtcccgcgagaaatccgatgcggctgttagtggcatccacaagtcggcagcgattgcagccaaagcacagtccatgagcaaattctttgagtaaggatcgaacactatgagcaagtcaatcactcacgcaaacaccatccgtctgccagacaccgccgaccagttctcccgccgagtacacatcaatgtgcgcggcgagaaggtcacgatggtctaccgctggaaagaccacaagtctccgaaagcacacactcaacgaatgaccttggatgacaagcaggtcggtcgcttgatgggtgcccttactatggctgctgacaaggtggtcggtgataaccgtgagcgtctggtagagttcggcgctggtatgcaagagattatcgagaagtgataaactcaaggtcgcccaagggtggcctttatgattatcatttagcacgaaaccaaaggagggcattatgctcgtaagtgacattgaggccaacaacctcttagagaaagtcaccaagtttcactgtggcgttatctatgactaccgtgatggtgagtatcatagttatcgtccgggcgacttcggggcgtatctggatgcgctggaagccgaggtgaagcgaggtgggcttattgttttccataacggtcacaagtatgacgttccggctttagagaaactcgcaaagctgcaactcaatcgtgacttcaagttaccccgtgagaattgtattgacacattggtactctcgcgtttacttcatgcgaaccttaaagacacagacatggggcttcttcgttccgggaaactacccggtcgtcgcttcgggtctcacgctctggaggcatggggttatcgcttgggcgagatgaaaggtgaatacaaggacgacttcaaggctatgctggaagagcagggcgaagagtatgttgatggtgctgagtgggtttcgttcaacgagccgatgatggcgtataacgttcaagacgttgttgtcactgtcaagctcttagagaaattccttacagacctccactacttccctgctggtatggacttcacgaagtacgatgcggatttattctggcgtgaagctggcgagtctgtggatattgaacatcgtgcagcgtggctgttagcgaagcaggagcgtaacggcttcccgttcaacacacaggccattgaggaactttatgtagaactggcagcgaaacgcgccgaacttctgcgaaagttaaccgaaacgtttggctcgtggtatcaaccgaaaggtggtaaggaactcttcaagcacccacgtacaggcaagccactgccgagttatcctcgcgtggtctatccgaaacagggtagcgtgtacaagaagcctcgtaataaggcacagcgcgaaggtcttgaaccttgcgacttggacacgagggactacatggagggtgctccgtatactccggtagagttcgttacgttcaagccaagtagccgtgaccacattcagaagaaactacaggaggccggatgggttcctgagaagttcaccgagaagggtgcgcctgtggtggacgatgaggtcttggagcatgtacgagtagatgaccctgagaagcaggcgtgcattgacttgattaaagagtacctgatgattcagaagcgtatcggtcaggcggcagaaggagacaaagcgtggttacgttatgttcaagatgacggtaagattcatggagccgttaaccctaacggtgcagttactggtcgtgctactcatagtttcccaaaccttgcacaagtacccggcgttcgttctccttacggggagcagtgtcgtagcgcttttggtgctgaacatcatttggatgggattactggcaagccgtgggtgcaagcagggatagacgccagtggcttagagttgcgctgtctggcacacttcatggctcgattcgacaacggagagtatgcgaatgagattctcaacggtgacattcacaccaagaaccagaacgctgcggaactcccaacgcgagacaacgccaagaccttcatttacgggttcctttacggagccggagatgagaagattggtcagattgttggggcagggaaggagcgcgggaaggaactcaagaagaaattcttagagaacaccccggcgattgcagcgctacgagaagctatccaacaatctctcgttaagtcttccgcttggattggcggtgagcagaaagtacagtggaagcgccgttggattaaaggtctggatggtcgcaaggttcacgtcaggtctccacacgcagcgctcaacacattgttgcagtctgctggtgctctgatttgtaagctgtggattatcaagaccgaagagatgctcattgagaaaggcttgaagcatggctgggatggtgactttgcgcagatgggatggattcatgatgaagtccagattgcgtgccgaacagaagagatagccaaggtcgtcgtagaggtagctcaagaagctatgcgctgggttggtgaacattggaacttccgttgtcgcttagacacagaaggtaagattggcccgaactgggcggtttgtcactaaggagtatttatgggaggcgtggctacactaaggttccacaagatgccgaccgggtgtgtagtctgcgtttcacataagcgcaatcacgatggctacttccggtacagtatagggtcgtccagaaagggcgagaagaaatgctttatgtttcaccgctgggtttgggaacgacaccgtgggcctataccagaagggtatgagatagaccacttgtgtctcaaccgtgggtgctgcaacgtagaacacttacagtgcataccgaagcgtgaacacataatcaaaaccaacaaagagcgcagtctcgtaaaggagaaacattatggcaatgaccaaacactttaaagtaaccttcgacgttaccgctgtgattgacagtgaatccgagaagaatctgaacgagttgctggtagacctagctaagaaggccggggctggcgagaagctgaatccgttcaaacaagaactgcttattcaaggtctgacacacgggccggaaggtgctgctgcgttctgtatcaagcaaggtctccgtgagtttatccgcgatggtcacagtgagttaagctctaccgagcagaagctgatgagattctcacctgcaaccgtgcgcgaggtgttcaaatgagtgaatacctgaaagttctggcagctatcaaaggttgccctaagtcctttcagtcgaactatgtgcgaaacaatgcggctctcgtagctgaggccgcttctcgtggacacattagctgtttgactgtgggtggtcgaaatggtggagcatgggaggtcacagcctctggtgtgcgcttcctgaaacgaatgggaggttgcgtatgattatgcctaagagtgacaccgtaacgatgacccgtgatgcgtggaacgatgttagcgcgtatattgataagctggagaaagacctagagttcctgaatgcgcttaaggcgtgtggtgtggataattgggacggatactctgatgcagtcgaaatggtttacggggaggatgacgaatgagcctaatcacattgaaagacttcgtggagatgcgtgaaggtaagcctatggagaatggagtgctggtcatggatggtgactggttggtatatcagtcaatggctgctgccgaagttgagacggattggggagatgacatttggactcttgagtgtgaccacgccaaggcacggagcattctcgattctgcaatcgaatcgtaccgaacccgtaagaaggcttggagtgacgctatggttgttctggcgtataccgacgatgtgaactggcgtaaggtactggttgatgagacctataaggagaaccgtaaggcgacccgtaagcctgtgggctaccgtgacttcctgtcgaagttgtgggagcgcgatgagttcattcacatcaaagaggacatgctggaaggtgatgacgttatgggtatcattgggtctggtcacgaggtcttcggcttcaagaaagctgtgttggtctcctgtgataaggacttcaagactatcccggacgttgacttcctgtggtgtaccactggtaacatcttgacgcagaccaaagataccgctgattggtggcatctcttccagaccatcaagggtgatatgactgatggctactcagggattcccggctggggcgatacggcagaagccttcctgaatgacccgttcattgtggagcctgtagagtccgtgttgaagtctggtaagaacaaggggcagacagtaaccaagtgggtgaagcgtgctcctgatgcgactgagacgctgtgggactgcattaaatccattggtgccaaagctgggatgaccgagcaggaaatcatcaagcaaggccagatggctcgcattcttcgcttcgaggaatacaattacattgacaaggagatttacctatggacgccgcaaagctgattaccgtcgctgtgctggtaggtatgctggcgcgaggtctctggatgttcgctctcatagtccgagacgttaatcgagactccgagattaagtgataaactcaaggctctctgtattaaccctcactaaagggaagagggagcctttatgattattactttaagacttaaccttaagaggtgaaattatgttacaaccaattaatcatgttttaactcatcccgatgatattcctagtatgcctcgtgcagctaaagagtatctacaggtgcgcttcaatcaggcctatgtggtggagtccggggagtaccgtgcgctccgcgctgcgggttactctgagtctttcattgctggtgtgatgcatggtctgtaccttgcctctcgaacacttgatgagattgaggtgcgtaaagagcaactgagacaggagtaattatatgtgctggaaaccgaaggtgaaagtccctaagatggacactaaccagattcgcgctgctgaaccagcacctttgactgaacctccgaagtctgtggtatggggaggcgatgatgacgaggacaccagcgtgtcttcctctgaggtgccaacctcaccgagcagcggtaagagcagtctcaaggtaaagctggatgacagcgcagccaagaacaagagtaaatcctccattcgctcaaaggcgtttgggtaactgagtcatagtatagggagaaacatcatgggattcttcaagaaaatcaagaaggctgttaagaaagttgtgaaggaagttagcagaccagtcgagaaggcaggtaaggaagttggtaaggttgttggaggcgcgctgggtgcaggtaagcaggagattatccaacaagaggctccagcaccagtagtagctgcaccgccaccagcacagattgtagacgtacctgaacaggataaggctgagggcgaggatgaggcgcaaaccgagagcgcacgtaagaaggcacgcgctggcggtaagaaagcacttagcgtagctcgcagttccggcggtggaatcaatatctgaggaggactgaatggctgattcaaaacgtacaggattgggcgaagacggtgctaaagctacctatgaccgcctgacgaacgaccgtagagcctatgagactcgtgcggaaaactgtgcgcaatacaccattccgtccttgttcccgaaggagtccgataacgaatctaccgactacacgactccgtggcaggctgtaggtgcgcggggtcttaacaatctggcctctaagttaatgcttgcgttattcccgatgcagtcgtggatgaagctgaccattagcgaatatgaggcgaagcagcttgttggagaccctgatggactcgctaaggtggacgaaggtctgtctatggttgagcgtattatcatgaattatatcgaatccaacagctaccgtgtgacgctctttgagtgcctcaagcagttgatcgtggcaggtaatgcactgctttacttaccggaacccgaaggtagctacaatccgatgaagctgtaccgattgtcttcttatgttgtccaaagagacgcatacggcaatgtgttacagattgtcactcgtgaccagatagcctttggtgctctcccggaagacgttcggtctgcggtagagaaagctggtggtgagaagaagatggacgaaatggtcgatgtgtacacccatgtgtatctcgatgaagagtccggcgattacctcaagtacgaggaagtagaggacgttgagattgatggctccgatgccacctatcctactgacgctatgccctacattccggttcgcatggttcgcattgatggcgagtcttacggtcgctcctactgtgaagaatacttaggtgacttaaggtctcttgagaatctccaagaggctatagttaagatgagcatgattagtgcgaaggtcataggtctggtgaatcctgctggcattacgcagccccgtagattaaccaaagctcagactggtgacttcgttcccggtcgccgagaagacattgatttccttcaactggagaagcaagctgactttaccgtagcgaaagctgtgagtgaccagatagaagcacgcttatcgtatgcctttatgttgaactctgcggtacagcgcacaggtgaacgagtgaccgccgaagagattcgatacgttgcgtcagaactggaagatacgcttggtggcgtatattcgattctgtctcaagaactgcaattgcctctggttcgtgtgctcttgaagcaactccaagcaacctcgcagattcctgagctaccgaaagaagccgttgagcctactatcagcacaggtctggaagcaatcgggcgtggtcaagacctcgataagctggagcgctgtatctccgcttgggctgctctggctcctatgcagggagacccggacattaaccttgctgtcattaagctgcgcattgctaacgccattggtattgatacttctggtatcctactgacggacgagcagaagcaagcactgatgatgcaggatgcggcccaaacaggtatcgagaacgccgccgccactggtggggctggtgttggtgctctagcgacctcaagtccagaagctatgcagggtgcagcagcacaggctggcctagacgccacctaataaccctcactaaagggagacctcatctttgaaatgagcgatgactaaaggttggagtcctttggtttccctttatctttaacaacttaggagatttaacaatggctgaatctaatgcagacgtttatgcgtccttcggtgtgaacaacgcggtaatgaccggaagtacacctactgaacacgaacagaatatgctgagtctcgatgttgctgcccgtgatggcgatgatgcaatcatacttagcgaggaacctagttcttatgacgatgacccttatgcggctggtgaagacccattcgctgatggtgaagacgatgagggccgcattcaggttcgtatcagtgaagatggtaacgaagctgagttcgacactggtagcgataacgctgaggtggataccgaaggtgaggccgctgagtttgagccgctgggtgacactccagaagaactgagccaagtgactgaacaattaggtaagcacgaagaaggctttcagtcgatggtcgagcaggccgttgagcgtggactgagtgcagagtctgtgactcgtatctacgaagagtacgaagccgatggcatctctgagaaatcctatgcggaactcgaagctgctggatatagccgtgcctttgtggactcctacatctccggtcaggaagcccttgtagaccagtacgtcaatcaggtggttgcctttgctggtggtaaggagcgctttagcgcaatctatacgcaccttgaagcgaccaacccggctgcggctgagtcccttgagactgccatgatgaaccgagacttggcgactgtcaaagcaattatcaatctggctggtgagagttacacgaagaaattcggtaagccagccaaccgtagtgttaccaagcgtgctactccggttaaacctgtagctcgtcagaaagagggctttacgaatcaggctgagatgattaaagctatgagtgacccgcgttaccgtagtgatgctgcctaccgtcaaatggtagaacagaaggttatcgactccagtttctaattaaccctcactaaagggagagaccatagatgactacaatggttgaatcacctgagcacagaactttgtggacgctcccgtaggtgaaacattgagaaccaactcgattcaagtagtaaccaaacttttctttaaattaacataaggagattcaacatggctaacattcaaggcggacagcaaattggtactaatcagggtaagggtcagtccgcagcggacaaattggcgctgttcctgaaagtgttcggcggtgaagtcctgactgctttcgctcgcacctccgtgaccatgcctcgtcacatgctgcgctctattgcttctggtaagtccgcacagttccctgtgattggtcgcaccaaagccgcttacctgaaaccgggtgagaacctcgatgacaaacgtaaggatatcaaacacaccgagaaggtaatcaacattgatggactgctgactgcggacgtgctgatttacgacattgaggacgcgatgaaccactatgacgttcgcgctgagtacaccgcacagttgggtgaatctctggcgatggcggctgacggtgctgtgctggctgaactggctggtctggttaacctgcctgacgactccaatgagaacatcgagggtctcggtaagcctaccgtactgactctggttaagcctaagactggcgacctgactgacccggttgagctgggtaaagcgattatcgctcagttgactatcgctcgtgcgtccctgaccaagaactacgttccggctgctgaccgtaccttctacaccactcctgataactactctgcgattctggccgctctgatgccgaacgctgcaaactatcaggcactgattgaccctgagcgcggtactatccgtaacgtgatgggcttcgaagtggttgaggttccgcacctgaccgctggtggtgctggtgatacccgtgaggatgccccggctgaccagaagcacgctttcccggctacttccagcgctaccattaaggttgctctggataacgttgtgggcctgttccagcaccgctctgcggttggtacggtcaagctgaaagacttggctctggagcgcgctcgtcgtgcgaactatcaggctgaccagattatcgctaagtatgcgatgggtcacggcggtctgcgtccagaagctgctggcgctatcgtgctgccaaagacttcgaaggcttaatggtagcgcctttgagtatgaacgcggagagtgaagtggagccgacccaagaggtagccgccgaagtagctctcacgcctcaacagaaggccgccattactcgtgctcgtaacaaggcacttaagtctcaataacaacaagcaaaccccttgggttccctctttgggagtctgaggggttttttgctttaaaccctcactaacaggaggtaacatcatgcgctcttatgagatgaacattgagaccgcagaagagctatcagccgtcaacgacattctggcttccatcggtgagccaccagtatcaacccttgagggtgatgcgaatgctgacgttgcgaatgctcgacgtgtactcaataagattaaccgacagattcaatcacgaggatggacattcaatattgaggaaggtgtgactcttctaccggatgcgttctctggtatgattccatttagctctgactatctgtccgtaatggcaaccagcggtcagacccaatatatcaaccgtggtggctatctctatgaccgctctgcgaagactgacagatttccttctggtgttcaggtcaacctgattcgtctgagagagttcgatgagatgcctgagtgcttccgtaactacatcgtcaccaaggcttcacgccagttcaacaaccgattcttcggtgcgccggaggtagacggagtgttgcaggaagaagaacaggaagcgtggcgtgcgtgcttcgagtacgagttagactacggcaactacaacatgcttgatggcgatagtttcgttcagggtctattgacgcgttaatagtaaggaggcacttatgccagcacatagaaaagaaataatcaacgggtgtaaagagtgctctaagtgcctcacagttaaaccgttggaagagtttggtaagtcgagcagaccgggtggtcaatcccaatgcaaagagtgccgtcagtcaggtaagcgcggcaggcctgtaagccccacacaacgtgagtctcaccgggcgtgggtgttgctgaacacctatgggataaccgttgatgattttaacaaaatgcttgaggatcaagcgggtgtttgtaagatatgcggtaagggcccttctggtcgattcaagcacctgtgcgtagaccactgccacacaactggacaggtgagaggactactatgccacgcctgtaacaagtcattagggttccttgaggatgaccctgataggattaaacgtctaatagcttatttaggaggtacacaatgtcactaattagccagtcgattaagaacctcaagggcggtatcagccaacagccagatattctccggttcgctgaacaatgtagcgtacagattaacggttggtcttctgagtccgagggtctccagaagcgcccaccgatgattcaccttaagacccttggcgctgctgggtatgtgggtgcgcaaccttacgtgcatcttatcaaccgcgatgagttcgagcagtatttcgcggtgttcactggtgaagacattaaggtgttcgacctcgatggtaaggagtaccaagtacgtggagaccgctcttatgtacgaacagccaacccacgggaagaccttcggatggtaacggtggctgactatacctttgttactaaccgcaaggtggttgtgcagagtaacgaccaatcggtcaaccttccgggctttaaagaccaaggtgatgcgctgattaatgttcgtggtgggcaatatgggcgtagactctcaatcgagttcaacggggctgagcgtgctgctattcaactaccagacggctcacaaccagcacacgtcaatgaggttgacggtcaggccatcgctgagaagctggcggctcagttgcggaataacctaggtaacccaaacaatgaacaaaacccaaataagtggcgcttcaacgttggccccggattcatccatatccttgcgccaaataacgataacgtttggggactacagactaaggatggttacgcagaccagctaatcaaccctgtaacccactacgctcagtcgttccagaagttgcctattaatgctccagatgggtacattgtgaagattgtaggtgacacctcaaagactgccgaccagtattacgttaggttcgacctcaaccgtaaggtgtgggtagaaacaatcggctggaacacaaggacttacctgcactaccacacgatgccttgggcgctggtacgtgcttctgacgggaactttgacttcaagtaccttgagtggggtgctcgtactgttggagatgatacaactaacccatacccatcgtttaccggacagacaatcaatgatattttcttcttccgtaaccgtttaggcttccttagtggggagaacatcatcttgtctcgcacctcgaaatacttcaacttcttcccggcctccgtgtcaaactactccgacgatgacccaatcgacgttgcggttagccacaaccgggtgtcaaccttgaagtatgccgttccgttctcagaagagttactcctatggtctgaccaagcgcagttcgttctgacagcttctggtatcctttcgagtcgctccgtagagttgaaccttacgactcagttcgacgtgcaagacagggcacgcccacatggtgtaggacgtaatgtatactttgcatcacctcgcgcttccttcacatccattaaccgatactatgcggtacaggatgtaagctctgtgaagaacgcagaggacatgacggctcacgttccgaactacataccgaatggggtattcagtatatcgggtacaaccgctgagaacttcgcggctatccttacgagcggagcaccgaaccgggtgtatatctacaagttcctctatattgatgaagaaatcaggcagcagtcgtggtctcattgggactttggggacaacgttacggtgtttgcagcacaggtgataaactcaacaatgactgtattgatgagcaatgaacatgctgtgtggatgggacgcttgcacttcacgaagaactccatagacattccgggagagccttacagattatacatcgacgctaagaggaaatacaccatccctgccgggacgtataatgatgatacctaccagacgtccataagcctcgcagcgatttatgggatgaacttcactaagggtaaagtgtctgtggtcttccctgatggaaagattatagaggtagacccgccaatcaacggttggagcagtgacccggtgttacgacttgatgggaaccaagagggccaagtggtttacattgggttcaacatcccgttcacttatacgttctcgaagttcctcattaagaagactgctgaggacggctcgacggctaccgaggatattggtcgcttacagcttcggcgtgcgtgggtaaactatgaggactctggagcgttcaccatccgtgtgaacaacctgtcccgtgagttcatctacacaatggctggcgctcgtttgggttctgacaatctgcgtgttggtaggtcgaacattggcacagggcagtaccgcttcccggttgttggaaacgctcagacgaacatagtaactatcgagtcagatgcgtcaactccactgaacatcattgggtgcggctgggagggtaactaccttcgtcgttcttcgggcatttaacttaaagtctccctgcggcgaattaaccctcactaaagggagacactaatagatacgaggggttaaagcattatgtacattacaaagtgtttacaaatccatgccgacaactttcagccgtccatagaggacattctggaagctgaggcactaggtgttgaaccaaaggtaattcctgatgagaacactgtggcaatgcttagcgataacgctgtgttggcaattggtggcaatcagggagaccgagtgtggttccttacctctaagtacgtcccactgtttaacttaaaggagcgcttagagtttcgcaagttaatagtcgaatatcgtgatacgatgctgaaccagtacgagtccatttggaacttcgtatgggtaggcaataagtcacacattcgtttcctaaagacaatcggagcggtattccacaacgagtacactctcgatggtcagttccaactattcacaatctcaaggaggcagcgtgaagagatgtaagaaatgcggagaacttaaggctgtctccgagttctataaggacaagaagagtaaggacggcctacggagtcactgtaagccctgtcactacgtgtattacaagaaggactactcaaaggcgcgagagtttaaccttaagcgactgtacggaattactctggaagaatatgaagcgatgctccttaagcaagatggagtgtgcgctatctgcggtcttaccgagagagttgagggacgggcgttagcggttgaccattgccacgccactggcgctgttcgtggtctcctttgctctgcctgtaacatcgctcttgggaagttcgaggacgacaccgagcgtcttcggaaggcaataacatacctaggagggaattgattatgtgttggatggcagcaatcccaatcgccatgatgggtgcccaagctctaagtagccagaacagtgctgacaaggcacgagtggcacagacagaagctggacgccgacaggcaatggagatggtcaaagagatgaatatccaaaatgccaacgcctcgctggaacaacgggacgcccttgaagctgcatcctctgagttgacttcacgtaacatgcagaaggtacaagctatgggaaccatccgtgcagctatcggcgagagtatgctagaaggcgaatccatgaagcgcatcaagcgtatcgaagagggcaactacattcgggaggcaaacagtgtcaccgagaattaccgccgagactacgctagtatctttgcgcaacaattgggacgcactcagtccacagcaagtcaagtagatgcagtgtacaagagcgaggccaagggtaagtctggtctgatgcgtgtactagaccctctgtccattatgggtcaggaagctgcaagtcaatatgcggctggtggatttgacaagaaaggcggcaaccaagcagcacctatcagtgccgccaaaggaaccaagaccgggaggtaataatggctagtaaactaaatagtgttttaggcaatatggcgactcccggtatggaacgactccggggcgtcaaaggtatggactaccgggcagcaaccattcaggctgaacaaccaagggcgagtcttctggactccattagtcgattcgctaaggctggtgccgatatgtatatggcgaaagatgaacgtgataagcaacgagccgatgagcgctccaacgagattatccgtaagctgacccctgagcagcgccgacaggctatccagaatggtacactgctgtatcaggatgacccatacgcaatgcaagccttgaagttcaagacagggcgtaacgctgcgttcctcgttgacgatgaggttcaacaggccatcaaagagggtcgcttccgtactcgtgaagagatggagcagtatcgtcactcacgcctacaggaacagtcgaagtcgttcgctgagcagttcggcatcaatgagatggatgaggagtaccagaagggtttcaatgcgaacatcaccgagcgtaacattgctctgtatggcgcacatgataccttcctgagtgaccaagcgcagaagggtgctatcctgaactcgaaggttgaactcaacggtgtcctgtctgaccctgacctactgtctcgtcctgagtccggtgagttcttccagaactacattgacaactccttggtgacagggatgaccgacaatcaggctcagcaggttatctcttcgtccttgaatgacgtgctacagcgtccgggtggtgccgccttcttgcagaacattgagaaccgcaaggtaactcttaatggcgctacgactacctatcgtgaactgatgggtgatgaacagtggcaggccatgatgattaaggcacagcacactcaattccagaacgacgcgaagttgactgagaggttccaactgagtatcaactctgcgcttaaccaagaggatactggcaagggatgggaggcgctccaaggtatcaaggcggaactcgacaagattcagcctggagaagaacttacgcctgagcgccagcagctcaatgatgcccaagcgcatatgcagacgcgcttcaaacaagaggccgctgagactgcgaagctgatggacaagcagcgtaagaccctgaataaatctttggtcatcgacaagcagttccagaagagaatcaatggtgagtatgtctcaactgactacaaagatatgccaacaaacgagaacactggagagtttgtccatagtgatatggtgaactacgcgaaccagaagttagcgcagattgacgctatggacattccagaggcgcagaaggatcgcatgaagttgcagtacctccaagctgactctaaagatggtgcattccgcactgctgtaggtcagttggtgtcagatgctcgtggtgagtggaaggcggctgtcatcaatggcgagatgcctgatagcacaccagcccttgactccctacgcaagatgcgcaacattgaccccggattgttcgcagcactgtatcccgacgatgccgagctgtttcacacaatggatcaattggatcgacaggggataaagccgcaagccctcattaacgccaccaaatcccgtcaagggaaaacgcgtgaaatgcagattgaggatgagcgtgcgttcagcgagctgatgaacaactctgagcagcccgaactgaaataccttccggcttccatgcgtgagtacgctcagattatttatgactctgagaagtacctaacaggaaaccctaaggatgccatatcagcggttagttcgttcctaaaggacactacctatacattctcttcggataacgtagatggtggaacctacggtgtaatccctcgcaacatgatgcaggtaacagatgaccctaaatcttgggagcaaggtaaggatatcattgagcaagctgttaagaagtaccaagagcaaaacccttgggttaccaacaaacagcttaaggttagccaacagggtaacttaatcaagatttacgataccactaccaacttgggcataagttatgataacgcactgctacgcaaggtgtataagaactatgctgagcaacaggctgcatcggctgagaagaaagccttaacggaagccaataagcgagcacctatcgtcgcggcaaccaaggcccgtaaagaagcagctaagcgtgtccaagagaaacggaacaaggttcctaagtttatctatggacgtaaagaagactaacagtaaactataaggaggctccatgagctacgacaagacgaaaccatccgagtatgatgggttatttcagaaagcggcagatgaacatggggtctcctatgacctgcttcgtaaattagcattcaacgaatctggcttcaatccgaaagccaaaagccctaccgggccgttgggtatcatgcagttcactaaaggtacggcagcggggcttggactcaaggtgacagggggagatgacgatgagagattcaaccctgagttggctgtggacgcagcagctcgtcacctgagcgacctcgttaggaaatacgacggggatgaacttaaagcggccctagcgtacaaccaaggagagggacgcaatggcgctccacaaatgcaggcttatgaccgaggcgattgggcctctatcagcgaggagggccgcaactacatgcgtaaacttctcgatgttgctaacagcccgcgcaagggagacttggaggcgttcggtgggataaccccaaaggctaaagggattcctgctgaggacgcctttgctggaatcggtaaggccgggaaggtaggaactgagcttccacaatcaactggctttaagctggagggtgtggaacaacaggaacctgccgtaccgttcactaaggatttctacgataaacatggaactaccgttgaggaatatgaaaaccgttcaacattcttcgggataaaggacaccacaagtgccgagcttcataactcgctattgggtgttgccttcaatgctgcgcgttttgatgatagttttgacatcttcaaggacgctattaccccaactcgatggaactcctaccagccgacagctgaggatcttgacaagctccgcaacagtgggcttcctccgagttactactcagtggtgacaggtggtgacggtgataactgggatgacctgattaagatggcgaagagaaactacgagatggacgtgaaggctgctgatgctggtgtgggagcacaattggttggcggaatcgtgggagctggtgttgacccattgagctatgtgccgcttgttggtgttgctggaaagggtctcaaggtggtaaacaaggcgttcgttgttggtgcccaaagtgcagccttgggcgcagtttcagaagctgttcgcacatccgttgctggtggtgaggcgcactatcaagatgcaatccttgggggtcttatgttcggggccgggatgagcgcaatagctgatggagtgagtgcagcattgggccgtgttcgcgctggtcaagttagtaacgacttcgaccgcatggctactcgactggaggcgcgtgagtctgcctttcaagctggtggcgaggacttaacacgtatgccaacagagggtcgtacatttgacggggaacatgcgggtgtaaactactctcaacttgaaactgaaccgggggctgtggtgctgccgcaaggtcaaatcttgagtgacaccaacccgattaaccctcagacacttcatgagttcgagcaggttaaccctgagcgagcggctcgtggtatctctttgggtggattcgctgagatcagcctcaagacccttcggtcggagaatgagactgtgcgctccattgcgagtgaccttgtgcgttctccgacagggatggaatcaggctctaacggtaagttcggtgcgactgcttctgacattaaggagcggctccacgcgaacaatcagcgcacctacaatcagctttatgatgctgtgcgtactgcaatgaaagaccctgagttctctacaggtggtgtgaagatgagccgtaaggaagtacgtcaggaaatctataagcgtgctgccttagcgattgagagaccagagctacaatcgggactcacaaagggagaacgtaaggtgatggatatcctgaaacaacacttcgacctcaagcgagaactcatggaaaaccctgctatcttcggtaacgccaaagctcgtagcatcttccccggctcacgccataacggaacctacgtgcctaatgtgtatgaccgcgccataaagttgtacatggtgagtcgctacggtaacgagggactacaacgggcaattgcagagtcgtggcttacatcttaccgcgctcgtccagaagtcaaggcgagagtcgatgagtacctgatggagcttaacggtctcaagacggtacaggaagtaacaccagatatggttcagaagcacgctatggacaaggcgtatggtatatcgcacactgaccaattcacttcctcctctatcattgatgaaaaccttgagggtctggttggcatcgagaacaataacttcttggaggcccgtaacatgttcgacagcgacatggctgttaccctcccggatggtagcacgttctctgtgaacgacctgcgtaactacgatatggctgacattcttcctgcttatgaccgtcgagttgacggtgacgtggctatcatgggtggttcgggtaagacgacgaaggaactgaaagatgaaatcatggcgctggacaagcagtctgagggtaacggctcactgaaaggtgaagtcgaagcactcaaggacaccgtgaagattctgactggtcgtgcccgcatgaacccagagggagctttcggtacgattcttcgctccatgactgacttggctttcttcgctaagaacttctatatgccgttccagaacttcactgaggttgctgctatgttgagtaaaggaaacacctctgcggtacttcatggaatcccactgcttaacgattgggttagccggaggaagcctatgagcggctctgagattaaggagattcacagtatggtgttcgggaaggaactagaccagcttatgcgtccggggcgcgaagaccatatccgtcgccttcgggagtctactgacactaacgcagtggtggctaatgtggttgggactattcgcttcggaactcaggaattgtctgcgcgctcaccttggacgatgctgcttaatggaacctctaactacatcatcgatgctgccagacagggtgtactgggtgatgtggctggggcagcgctcgctgggaaaggatctaagttcggtaaagcgaattaccttaagtctgcctctgtgtcacctgagcagtggaagggaataaagcagttgttccgtgaccacgccactcgtgatgctgacggtaagtttacaatccgggacaaacaggctttcgccaatgacccacggactatggacttatggcgtctggctgataaggttgctgatgagactatccttaggccgcataaggtttcctcacaggacgccaaggcttacggagcggctgtcaagatggtgatgcagtttaagaacttcgtaatcaagtctcttaactcgcgcttcgtcagattgttttatgacgcgactaagaacaacagggctatcgattctgcgctgactgcaatcatctctatgggtctggctggtggttactatgttgctcaggtgcacttgaaggcttacggcctacaggagcacaagcgtaaggagtacctaaagaatgctcttgaccctaaaatgattgcccacgcgtcattatccagaagttcacaccttggttccccactgtctgtctatgatatgattggtggcttgttcggtaatgatacctaccagtacacccgctcaacggtgttaccaaaggaaaagaccgaacgtgaccgaaacaaggcttggactggtaaggaggttgcgggtaacatagtaggggcgatatccaaccaagtaccagctgtaggactagttgggaatattgggtctaccgccatgaatgcctctacgctacttagctctgatggtaagcagagtgaggtagagttccgtactggtgtgttcaacgccatgcgtgagcttgtccccaatgacccgctgacacaacagttgattatgcacatcttcgaagagcagggcatcaagattaaggatgatgcaacacgccctcgccaataaaccctcactaaagggagagaggtcacattctggcctcttctctcttaatgctaatttacaaaggaggtcacatggctacaaatattaagaccgtgatgacttacccgctggatggctccactacggacttcaatattccgtttgagtatctggcgcgtaagttcgtcagagtgacacttatcggtgttgaccgaaaggaactcatcttgaatcaagactatcgttttgcaactaagaccacaatctccacaacgagagcattggggccagcggacggttataacatgattgaaatccgtcgatttacctccgctaccgataggctggttgacttcaccgatggttcaatccttcgggcatacgacctgaacatctctcaggttcaaacccttcacgttgcagaagaggctcgtgacttaacggctgataccattggtgtgaacaatgatggcaaccttgatgctcgtggtcgtcgtatcataaacgtagctgatggtgttgacctcggtgatgttatcactttaggtcaagtcactcggtggaacgagtctgccctgaactctaagaacgccgctgctacctctcaggccgctgccaagacctcagagaccaacgctaagacctcagagaccaacgctaagacctctgagaccaacgcgtaccaatgggcgcagcgtgctgaggactctccggtacagggtagcgagttctctgcgtatcattactccctcaagtccgcaaaaagtgcaacagccgcgcatacgtctgaggtcaacgctaagacctctgagaccaacgctaagtcctctgagactaacgctaagacctctgagactaacgctgcatcgagtgctgctaaggcttctgaggaggctgctaagctgactaacatgaatgactttgctgccgctattgattcagtcaacggtaacaatgttgtcatgaagggtgacttcaccattaaaggaaacggtaaagtatcaatactgaaccacagtgggctataccaagataagaccgttaatggcgtgaactatgccaacaggatttatatggatgatgcaggggccatgcacttcgagaactaccgtgtgtctggtgcttcatccaccttacgtgctggttttgttattacagataccaacaggtttgactttacagggccaacgcgagttaatggtgaatctaccgtatatgtgtatgcgccccctaatccggctattggtcaatacctcaatgctgtggcagttcgctcacagcttcggggccgtggtggtaatggtgatccacttggtgcgtactgtggtatgtatattcaggagcacgttggtacagaccacgcgataatccttaacctcaatggttatagcaaggatactaactggcagctattctccaatggtaaaatatctacaccacttggtgatgtgatgacttcaggttctgatgttagaatcaaggatgatatcactaaacctcttgatggtgctggtgagcgtattgacgcaattggcatagtggaatacacagagattgccaccggggaacgtaaacgtgggtggctggcccaacaacttgacacgattgacccgctgtacacatacctaacgaccaccgcagaaggtagtcttttgaataccaacgacagggcgttgcttgctgacgtaataactgagcttcaagcactgcgtcaacgcgttaaagaactcgaaggacaatcaacaaagccagcggacggcacaacataaggagaacacaatgctttcttttgacttcaataacgaggtcgttaaggctgcgccgattgttggcacaggggtcgctgatggtgcggcccgactcttttggggactatcgttaaacgaatggttctacgttgcagccatcgcctacacagtggttcagattggtgccaaggtagtcgataagattattgactggaaacgtgcaaataaggagtaacctatgagcgacaagactttaatcaagctgctggagatgctggacacggagatggcacagcgtatgcttgctgacctccagagcgaggaacgccgaacgccgcagctttacaacgcaatcggcaaactgttagaccgccataagttccaaatcagtaagctgaccccggatgagaacatccttggcggtctcgcggctggtctggaagactacaacaaagtggtcggccctaatggtctgactgacgatgagaccatcacgctacagtaagtgacatactcaaggttctccacgtggggagcctttatggatgttatttggtgcatctgtgtgaaatctgaaaattgatgggaggtgttatgctaaaacttttacgcagcgcactcccttgggtactcgccgggacactctttatgggtggctggcacttagggtcaacccatgagagagcaaactggaaggaggtaatccaaaatgaatacattgcgaaaacaaaagcaaccgcagcaactcaggcagaggtcagtcgggtatcccgtgagtaccaagaagagattgcagccattgaaggcagcactgataggatgcttaatgacctgcgtagtaataataagcggctgtcagtccgcatcaaaacccttaccggactgccagaagataacggtagatgcgagtttaatggtcgagccgaactacacgagtcagatgctaagcgtattatcggaataacccaagctgccgatgctcacgtaagagcgctccagcgtactattaaggagatgcagaatgagcgacacccaagcaaaccgtaatgcgctaatcattgcgcagcttaagggtgacttcgtggccttcctgttcgtattgtggaaggctttggctctcccgccgccgactaagtgtcagattgatatggcccggtgtctggctaacggagacaacaagaagtttatcctacaggctttccgtggtattggtaaatcattcatcacctgtgcgttcgttgtgtggacgctatggcgtgaccctcagttgaagatactgattgtctctgcatccaaagaacgtgcggacgctaactccatcttcatcaagaacatcattgacctgctgcccttcttggctgagctaaagcctcgccccggtcagcgtgactctgtgattagtttcgatgttggccctgccaagcctgaccactctccgtctgtgaagtcggtgggcatcactggtcagttgactggtagccgtgctgatatcatcatagcggatgacgttgagattccgtctaactccgcaactcaaggtgcccgtgagaagctgtggactctggtgcaggaatttgctgcgcttctgaaaccgctgccgacttctcgcgttatctaccttggtacgcctcaaaccgaaatgaccttgtacaaggaactcgaagataaccgtgggtacaccacaatcatctggcctgcgctctatccgcgtagccgtgaggaagacttgtactatggcgaccgtctggccccgatgctccgcgaagagttcaacgatgggttcgagatgctccaaggtcaaccgactgaccccgtgcgcttcgatatggaagacctgcgtgagcgtgagttggaatacggtaaggctggcttcactttgcagttcatgctcaacccgaacctgagtgatgccgagaagtaccccttacgcctccgtgacgctatcgtgtgcggtctggacttcgagaaagccccaatgcattaccagtggcttccgaaccgtcagaatcgcaatgaagagctacctaacgtgggccttaagggtgatgatattcatagttatcattcgtgcagccagaacactggacagtaccagcaacgcatcctcgtgattgaccctagtggtcgaggtaaggatgagactggttacgcagtgttgttcaccctgaatggctacatctatctgatggaagctggcgggttccgcgatggttattccgacaagacccttgagtccctcgctaagaaagcgaagcagtggaaggttcagacggtggtcttcgagagtaacttcggggatggtatgtttggtaaggtattcagccctgtgctcctgaaacaccatgcagcctctatggaagagattcgtgctcgtggtatgaaggaactacgcatttgtgatacgctggagcctgtactctctacgcaccgccttgtgattcgtgacgaggtgattcgtgaggactaccagactgcccgtgacgctgatggcaagcatgatgttcgctattcgctgttctaccagttgacccgtatggctcgtgagaagggcgctgtggcccacgatgaccgacttgatgcattagcattgggtgtggagttcttacgctctacgatggaactggacgccgtgaaggtggaagctgaggtgcttgaggcgttcttagaggaacacatggagcacccaatccattcggctggtcatgtagttaccgctatggttgacgggatggaactctattgggaggatgacgatgcgaatagcaacaggttcattgactggtagttatgcatattgagtgcataaggaagcatcgagaccacggatggtcactttaagaaactccttaagaatcaatgagtttgaattaaccctcactaaagggagagaggggacttaaagctactatataggttagtcattcaggttatgcaatgaccttttatgcactttaagtctacctctgtgattggtgatattatcattatataatcacctaccttagagcaactgaaaggaggtggctcaatgttacgcttgctgattgccctgctgcgtcatagagtcacttggcgatttcttctggtacttactgctacccttgggtacgcaggccttactgaccacctcggtcaactggaagtggccttttgctctatactctcttgtggggattaaattattgttgatgacagacaagcggctctgagggattcgtaggtatagtttcactacaccaactcatccctgtagagtcaaccctaaaggttatacctaaagatgccctgtagttcgtaatggtcttacagggtcttctggtgtctcctagctatcccttctggatgcgcctatggtctcacctatggtgtggccttacctaaagtggttgcctaaagagaccctttaagaatttaccacaaaaatctgaatgggtatctcacagttcaagaaaccaaagtacccccatagccctcctaaagccacctaaagccagccctacccctagggtttaaccttcggttaaccttgggtatctcctcaagtggcctataggatagcctaaagtgttgcataaagtcaatacctaaagaggcggatggcttaaagaggccttgaagagtgtcctagtgtaccagttcgatagtacatctctctttgtgtccct

SEQ ID NO: 24 - DNA, 38190 bp, Unknown
  source: /note="Description of Unknown: KP2-16-1 Bacteriophage Sequence"
atctgttagccattcctaaagtaaaccctaaagccatcacctaaagctatcacctaaagagcggcgctatcttaaagacaaccagaccgatagacccattgttaacctgtagtgatgccttgtagttatctgtagtcgtttcattaaccctcactaaagggaataagggatacttaaagagggaataagggaataagggatacttaaagagggaataagggatttaataaaagattaaaattaatggttgactttaagtaacccttaaggctattattcatctcgtcaacgggacaacggccttaaagccactccctgagataccggagtcaaccggataagtagacagcctgataagtcatacgaaaaacaggcattgacaacatgaagtaaacgcagtaagatacacagcgtcaaccggacacaaggtgtcttctaggtgacttaagcgcaccacggcacataaagcgaaacaaaatggttgacaacatgaagtaagcacggtacgatgtaccacgaaatgacggaacagtgaggcgggacactgaaagccgctagggtctaacgaaaccagaccgacacgctctttaacaatctggataatagctcttgagtgtaccgatgtataagcgaataactcaaggtcgcactgaaagcgtggcctttatgatattcacttaacacgaactaacatgaggtaacaccaaatgattttcactaaagagcctgctaacgtcttctatgtactggtgtcagctttccgttcaaaccttgatgatgaggtgaacatgagtcgccaccgccacatggtaagcactttacgtgccgcaccgggtctttatggctccgttgagtcaaccgatttgaccgggtgctatcgtgaggcaatcgcaagcgcaccgactgaggaaaaaacggttcgtgtacgctgcaaggacaaggcgcaggcactcaatgttgcacgcttagcttgcaatgagtgggagcaagattgcgtactggtatacaaatcacagactcacacggctggtctggtgtacgctaaaggcatcgacgggtataaggctgaacgtctgccgggtagcttccaagaagtgcccaaaggcgcaccgctgcaaggctgcttcacgattgatgagttcggacgccgctggcaagtacaataagtgatagactcaaggtcgcactgtatgtgtggcctttatgattatcacttagcacgctataggactaacaccatgaaacgatactccatccttattcccggctggtgctactcaatgacctgctacgggtacaacgaaagggacgcccgtgcacgcttcagagaccaacaaggcttcggcaagcgtttacctaatggtacggctgtatgggaggtgactgtatgagtaaacttctggcaacatctaaaatcaagggccaatgcactgtaacgctgcgtgagtattaccacgggtcaatgggatgcacctacgttgtgcgctacggcaaacaggtcacacattgggtaaacccgattttagcacaagaggattatcaagcctgtgtgatacaccaagcaacatgcgctggctggaatgattgacattacaggaggattagcaatggttatctttatcgctgtcgcactctttgcggtcgctggctggtactctgagtcacgcaaggccgctcgctatcatcgcaagatggttaaactcatggaacacttggacgcagaagggcgaggccacgaggctatcgaactggtgaaacacgcatgatgattctctttatcgcactggtctatctgtgcatcgctatgtactttatgcgagactttaagcacggtctggtagtccataaagcaacactgagctactttaagtggggattcatcccacggtttacggttcgtgaacgtaacggacgctttaaggccaacaaggtaggagtattctacattgctacgcactaactcaaagcacgtaaagattgcattgtatgctatggcgtatggtgcatcgaaacgcaaggtcaaacgcatcttaacgagacaccgcaagatgaccgcacgacaggctgcaagcgctgtcaaatgggctgaatttactctttactcttcttacagataacaggacactgaacgatgactttcaccgaagcacaagccgcactcgaagctatccgcaacctaccgattgagcgcctgaacgaacgccagccaatgctggtggctcttgcggctgctatcgtgaacgatgagactcaagacggcgaactgacgcaggccaaaggcaattggggcttggagtctatggactactggcagacactggcggagcgtatgcgtgatgttggtttcatcaagctgggcaacggtcactttagcgcagcatatgagcacgcattgttaccgggcaaggttatcaaggtaggctttaagaaagaggactcaggcgctgcctatgctgccttctgccgcatgaatcagggtcgtgagggcatccctacggtgtacgacattcagcgtcatacgggctgctacacggtggtcttggactatctgacaccgcttaacgattggtgctacggtgaaagcgataagattcgtcaccactttcgggctgcacgggaaatcattgaggaggattgcttcgacaccgccgaagagtacccaataagtgacgggttcattgagacctgcaaggatatccgcaagttcttcttaggcatcgcatcgttcgactgtcacagcggtaacatgatgaaagaccaaatgggccgcttgattatcacagacccggtatcgttcagcgcagacgacaagttaaagccgggtgagttccactgtgacccggatgaactcatcgctgagattgaggcgctgagagcgcaggaagcgattgaccgctgtaaggcacgcaaggcacgccgtgaccctaaaggagactttcaggtagcacgtaaagcccgtgccaaatggcgcagaaaggcctctaagcgtgctaaacgtgacgctaaggtactcgctaagatgcgcatggacgccaatcagaatcgcagggatgagcctagggcgcgtatggtgtggggcgataagcactggcgcaacgcttggatgcaccacaataacctaaactttgcagaactggagcgccacgctgctgcggcaatgatgatgcacgacgaggtgcgcattcagtggggcaaaccgttacacatagacgcataccttgacaagcgtctacaaggctgatagagtcttatcttacaggtcatcaatcggtggcctgaataggtacgatttattcacaatgaggtaagcaatgaacatcatcgaaaacatcgaaaagaatgacttctccgaaatcgaactggctgctatcccgttcaacacactggctgaccactacggcagcgcattggctcgtgaacaactggctttagaacatgagtcttatgagctaggcgagcgccgcttcctcaagatgcttgagcgtcaagcgaaagctggtgagattgcagacaacgcagccgctaagccgttactagctacgcttctccctaagttaaccacacgtatcgtcgagtggctcgaagagtacgcatcgaagaaaggccgcaagcctgtagcctatgcgccactccagttactcaagccggaggcgtccgcgtttatcacactcaaggtcatccttgcgtcactgaccagcacgaacatgacaaccattcaggccgctgctggtatgctggggaaagccattgaggacgaggcacgtttcggtcgcatccgtgacctcgaagcgaagcacttcaagaagcacgttgaggaacagcttaacaagcgccacgggcaagtctacaagaaagcctttatgcaggtggtcgaggccgatatgattggtcgcggtctgcttggtggtgaggcgtggtctagctgggataaagaaaccacgatgcacgtagggattcgcctgattgaaatgctgattgaatccacgggtctggtggaactacagcgccacaacgcaggtaacgcaggctctgaccatgaggcactacaactggcccaagagtacgtggacgtattagcgaagcgtgcaggcgctctggcgggtatctctccgatgttccagccatgtgtcgtaccgccgaaaccttgggtagcaatcaccgggggcggctattgggctaacggtcgcagacctttggcactcgttcgcactcactctaagaagggcttgatgcgttacgaagacgtttacatgccagaagtctacaaggctgtgaacatcgcgcaaaacaccgcatggaaaatcaacaagaaagttcttgcggttgtcaatgagattgttaactggaagaattgcccggtcgcagacattccatcgctggagcgccaagagttaccgcctaagccggacgacattgacaccaacgaggcagcactcaaggagtggaagaaagccgccgctggtatctaccgcttggacaaggcacgagtgtctcgccgtatcagcttagagttcatgttggagcaggccaacaagttcgcaagcaagaaagcaatatggttcccttacaacatggactggcgcggtcgtgtgtacgctgtgccgatgttcaacccacaaggcaacgacatgacgaaaggtctgttgaccctcgctaaaggcaagccaatcggtgaggaaggtttctactggctgaaaatccacggtgcgaactgtgcgggtgtcgataaggttcctttccctgagcgcatcgcgttcattgagaagcacgtagacgacattctggcttgcgctaaagacccaatcaataacacttggtgggccgagcaggattcacctttctgtttcctcgcgttttgcttcgagtatgcaggcgttgcgcaccacggtctgagctacaattgctccctgccgctggcgttcgacgggtcttgctctggtatccagcacttctccgcgatgctacgcgatgaggtaggcggtcgtgctgttaacctgctgccaagcgaaaccgtgcaggacatttacggcatagttgcgcagaaagtaaacgagattctcaaacaggatgcaataaacggcacacctaacgagatgattaccgtgaccgacaaggacaccggggaaatctcagagaagctcaagctgggaacctcaacgctggcgcaacagtggctggcatacggtgtaacccgtagcgtaactaaacgttcggtcatgacgctggcttacggttccaaggagttcggctttcgtcaacaggtactggacgacaccattcagcctgcgattgacagcggtaagggcttgatgttcacccaacctaaccaagcggctggctatatggctaagctgatttgggacgcggtgagtgtgaccgtagtcgcagcggttgaggcgatgaactggctcaagtctgccgctaagctgctggctgctgaggtcaaggacaagaagaccaaggagattctgcgccaccgttgcgcggttcactggactacgccggacggcttcccggtatggcaggaataccgcaagccactccagaagcgtctcgatatgattttcttagggcaattccgtctgcaaccgacgattaataccctcaaggattcaggcattgacgcacacaagcaggagtctggcatcgctcctaactttgttcactcacaggacggtagccacctccgcatgacagtcgtttatgctcacgagaagtacggcattgagtcctttgcgctgattcacgatagcttcgggactatcccggcagacgctggcaagctgttcaaggctgtgcgtgaaacgatggtcatcacctacgagaacaacgatgtgctggcagacttctatgaccagtttgcagaccagttgcacgagacccaactggacaagatgcctccacttccgaagaaaggaaacctgaacctgcaagacattctcaagtctgactttgcctttgcataacaagcacttagcattaaccctcactaacgggagactacttaaggtctcccactttaagacactttaggtactaagagattaaatttatgattaacattaagactttctttaagaacatctttaagtcaaaccgcttgacttccgttaagttctacgcttggatgcccggtagcgatgacctccgcaagactgaatttaagctaggcttagggccgtgcggtaaggtggtcacgaagttggaatgttactcaacgtcctccgggatggtcatcttccagaccactgaggacaacgaaatgaaatccttctactacccgaaaggttcaacgtgtggtcgtatcgaacggacatacagttaacactcactaacaggagagttagcctcaaggtcgtccaagcgggtggcctttgtgattaactttcaatacacatcaacatgaggtaagatactatgcgtaccaactttgagaaatttaccaagcgcgattcagtggtcaacgagcatggcgaacagtggcaagagcgccgtgaccgcatgaagaaacgccacaaacaacagcgcggtaactcacagaaacgggagtggaactaatgatgggacgtatctatagcggcaacctgaacgattacaaagacgcggtagcacgtctacaggaagaccatgacgtgaccgtgaaggtggagtcattcagatatgaaaacccagcgaagatgtgcaggtcatcgggtgaggttctccgtgtgttcacacgctccgggcatccggtggcatccagaaccttcgagcacagcgacagtgatgtacaaatcaacgcgcagactgcatggctccgtagggttcacagcgatttgaaacactggaagtaataaccctcactaacaggagaatcctcaaggtcactttaacgagtggcctttgtgattcgaactgattaactttcaaccaatgaggaacaaccgtatgaacatcttcaataccaacccattcaaagctgtgtcattcgtagagtctgccgttaagaaagcgctggagacctccggctacctgattgcggacattaagtacgatggtgtgcgcggtaacatcgtggttgacaacgtggctgaggctgcatggctgtcccgtgtgtccaagtttatcccggcgctagaacacctgaacggattcgataagcgctggcagcaactactgaacgatgaccgctgcatcttcccggatggcttcatgctggatggcgaactgatggtcaaaggtgtagacttcaacaccgggtctggcctgctgcgtaccaagtggctcaagaaggataacgccgagttccataacgtaatggtcacaccagacatgctcaagccacgtaaggtgggagtagctaaacgggttcgcaccgcctttgagttagaccctaagcgcctgagtgtgcgcctgtatgcggtcatgccaattcacattgctgagtctggcgaggactacgatgtgcataacctcctgatgccatatcatgtggaagccatgcgctctcttctggttgaatacttcccggaaatcgagtggcttatcgctgagacctacgaggtctacgatatggattcgctgactgaactgtacgaagagaagcgtgccgaaggtcacgagggtctcatcgtgaaagacccgcaaggcatctacaagcgaggcaagaagtctggctggtggaagctcaagcctgagtgtgaagctgatggtatcattcagggtgtcaattggggaaccgaagggttagccaacgagggtaaagtgataggctttagtgtgcttcttgagactggtcgtttagtagacgccaacaacatctctcgcgcactgatggacgagttcacagccaacgttaaagcccacggtgaagacttctacaatgggtgggcctgtcaggtcaactacatggaagaaacccctgacggctccctgcgtcaccctagcttcgagaagttccgaggcactgaggacaaccctcaagagaaaatgtaaccgcgcactggctcaccttaacgggtgggcctttctgcgttccgggcgttgccgcctattaaccctcactaacaggagacacacgtcatgtggcttatcctattcgctatcgtcgcaacgctgggattaattgctgccgacgacaacatttggcctgattgttaaggagataacaccatgcgtttacacttcaacaaatccaatggtatcttttcggttcgccgtaaagaccgctcaactgtgctggcctctgagcgcaacgctaagctgcctctgattggctcagtcgctacgctgtcaccttgtgttcacctgctgattactcgcggtgagttcgtcaaggcgatgaacaaagagcgtccgcatctggaagccgtggtcacttactggcctcgcgttcgtctgttcttcaagtggattaaggaggtactgtaatgctacaacatcattggaacaaaccagacttagaggctcgcttcccggttaactctgttgtgcgatactccggcggtggtctcaagcgcatcttgggtatgagcggagtggtcactggttactcgcacacaggccgcgttaaggttcgcttcggtactcagcacgctgaggttcttccgcacaacctgattccgctaccgaaagctggcgttaagactccgaacgtggaagcaccgaaggaagtcaagtctgacgtgacccatccgaaccactatatgctgttcgacaacgtggaagccattgaggttatcgcccggtcgatgaccgttgaggcgttccgtgggtactgcttagggaacatccttaagtatcgcctgcgtgctggcaagaaatccgaactggcaactatggagaaagacctcaagaaagctgcattctatcaggaactctttgacaaacaccgggggctgtgttatgacgcttcgtgaatgctgcgattggtgtgccgctaagtggaaccaagctatcgaggctggtgatgaggctgctgccaacgcataccaacaactatacgcgctgtgggagcggcgctttaaggaggccaataaatgagccaatgtaacaacgggtgccagtacgcgaaggacgtagggatggagaaccactcctgtgcaaatcgctgcatgtactcagaacagaaataccttctgacaatggaaggtaacaccgagtcctttgagattccggtattcgcccggtctctcgaagaggcaacgctacaggctgaacattacgaggacgcagggttcgtagttactcgaatccgtccagaagtgaaagcctaattaccctcactaaagggaacaacccaaactatcaaccaaaggagaaatactatggctggtttcaagaagaaaatctacacctctggtcttggcactgctgagccttatgcttacctgagtaagccggattatggcaacgaagagcgcggcttcggcaaccctcgtggtatctataaggtagacctgactctttccaataaagacccgcgctgtcaggcgatggtcgatgaaatcgtgaagactcacgaagaggcttatgctgctgccgtggaagagttcgaggctaacccgccgcaggtacagcgtggtaagaaaccactgaaaccttacgagggcgacatgccgttcttcgataacggtgacggtacgactaccttcaagttcaaatgctatgcgtctttccaagacaagaagaccaaagagaccaaacacatcaatctggtcgtggtcgatagcaagggcaagaagattcaggacgttccgattatcggtggtggctctaagctgaaagtgaaatactctctggttccttacaagtggaacaccgctgtgggcgcaagcgtcaagctgcaactggaatccgtgatgctggtcgaactggctaccttcggtggtggcagtgaagatgagtgggccgatgaagtcgaagatggtggttacactgcgagtgaatcccgtcagtcccgcgatgagcaggagtggcaggaagacgagcacgaagaaaccccggatgatgacgaggacttctaatggctggcgcatacgctgcgcgaggtgtacgcaaggtcggggctttccgctccggcctagaagataaagtctcaaagcagcttgagagtaagggcattaagttcgattatgaactttggagaatcccttacgtcatccctgcgagtgaccacttatacactccagacttcctgctacctaacggtatcttcattgagaccaaagggctgtgggattccgatgaccgcaagaaacaccttttgattcgtgagcaataccctgaactggacattcgcttggtcttctcaagcagccgctcaaagctctacaagggtagcccaacaagctacggtgagtggtgcgagaagcatggcattctgtttgctgacaagctaattccggtggagtggctcaaagaacccaagaaggaggttccgttcgataaatttaagactaagaaaggagtaaagaaaaatggctaaagttcaattcaaaccacgagcaaccacggaggcaatctttgtgcattgctcagcaaccaagccaagccagaacattggcgttcgtgagattcgtcagtggcacaaagagcagggctggttagacgtaggatatcacttcatcattaagcgtgatggcactgtggaagcgggccgcgatgaactggctgtaggttcccacgtgaaaggttacaaccacaactccgtaggcgtatgcctcgtgggtgggattgatgataaaggtaagttcgacgccaactttacacctgcgcaaatgcaagcgctgcgtagtctgctggtcacgctgctggcgaagtatgagggttcaatccttcgtgctcaccatgacgttgcacccaaagcctgcccgtccttcgacttgaagcgctggtgggagaagaacgaactggttacatctgaccgagggtgataccatgaggatgatttgtattcgctgtgataagccgttgaagagtcgtgtaccgtcacgtcagtgtcagtgcaaagacccaatcaaggcggaggaacacaccgaggaataattaacactcactaaagggagacttaacggtttccctttgttctcgcaactgattaaggaatgtacaatggaacgagaagacgatagtatctttctgtttcatgctccatgtgaaaactgtgggtcttctgatggtaactctgtgtactctgacgggcatgaatggtgcttcgtgtgtgaacatcgagtacccgcaaacgaagagcgtgaagcaaagttatcaacgagaagacgtacaggaggcagcaagcctatgagctatgacgtatggaatttcggtgacagcaacggtcgatactctgacctgactgcccgtggcatctctaaggagacgtgccaaaaggctggctactggctggcgaaagtggacaaccgaatgtatcaggttgccgactacagagaccagaacggctccatcgtgtcacagaaggtgcgcgataaggacaagaactttaagaccaccggaagccacaagagcgatgcgttgttcttgaagcacctctggtctggcggtaagaaaattgtggtcactgagggcgaaattgatgcgctcactgtgatggaactccaagactgtaagtacccggtcgtatcattgggtcacggtgcctctgctgctaagaagacatgcgccgctaactatgaatactttgaccagttcgagcagattatcttgatgttcgacatggatgacgcaggccgtaaggcagtcgaagaggccgcacaggttctcccggctggtaaggttcgtgttgccgtgttgccgtgtaaggacgccaacgagtgtcacatcatgggtgaagacaaagcaatcttggagcaggtctggaacgcgaacccttgggtgccagatggcgttgtctctgcgttgtcactcaaagaccgcgttaaggaagctatgacctccgaggacgctgtaggtttattattcgatggctgtcaaggcctgaacgatagaaccttgggtgctcgtggcggtgaagtcgttatggtcacttccggttccggtatgggtaagtcaaccttcgttcgtcaacaggctctggcttggggcaagcgaatgggtaaacgtgtgggcctagcgatgctggaggaatccgttgaggataccattcaggacatgatgggcttgaacaataaggttcgtctgcgtcagtctgatgaagtcaagaaggctatcgcagaggacggacgtttcgatgaatggtatgatgaactatttggagacgatacgttccacctttatgactcctttgcggaggccgaagctgacaggctgttagcgaagctggcctacatgcgaacaggcttagggtgtgatgttatagtgctcgaccacatatcaatcgtcgtgtctgcctctgaggaatcggatgagcgtaagatgattgaccgcctcatgacgaagctcaaagggttcgctaagtcaactggtgttgtgctcgtagtgatttgtcacttgaagaacccggataagggaaaagcacatgaagaaggacgcgctgtttctattactgacctacgcggttctggtgccctgcgccagctttctgatactatcatcgccttggagcgtaaccagcaaggtgatatgcctaacttggtgttggttcgcctgcttaagtgtcgtttcactggcgacactggaattgctggatacatggaatacaacagagaaaccgggtggcttgaaccgtctagctacactggcgaagaaggagaaggagatactggctggactgaacatgacggacagtcagacttctaaaggatgcccgtgtgggcattccgattgcgatggaatcatgtaccactaattaaccctcactaacgggaacaaccattaaaccataggagacacatcatgtttaaattcattaacgctttaggtaagctggtagttaaactgtacttcatcgaagccaagaagctggacaagaaggccaaagctgattcacagcgagccattgagttggcgaaacagtcccgtgagaaatccgatgcggctgttaatggcatccacaagtcggcagcgattgcagccaaagcacaatccatgagcaaattctttgagtaaggagcgcacactatgagcaagtcaatcacccacgcaaacaccatccgtctgccagacaccgctgaccagttctcccgccgagtacacattaatgtgcgtggtgagaaggtcacgatggtctaccgctggaaagaccacaagtctccgaaagcacacactcaacgcatgaccttggatgacaagcaggtcggtcgcctgatgggtgccctgactatggctgctgacaaggtggtcggtgataaccgtgagcgtctggtagagttcggcgctggtatgcaagagattatcgagaagtgataaactcaaggtcgcccaagggtggcctttatgattatcattcatcctgaaatgaaaggagggcattatgctcgtaagtgacattgaggccaacaacctcttagagaaagtcaccaagtttcactgtggcgttatctatgactaccgtgatggtgagtatcatagttatcgtccgggcgacttcggggcgtatctggatgcgctggaagccgaggtgaagcgaggtgggcttattgttttccataacggtcacaagtatgacgttccggctttagagaaactcgcaaagctgcaactcaatcgtgacttcaagttaccccgtgagaattgtattgacacattggtactctcgcgtttacttcatgcgaaccttaaagacacagacatggggcttcttcgttccgggaaactacccggtcgtcgcttcgggtctcacgctctggaggcatggggttatcgcttgggcgagatgaaaggtgaatacaaggacgacttcaaggctatgctggaagagcagggcgaagaatatgttgatggtgccgagtgggtttcattcaacgagccgatgatggcgtataacgttcaagacgttgtggtcactgtcaagctcttcgagaaattacttagtgacctccactacttccctgcgggtatggacttcacgaagtacgatgcggatttattctggcgtgaagctggtgagtctgtggatattgaacatcgtgcagcgtggcttttagcgaagcaggagcgtaacggcttcccgttcaacaccaaggccattgaggaactttatgtagaactggcagcgaaacgcgccgaacttctgcgaaagttaaccgaaacgtttggctcatggtatcaaccgaaaggtggtaaggaactcttcaagcacccacggacaggcaaaccacttccgagttaccctcgcgtggtctatccgaaacagggtggcgtgtacaagaagcctcgtaataaggcacagcgcgaaggtcttgagccttgcgacttggacacgagggattacatggagggtgctccatatactccggtcgagttcgttacgttcaagccaagtagccgtgaccacattcagaagaaactacaggaggccggatgggttcctgagaagttcaccgagaagggtgcgcctgtggtggacgatgaggtcttggagcatgtacgagtggatgaccctgagaagcaggcgtgcattgacttgattaaagagtacctgatgattcagaagcgaatcggtcaggcggcagaaggtgacaaagcgtggttacgttatgttcaagatgatggtaagattcatggagccgttaaccctaacggtgcagttactggtcgtgctactcatagtttcccaaaccttgcacaagtacccggcgttcgttctccttacggggagcagtgtcgtagcgcttttggtgctgaacatcatttggatgggattactggcaagccgtgggtgcaagcggggatagacgccagtggcttagagttgcgctgtctggcgcacttcatggctcgtttcgataacggagagtatgcgaatgagattctcaacggtgacattcacaccaagaatcagaacgctgcggaactcccaacgcgagacaacgccaagaccttcatttacgggttcctttatggagcaggagatgagaagattggtcagattgttggggctgggaaggagcgcgggaaggaactcaagaagaaattcttagagaacaccccggcgattgcagcattgcgagaagctatccaacagtctctcgttaagtcttccgcttggattggtggtgagcagaaagtacagtggaagcgccgttggattaaaggtctggatggtcgcaaggttcacgtcaggtctccacacgcagcgctcaacacattgttgcagtctgctggtgctctgatttgtaagctgtggattatcaagaccgaagagatgctcattgagaaaggcttgaagcatggctgggatggtgactttgcgtacatggcttgggttcacgatgagattcaggtggcctgccgtacagagcacatcgctcagattgttattgacaccgcgcaggaggctatgcgttgggtcggagagcattgggctttccgttgtcgtttagataccgaaggtaagatggggccgaattgggctgtctgccactaacagtaggagaaacattatgggtatgaacaaacaactcaaagtaactttcaacgtgaccgcaaccctgagtgatgagcaggaagcggagttcgtgcagacgctgaaagagatggcgaaaaacccgaagcgtgggccttacttcgacaacattctggtagccgctctgactcatgggccggagggtgcctttgagcagatgctgaaacagggtcttcgtgagttcgtcaaggaagaacttggcaaagagtgtgctcgttcagtcgatgagttcatcctcaaggttgccccagcgaaagtggaggttatccgatgagtgaatacctgaaagttctggcagctatcaaaggttgccctaagtcctttcagtcgaactatgtgcgaaacaatgcggctctcgtagctgaggccgcttctcgtggacacattagctgtttgactgtgggtggtcgcaatggtggagcatgggaggtcacagccgctggtgtgcgcttcctgaaacgaatgggaggttgcgtatgattatgccaaagagtgacaccgtaacgatgacccgtgacgcgtggaacgatgttagcgcatacattgataagctggagaaagacctagagttcctgaacgcgcttaaggcgtgtggtgtggataattgggacggatactctgatgcagtcgagatggtttacggggaggatgacgaatgagcctaatcacattgaaagacttcgcggagatgcgtgaaggtaagcctgtggagaagggagtgctggtcatggatggtgactggttggtatatcagtcaatggctgctgccgaagttgagacggattggggggacgacatttggactcttgagtgtgaccacgccaaggcacggagcattctcgattctgcaatcgaatcgtaccgaacccgtaagaaggcttggagtgacgctatggttgttctggcgtttaccgacgatgtgaactggcgtaaggtactggttgatgagacctataaggagaaccgtaaggcgacccgtaagcctgtgggataccgtgacttccttcaagctctgtgggagcgcgatgagttcattcacatcaaagaggacatgcttgaaggtgatgacgttatgggcatcattgggtctggtcacgaggtcttcggcttcaagaaggctgtgttggtctcctgtgacaaggacttcaagactatcccggacgttgacttcctgtggtgtaccactggtaacatcttgacgcagaccaaagagaccgctgattggtggcatctcttccagactatcaagggcgatatgaccgatggctactccgggattcccggctggggcgatacggcagaagccttcctgaatgacccgttcattgtggagcctgtggagtccgtgttgaagtccggcaagaacaaggggcagacagtaaccaagtgggtgaagcgtgctcctgatgcgactgagacgctgtgggactgcattaaatccattggtgccaaagctgggatgaccgagcaggaaatcatcaagcaaggccagatggcccgcattcttcgcttcgaggaatacaattacattgacaaggagatttacttatggacgccgcaaagtacataaccatcgctgtgctggtaggtatgctggcgcgaggtctctggatgttcactctcatagtccgagacgtgaagcgagactccgagattaagtgataaactcaaggctctctgtattaaccctcactaaagggaagagggagcctttatgattattactttaagacttaaccttaagaggtgaaattatgttacaaccaattaatcatgttttaactcatcccgatgatattcctagtatgcctcgtgcagctaaagagtatctacaggtgcgcttcaatcagacctatgtgatggagtccggggagtaccgtgcgctccgcgctgcgggttactctgagtctttcattgctggtgtgatgcatggtctgtaccttgcctctcgaacacttgatgagattgaggtgcgtaaagagcaactgagacaggagtaattatatgtgctggaaaccgaaggtgaaagtccctaagatggacactaaccagattcgcgctgccgaaccagcacctttgactgagccaccgaaatctgtggtatggggaggcgatgacgatgaggacaccagcgtgtcttcctctgaggttccaaccacacagagcagcggtaagagcagtctcaaggtaaagctggatgacagcgcagccaagaacaagagtaaatcctccattcgctccaaggcgtttgggtaactgagtaataacataggggacacattatgggattcttcaagaaaatcaagaaagccgttaagaaagttgtgaaggaagttagtagaccagtcgagaaggcaggtaaggaagtcggtaaagtcgttggcggtgcgctgggtgctggtaagcaggagattatccaacaagaggctccagtaccagtagtgactgcgccgcctccagcacagattgtagatgtacccgaacaggataaggctgagggtgaggatgaggcgcaaaccgaaagcgcacgtaagaaagcacgcgctggcggtaagaagtctctgagtgtagcccgtagctccggcggtggcatcaacatctaaggaggactgaatggctgattcaaaacgtacaggcttgggcgaagacggtgctaaagctacctatgaccgcctaacgaacgaccgtagagcctatgagactcgtgcggaaaactgtgcgcaatacaccattccgtccttgttcccgaaggagtccgataacgaatctaccgactacacgactccgtggcaggctgtaggtgcgcggggtcttaacaatctggcctctaagttaatgcttgcgttattcccgatgcagtcgtggatgaagctgaccattagcgaatatgaggcgaagcagcttgttggagaccctgatggactcgctaaggtggacgaaggtctgtctatggttgagcgtattatcatgaattatatcgaatccaacagctaccgtgtgacgctctttgagtgcctcaagcagttgatcgtggcaggtaatgcactgctttacttaccggaacccgaaggtagctacaatccgatgaagctgtaccgattgtcttcttatgttgtccaaagagacgcatacggcaatgtgttacagattgtcactcgtgaccagatagcctttggtgctctcccggaagacgttcggtctgcggtagagaaagctggtggtgagaagaagatggacgaaatggtcgatgtgtatacccatgtgtatctcgatgaagagtccggcgattacctcaagtacgaggaagtagaggacgttgagattgatggctccgatgccacatatcctactgacgctatgccctacattccggttcgcatggttcgcattgatggcgagtcttacggtcgctcctactgtgaagaatacttaggtgacttaaggtctcttgagaatctccaagaggctatcgttaagatgagcatgattagtgcgaaggtcatcggtctggtgaacccggctggcatcacgcagccccgtagattaaccaaagctcagactggtgacttcgttcccggtcgtcgagaagacattgacttcctgcaactggagaagcaagctgactttaccgtagcgaaagctgtgagtgaccaaatagaagcacgcttatcgtatgcctttatgttgaactctgcggtacaacgaacaggtgaccgtgtgaccgccgaagagattcgatacgttgcgtcagaactggaagatacgcttggtggtgtctattcgattctgtctcaggaactgcaattgcctctggttcgtgtgctcttgaagcaactccaagcaacctcgcagattcctgagctacctaaagaagccgttgagcctactatcagtacaggtctggaagcaatcgggcgtggtcaagacctcgataagctggagcgctgtatctccgcttgggctgctctggctcctatgcagggagacccagacattaaccttgctgtcattaagctgcgcattgctaacgccattggtattgatacttctggtatcctactgacggatgagcagaagcaagcccttatgatgcaggatgcagcacaaacaggtatcgagaacgctgccgccgctggtggggctggtgttggtgctctagcgacctcaagcccagaagctatgcagggtgccgcagcgcaggctggcctagacgccacctaataaccctcactaaagggagacctcatctttgaaatgagcgatgactaaaggttggagtcctttggtttccctttatctttaacaacttaggagatttaacaatggctgaatctaatgcagacgtttatgcgtccttcggtgtgaacaacgcggtaatgaccggaagcacacctactgaacacgaacagaatatgctgagtctcgatgttgctgcccgtgatggcgatgatgcaatcgtacttagcgaggaaccgagttcccataacgatgacccatatgcatccggtgtagacccgttcgctgatggtgaagacgatgagggccgcattcaggttcgtatcagtgaagatggtaatgaagccgagtttgacactggtagcgataacgctgaggttgagaccgaaggtgaggccgctgagtttgaaccgctgggtgacactccagaagaactgagccaagtgactgaacaattaggtcagcacgaagaaggctttcaggcgatggtcgagcaggccgttgagcgtggactgagcgcagagtctgtgactcgcatctacgaagagtacgaatccgatggtatctctgagaaatcctacgcggaactcgaagctgctggctatagtcgtgcctttgtggactcctacatctccggtcaggaagcccttgtagaccagtacgtcaatcaggtagttgcctttgctggtggtaaggagcgctttagcgcaatccatacgcaccttgaagcaaccaacccggctgcggctgagtcccttgaggctgccatgatgaaccgagacttggcgactgtcaaggcaattatcaatctggctggtgagagttacacgaagaaattcggtaagcctgccaaccgtagtgttaccaagcgtgctactccggttaaaccagtagctcgtcagaaagagggctttacgaatcaggctgagatgattaaagctatgagcgacccgcgctatcgtagcgattctgcctaccgccaaatggtagaacagaaggttatcgactccagtttctaattaaccctcactaaagggagagaccatagatgactacaatggttgaatcacctgagcacagaactttgtggtcactcccgtaggtgaaacattgagaaccaactcgattcaagtagtaaccaaacttttctttaaattaacataaggagattcaacatggctaacattcaaggcggacagcaaattggtactaatcagggtaagggtcagtccgcagcggacaaattggcgctgttcctgaaagtgttcggcggtgaagtcctgacggctttcgctcgcacctccgtgaccatgccgcgtcacatgctgcgctctattgcttctggtaagtccgcacagttccctgtgattggtcgcaccaaagctgcttacctgaaaccgggtgagaacctcgatgacaaacgtaaggatatcaaacacaccgagaaggtaatccacattgatggcctgctgactgcggacgttctgatttacgacattgaggacgcgatgaaccactacgacgttcgcgctgagtacaccgcacagttgggtgaatctctggctatggcggctgacggtgctgtactggctgaactggctggtctggttaacctgcctgacgcctccaatgagaacatcgagggtctcggtaagcctaccgtactgactctggttaagccgacctctggcgacctgactgacccggttgagctgggtaaagcgattatcgctcagttgaccgttgctcgtgcggcgctgaccaagaattacgttccggctgctgaccgtactttctacaccactcctgataactactccgcgattctggctgccctgatgccgaacgctgcaaactatcaggcactgattgaccctgagcgtggtactatccgtaacgtgatgggcttcgaagtggttgaggttccgcacctgactgctggtggcgctggtgatacccgtgaggattccccggctgaccagaagcacgctttcccggcgacttccagcactaccgttaaggttgctctggataacgttgttggcctgttccagcaccgctctgcggttggtacggtcaagctgaaagacttggctctggagcgcgctcgtcgtgcgaactatcaggctgaccagattatcgctaagtacgcgatgggtcacggcggtctgcgtccagaagctgctggcgctatcgttctcccaaaggtgtcggagtaattcccgaccccactggagttactcttagtcagaagactatgagcttagtcgttggggcttctaaagccctgactgctacggtaactccggctgatgcagtacagacagtgacctttacgtcttccgatgcgaagattgctacggtcgatgcctctggtactgtaactgctgtgggcgctggctccgctgacatcactgctactactgtgaatggcctgacggctgtctgcaaggtcactgtgaaagcagtagagcctcccgtagaaggctaaggtctttaccggggatttactttccttcattactttatgaaccccttgggtgccctctgagggtatctgaggggttttttgctttaaaccctcactaacaggaggtaacaccatgcgctcttatgagatgaacattgagaccgcagaagagctatcagccgtcaacgacattctggcttccatcggtgagccaccagtatcaacccttgagggtgatgcgaatgctgacgttgcgaatgctcgacgtgtactcaataagattaaccgacagattcaatcacgaggatggacattcaatattgaggaaggtgtgactcttctaccggatgcgttctctggtatgattccatttagctctgactatctgtccgtaatggcaaccagcggtcagacccaatatatcaaccgtggtggatatctctatgaccgctctgcgaagactgaccgatttccttctggtgttcaggtcaacctgattcgtctgagagagttcgatgagatgcctgagtgcttccgtaactacatcgtcaccaaggcttcgcgccagttcaacaaccgcttcttcggtgcgccggaggtagacggagtgttgcaggaagaagagcaggaagcgtggcgtgcgtgcttcgaatacgaactagactacggcaactacaacatgctggacggtgacgcattcacctctggtctacttaaccgctaatcataaggaggctctatggctctcattagccaatcaatcaaaaacctcaagggtggtatcagccaacagccagatattctccggttcgctgaacaaggtagcgtacagattaacggttggtcttctgagtccgagggtctccagaagcgcccaccgatgattcaccttaagacccttggcgctgctgggtatgtgggtgcgcaaccttacgtgcatcttatcaaccgtgatgagttcgagcagtatttcgttgtgttcactggtgaagacattaaggtgttcgacctcgatggtaaggagtatctagtacgtggagaccgctcttatgtgcgcacagctaacccacgggaagaccttcggatggtaacggtggcagactatacctttgtgactaaccgcaaggtggttgtgcagagtaacgaccaatcggtcaaccttccgggctttaaagaccaaggcgatgcgctgattaatgttcgtggtgggcaatatggacgtagactctcaatcgagttcaacggggctgagcgtgctgctattcaactaccagacggctcacaaccagcacacgtcaatgaggttgacggtcaggccatcgctgagaagctggcggctcagttgcggaataacctagggaatccaaacaatgaacaagacccaaataagtggcggttcaatgttggccccggattcatccatatccttgcaccaaataacgataacgtttggggactacagactaaggatggttacgcagaccagctaatcaaccctgtaacccattacactcagtcgttccagaagttgcctattaacgctccagatgggtacattgtgaagattgttggtgatacctcaaagactgccgaccagtattacgttaggttcgacctcaaccgtaaggtgtgggtagaaacaattggatggaacacaaggactcacctacattaccacacgatgccttgggcgctggtacgtgcttctgacgggaactttgacttcaagtaccttgagtggggtgctcgtactgtgggcgatgatacaactaacccatacccatcatttaccggacagacaatcaacgatattttcttcttccgaaaccgtttgggattccttagcggggagaacatcatcttgtctcgcacctcgaaatacttcaacttcttcccggcctccgtgtcaaactactccgacgatgacccaatcgacgttgcggttagtcacaaccgggtgtcaaccttgaagtatgccgttccgttctccgaagagttgctcctgtggtctgaccaagcgcagttcgttctgacagcctctggtatcctatcgagccgctccgtagagttgaaccttacgactcagtttgatgtgcaagacagggcgcgaccacacggtgtggggcgtaatgtatactttgcgtcacctcgcgcttccttcacatccattaaccgatactatgcggtacaggatgtaagctctgtgaagaacgcagaggacatgacggctcacgttccgaactacataccgaatggagtattcagtatatcgggtacaaccgctgagaacttcgcggctatccttacgagcggagcaccgaaccgagtgtatatctacaagttcctctatattgatgaggaaatcaggcagcagtcgtggtctcattgggactttggggacaacgttacggtgtttgcagcacaggtgataaactcaacaatgactgtattgatgggcaatgaacatgctgtgtggatgggacgcttacacttcacgaagaactccatagacattccgggagagccttacagactgtacatcgacgctaagagaaggtacaccatccctgctgggacatacaatgacgatacctaccagacgtcaataagcctctcagcgatttacgggatgaacttcacgaagggtaagatttcggtggtctttcctgatggtaagattgtagagatagacccgccagtcaacgggtggagtagcgacccggtgttgcgacttgatgggaaccaagagggccaagtggtttacattgggttcaacatcccgttcacttatacgttctcgaagttcctcatcaagaagaccgctgaggacggctcgacggctactgaggatatcggtcgcttacagcttcggcgtgcatgggtaaactatgaggactctggagcgttcatcatccgtgtgaacaacctgtcccgtgagttcatctacacaatggcgggtgcacgattggggtctgacaacctccgtgttggaggctcaaacattggtacagggcagtaccgcttcccggtggtaggcaatgctcaggcgaacatagtaactatcgagtcagacgcatcaaccccactgaacatcattgggtgcggatgggagggtaactaccttcgtcgttcttctggcatttaacttaaagtctccctgcggtgaattaaccctcactaaagggagacactaatagatacgaggggttaaagcattatgtatattacaaagtgtttacaaagccacgctgacaactttcagccgtccatagaggacattctggaagctgaggcattgggtgtcgaacctaaagtaattcctgatgagaacactgtggcaatgctcagcgataacgctgtgttggcaatcggtggcaatcagggagaccgagtatggttccttacctctaagtacgtcccgctgtttaacttgaaggagcgcttagagtttcgtagacttatcattgaatatcgtgatatgatgctgagccagtacgagtccatttggaatttcgtttgggtaggcaataagtcacacattcgtttcctaaagaccataggtgcggtattccataatgagtttatcgctgatggtcaattccaattattcactatcagtaggaggtaactatgtgctggatggcagcgattcctatcgccatgatgggtgcccaagctctgagtagccagaacagtgctgacaaggcgcgagtggcacagaccgaagctggacgcagacaggcaatggagatggtcaaagagacgaatatccaaaatgccaacgcctcgctggaacaacgggacgcccttgaggctgcatcctctgagttgactacacgtaacatgcagaaggtacaggctatgggaacaatccgtgcggcgattggtgagggtatgctcgaaggtgaatccatgaagcgcatcaagcgtatcgaagagggcaactacattcgagaggccaatagcgtcaccgagaattaccgccgagactatgcgagtatctttgcgcaacagttgggacgcactcagtccacagcaagtcaagtcgatgccatgtacaagagcgaggccaaaggtaagtctggtcttatgcgcgtactagaccctctgtccattatgggtcaggaagctgcaagtcaatatgcggctggtggatttgacaagaaaggcggaaaccaagcagcacctatcagtgccgccaaaggaaccaagaccgggaggtaataatggctagtaaactaaatagtgttttaggcaacatggcgactcccggtatggaacgactccggggcgtcaaaggtatggactaccgggcagcaaccattcaggctgaacaaccaagagcgagtcttctggactccattggtcgattcgctaaggctggtgccgatatgtacatggcgaaagatgaacgtgataagcaacgggccgatgagcgctccaatgagattatccgtaagctgacccctgagcagcgccgacaggctatccagaatggtacactgctgtatcaggatgacccatacgcaatgcaagccttgaagttcaagaccgggcgtaacgctgcgttcctcgttgacgatgaggttcaacaggccatcaaagagggccgcttccgtactcgtgaagagatggagcagtatcgtcactcacgcctacaggagcactcgaagtcgttcgctgagcagttcggcatcaatgagatggacgaggaataccagaagggtttcaatgcgaatatcaccgagcgtaacattgctctgtatggcgcacatgattccttcctgagtgaccaagcgcagaagggtgcaatcctgaactcgaaggttgaactcaatggtgtcctgtctgaccctgacctactgtctcgtcctgagtccggtgagttcttccagaactacattgacaactccttggtgacagggatgaccgacaatcaggctcaacaggttatctcttcgtccctgaatgacgtgctacagcgtccgggcggtgccgccttcttgcagaacattgagaaccgcaaggtgactcttaatggcgctacgactacctatcgtgaactgatgggtgatgagcagtggcaggcaatgatgattaaggcacagcacactcaattccagaacaacgcgaagttaacagagaagttccgactggatattaactcagcgcttaaccaagcggacactggtaaaggttgggagactcttcaaggtatcaaggccgaactcgataagattcagccgggtgaagagatgactcctgagcgcgagtggttgatttccgcacaggaacagatgcgcacccgcttcaagcaggaacaagctgagacagccaagctgatggacaagcaacagaagaccctgaataaatctttggtcatcgacaagcagttccagaagcgcctcaacggtgaatacgtctcgaccaactataaggacatgccgacaaacgagaacactggtgagtttacacatagcgatatggtcaactacgcgaaccagaagttagcggaaatcgaagcgatggacttaacgccagaacagaaagacaaactgaaattggactacctacgggcagactccaaggagggtgctttccgtgcagcgtttggtgagatgattactgacgcgggtaacgaatggcaggctgcggtgattaacggtaagatgcctgagagcacaccagcgatggacaaccttcgtcgcatccgcaacactgaccctgacctgattgcctctctgtatcctgacaaggccgagttgttcctgacgatggacatgttggataaccaaggcatcgacacgcaggttcttatcgacgctgataaggcccgcgcacagaagaccaaggagatgcagtttgaggatgaccgagcgtgggctgctatgatgaacgattcaacgaatcctcaaatcaagtacatgccttcgagtgtccaagggtatgcccggaagatttatgattccgtgaagtaccggacagggaaccctgacatggcaactgaacaggtcgcaaagttcctctccgattctacgaccacgttctccagtagcgatgttgagggtgatacctacggcgtcctaccgaagaacatcctgactgtttcggatgaccctaagtcgtgggagcaagggaagaacattctggacgaagccattaagggaatcacagcggcgaacccttggattaccaacaagcaactgtcggtgtaccagcaaggtgattcaatctacctgatggacacaaccggacaggttcgcattcggtatgaccaagagttgctcaagcgtgagtatcagcgcaccgcacagatgcaagctgaggcagcgcgagagaaagctctcaaagaggccaataagcgtgctccaatcagtcgcgcaacgcaggcgcgtgaagaagcgcgtaaacgtgtccaagagaaacggaagaagactccgaagtacatctatgggcgtaaagaagactaacagtgataaggaggctccatgagctacgataagaacaaacctagcgagttcgatgggttatttcaaaaagcggcagacaatcatggggtctcctatgacctgcttcgtaaattagcattcaacgaatccagctttaatccaaaggccaaatccccaactggcccgaagggtctcatgcagttcaccaaaggtacagccactgcgcttggcctcaaggttactgacgatgatgacgatgaccgttacaaccctgagttggctgtggatgcagccgctcgtcacctgagtgacctcattcggaagtacgatggggatgagcttaaggcagccctagcatacaaccaaggcgaggggcgcaacggtgctccacagatacaggcctacgacaaaggtgattgggcttcaatctctgaggaaggtcgtaactatatgcgtaacctgatggacgtagctaacagtcctcgcaagggggacttggaggcgttcggcggtatcaccccaaaggctaagggcattccatcgggggatgcatttgctggaatcgggaagaagcagacggtaggcactgacctgccggagtcaactggattcaaagtggagggtaaagagcagaaagcacctaacgtgccttatgccaaggacttttgggaaaagactggaacaacgctggacgagtttaattcacgttcgaccttcttcggaatcggagatgccacgagtgcagaacttcacaactccgtattgggtgtggcttttcgtgccgctcgtagtgatgacggttttgatttattcaaggacaccattactccgactcgctggaacagccatacgtggactccagaagagctagagcgtatccgtaaggaagtgaagaacccatcgtacatcaacgtagtcactggaggctctcctgagaatctggacgccctcattaagatggcgaatgacaactatgagatggacgcacggtctgccgatgctggtgttggtgccaaacttactgctggtatcgtcggtgctggtgtagacccgctgagttacgtgccgctagtaggcgtagccgggaagggtctcaaggtggttaacaaggctttcattgtgggtactcaaagtgctggcctcgcggttgcctctgagggtatccgtacatcaatcgctggtggagaagcccactatgctgatgctgctttaggcggtctgatgttcggtgctgggatgagtgcaataagcgatgctatcgcggctggtattcgccgttcccgtggtactgaggttgttaatgacttcgctcctatggcacaccgattggaagcccgtgagaccgctctgaactctggtggtgaagacctgacccgtatgccgagcgagaaccgtgtgttcgaccgtgagcacgctggcgttgagtattcacctctggagaccgagccgggtgccgttgtgttgcctcaaggtcaaatccttagcgacaccaacccgctgaaccctcagactcttagcgagttcgaggcggtcaaccctgagcgtgcctctcgtggtatctctttgggtggcttcactgagattggattgaagactctccgctctgagaacccgactgttcgctccattgcgagtgaccttgtgcgttctccgacagggatggaatcaggctctaatggtaagttcggtgcgacagcttctgacattaaggagcggctccacgcgaacaatcagcgcacctacaatcagctttatgatgctgtgcgtactgcaatgaaagaccctgagttctccacgggtggggccacaatgagccgtaaggaaatccgacaggaaatctacaagcgtgcagccttggcgattgagcggcctgagcttcaagcaaacctgacaaggggtgagcggaacgtgatgaacatcctcaagcagcactttgacctcaaacgtgaaatcatggagaacccgtcaatcttcggcaacaccaaggctgtcagtatcttccccggctcacgccacaagggaacctacgtgccaaacgtgtacgaccgcgctatcaagattgagatggttaaacgttacggtaatgatggcttgcagcgagcaatcgcggagtcatggttgacgtcttatcgtgctcgtccagaagtcaaggcgagggtcgatgagtacctgatggaacttaacggtctcaaatccgttcaggaagttacacctgagatggtgcagaagcacgcgatggataaggcgtatggtatttcacacactgaccagttctctgcctcctctgtcattgaggataacattgagggtctggtgggtatcgagaacaacaacttcttggaagcccgtaacatgttcgacagtgacatggcggtgactctccctgatggtaacacgttctctgtgaatgacctgcgtacctatgacatggctgaaattctgcctgcatacgaccgacgagtggatggggatgttgcaatcatgggcggttccggtaagactaccaaagacctgaaagatgaaatcatggcgctggataagcagtcagagggtaacggcacactgaaaggtgaagtggaagccctcaaggacaccgtgaagattctgactggtcgcgctcgaaggaacccggaaggcgcttggggcacagccctacgctccgtcaatgaccttacgttcttcgctaagaacgcctatatgggcgcacagaacgttactgaaatcgctggtatgctggcgaagggtaacgtctctgcgataactcatggcatccctatgattaacgattgggtcaaccgtggtaaaccgcttcgtgcctctgagattaaggagatacacgggatggtgttcggtaaggaactagaccaactaatccgtccgggacgtgaagaccacgtgcgccgactccgggagtctactgacaccagcgctgcggttgccaatgtggtcggtacgattcgtttcggcactcaagagttggctgcacgctctccttggacaatgctcctaaacggaacatcaaactacattcttgatgctgcccgtcagggtgtgcttggggatgtggctggagcggcccttgctgggaaagcctctaagttcggtaaggcaaactaccttaagtctgcctctatcagccctgagcagtggcgtggaatcaagcagttgttcagagaccatgcgactcgtggagaagacggtaagttcaccattcgtgacaaacaggctttcgctaacgacccccgttcaatggacttgtggcgactggctgacaaggtggctgatgagaccatactgcgccctcacaaggtttcctcacaggactccaaagcgttcggtgcaggggtgaagatggtgatgcagtttaagaacttcgtcatcaagtcccttaactcccggttcgtccgtagcttctacgaggcaacgaagaacaaccgtgcgttagaccaagcgttgactcatatcatctctttgggtctagctggtggttactacgttgcgcaggcgcaccttaaggctgcaagtctacaggagcacaaacgtaaggagtaccttaagaacgcccttgaccctaagatgattgctcatgcgtcaatatctcgtagttcacacttaggctcaccattgagtatctacgacatgttcgccgggatggttggtagcgatacctataagtacacccgctctacggtgctccctaaagagtccgagaagcgtgaccctaacaaggcagtgacaggtagacaggtggcttcaactatcgcaggtgcaattggtgagcaggttccgggtttaggctttgttggctctgtgggtgcaacagctattaacgccgcttccctgctgtcttctccgaacaaggctaccgctctggagttccgtacaggcctcttcaacacctctcgtgagttgattcctaatgacccgctatcgcagcaactcattatgaaaatctacgaggccaacggtatccgcataaaggagacgccgaagaaacaataaaccctcactaaagggagagaggtcacattctggcctcttctctcctaatgctaatttataaaggaggtcacatggctacaactattaagaccgtgatgacttacccgctggatggctctactacggactttaatattccgtttgagtatctggcgcgtaagttcgtcagagtgacccttatcggtgttgaccgaaaggaactcatcttgaatcaagactatcgttttgcgactaagaccacaatctccacaacgagagcgttggggccagcggacggttatactttgattgaaatccgtagattcacctccgctaccgataggctggttgactttacggatggctcaatcctccgtgcgtatgacctgaacatctcgcaggtacagaccctccacgttgctgaggaagcgcgtgaccttaccgctgatacgattggcgttaacaacgatggtgacttggacgctcgtggtcgtcgtatcgtgaacgttgcggacgctaaagaccccggtgatgcaataactttaggtcaagtctctcgatggaatgagtcggcactgaactctgcgaatgctgctgctgcatctcaacaggccgctgctgcatctcaacaggccgctaagtcctcagagactaacgcaaagtcctctgagagcaacgcaaagtcctcagagaccagcgcgtacgaatgggcgcagcgtgcagaggactctccggtgcagggtagcgagttctcctcatatcactactcacgcaaggccgcaaaaagtgcaacagccgcgcatacgtctgagaccaacgctaagtcctctgagaccagcgctaagtcctctgagactaacgctaagacctctgagactaacgctgcatcgagtgctgctaaggcttctgaggaggctgctaagctgactaacatgaatgactttgctgctgctattgattcagtcaacggtaacaatgttgtcatgaagggtgacttcaccattaaaggaaacggtaaagtatcaatactgaaccacagtgggctataccaagataagaccgtgaacggcgtgaactatgccaacaggatttatatggatgatgcagggggcatgcacttcgagaactaccgtgtgtctggtacttcatccaccttacgtgctggttttgttattacagataccaacaggtttgactttacagggccaacgcgagctaatggtgatatcatcgcatatgtgaatgcgccccctaatccagctattggccaatacctcaattctgtggcagttcgctcacagcttcggggccgtggtgctaagaatgatccacttggtgcgtactgtggtatgtatattcaggagcacgttggtacagaccacgcgataatccttaacctcaatggttatagcaaggatactaactggcagctattctccaatggtaaaatatctacaccacttggtgatgtgatgacttcgggttctgatgttagaatcaaggatgatatcactaaacctcttgatggtgctggtgagcgtattgacgcaattggcatagtggaatacacagagattgccaccggggaacgtaaacgtgggtggctggcccaacagcttgacacgattgacccgctgtacacatacctcacgaccaccgcagaaggtagtcttttgaataccaacgacagggcgttgcttgctgacgtaataactgagcttcaagcactgcgtcaacgtgttaaagaactcgaaggacaatcaacaaagccagcggacggcacaacataaggagaacaagaatgttatcttttgacttcaataacgaggtcgttaaggctgcgcctattgttggcacaggggtcgctgatggggcggcccgactcttttgggggctatcgttaaacgaatggttctacgttgcagctatcgcctacacagtggttcagattggtgccaaggtagtcgataagatgattgactggaaacgtgcaaacaaggagtaacctatgagcgacaagactttaatcaagctgctggagatgctagacacggagatggcacagcgtatgcttgctgacctccagagcgaggaacgccgaacgccacagctttacaacgcaatcggcaagctgttagaccgccataagttccaaatcagtaagctgaccccggatgagaacatccttggaggtctcgcggctggtctggaagactacaacaaagtggtcggccctaatggtctgactgacgatgagactatcacgctacagtaagtgacatactcaaggttctccgcgtggggagcctttatggatgttatttggtgcatctacgtgaaatctgaaaattgatgggaggtgttatgctaaaacttttacgcagcgcactcccttgggtactcgccgggacactctttatgggtggctggcacttagggtcaacccatgagagagcaaactggaaggaggtaatccaaaatgaatacattgcgaaaacaaaagcaaccgcagcaactcaggcagaggtcagtcgggtatcccgtgagtaccaagaagagattgcagccattgagggcagcactgataggatgcttaatgaccttcgtagtaataataagcggctgtcagtccgcatcaaaacccttaccggactaccagaagataacggtagatgcgagtttaatggtcgagccgaactacacgagtcagatgctaagcgtattatcggaataacccaagctgctgatgctcacgtaagagcgctccagcgtactattaaggagatgcagaatgagcgacacccaagcaaaccgtaatgcgctaatcatcgcgcagcttaagggcgactttgtggccttcctgttcgtattgtggaaggctttggctctcccgccaccgactaagtgtcagattgatatggcccggtgtctggctaacggagacaacaagaagtttatcctacaggctttccgtggtatcggtaagtcattcatcacctgtgcgttcgttgtgtggacgttatggcgtgaccctcagttgaagatactgattgtctctgcatccaaagaacgtgcggacgctaactccatcttcatcaagaacatcattgacctgctgcccttcttggctgagctaaagcctcgccccggtcagcgtgactctgtgattagtttcgatgttggccctgccaagcctgaccactctccgtctgtgaagtcggtgggtatcactggtcagttgactggtagccgtgctgatatcatcatagcggatgacgttgagattccgtctaactccgcaactcaaggtgcccgtgagaagctgtggactctggtgcaggaatttgctgcgcttctgaaaccgctgccgacttctcgcgttatctaccttggcacgcctcaaaccgaaatgaccttgtacaaggaactcgaagataaccgtgggtacaccacaatcatctggcctgcgctctatccgcgtagccgcgaggaagacttgtactatggcgaccgtctggccccgatgctccgcgaagagttcaacgatgggttcgagatgctccaaggtcaaccaactgaccccgtgcgcttcgatatggaagacctgcgtgagcgtgagttggaatacggtaaggctggcttcactttgcagttcatgctcaacccgaacctgagtgatgccgagaagtaccccttacgcctccgggacgctatcgtgtgcggtctggacttcgagaaagccccaatgcattaccagtggcttccgaatcgtcagaatcgcaatgaagagctacctaacgtgggccttaagggtgatgatattcatagctatcattcgtgcagccagaacactggacagtaccagcaacgcatcctcgtgattgaccctagtggtcgaggtaaggatgagacaggttacgcagtgttgttcaccctgaatggctacatctatctgatggaagctggcgggttccgcgatggttattccgataagacccttgagtccctcgctaagaaagcgaagcagtggaaggttcagacagtggtcttcgagagtaacttcggggatggtatgtttggtaaggtattcagccctgtgctcctgaaacaccatgcagccgctatggaagagattcgcgctcgtggtatgaaggaactacgcatttgtgatacgctggagcctgtactctctacgcaccgccttgtgattcgtgacgaggtgattcgtgaggactaccagactgcccgtgacgctgatggcaagcatgacgttcgctattcgctgttctaccagttgacccgtatggctcgtgagaagggcgctgtggcccatgatgaccgacttgatgcgttagcattgggtgtggagttcttgcgctctacgatggaactggacgccgtgaaggtggaggctgaggtgcttgaggcgttcttagaggaacacatggagcacccaatccattcggctggtcatgtagttacctctatggttgacggtatggaactctattgggaggatgacgatgtgaatagcaacaggttcattgactggtagttatgcatattgagcgcataaggattcaattagaccacggatggtcactttaagaaattccttaagaatcaacgagtttgcattaaccctcactaaagggagagaggggacttaaagctactatataggttagtcattcaggttatgcaatgaccccttatgcactttaagtctacctctgtgattggtgatattatcattgtataatcaccctaccttagagcaactgaaaggaggtggctcatgttacgcttgctgattgccctgctgcgtcatagagtcacttggcgatttcttctggtacttactgctacccttgggtacgcaggtcttaatgaccacctcggtcaactggaagtggccttttgctctatactctcttgtggggattaaattattgttgatgaacgacaagcggctctgagggattcgtaggtatagtttcactacaccaactcatccctgtagagtcaaccctaaaggttatacctaaagatgccctgtagttcgtaatggtcttacagggtcttctggtgtctcctagctatcccttcgggatgcgcctatggtctcacctatggtgtggccttacctaaagtggttgcctaaagagaccctttaagaatttaccacaaaaatctgaatgggtatctcacagttcaagaacccaaagtacccccccatagccctcttaaagccacctaaagccagccctacccctagggtttaaccttcggttaaccttgggtatctctccaagtggtctataggatagcctaaagtgatgcctaaagtcaatacctaaagtggtggatggcttaaggaggacttagagagtgtcctagtgtaccagtgcgatagtacatctctatgtgtccct

SEQ ID NO: 25 - DNA, 39088 bp, Unknown
  source: /note="Description of Unknown: KP2-8c Bacteriophage Sequence"
gtaacccttaaggctattattcatctcgtcaacgggacaacggccttaaagccactccctgagataccggagtcaaccggataagtagacagcctgataagtcatacgaaaaacaggcattgacaacgcaaggtaacaagtagtaagatgcacaacgtaacgtcaaccagcaaatcggtgtcttctaggtgacttaagcgcaccacggcacataaagcgaaacaaaatggttgacaacatgaagtaagcacggtacgatgtaccacatgaaagacaccgagtgtcgtaggtgtaaaaacgcgacatagtggatagatggcgaaagcacaagcgaccacgataataaagagcttgtcgcacttataatgcaagtgacggctaacactgaaatagcctcggctcgacgaaactgtagcctaaagttctttaacaatctggataatagctcttgagtgtaccgacgtataagcgaataactcaaggtcgcactgaaagcgtggcctttatgatattcacttaacatgaactaacatgaggtaacaccaaatgattttcactaaagagcctgctaacgtcttctatgtactggtgtcagctttccgttccaacctcgacgatgaggtgaacatgagtcgccaccgccacatggtaagcactttacgtgccgcaccgggtctttatggctccgttgagtcaaccgatttgaccgggtgctatcgtgaggcaatcgcaagcgcaccgactgaggaaaaaacggttcgtgtacgctgcaaggacaaggcgcaggcactcaatgttgcacgcttagcttgtaatgagtgggagcaagattgcgtactggtatacaaatcacagactcacacggctggtctggtgtacgctaaaggtatcgacggttacaaggctgaacgtctgccgggtagcttccaagaagtgcctaaaggcgcaccactgcaaggctgcttcacgattgatgagttcggtcgccgctggcaagtacaataagtgttaaactcaaggtcgctccatgcgagtggcctttatgattgacattacaggaggattagcaatggttatatttatcactatcgcactctttgcggtcgctggctggtactctgagtcacgcaaggccgctcgctatcatcgcaagatggttaaactcatggaacacttggacgcagaagggcgaggctgcgaggctatcgaactggtgaaacacgcatgatgattctctttatcgcactggtctatctgtgcatcgctatgtactttatgcgagactttaagcgcggtctggtaatacacaaggcaacgctgagttactttaagtggggattcatcccacggtttacggttcgtgaacgtaacggacgatttaaggccaacaaggtaggagtattctacattgctacgcactaactcaaagcacgtaaagaccgcactgtatgcgatggcgtatggtgcatcgaaacgcaaggtcaaacgcatcttaacgagacaccgcaagatgaccgcacgacaggctgcaagcgctgtcaaatgggctgaatttactctttactcttcttacagataacaggacactgaacgatgactttcaccgaagcacaagccgcactcgaagctatccgcaacctgccgattgagcgcctgaacgaacgccagcccatgctggtggctcttgcggctgctatcgtgaacgatgagactcaagacggcgaactgacgcaggccaaaggtaattggggcttggagtctatggactactggcagacactggctgagcgtatgcgtgatgttggatttgtacgcttgggcaacggtcactttagcgcagcatatgagcacgcattgttaccgggcaaggttatcaaggtaggctttaagaaagaggattcaggcgctgcctatgctgcattctgccgtatgaaccaaggccgggaaggtatccctacggtgtacgacattcagcgtcatacaggctgctacacggtggtcttggactatctgacaccgcttaacgattggtgccacggtgaaagcgataagattcgccaccacttccacgctgcaagggaaatcattgaggaggattgcttcgataccgccgaagagtacccgataagcgagggcttcattgagacctgcaaggatatccgcaagttcttcttaggcatcgcatcgttcgattgtcacagcgggaacatgatgaaagaccagatgggacgcctgattatcacagacccggtatcgttcagcgcagacgacaagttaaagccgggtgagttccactgtgacccggatgaactcatcgctgagattgaggcgctgagagcgcaggaagcgattgaccgctgcaaggcacgtaaggcacgccgtgaccctaaaggagactttcaggtagcacgtaaagcccgtgccaaatggcgcagaaaggcctctaagcgtgctaaacgtgacgctaaggtactcgctaagatgcgcatggacgccaatcagaatcgcagggatgagcctagggcgcgtatggtgtggggcgataagcactggcgcaacgcttggatgcaccacaataacctaaactttgcagaactggagcgccgcgctgctgcggcaatgatgatgcatgacgaggtgcgcattcagtggggcaaaccgttacacatagacgcataccttgacaggagactgcaaggctgatagagtcttttcttacaggtcatcatgaggtggcctgaataggaacgatttattcacaacgaggtaagcaatgaacatcatcgaaactatcgaaaagaatgacttctccgaaatcgaactggctgctatcccgttcaatacactggcagaccactacggcagcgcattggctcgtgaacaactggctttagagcatgagtcttatgagctaggcgagcgccgcttcctcaagatgcttgagcgtcaagctaaagctggtgagattgcagacaacgcagccgctaagccattactcgctactcttctccctaagttaaccgcacgtatcgtggagtggctcgaagagtacgcctcgaagaaaggccgcaagccagtagcctatgcaccactccagttactcaagccggaggcgtccgcgtttatcacactcaaggtcatccttgcgtcactgaccagcacgaacatgacaaccattcaggccgctgctggtatgctggggaaggccattgaggatgaggcacgtttcgggcgcatccgtgacctcgaagcgaagcacttcaagaagcacgttgaggaacagcttaacaagcgccacgggcaagtctacaagaaagcctttatgcaggtggtcgaggccgatatgattggtcgtgggctgcttggtggtgaggcgtggtctagctgggataaagaaaccacgatgcacgtagggattcgcctgattgaaatgctgattgaatccacgggtctggtggaattacagcgccacaacgcaggtaacgcaggctctgaccatgaggcactacaactggcccaagagtacgtggacgtattagcgaagcgtgcaggcgctctggcgggtatctctccgatgttccagccatgtgtcgtaccgccgaaaccttgggtagcaatcaccgggggcggctattgggctaacggtcgcagacctttggcactcgttcgcactcactctaagaagggcttgatgcgctacgaagacgtttacatgccagaagtctacaaggctgtgaacatcgcacagaacaccgcatggaaaatcaacaagaaagttcttgcggttgtcaatgagattgttaactggaagaattgcccggtcgcagacattccagcgctggagcgccaagagttaccgcctaagccggacgacattgacaccaacgaggcagcactcaaggagtggaagaaagccgccgctggtatctaccgcttggacaaggcacgagtgtctcgccgtatcagcttagagttcatgctggagcaggccaacaagttcgcaagcaagaaagcaatctggttcccttacaacatggactggcgcggtcgtgtgtacgctgtgccgatgttcaaccctcaaggcaacgacatgacgaaaggtctgctgaccctcgctaaaggcaagccaatcggtgaggaaggtttctactggctgaaaatccacggtgcgaactgtgcgggtgtcgataaggttcctttccctgagcgcatcgcgttcattgagaagcacgtagacgacattctggcttgcgctaaagacccaatcaataacacttggtgggccgagcaggattcacctttctgtttcctcgcgttctgcttcgagtatgcaggcgttgcgcaccacggtctgagctacaactgctctctgccgctggcgttcgacgggtcttgctctggtatccagcacttctccgcgatgctccgcgatgaggtaggtggtcgtgcggttaacctgctgccaagcgaaaccgtgcaggacatttacggcatcgttgcacagaaagtaaacgagattctcaaacaggatgcaatcaacggcacacctaacgagatgattaccgttaccgacaaggacaccggggaaatctcagagaagctcaagctgggaacctcaacgctggcgcaacagtggctggcatatggtgtaacccgtagcgtaactaaacgttcggtcatgacgctggcttacggctccaaggagttcggctttcgtcaacaggtactggacgacaccattcagcctgcgattgacagcggtaagggcttgatgttcacccaacctaaccaagcggctggttatatggctaagctgatttgggacgcggtgagcgtgaccgtagtcgcagcggttgaggcgatgaactggctcaagtctgccgctaagctgctggctgctgaggtcaaggacaagaagaccaaggagattctgcgccaccgttgtgcggttcactggactacgccggacggcttcccggtctggcaggaataccgcaagccactccagaagcgtctcgatatgattttcttagggcaattccgtctgcaaccgacgattaataccctcaaggattcaggcattgacgcacacaagcaggagtctggcatcgcgcctaactttgttcactcacaggacggtagccacctccgcatgacagtagtttatgctcacgagaagtatggcattgagtcctttgcgctcatccatgacagctttgggactattccggcagacgctggtaagctctttaaggctgtgcgtgaaacgatggttctcacctacgagaacaacgatgtgctggcagacttctatgaccagtttgcagaccaattgcacgagacccaactggacaagatgcccccgcttccgaagaaagggaacctgaacctgcaagacattctcaagtctgactttgcctttgcataacaagcacttagcattaaccctcactaacgggagactacttaaggtctcccactttaagacactttaggtactaagagattaaatttatgattaacattaagactttctttaagaacatctttaagctaaaccgcttgacttccgttaagttctacgcttggatgcccggtagtgatgacctccgcaagactgaatttaagttaggcttagggccgtgcggcaaggtggtcacgaagttggaatgttactcaacgtcctccgggatggtcatcttccagaccactgaggacaacgaaacgaaatccttctactacccgaaaggttcaacgtgtggtcgtatcgaacggacatacagttaaccctcactaacgggagagttaaacttaaggtcatcaacaacggtggcctttgtgattaactttcaatacacatcaacatgaggtaagatactatgcgtaccaactttgagaaatttaccaagcgcgattcagtggtcaacgagcatggcgaacagtggcaagagcgccgtgaccgcatgaagaaacgccacaagcaacagcgcggtaactcacagaaacgggagtggaactaatgatgggacgtatctatagcggcaacctgaacgattacaaagatgcggtagcgcgtctacaggaagaccatgacgtgaccgtgaaggtggagtcattcagctatgaaaacccagcgaagatgtgcaggtcatccggtgaggttctccgcgtgttcacacgctcagggcatccggtggcatccagaaccttcgagcatagcgacagcgatgtacaaatcaacgcgcagactgcatggctccgtaaggttcacagcgatttgaaacactggaagtaataaccctcactaaagggagaacgaaaggaggaaacattatgagaatttcatttgacttaatgagtccttcctttctctcatgggatacgggtcgtcacactggcggctctattcgcaacggctatagaagggttcgttatgaaggtaagtggttaaaccatcacatactcatttgggaacacttcaacggtgcagtcccggagggaatggaagtagaccacattgaccgtaacaaacttaacaacgcgcctagtaaccttagacttgtgacccgctctgagaacaacagaaatcggtcagtacaccggaacaacaagtcaggaatcaaaggtgtctactggcacaaacaccgccaagtttggtacggtcagtgtcgaagaggcaacaaaacatttatcaccgctggttgctccacgaaggaacaggcggcagaacttttagagaaactcaaagaggaaattaattatgatgattttcaaaaccgtcccgtataaggctgtgtcattcgtagagtctgccgttaagaaagcgctggagacctccggctacctgattgctgacattaagtacgatggtgtgcgcggtaacattgtggttgacaacgtggctgaggccgcatggttgtctcgcgtatccaagttcatcccggcgctggaacacctgaacggtttcgataagcgctggcagcaactactgaacgatgaccgctgcattttccctgatggcttcatgctggatggtgaactgattgtcaaaggcgtagacttcaacacagggtctggcctgctgcgtaccaagtggctcaagaagaacaacttcatgtttgaccgtggtggtgttgagccgctgaaaggttccaaagtagcctttgagttagaccctaagcgcctgagtgtgcgcctgtatgctgtcatgccgattcacattgcggagtctggcgaggactacaatgtacagaacctgctgatgccgtatcatgtggaagccatgcgctctcttctggttgaatacttcccagaaatcgagtggcttattgctgagacctatgaggtctacgatatggattcgctgactgaactgtacgaggccaagcgtgccgaaggtcacgagggtctcattgtgaaagacccgcaaggcatctacaagcgaggcaagaagtctggctggttcaagctcaaaccagaatgtgaagctgatggcatcattcagggtgtcaattggggaaccgaaggtttagccaacgagggcaaagtgattggctttagtgtgcttcttgagactggtcgtttagtagacgccaacaacatctctcgcgcactgatggacgagttcacagccaacgttaaagcccatggtgaagacttctacaacgggtgggcctgtcaggtcaactatatggaagagaccccggacggctccctgcgtcaccctagcttcgagaagttccgaggcactgaggacaaccctcaagagaaaatgtaaccaactcactggctcaccttcacgggtgggcctttcttcgttccgggggggaattaaccctcactaacaggagacacacaccatgtggcttatcctattcgctatcgtcgcaacgctgggattaatggctgccgacgacaacatttggcctgattgttaaggagataacatcatgcgtttacatttcaacaaatccaacggtatcttttcggttcgccgtaaagaccgctcgaccgtattggcctctgagcgcaacgccaagctgccgctgattggttcggtcgccacgctatccccttgcgttcacctgctgattactcgcggtgagttcgtcaaggcgatgaacaaagagcgtccgcatctggaagccgtggtcacttactggcctcgcgttcgtctgttcgttaaatggcttaaggaggtactgtaatgttacaggaatattatgatatgcgtagccgcttcccggttaactctgccgttcgttattcaggagcgaaccctttgttcaagggtctgaccggaacagtgcagggctactctcacactggtcgagtcaaggttcgcttcggtattcgtgaggctgaggtgcatccatccgtactaatcccgctacctaaagtcggcccgaacgtggaagcaccgaagacagaagtcaagtctgacgtgacccatccgaaccactacatgctgttcgacaacgtggaagccattgaggttatcgcccggtcaatgaccgtcgaggcgttccgtgggtactgccttgggaacatcctgaaataccgcctgcgtgctggtaagaaatccgaactggcaacgatggagaaagaccttaagaaagcggctttctatcaggaactgtttgacaaacataaggggctgtgttatgacgcttcgtgaatgctgcgattggtgtgccgctaagtggaaccaagctattgaggatggtgacaaggcggctgctgacgcttaccaacaactgtacgcgctgtgggagcggcgctttaaggaggcccaaagtggagcaacgtgaacagaaataccttctgacaatggaaggtaacaccgagtcctttgagattccggtattcgcccggtctctcgaagaggcaacgctacaggctgaacattacgaggacgcagggttcgtagtgactcgcatccgtccagaagtgaaagcctaattaccctcactaaagggaacaacccaatcattaaccacaaaggagaaatactatggctggtttcaagaagaaaatctacacctccggtcttggcactgctgagccttatgcttacctgagtaagccggattatggcaacgaagagcgtggcttcggcaaccctcgtggtatctataaggtagacctgactctttccaataaagacccgcgctgtcaggcgatggtcgatgaaatcgtgaagactcacgaagaggcttatgctgctgccgtggaagagttcgaggctaacccgccgcaggtacagcgtggtaagaaaccactgaaaccttacgagggcgacatgccgttcttcgataatggtgacggtacgactaccttcaagttcaaatgctatgcgtctttccaagataagaagaccaaagagaccaagcacatcaatctggtcgtggtcgatagcaagggtaagaagattcaggaagtgccgattatcggtggcggctccaagctgaaagtgaaatactctctggtgccgtacaagtggaacaccgctgtgggcgcaagcgtcaagctgcaactggagtccgtgatgctggtcgaactggctaccttcggtggtggcggtgaagatgagtgggccgatgaagtcgaagatggtggttacactgcgagtgaatcccgtcagtcccgcgatgagcaggagtggcaggaagacgagcacgaagaaaccccggatgaggatgaggacttttgagtcgcctgagccgcgaacaactgcaagctaagattcgtgccaatgtagaactggatggcgactgctggatttggcagaagtccttcggttctcatgggtacggtaacataggcactggtggcggtcgaaatgagaccgtccatcgggtgtctcatgaagtgtttaacggagagatacccaagggtctgattgtcctacatagctgcgacaacaggaagtgctgcaacccggcacatcttcgagcgggaactagggttgacaacatgaaggatgccttgcaccgctccccaataaagcgcaagctgacactggaggaagcacaggagatttatgattctaagctgtcacaaagaaaactcgctgaactctatggtgtatctcagagattaatctggaacataaagagaggtgcagcatggcagcatatggtgcaaaaggaatacgaaaagtaggaaccttccggtcaggactggaggacaaagtacataaacaactggaggctcgtggtataaaggctgaatatgaaatgtggaagattccatatgttgtgccagccagtaatcacacgtaccgaccagattttattttacccaatggaatcattgtcgagaccaagggactgtgggaagctgatgaccggaagaagcacttgctaatccgtgagcagtatcctgaactggacattcgtctggtgttctcttcgagtcgtaccaaaatctacaaagggtctccaacttcttacgccgagttctgcgagaagaaagggattctctttgccgacaaactgatacccgtcgagtggctcaaggagcctaagcgggacgtaccgtgggagaaactaattcgtgtaaaggagaaaaagtaaatggctaaagttcaattcaaaccacgagcaaccacggaggcaatctttgtgcattgctcagcaaccaagccaagccagaacattggcgttcgtgagattcgtcagtggcacaaagagcagggctggttagacgtaggatatcacttcatcatcaagcgtgatggcactgtggaagcaggccgcgatgaactggctgtaggttcccacgtgaaaggttacaaccacaactccgtaggcgtatgccttgtaggtggcatcgacgataaaggtaagtttgacgccaactttacacctgcgcaaatgcaagcgctgcgtagtctgctggtcacgctgctggcgaagtatgagggttcaatccttcgtgctcaccatgacgttgcacccaaagcctgcccgtccttcgatttgaagcgctggtgggagaagaacgaactggttacatctgaccgagggtgataccatgaggatgatttgtattcgctgtgataagccgttgaagagtcgcgtaccgtcacgccagtgtcagtgcaaagacccaatcaaggctgaggaacacaccgaggaataattaacactcactaaagggagacttaacggtttccctttgttctcgcaactgattaaggaatgtacaatggaacgagaagacgatagtatctttctgtttcatgctccatgtgaaaactgtgggtcttctgatggtaactctgtgtactctgacgggcatgaatggtgcttcgtgtgtgaacatcgagtacccgcaaacgaagagcgtgaagcaaagttatcaacgagaagacgtacaggaggcagcaagcctatgagctatgacgtatggaatttcggtgacagcaacggtcggtactctgacctgactgcccgtggcatctcaaaggagacgtgccaaaaggctggctactggctggcgaaagtggacaaccgaatgtatcaggttgcggattaccgtgaccagaatggttccatcgtgtcacagaaggtgcgcgataaggacaagaactttaagaccaccggaagtcacaagagcgatgcgttattcttgaagcacctctggtctggcggtaagaagattgtggtcactgagggcgagattgatgcgctcactgtgatggaactccaagactgtaagtacccggtcgtatcattgggtcacggtgcctctgctgctaagaagacatgcgccgctaactatgaatactttgaccagttcgagcagattatcttgatgttcgacatggatgacgcaggacgtaaggcagtcgaagaggccgcacaggttctcccggctggtaaggttcgtgttgccgtgttgccgtgtaaggacgccaatgagtgtcacatcatgggtgaagacaaagcaatcttggagcaggtctggaatgcaaacccttgggtgcctgacggtgttgtctctgcgttgtcactcaaagaccgcgttaaggaagctatgacctccgaggacgctgtaggtctgctgttcgatggctgtcaaggcctgaacgatagaaccttgggtgcccgtggaggtgaagtcatcatggtcacttccggttccggtatgggtaagtcaacgttcgttcgtcaacaggcgctggcttggggcaagcgaatgggtaaacgtgttggcctagcgatgctggaggaatccgttgaggataccattcaggatatgatgggtctgaacaataaggttcgtctgcgtcagtctgatgaagtcaagaaggctatagcagaggacggacgtttcgatgaatggtatgatgaactattcggagatgatacgttccacctttatgactcctttgcggaggccgaagctgacaggctgttagcgaagctggcctacatgcgaacaggcttagggtgtgatgttatagtgctcgaccacatatcaatcgtcgtgtctgcctctgaggaatcggatgagcgtaagatgattgaccgcctcatgactaagctaaaagggttcgctaagtcaactggtgttgtgctcgtagtgatttgtcacttgaagaacccggagaaggggaaaccacatgaagaaggacgcgctgtttctattactgacctacgtggtagcggtgccttgcgtcagttatctgatactatcatcgccttggagcgtaaccagcaaggtgatatgcctaacttggtgttggttcgcctgcttaagtgtcgtttcactggcgacactggaattgccggatacatggaatacaacagagaaaccgggtggcttgaaccgtctagctacactggcgaagaaggagaaggagatactggctggactgaacaagacggacagtcagacttctaagtaccagtgccactgcggtcatccagactgtgatggcggaatgtaccactaattaaccctcactaacgggaacaacctcaaaccataggagacacatcatgtttaaattcattaacgctttaggtaagctggtagtcaaactgtacttcatcgaagccaagaagctggacaagaaggccaaagcagattcacagcgagccattgagttggcgaaacagtcccgtgagaaatcagatgcggctgttagtggcatccacaagtcggcagcgattgcagccaaagcacagtccatgagcaaattctttgagtaaggagcgaacactatgagcaagtcaatcactcacgcaaacaccatccgtcttccagacaccgccgaccagttctcccgccgagtacacatcaatgtacgtggcgagaaggtcacgatggtctaccgctggaaagaccacaagtctccgaaagcacacactcaacgaatgacattggatgacaagcaggtcggtcgccttatgggtgccctgactatggctgctgacaaggtggtcggagataaccgtgagcgtctggtagagttcggcgctggtatgcaagagattatcgagaagtgataaactcaaggtcgcccaagggtggcctttatgattatcatttagcacgaaaccaaaggagggcattatgctcgtaagtgacattgaggccaacaacctcttagagaaagtcaccaagtttcactgtggcgttatctatgactaccgtgatggtgagtatcatagttatcgtccgggcgacttcggggcgtatctggatgcgctggaagccgaggtgaagcgaggtgggcttattgttttccataacggtcacaagtatgacgttccggctttagagaaactcgcaaagctgcaactcaatcgtgacttcaagttaccacgtgagaattgtattgacacattggtactctcgcgtttacttcatgcgaaccttaaagacacagacatggggcttcttcgttccgggaaactacccggtcgtcgcttcgggtctcacgctcttgaggcatggggttatcgcttgggcgagatgaaaggtgaatacaaggacgacttcaaggctatgctggaagagcagggcgaagagtatgttgaaggtgccgagtgggtttcattcaacgagccgatgatggcgtataacgttcaagacgttgtggtcactgtcaagctcttagagaaattccttacagacctccactacttccctgcgggtatggacttcacgaagtacgatgcggatttattctggcgtgaagctggcgagtctgtggatattgaacatcgtgcagcgtggctgttagcgaagcaggagcgtaacggcttcccgttcaacacacaggccattgaggaactttatgtagaactggcagcgaaacgcgccgaacttctgcgaaagttaaccgaaacgtttggctcgtggtatcagccgaaaggtggtaaggaactcttcaagcacccacggacaggcaaaccacttccgagttatcctcgcgtggtctatccgaaacagggtggcgtgtacaagaagcctcgtaataaggcacagcgtgaaggtcttgaaccttgcgacttggacacgagggattacatggagggtgctccatatactccggtcgagttcgttacgttcaagccaagtagccgtgaccacattcagaagaaactacaggaggccggatgggttcctgagaagttcaccgagaagggtgcgcctgtggtggacgatgaggtcttggagcatgtacgagtggatgaccctgagaagcaggcgtgcattgacttgattaaagagtacctgatgattcagaagcgaatcggtcaggcggcagaaggtgacaaagcgtggttacgttatgttcaagatgatggtaagattcatggagccgttaaccctaacggtgcagttactggtcgtgctactcatagtttcccaaaccttgcacaagtacccggagttcgttctccttacggggagcagtgtcgtagcgcttttggtgctgaacatcatttggatgggattactggcaagccgtgggtgcaagcggggatagacgccagtggcttagagttgcgctgtctggcacacttcatggctcgcttcgacaacggagagtatgcgaatgagattctcaacggtgacattcacaccaagaaccagaacgctgcggaactcccaacgcgcgacaacgccaagaccttcatttacgggttcctttacggagccggagatgagaagattggtcagattgttggggcagggaaggagcgcgggaaggaactcaagaagaaattcttagagaacaccccggcgattgcagcactacgagaagctatccaacattctctcgttaagtcttccgcttggattggtggtgagcagaaagtccagtggaaacgccgttggattaagggtctggatggtcgcaaggttcacgtcaggtctccacacgcagcgctcaacacattgttgcagtctgctggtgctctgatttgtaagctgtggattatcaagaccgaagagatgctcattgagaaaggcttgaagcatggctgggatggtgactttgcgtacatggcttgggttcacgatgagattcaggtggcctgccgtacagagcacatcgctcagattgttattgacaccgcgcaggaagctatgcgttgggtcggagagcattgggctttccgttgtcgtttagataccgagggtaagatggggccgaattgggctgtctgccactaattctataggagaaattattatggctatgaccaagaaatttaaagtgtcattcgacgttaccgctaagatggcatctgacgttcaggaaatcttggagaaagacattctgcacctgtgtaagcaggttggctcaggcgctattgtccccactggtaaacagaaagagatgattgtccagttcctgacgtatggcatggaggggctgatggccttccttgtgcgaacgtctttccgtgaggccattaaagatatgcacgaagagtatgccgataaggacagcttcaagctgtctcccgctactgtacgggaggtgttctaatgagtgaatacctgaaagtgctggcagctatcaaaggttgccctaagtcctttcagtcgaactatgtgcgaaacaatgcggctctcgtagctgaggccgcttctcgtggacacattagctgtttgactgtgggtggtcgcaatggtggagcatgggaggtcacagcctctggtgtgcgcttcctgaaacgaatgggaggttgcgtatgattatgccaaagagtgacaccgtaacgatgacccgtgatgcgtggaacgatgttagtgcgtacattgataagctggagaaagacctagagttcctgaatgcgcttaaggcgtgtggtgtggataattgggacggatactctgatgcagtagaaatggtttacggggaggatgacgaatgagcctaatcacattgaaagacttcgcggagatgcgtgaaggtaagcctatggagaagggagtgctggtcatggatggtgactggttggtctatcagtcaatggctgctgccgaagttgagacggattggggagacgacatttggactcttgagtgtgaccacgccaaggcacggagcattctcgattctgcaatcgaatcgtaccgaacccgtaagaaggcttggagtgacgctatggttgttctggcgtatactgacgatgtgaactggcgtaaggtactggttgatgagacctataaggagaaccgtaaggcgacccgtaagcctgtaggataccgtgacttcctgtcgaagctgtgggagcgcgatgagttcattcacatcaaagaggacatgctggagggcgatgacgttatgggaatcgttgggtctggtcacgaggtcttcggcttcaagaaggctgtgttggtctcctgtgacaaggacttcaagactatcccggacgttgacttcctgtggtgtaccactggtaacatcctgacgcagaccaaagagaccgctgattggtggcatctcttccagactatcaagggtgatatgactgatggctactccgggattcccggctggggcgatacggcagaaggtttcctgaatgacccgttcattgtggagcctgtagagtccgtgttgaagtctggtaagaacaaggggcagacagtaaccaagtgggtgaagcgtgctcctgatgcgactgagacgctgtgggactgcattaaatccattggtgccaaagctgggatgaccgagcaggaaatcatcaagcaaggtcagatggctcgcattcttcgcttcgaggaatacaattacattgacaaggagatttacttatggacgccgcaaagctgattaccatcgctgtgctggtaggtatgctggcgcgaggtctctggatgctcgctctcatagtccgagacgtgaagcgagactccgagattaagtgataaactcaaggctctctgtattaaccctcactaaagggaagagggagcctttatgattattactttaagacttaaccttaagaggtgaaattatgttacaaccaattaatcatgttttaactcatcccgatgatattcctagtatgccgcgtgcagccaaagagtatctacaggtgcgcttcaatcaggcctatgtgatggagtccggggagtaccgtgcgctacgcgctgctggatactctgagtctttcattgctggtgtgatgcatggtctgtaccttgcctctcgaacacttgatgagattgaggtgcgtaaagagcaactgagacaggagtaatgatatgtgctggaaaccgaaggtgaaagtccctaagatggacactaaccagattcgcgctgccgaaccagcacctttgactgagccaccgaaatctgtggtatggggaggtgatgacgatgaggacaccagcgtgtcttcctctgaggtgccaacctcaccgagcagcggtaagagcagtctcaaggtaaagctggatgacagcgcagccaagaacaagagtaaatcctccattcgctccaaggcgtttgggtaactgagtcataacatagggagaaacatcatgggattcttcaagaaaatcaagaaggctgttaagaaagtcgtgaaggaagttggcaaaccgatcgagaaggctggtaaggaagtcggtaaagccgttgggggcgctctgggtgcaggtaagcaggagattatccaacaagaggctcctgcaccagtagtgactgcgccacctccagcacagcttgtagatgtacctgaacaggataaggctgagggtgaggatgaggcacaaaccgaaagcgcacgtaagaaagcacgcgctggcggtaagaagtctctgagtgtagcccgtagctccggcggtggcatcaacatctaaggaggactgaatggctgattcaaaacgtacaggattgggcgaagacggtgctaaagctacctatgaccgcctaacgaacgaccgtagagcctatgagactcgtgcggaaaactgtgcgcaatacaccattccgtccttgttcccgaaggagtccgataacgaatctaccgactacacgactccgtggcaggctgtaggtgcgcggggtcttaacaatctggcctctaaattaatgctggcactattcccgatgcagtcgtggatgaagctgaccattagtgagtatgaggcgaagcagcttgttggagaccctgatggactcgctaaggtggacgaaggtctgtctatggttgagcgtattatcatgaattatatcgaatccaacagctaccgtgtgacgctctttgagtgcctcaagcagttgatcgtggcaggtaatgcactgctttacttaccggaacccgaaggtagctacaatccgatgaagctgtaccgattgtcttcttatgttgtccaaagagacgcatacggcaatgtgttacagattgtcactcgtgaccagatagcctttggtgctctcccggaagacgttcggtctgcggtagagaaagctggtggtgagaagaagatggacgaaatggtcgatgtgtacacccatgtgtatctcgatgaagagtccggcgattacctcaagtatgaggaagtagaggatgttgagattgatggctccgatgccacctatccgactgacgctatgccctacattccggttcgcatggttcgcattgatggcgagtcttacggtcgctcctactgtgaagaatacttaggtgacttaaggtctcttgagaatctccaagaggctatcgttaagatgagcatgattagcgctaaggtcatcggtctagttaatccggctggcattacgcagccacgtagattaaccaaagctcagactggtgacttcgttcccggtcgtcgagaagacattgacttcctgcaactggagaagcaagctgactttaccgtagcgaaagctgtgagtgaccagatagaagcacgcttatcgtatgcctttatgttgaactctgcggtacaacgcactggtgaacgtgtgaccgccgaagagattcggtacgttgcgtcagaactggaagatacgcttggtggcgtctattcgattctgtctcaagaactgcaattgcctctggttcgtgtgctcttgaagcaactccaagcaacctcgcagattcctgagctaccgaaagaagccgttgagcctactatcagtacaggtctggaagcaatcgggcgtggtcaagacctcgataagctggagcgctgtatctccgcttgggctgctctggctcctatgcagggagacccggacattaacctcgctgtcattaagctgcgcattgcgaacgccattggtattgatacttctggtatcctactgacggacgagcagaagcaagccctgatgatgcaggatgcggcccaaacaggtatcgagaacgctgccgcaactggtggggctggcgtgggtgccctagcgacctcaagtccagacgctatgcagggtgccgcagcacaggctggcctcgacgccacctaataaccctcactaaagggagacctcatctttgaaatgagcgatgactaaaggttggagtcctttggtttccctttatctttaacaacttaggagatttaacaatggctgaatctaatgcagacgtttatgcgtccttcggtgtgaacaacgcggtaatgaccggaagtacacctactgaacacgaacagaatatgctgagtctcgatgttgctgcccgtgatggcgatgatgcaatcgtacttagcgaggaaccgagttcccataacgatgacccatatgcatccggtgtagacccgttcgctgatggtgaagacgatgagggccgcattcaggttcgtatcagtgaagatggtaatgaagccgagttcgacactggtagcgataacgctgaggtggagaccgaaggtgcggacgttgagtttgaaccgctgggtgacactccagaagaactaagccaagtgactgagcaattaggtcagcacgaagaaggctttcaggcgatggtcgagcaggccgttgagcgtggactgagcgcagagtctgtgactcgcatctacgaagagtacgaagccgatggtatctctgagaaatcctacgcggaactcgaagctgctggctatagtcgtgcctttgtggactcctacatctccggtcaggaagcccttgtagaccagtacgtcaatcaggtagttgcctttgctggtggtaaggagcgctttagcgcaatccatacgcaccttgaagcaaccaacccggctgcggctgagtcccttgaggctgccatgatgaaccgagacttggcgactatcaaagcgattatcaatctggctggtgagagttacacgaagaaattcggtaagcctgccaaccgtagtgttaccaagcgtgctactccggttaaacctgtagctcgtcagaaagagggctttacgaatcaggctgagatgattaaagctatgagtgacccgcgttaccgtagcgatgctgcctaccgtcaaatggtagaacagaaggttatcgactccagtttctaattaaccctcactaaagggagagaccatagatgactacaatggttgaatcacctgagcacagaactttgtggtcactcccgtaggtgaaacattgagaaccaactcgattcaagtagtaaccaaacttttctttaaatcaacataaggagattcaacatggctaacattcaaggcggacagcaaattggtactaatcagggtaagggtcagtccgcagcggacaaattggcgctgttcctgaaagtgttcggcggtgaagtcctgacggctttcgctcgcacctccgtgaccatgcctcgtcacatgctgcgctctattgcttctggtaagtccgcacagttccctgtgattggtcgcaccaaagctgcttacctgaaaccgggtgagaacctcgatgacaaacgtaaggatatcaaacacaccgagaaggtaatccacattgatggcctgctgactgcggacgtgctgatttacgacattgaggacgcgatgaaccactatgacgttcgcgctgagtacaccgcacagttgggtgaatctctggcgatggcggctgacggtgctgtgctggctgaactggctggtctggttaacctgcctgacgcctccaatgagaacattgagggtctcggtaagccgaccgtactgactctggttaagccgaccactggcgacctgactgacccggttgagctgggtaaagcgattatcgctcagttgactatcgcgcgtgcgtctctgaccaagaactacgttccggctgctgaccgtaccttctacaccactcctgataactactccgcgattctggctgctctgatgccgaacgctgcaaactatcaggcactgattgaccctgagcgcggcactatccgtaacgtgatgggcttcgaagtggttgaggttccgcacctgactgctggtggtgctggtgatgaccgtgaggacactccggctggccagaagcacgctttcccggcgacttccagcactaccgttaaggttgctctggataacgttgttggcctgttccagcaccgctctgcggttggtacggtcaagctgaaagacttggctctggagcgcgctcgtcgtgcgaactatcaggctgaccagattatcgctaaatatgcgatgggtcacggcggtctgcgtccagaagctgctggcgctatcgttctcccaaaggtgtcggagtaattcccgaccccactggagttactcttagtcagaagactatgagcttagtcgttggggcttctaaagccctgactgctacggtaactccggctgatgcagtacagacagtgacctttacgtcttccgatgtgaagattgctacggtcgatgcctctggtactgtaactgctgtgggcgctggctccgctgacatcactgctactactgtgaatggcctgacggctgtctgcaaggtcactgtgaaagcagtagagcctcccgtagaaggctaaggtctttaccggggatttactttccttcattactttatgaaccccttgggtgccctctgagggtatctgaggggttttttgctttaaaccctcactaacaggaggtaacaccatgcgctcttatgagatgaacattgagaccgcagaagagctatcagccgtcaacgacattctggcttccatcggtgagccaccagtatcaacccttgagggtgatgcgaatgctgacgttgcgaatgctcgacgtgtactcaataagattaaccgacagattcaatcacgaggatggacattcaacattgaggaaggtgtgactcttctaccggatgcgttctctggcatgattccatttagctctgactatctgtccgtaatggcaaccagcggtcagacccaatatgtcaaccgtggtggctatctctatgaccgctctgcgaagaccgacagattcccttctggtgttcaggtcaacctgattcgtctgagagagttcgatgagatgcctgagtgcttccgtaactacatcgttaccaaggcttcccgtcagttcaacaaccgattcttcggtgcgccggaggtagacggagtgttgcaggaagaggaacaggaagcgtggcgtgcgtgcttcgagtacgagctagactacggtaactacaacatgctggatggtgacgcattcacctctggtctacttaaccgctaatcataaggaggctctatggctcttattagccaatcaatcaaaaacctcaagggtggtatcagccaacagccagatattctccggttcgctgaacagggtagcgtacagattaacggttggtcttctgagtccgagggtctccagaagcgcccaccgatgattcaccttaagacccttggcgctgctgggtatgtgggtgcgcaaccttacgttcacctcatcaaccgtgatgagttcgagcagtatttcgttgtgttcactggtgaagacattaaggtgttcgacctcgatggtaaggagtatctagtacgtggagaccgctcttatgtgcgtacagctaacccacgggaagaccttcggatggtaactgtggcagactatacctttgtgactaaccgcaaggtggttgtgcagagtaacgaccaatcggtcaaccttccgggctttaaagaccaaggcgatgcgctgattaatgttcgtggtgggcaatatgggcgtaggctctcaatcgagttcaacggggctgagcgtgctgctattcaactaccagacggctcacaaccagcacacgtcaatgaggttgacggtcaggccatcgctgagaagctggcggctcagttgcggaataacctagggaaccccaacaacgagcaagacccgaataagtggcgcttcaacgttggccccggattcatccatatccttgcgccaaataacgataacgtttggggactacagactaaggatggttacgcagaccagctaatcaaccctgtaacccattacactcagtcgttccagaagttgcctattaacgctccagatgggtacatcgtgaagattgttggtgatacctcaaagactgccgaccagtattacgttaggttcgacctcaaccgtaaggtatgggtagaaacaatcggctggaacacaaggactcacctgcactaccacacgatgccttgggcgctggtacgtgcttctgacgggaactttgacttcaagtaccttgagtggggtgctcgtactgtgggcgatgatacaactaacccatacccatcgtttaccggacagacaatcaatgatattttcttcttccgtaaccgtttggggttccttagcggggagaacatcatcttgtctcgcacctcgaaatacttcaacttcttcccggcctccgtgtctaactactctgacgatgacccaatcgacgttgccgttagtcacaaccgggtgtcaaccttgaagtatgccgttccgttctccgaagagttgctcctgtggtctgaccaagcgcagttcgttctgacagcctctggtatcctttcgagtcgctccgtagagttgaaccttacgactcagttcgacgtgcaagacagggcgcgaccacacggtgtggggcgtaatgtatactttgcgtcacctcgctcttccttcacatccattaaccgatactatgcggtacaggatgtaagctctgtgaagaacgcagaggacatgacggctcacgttccgaactacataccgaatggagtattcagtatatcgggtacaaccgctgagaacttcgcggctatcctcacgagcggagcaccgaaccgggtgtatatctacaagttcctctatattgatgaagaaatcaggcagcagtcgtggtctcattgggactttggggacaacgttacggtgtttgcagcacaggtgataaactcaactatgactgtattgatgggcaatgaacatgctgtgtggatgggacgcttacacttcacgaagaactctatagacattccgggagagccttacagattatacatcgacgctaagaggaaatacatcatccctaccggggcatataatgatgatacctaccagacgtccataagcctcgcagcgatttatggaatgaacttcactaagggtagagtgtctgtggtcttccctgatggaaagattatagaggtagacccgccagtcaacgggtggagtagcgacccaatattgagactcgatgggaaccaagagggacaagtggtttacattgggttcaacatcccgttcacttatacgttctcgaagttcctaattaagaagactgctgaggacggctcgacggctaccgaggatattggtcgcttacagcttcggcgtgcgtgggtaaactatgaggattctggcgcgttcaccatccgtgtgaacaacctgtcccgtgagttcatctacacaatggctggtgctcgattgggttccgacaatctgcgtgttggcaggtctaacattggaacagggcagtaccgcttcccggtggtgggtaatgcgcagacgaacatagtaactatcgagtcagatgcgtcaactccactgaacatcattgggtgcggctgggaggggaactaccttcgtcgttcttctggcatttaacttaaagtctccctgcggtgaattaaccctcactaaagggagacactaatagatacgagggttaaagcattatgtatattacaaagtgtttacaaagccacgctgacaactttcagccgtccgtagaggacattctggaagctgaggcattgggtgtcgaaccaaaggtaattcctgatgataacactgtggcaatgcttagcgataacgctgtgttggcaattggtggcaatcagggagaccgagtgtggttccttacctctaagtacgtcccactgtttaccttgaaggagcgcttagagtttcgtaagttaataatcgaatatcgcgatatgatgctgaaccagtacgagtccatttggaacttcgtatgggtaggcaataagtcgcacattcgtttcctaaagacaatcggagcggtattccacaacgagtacactctcgatggtcggttccaactattcacaatctcaaggaggcaacgtgaagaactgtaagaaatgcggagagatgaaagctgtctccgagttctataaggacaagaagagtaaggacggcctacgaagtcactgtaagccatgtcactacacgtattacaagaaggactactcaaaggcgcgagagatgaaccttaagcgtctgtacggaatcactctggaagaatacgaagcgatgctccttaagcaagacggagtgtgtgctatctgcggtcttaccgagagagttgagggacgggcgttagcggttgaccattgccacgccactggcgctgttcgtggtctcctttgctctgcctgtaacatcgctcttgggaagttcgaggacgacaccgagcgtcttcggaaggcaataacatacctaggagggaaatgattatgtgttggatggcagcaattcctatcgccatgatgggtgcccaagctctaagtagccagaacagtgctgacaaggcacgggtggcacagaccgaagctggacgcagacaggcaatggagatggtcaaagagatgaatatccagaatgccaacgcctcgctggaacaacgggacgcccttgaagctgcatcctctgagttgacttcacgtaacatgcagaaggtacaagctatgggaaccatccgtgcagctatcggcgagagtatgctagaaggcgaatccatgaagcgcatcaagcgtatcgaagagggcaactacattcgggaggctaatagtgtcaccgagaattaccgccgagactacgcgagtatctttgcgcaacagttgggacgcactcagtcaacagcaagtcaagtcgatgcaatgtacaagagcgaggccaaaggtaagtctggtctgatgcgtgtactagaccctctgtcaattatgggtcaggaagctgcaagtcaatatgcggctggtggatttgacaagaaaggtggaaaccaagcagcacctatcagtgccgccaaaggaaccaagaccgggaggtaataatggctagtaaactaaatagtgttttaggcaacatggcgactcccggtatggaacgactccggggcgtcaaaggcatggactaccgggcagcaaccattcaggctgagcaaccaagagcgagtcttctggactccctaggtcgattcgctaaggctggtgccgatatgtacatggcgaaagatgaacgtgataggcaacgagccgatgagcgttccaacgagattatccgtaagctgacccctgagcaacgccgacaggctatccagaatggtacactgctgtatcaggatgacccatacgcaatgcaggccttgaagttcaagaccgggcgtaacgctgcgttcctcgttgacgatgaggttcaacaggccatcaaagagggtcgcttccgtactcgtgaagagatggagcagtatcgtcactcacgcctacaggagcactcgaagtcgttcgctgagcagttcggcatcaatgagatggacgaggaataccagaagggtttcaatgctaacatcaccgagcgtaacattgctctgtacggcgcacatgataccttcctgagtgaccaagcgcagaagggtgcaatcctgaactcgaaggttgaactcaatggcgtcctgtctgaccctgacctgctgtctcgtcctgagtccggtgagttcttccagaactacatcgacaactccttggtgacagggatgaccgacaatcaggctcaacaggttatctcttcgtccctgaatgacgtgctacagcgtccgggtggtgccgccttcttgcagaacattgagaaccgcaaggtgactcttaatggcgctacgactacctatcgtgaactgatgggtgatgagcagtggcaggcaatgatgattaaggcacagcacactcaattccagaacaacgcgaagttaaccgagaagttccgactggatattaactcagcgcttaaccaagcggacactggtaaaggctgggagactcttcaaggcatcaaggccgaactcgataagattcagccgggtgaagagatgactcctgagcgtgagtggctgatttccgcacaggaacagatgcgcacccgcttcaagcaggaacaagctgagacagccaagctgatggacaagcaacagaagaccatgaataaatctctggtcatcgacaagcagttccagaagcgcctcaatggtgaatacgtctcgaccaactataaggacatgccgaccaacgagaacactggtgagtttacccatagcgatatggtcaactacgcgaaccagaagttagcggaaatcgaagcgatggacttaacgccagaacagaaagacaaactgaaattggactacctacgggcagactccaaggagggtgctttccgtgcagcgtttggtgagatgattaccgacgcgggtaacgaatggcaggctgcggtgattaacggtaagatgcctgagagcacaccagcgatggacaaccttcgtcgcatccgcaacactgaccctgacctgattgcctctctgtatcctgacaaggccgagttgttcctgacgatggacatgttggataaccaaggcatcgacacgcaggttcttatcgacgctgataaggcccgtgcacagaagaccaaggagatgcagtttgaggatgaccgagcgtgggctgctatgatgaacgattcaacgaatcctcaaatcaagtacatgccttcgagtgtccaagggtatgcccggaagatttatgattccgtgaagtaccggacagggaaccctgacatggcaaccgaacaggtcgcaaagttcctctccgattcgacgaccacgttctccagtagcgatgttgagggtgatacctacggcgtcctaccgaagaacatcctgactgtttcggatgaccctaagtcgtgggagcaggggaagaacattctggacgaagccattaagggaatcacagcggcgaacccttggattaccaacaagcaactgtcggtgtaccagcaaggtgattcaatctacctgatggacacaaccggacaggttcgcattcggtatgaccaagagttgctccagcgtgagtaccagcgtaccgcacagatgcaagctgaggcagcacgagagaaagccctcaaagaggccaacaagcgtgccccaatcagccgtgtatcacaggcgcgtgaagaagcgcgtaaacgtgtccaagagaaacggaagaagactccgaagtacatctatggacgtaaagaagactaacagtgataaggaggctccatgagctacgataagaacaaacctagcgagttcgatgggttatttcaaaaagcggcagacaaacatggggtctcctatgacctgcttcgtaaattagcattcaatgagtccagcttcaatccaaaggccaaatcaccaactggcccgaagggtctcatgcagttcaccaagggtacagccactgcgctgggactcaaggtcactgatgcagacgatgatgaccgctacaaccctgagttggctgtggatgcagccgctcgccacctgagtgacctcattcgtaaatacgatggggacgaacttaaggcagccctagcgtacaaccaaggcgagggcagaaatggtgcccctcagatgcaggcctacgacaaaggtgattgggcttcaatctctgaggaaggtcgtaactatatgcgtaacctgatggacgtagctaacagtcctcgcaagggggacttggaggcgttcggcggtatcaccccaaaggctaagggcattccatcgggggatgcatttgctggaatagggaagaagcagacggtaggaaccgacctgccggagtcaactggattcaaagtggagggtaaagagcagaaagcacctaacgtgccttatgctaaggacttttgggaaaagactggaacaacactggacgagtttaactcacgctctaccttcttcggaattggagatgcaacaagtgcggagcttcacaactctgtacttggagttgctttccgtgcagcccgtagcgacgatggttttgatttgttcaaggacaccattacgcctacccgttggaatagccatacgtggactccagaagagttagagcgtatccgtaaggaagtgaagaaccccgcgtacatcaacgtagtcactggaggctctcctgagaatctggacgccctcattaagatggcgaatgacaactacgagatggacgcgcggtctgccgatgctggtgttggtgccaaacttactgctggtatcgtcggtgctggtgtagacccgctgagttatgtaccgctagtaggcgtagccgggaagggtctcaaggtggctaacaaggctttcattgtcggtactcagagtgctggcctcgctgttgcctctgagggtctccgtacatcaatcgctggtggagaagcccactatgctgatgctgctttaggcggtctgatgttcggtgccgggatgagtgcaatcagtgacgctatcgccgctggtattcgccgttcccgtggtactgaggttgttaatgacttcgctcctatggcacaccgcttggaagcccgtgagaccgctctgaactctggtggtgaagacctgacccgtatgccgagcgagaaccgtgtgttcgaccgtgagcacgctggcgttgagtattcacctctggagaccgagccgggtgccgttgtgttgcctcaaggtcaaatccttagcgacaccaacccgctgaaccctcagactcttagcgagttcgaggctgtcaaccctgagcgtgccgcacgtggtatctctttgggtggcttcacggagattggcttgaagactctccgctctgagaacccgactgttcgctccattgcgagtgaccttgtgcgttctccgacagggatggaatcaggctctaatggtaagttcggtgcgactgcttctgacattaaggagaggctacacgcgaacaatcagcgcacctacaaccagctttatgatgctgttcgtactgcaatgaaagaccctgagttctccacaggtggtgccacaatgagccgtaaggaaatccgacaggaaatctacaagcgtgcagccttagcgattgagcggcctgagcttcaagcaaacctgacaaagggtgagcggaatgtgatgaacatcctcaagcagcactttgacctcaaacgcgaaatcatggagaacccgtcaatcttcggcaacaccaaggcggtcagtatcttccccggctcacgccacaagggaacctacgtgccaaacgtgtacgaccgagcaatcaagattgagatggttaaacgctacggtaatgatggcttacagcgagcaatcgcggagtcatggttgacgtcttatcgtgctcgtccagaagtcaaggcgagggtcgatgagtacctgatggaacttaacggtctcaaatccgtgcaggaagttacacctgagatggtgcagaagcacgcgatggataaggcgtatggtatttcacacaccgaccagttctctgcctcctctgtcattgaggataacattgagggtctggtgggtatcgagaacaacaacttcttggaagcccgtaacatgttcgacagtgacatggcggtgactctccctgatggtaacacgttctctgtgaacgacctgcgtacatatgacatggctgaaattctgcctgcatacgaccgacgagtagatggtgatgttgcaatcatgggtggttccggtaagactaccaaagacctgaaagatgaaatcatggcgctggataagcagtcagagggcaacggcacactgaaaggtgaagtggaagccctcaaggataccgtgaagattctgactggtcgtgctcgtaggaacccggaaggcgcttggggtacagccctgcgctccgtaaatgacctcacgttctttgctaagaacgcctatatgggcgcacagaacgttactgaaatcgctggtatgctggcgaagggtaacgtctctgcgataactcatggcatccctatgattaacgattgggtcaaccgtggtaaaccgcttcgtgcctctgagattaaggagatacacgggatggtgttcggtaaggaactagaccaactaatccgtccgggacgtgaagaccacgtgcgccgactccgggagtctacggacaccagcgctgcggttgccaatgtggtcggtacgattcgtttcggcactcaagagttggctgcacgctctccttggacaatgctcctaaacggaacatcaaactacattcttgatgctgcccgtcagggtgtgcttggggatgtggctggagcggcccttgctgggaaagcctctaagttcggtaaggcaaactaccttaagtctgcctctatcagccctgagcagtggaatggaatcaagcagttgttcagagaccatgcgactcgtggagaagacggtaagttcaccattcgtgacaaacaggctttcgctaacgaccctcgttcgatggacttgtggcgactggctgacaaggtggcggatgagactatactgcgccctcacaaggtttcatcacaggactccaaagcgttcggtgcaggggtgaagatggtgatgcagtttaagaacttcgtcatcaagtcccttaactcccggttcgtccgtagcttctacgaggcaactaagaacaaccgtgcgttagaccaagcgttgacgcatatcatctctttgggtctagctggtggttactacgttgcgcaggcgcaccttaaggccgcaagcctacaggagcacaaacgtaaggagtaccttaagaacgcacttgaccctaagatgattgctcatgcgtcaatctctcgtagttcacacttaggctcaccattgagtatctacgacatgttcgctgggatggttggtagcgatacctataagtacacccgctctactgtactccctaaagagtccgagaagcgtgaccctaacaaggcggtgacaggtagacaggtggcttcaactatcgcaggtgcagttggtgagcaggttccgggtttaggttttgtgggttctgtgggcgcaacagcaattaacgccgcttccctactgtcttctccaaacaaggctaccgctctggagttccgtacaggactcttcaacacctctcgtgagttgatccctaatgacccgctatcgcagcaactcattatgaaaatctacgaggccaacggtatccgtataaaggagacgccgaagaaacaataaaccctcactaaagggagagaggtcacattctggcctcttctctcctaatgctaatttacaaaggaggtcacatggctacaactattaagaccgtgatgacttacccgctggatggctccactacggacttcaatattccgtttgagtatctggctcgtaagttcgtccgagtgacccttatcggtgttgaccgaaaggaactcatcttgaatcaagactatcgttttgcaactaagaccacaatctccacaacgagagcgtgggggccagcggacggttataacatgattgaaatccgtcgatttacctccgctaccgataggctggttgacttcaccgatggttcaatccttcgggcatacgacctgaacatctctcaggttcaaacccttcacgttgcagaagaggctcgtgacttaacggctgataccattggtgtgaacaacgatggcaaccttgatgctcgtggtcgtcgtatcgtaaacgtagctgatggtattgacctcggggatgctatcaatttaggtcaagtcactcggtggaacgagtctgccctgaactctaagaacgccgctgctacctctcaggccgctgccaagacctcagagaccaacgctaagacctctgagaccaacgctaagacctctgagaccaacgctaagacctctgagaccaacgcgtaccaatgggcgcagcgtgctgaggactctccggtacagggtagcgagttctctgcgtatcactactcccgcaaatccgctaagagtgctgccgccgcgagtgtttctgaagataatgctaaggtgtccgagaataactcgaagacctctgagaccaacgctaagacctctgagaccaacgctgcggcctctgctcagacagctaaggatgaggcggctaagctgaccaacatgaatggctttgctgccgctattgattcagtcaacggtaacaatgttgtcatgaagggtgacttcaccattaaaggaaacggtaaagtatcaatactgaaccacagtgggctataccaagataagaccgtgaatggcgtgaactatgccaacaggatttatatggatgatgcaggggccatgcacttcgagaactaccgtgtgtctggtacttcatccaccttacgtgctggttttgttattacagataccaacaggtttgactttacagggccaacgcgagttaatggtgatatcatcgcatatgtggatgctccccctaatccatatcttggccaatatctcaattctgtggcagttcgctcacagcttcggggccgtggtgctaagaatgatccacttggtgcgtactgtggtatgtatattcaggagcacgttggtacagaccacgcgataatccttaacctcaatggttatagcaaggatactaactggcagctattctccaatggtaaaatatctacaccacttggtgatgtgatgacttcgggttctgatattagaatcaaggatgatatcactaaacctcttgatggtgctggtgagcgtattgacgcaattggtatagtggaatacacagagattgccaccggggaacgtaaacgtgggtggctggcccaacagcttgacacgattgacccgctgtacacatacctcacgaccaccgcagaaggtagtcttttgaataccaacgacagggcgttgcttgctgacgtaataactgagcttcaagcactgcgtcaacgcgttaaagaactcgaaggataatcaacaaagccagcggacggcacaacataaggagaacacaatgctttcttttgacttcaacaacgaggtcgttaaggctgcgccgattgttggcacaggggtcgctgatggtgcggcccgactcttttggggactatcgttaaacgaatggttctacgttgcagctatcgcctacacagtggttcagattggtgccaaggtagtcgataagatgattgactggaaacgtgcaaacaaggagtaacctatgagcgacaagactttaatcaagctgctggagatgctagacactgagatggcacagcgtatgcttgctgacctccaaagcgaggagcgccgaacgccgcagctttacaacgcaatcggcaaactgttagaccgccataagttccaaatcagtaagctgaccccggatgagaacatccttggcggtcttgcgtctggtctggaagactacaacaaagtggtcggccctaatggtctgactgatgatgaaacaatcacgctacagtaagtgacatactcaaggttctccacgcggggagcctttatggatgttatttggtgcatctacgtgaaatctaaaaattgatgggaggtgttatgctaaaacttttacgcagcgcactcccttgggtactcgccgggacactctttatgggtggctggcacttagggtcaacccatgagagagcaaactggaaggaggtaatccaaaatgaatacattgcgaaaacaaaggcaaccgcagcaactcaggcagaggtcagtcgggtatcccgtgagtaccaagaagagattgcagccattgaaggcagcactgataggatgcttaatgacctgcgtagtaataataagcggctgtcagtccgcatcaaaacccttaccggactaccagaagataacggtagatgcgagtttaatggtcgagccgaactacacgagtcagatgctaagcgtattatcggaataacccaagctgctgatgctcacgtaagagcgctccagcgtactattaaggagatgcagaatgagcgacacccaagcaaaccgtaatgcgctaatcatcgcgcagcttaagggtgacttcgtggccttcctgttcgtattgtggaaggctttggctctcccgccgccaactaagtgtcagattgatatggcccggtgtctggctaacggagacaacaagaagtttatcctacaggctttccgtggtatcggtaagtcattcatcacctgtgcgttcgttgtgtggacgttatggcgtgaccctcagttgaagatactgattgtctctgcatccaaagaacgtgcggacgctaactccatcttcatcaagaacatcattgacctgctgcccttcttggctgagctaaagcctcgccccggtcagcgtgactctgtgattagtttcgatgttggccctgccaagcctgaccactctccgtctgtgaagtcggtgggtatcactggtcagttgactggtagtcgtgctgatatcatcatagcggatgacgttgagattccgtctaactccgcaactcaaggtgcccgtgagaagctgtggactctggtgcaggaatttgctgcgcttctgaaaccactgccgacttctcgcgttatctaccttggcacgcctcaaaccgaaatgaccttgtacaaggaactcgaagataaccgtgggtacaccacaatcatctggcctgcgctctatccgcgtagccgtgaggaagacttgtactatggcgaccgtctggccccgatgctccgcgaagagttcaacgatgggttcgagatgctccaaggtcaaccgactgaccccgtgcgcttcgatatggaagacctgcgtgagcgtgagttggaatacggtaaggctggcttcactttgcagttcatgctcaacccgaacctgagtgatgccgagaagtaccccttacgcctccgtgacgctatcgtgtgcggtctggacttcgagaaagccccaatgcattaccagtggcttccgaaccgtcagaatcgcaatgaagagcttcctaacgtgggccttaagggtgatgatattcatagctatcattcgtgcagccagaacactggacagtaccagcagcgcatcctcgtgattgacccaagtggtcgcggcaaggatgagactggttacgcagtgttgttcaccctgaacggctacatctatctgatggaagctggcgggttccgcgatggttattccgataagacccttgagtccctcgctaagaaagcgaagcagtggaaggttcagacagtggtcttcgagagtaacttcggggatggtatgtttggtaaggtattcagccctgtgctcctgaaacaccatgcagcgcaacttgaagagattcgtgctcgcggtatgaaggaactacgcatttgtgatacgctggagcctgtactctctacgcaccgccttgtgattcgtgacgaggtgattcgtgaggactaccagactgcccgtgacgctgatggcaagcatgacgttcgctattcgctgttctaccagttgacccgtatggcccgtgagaagggcgctgtggcccacgatgaccgacttgatgcgttagcattgggtgtagagttcttacgctctacgatggaactggacgccgtgaaggtggaagctgaggtgcttgaggcgttcttagaggaacacatggagcacccaatccattcggctggtcacgtagttaccgctatggttgacgggatggaactctattgggaggatgatgatgcgaatagcaacaggttcattgactggtagttatgcatattgagtgcataaggaagcattgaggccacggatggtcactttaagaaattccttaagaatcaatgagtttgaattaaccctcactaaagggagagaggggacttaaagctactatataggttagtcattcaggttatgcaatgaccctttatgcactttaagtctgcctctatgattggtgatattatcattgtataatcaccctaccttagagcaactgaaaggaggtggctcaatgttacgcttgctgattgccctgctgcgtcatagagtcacttggcgatttcttctggtacttactgctgcccttgggtacgcaggtcttactgaccacctcggtcaactggaagtggccttttgctctatactctcttgtggggattaaattgttgttgatgaccgacaagcggctctgagggattcgtaggtatagtttcactacaccaactcatccctgtagagtcaaccctaaaggttatacctaaagatgccctgtagttcgtaatggtcttacagggtcttctggtgtctcctagctatcccttcgggatgcgcctatggtctcacctatggtgtggccttacctaaagtggtttcctaaagagaccctttaagaatttaccacaaaaatctgaatgggtatctcacagttcaagaacccaaagtacccccatagccctcctaaagccacctaaagccagccctacccctctggtttaaccttcggttaaccttgggtatctcctcaagtggcctataggatagcctaaagtgttgcctaaagtcaatacctaaagtggttggtggcttaaggaggacttagagaggccttaaagagtgtcctagtgtaccagttcgatagtacatctctatgtgtccctatctgttagccattcctaaagtaaaccctaaagccactacctaaagccactacctaaagcctccacctaaagagcgacgctatcttaaagacaaccagactgatagacccactgttagcctgtagtgacgccttgtagttatctgtagttatttcgttaaccctcactaaagggaataagggatacttaaagagggaataagggatttaataaaagattaaaattaatggttgactttaagtaacccttaaggctattattcatctcgtcaacgggacaacggccttaaagccactccctgagataccggagtcaaccggataagtagacagcctgataagtcatacgaaaaacaggcattgacaac

SEQ ID NO: 26 - DNA, 39405 bp, Unknown
  source: /note="Description of Unknown: KP2-5 Bacteriophage Sequence"
atctgttagcctcctaaagtaaaccctaaagcctccacctaaagaccagacctaaagtaaagcctccacctaaagaccagacctaaagccatcacctaaagagcgacgctatcttaaagacaaccataccgatagacccactgttaacctgtagtgatgccttgtagttgtctatggtgtctatcgtcaattcaattaccctcactaaagggaataagggatacttaaagagggaattagggatttaataaaaagattaaattaatggttgactttaagtaacccttaaggctattattcatctcgtcaacgggacaacggccttaaagccactccctgagataccggagtcaaccggataagtagacagcctgataagtcatacgaaaaacaggcattgacaacatgaagtaaacgcagtaagatgcacaacataacgtcaaccgccaatcggtgtcttctaggtgacttaagcgcaccacggcacataaagcgaaacaaaatggttgacaacatgaagtaaacacggtacgatgtaccacattgaaacgacagtgaggcgggacactgaaagccgctagggtctaacgaaaccagaccgacacgctctttaacaatctggataatagctcttgagtgtaccgatgtataagcgaataactcaaggtcgcactaaaagcgtggcctttatgatattcacttaacacgaactaacatgaggtaacaccaaatgattttcactaaagagcctgctaacgtcttctatgtactggtgtcagctttccgttccaacctcgatgatggggtgaatatgagtcgccaccgccacatggttagcactttacgtgccgcaccgggtctttatggctccgttgagtcaaccgatttgaccgggtgctatcgtgaggcaatcgcaagcgcaccgactgaggaaaaaacggttcgtgtacgctgcaaggacaaggcgcaggcactcaatgttgcacgcttagcttgcaatgagtgggagcaagattgcgtactggtatacaaatcacagactcacactgctggtctggtgtacgctaaaggaatcgacgggtataaggctgaacgtctgccgggtagcttccaagaggttcctaaaggcgcaccgctgcaaggctgcttcacgattgacgagttcggtcgccgctggcaggtggcctaacatgaatcgttattacatcaacgtaccgggctggggtggttctctaacctgctacggatacaacgaacgggacgcacggaaacgttttagagaacaacacggcttcggaaggcttcctaatgggacgcgcctatggctggacgcccgtgattggtaagtgatagactcaaggtcgcactgtatgtgtggcctttatgattatcacttataggactaacatcatgagtaaacttctggcaacatctaaaatagaaggccaatgcaccgtaacactgcgtgagtattaccacgggtcaatgggaagcacctatgttgtgcgatacggtaaacaggtcacacattgggtaaacccgattttagcacaagaggattatcaagcctgtgtgatacaccaagcaacatgtgcgggctggaatgattgacattacaggaggattagcaatggttatatttatcactatcgcactctttgcggtcgcgggctggtactctgagtcacgcaaggccgctcgctatcatcgcaagatggttaaactcatggaacacttggacgcagaagggcgaggccgcgaggctatcgaactggtgaaacacgcatgatgattctctttatcgcactggtctatctgtgcatcgctatgtactttatgcgagacttcaagcgcggtctggtagtccataaggcaacgctgagttactttaagtggggattcatcccacggtttacggttcgtgaacgtaacggacgctttaaggccaacaaggtaggagtattctacattgctacgcactaactcaaagcacgtaaagattgcactgtatgcgatggcttatggtgcatcgaaacgcaaggtcaaacgcatcttaacgagacaccgcaagatgaccgcacgacaggctgcaagcgctgtcaaatgggctgaatttactctttactcttcttacagataacaggacactgaacgatgactttcaccgaagcacaagccgcactcgaagctatccgcaacctaccgattgagcgcctgaacgaacgccagcccatgctggtggctcttgcggctgctatcgtgaacgctgagactcaagacggcgaactgacgcaggccaagggcaattggggtctggagtcgatggactactggcagacactggcggagcgtatgcgtgatgttggtttcgtcaagctgggcaacggtcactttagcgcagcctatgaacacgcactgctaccgggtaaggtaatcaaggtaggctttaagaaagaggactcaggcgctgcctatgctgccttctgccgcatgaatcagggtcgtgagggcatccctacggtgtacgacattcagcgtcatacaggctgctacacggtggtcttggactatctggcaccgcttaacgattggtgctacggtgaaagcgataagattcgccaccactttcaggctgcacgggaaatcattgaggaggattgcttcgataccgccgaagagtacccgataagcgagggcttcattgagacctgcaaggatatccgcaagttcttcttaggcatcgcatcgttcgattgtcacagcgataacatgatgaaagaccagatgggacgcctgattatcgcagacccggtatcattcagcgcagacgacaagttaaagccgggtgagttccactgtgacccggatgaactaatcgccgagattgaggcgctgagagcgcaggaagcgattgaccgctgtaaggcacgcaaggcacgacgtgaccctaacggaacctttcaggcagcacgtaaagcgcgcatcaagtggcgcagaaaggcctctaagcgtgctaaacgtgacgctaaggtactcgctaagatgagcatggacgccaatcagaatcgcagggatgagcctagggcgcgtatggtgtggggcgataagcactggcgcaacgcttggatgcaccacaataacctaaactttgcagaactggagcgccgcgctgctgcggcaatgatgatgcacgatgaggtgcgcattcagtggggcaaaccgttacacatagacgcataccttgacaagcgtctacaaggttgatagagtcttatcttacaggtcatcaaacggtggcctgaataggtacgatttattcacaatgaggtaagcaatgaacatcatcgaaaacatcgaaaagaatgacttctccgaaatcgaactggctactatcccgttcaacacactggcagaccactacggtagcgcattggctcgtgaacaactggctttagagcatgagtcttatgagctaggcgagcgccgcttcctcaagatgcttgagcgtcaagcgaaagctggtgagattgcagacaacgcagccgctaagccattactcgctacgcttctccctaagttaaccgcacgcatcgttgagtggctcgaagagtacgcctcgaagaaaggccgcaagccagtagcctatgcgccactccagttactcaagccggaggcgtccgcgtttatcacactcaaggtcatccttgcgtcactgaccagcacgaacatgacaaccattcaggccgctgctggtatgctggggaaggccattgaggatgaggcacgtttcgggcgaatccgtgacctcgaagcgaagcacttcaagaagcacgttgaggaacaactcaacaagcgccacgggcaagtctacaagaaagcctttatgcaggtggttgaggcagacatgattggtcgcgggctgctgggaggcgaggcgtggtctagctgggacaaggaaaccacgatgcacgtagggattcgcctgattgaaatgctgattgaatccacgggtctggtggaattacagcgccacaacgcaggcaacgcaggctctgaccatgaggcactgcaactggcccaagagtacgtcgatgtgttagcgaagcgtgcaggagcactggctggcatctctccgatgttccaaccgtgtgtcgtaccgccgaaaccttgggtatcaatcacaggtggcggctattgggcgaacggtcgcagacctttggcgctcattcgcactcactctaagaagggactgatgcgctatgaggatgtttacatgccagaagtatacaaggcggtcaacatcgcacagaacaccgcatggaaaatcaacaagaaagtcctcgcggttgtcaacgagattgtgaactggaagaactgcccggtagcagacattccatctctggagcgccaagagttaccgcctaagccggacgacattgacaccaacgaggcagcactcaaggagtggaagaaagccgctgctggtgtctaccgcttggataaggcacgagtgtctcgccgtattagcttagagttcatgctggagcaggccaacaagtttacaaacaagaaagcaatctggttcccttacaacatggactggcgcggtcgtgtgtacgctgtgccgatgttcaacccgcagggcaacgacatgacgaaaggtctgctgaccctcgctaaaggaaagccaatcggtgaggaaggtttctactggctgaaaatccacggtgcgaactgtgcgggtgtcgataaggttcctttccctgagcgcatcgcgttcattgagaagcacgtagacgacattctggcttgcgctaaagacccaatcaataacacttggtgggccgagcaggattcaccgttctgtttcctcgcgttttgcttcgagtatgcaggcgttgcgcaccacggtctgagctacaattgctctctgccgctggcgttcgacgggtcttgctctggtatccagcacttctccgcgatgctccgcgatgaggtaggcggtcgtgcggttaacctgctgccaagcgaaaccgtgcaggacatttacggaatcgttgcacagaaagtaaacgagattctcaaacaggatgcaatcaacggcacacctaacgagatgattaccgtgaccgacaaggacaccggggaaatctcagagaagctcaagctgggaacctcaacgctggcgcaacagtggctggcatacggtgtgacccgtagcgtaactaaacgttcggtcatgacgctggcttacggttccaaggagttcggctttcgtcaacaggtactggacgacaccattcagcctgcgattgacagcggtaagggcttgatgttcacccaacctaaccaagcggctggctatatggctaagctgatttgggacgcggtgagcgtgaccgtagtcgcagcggttgaggcgatgaactggctcaagtctgccgccaagctgctggctgctgaggtcaaggacaagaagaccaaggagattctacgccaccgttgcgcggttcactggactacgccggacggcttcccggtctggcaggaataccgcaagccactccagaagcgtctcgatatgattttcttagggcaattccgtctgcaaccgacgattaataccctcaaggattcaggcattgacgcgcacaaacaggagtctggcatcgctcctaactttgttcactcacaggacggtagtcacctccgcatgacagtcgtttatgctcacgagaagtacggcattgagtcctttgcgctgattcacgatagcttcgggactatcccggcagacgctggcaagctgttcaaggctgtgcgtgaaacgatggtcattacttacgagaacaacgatgtgctggcagacttctatgaccagtttgcagaccagttgcacgagacccaactggacaagatgcctccacttccgaagaaaggaaacctgaacctgcaagacattctcaagtctgactttgcctttgcataacaagcacttagcattaaccctcactaacgggagactacttaaggtctcccactttaagacactttaggtactaagagattaaatttatgattaacattaagactttctttaagaacatctttaagttaaaccgcttgacttccgttaagttctacgcttggatgcccggtagtgatgacctccgcaagactgaatttaagctaggcttagggccgtgcggtaaggtggtcaagaagttggaatgttactcaacgtcctccgggatggtcatcttccagaccactgaggacaacgaaacgaaatccttctactacccgaaaggttcaacgtgtggtcgtatcgaacggacatacagttaaccctcactaacgggagagttagacttaaggtcatcaacaacggtggcctttgtgattaactttcaatacacatcaacatgaggtaagatactatgcgtaccaactttgagaaatttaccaagcgcgattcagtggtcaacgagcatggcgaacagtggcaagagcgccgtgaccgcatgaagaaacgccacaagcaacagcgcggtaactcacagaaacgggagtggaactaatgatgggacgtatctatagcggcaacctgaacgattacaaagatgcggtagcgcgtctacaggaagaccatgacgtgaccgtgaaggtggagccgttcagctatgaaaacccagcgaagatgtgcaggtcatccggtgaggttctccgtgtgttcacacgctccgggcatccggtggcatccagaaccttcgagcacagcgacagcgatgtacaaatcaacgcgcagactgcatggctccgcaaggttcacagcgatttgaaacactggaagtaataaccctcactaacaggagaaacgaaatgagagatatcgaacggttcaacgcaaagactgaaccttgcggcgactgtctacgttggactggtcgaatccagcctaacggttacggacagtttcgcctcgaaggtaaaacacaatacgcacatcgagcagcttacaagctgtttatcggtgaattggacaataaagatacagtcctccactcgtgcgataacaggtggtgtgtgaaccctgagcatttgaccaagggaacgcaggccgataacctgaaagatatggcgataaaaggtaggcaccacgccattaagattccgaacgatgccatcgcgggcatccgtaaagaccctcgctctgctactgtgatagcggctgagtggggcgtccatccaacaaccatccataagattaagtgaaacatcaacaggagattcgtatgaacattttcaagaccgcgccatataaagccgtatcatttgtagagtctgccgtgaagaaagcacttgacaatgctggttatttgatttgcgattgcaaatatgatggtgttcgcggtaacatcgtggttgacaacgtggctgaggctgcatggctgtcccgtgtaggtaagctgattccggcgctggaacatctgaacggtttcgataagcgctggcagcgactactgaacgatgaccgctgcattttccctgatggcttcatgctggatggtgaactgatggtcaaaggcgtagacttcaacacagggtctggcctgctgcgtaccaagtggctcaagaagaacaacttcatgtttgaccgtggtggtgttgagccgctgaaaggttccaaagtagcctttgagttagaccctaagcgcctgagtgtgcgcctgtatgctgtcatgccgattcacattgcggagtctggcgaggactacgatgtacagaacctgctgatgccgtaccatgtggaagccatgcgctctcttctggttgaatacttcccggaaatcgagtggcttatcgctgagacctacgaggtctacgatatggattcgctgactgaactgtacgaagagaagcgtgccgaaggtcacgagggtctcattgtgaaagacccgcagggcatctataagcgaggcaagaagtctggctggtggaagctcaagcctgagtgtgaagctgatggtatcattcagggtgtcaattggggaaccgaaggtttagccaacgagggtaaagtgataggctttagtgtgcttcttgagactggtcgtttagtagacgccaacaacatctctcgcgcactgatggacgagttcacagccaacgttaaagcccacggtgaagacttctacaacgggtgggcctgtcaggtcaactatatggaagagaccccggacggctccctgcgtcaccctagcttcgagaagttccgaggcactgaggacaacccaaaggagaaaatgtaatgcttatctttgatgagaacggttggagggtgtaccaacacccacacctgatgatattccacatatcaaagtggatggaaggagatgaccggagaagctacggtagaacttgggactactttactgtctatgagtgtcatagtattaaggaagtcgaggagtacctacgaaacaatatgtaaacacactggctcaccgaaaggtgggcctttcttcgttccgggggaattaaccctcactaacaggagacacacaccatgtggcttatcctattcgctatcgtcgcaacgctgggattaatggctgccgacgacaacatttggcctgattgttaaggagataacatcatgcgtttacacttcaacaaatccaacggtatcttttcggttcgccgtaaagaccgctcgaccgtattggcctctaagcgcaacgctaagctgcctctgattggctcagtcgctacgctgtcaccttgtgttcacctgctgattactcgcggtgagttcatcaaggcgatgaacaaagagcgtccgcatctggaagccgtggtcacttactggcctcgcgttcgtctgttcttcaagtggattaaggaggtgctgtaatgttacaacatcattggaacaaaccagacttagaggctcgcttcccggttaactctgtggtgcgatactccggcggtggcctcaagcgcatcttagggatgagtggagtggtaactggtcactcgcacacaggtcgcgttaaggttcgcttcggtactcagcacgctgaggttcttccgaacaacctgattccgctaccgaaagctggcgttaagactccgaacgttgaagctcagaagcctgagtctaagtctgacgtgacccatccgaaccactacatgctgttcgacaacgtggaagccattgaggttatcgcccggtcaatgaccgtcgaggcgttccgtgggtactgccttgggaacatccttaagtatcgcctgcgtgctggcaagaaatccgaactggcaactatggagaaagacctcaagaaagctgcattctatcaggaactctttgacaaacaccgggggctgtgttatgacgcttcgtgaatgctgcgattggtgtgccgctaagtggaaccaagctattgaggatggtgacaaggtggctgctgacgcttaccaacaactgtacgcgctgtgggagcggcgctttaaggaggccaataaatgagccagtgtaacaacgggtgccagtacgcgaaggatgtagggatggagaaccactcctgcgcaaatcgctgcatgtactcagaacagaaataccttctaacgattgaaggtaacaccgagtcctttgagattccggtattcgcccggtctctcgaagaggcaacgctacaggctgaacattacgaggacgcagggttcgtagttactcgaatccgtccagaagtgaaagcctaattaccctcactaaagggaacaaccaaaactatcaaccaaaggagaaatactatggctggtttcaagaagaaaatctacacctccggtcttggcactgctgagccttatgcttacctgagtaagccggattatggcaacgaagagcgtggcttcggcaaccctcgtggtatctataaggtagacctgactctttccaataaagacccgcgctgtcaggcgatggtcgatgaaatcgtgaagactcacgaagaggcttatgctgctgccgtggaagagttcgaggctaacccgccgcaggtacagcgtggtaagaaaccactgaaaccttacgagggcgacatgccgttcttcgataacggtgacggtacgactaccttcaagttcaaatgctatgcgtctttccaagacaagaagaccaaagagaccaaacacatcaatctggtcgtggtcgatagcaagggcaagaagattcaggacgttccgattatcggtggtggctctaagctgaaagtgaaatactctctggtgccttacaagtggaacaccgctgtgggcgcaagcgtcaagctgcaactggaatccgtgatgctggtcgaactggctaccttcggtggtggcagtgaagatgagtgggccgatgaagtcgaagatggtggttacactgcgagtgaatcccgtcagtcccgcgatgagcaggagtggcaggaagacgagcacgaagaaaccccggatgatgacgaggacttctaatggctggcgcatacgctgcgcgaggtgtacgcaaggtcggggctttccgctccggcctagaagataaagtctcaaagcagcttgagagtaagggcattaagttcgattatgaactttggagaatcccttacgtcatccctgcgagtgaccacttatacactccagacttcctgctacctaacggtatcttcattgagaccaaagggctgtgggattccgatgaccgcaagaaacaccttttgattcgtgagcaataccctgaactggacattcgcttggtcttctcaagcagccgctcaaagctctacaagggtagcccaacaagctacggtgagtggtgcgagaagcatggcattctgtttgctgacaagctaattccggtggagtggctcaaagaacccaagaaggaggttccgttcgataaatttaagactaagaaaggagtaaagaaaaatggctaaagttcaattcaaaccacgagcaaccacggaggcaatctttgtgcattgctcagcaaccaagccaagccagaacattggcgttcgtgagattcgtcagtggcacaaagagcagggctggttagacgtaggatatcacttcatcattaagcgtgatggcactgtggaagcgggccgcgatgaactggctgtaggttcccacgtgaaaggttacaaccacaactccgtaggcgtatgcctcgtgggtgggattgatgataaaggtaagttcgacgccaactttacacctgcgcaaatgcaagcgctgcgtagtctgctggtcacgctgctggcgaagtatgagggttcaatccttcgtgctcaccatgacgttgcacccaaagcctgcccgtccttcgacttgaagcgctggtgggagaagaacgaactggttacatctgaccgagggtgataccatgaggatgatttgtattcgctgtgataagccgttgaagagtcgtgtaccgtcacgtcagtgtcagtgcaaagacccaatcaaggcggaggaacacaccgaggaataattaacactcactaaagggagacttaacggtttccctttgttctcgcaactgattaaggaatgtacaatggaacgagaagacgatagtatctttctgtttcatgctccatgtgaaaactgtgggtcttctgatggtaactctgtgtactctgacgggcatgaatggtgcttcgtgtgtgaacatcgagtacccgcaaacgaagagcgtgaagcaaagttatcaacgagaagacgtacaggaggcagcaagcctatgagctatgacgtatggaatttcggtgacagcaacggtcgatactctgacctgactgcccgtggcatctctaaggagacgtgccaaaaggctggctactggctggcgaaagtggacaaccgaatgtatcaggttgccgactacagagaccagaacggctccatcgtgtcacagaaggtgcgcgataaggacaagaactttaagaccaccggaagccacaagagcgatgcgttgttcttgaagcacctctggtctggcggcaagaaaattgtggtcactgagggcgaaattgatgcgctcactgtgatggaactccaagactgtaagtacccggtcgtatcattgggtcacggtgcctctgctgctaagaagacatgcgccgctaactatgaatactttgaccagttcgagcagattatcttgatgttcgacatggatgacgcaggccgtaaggcagtcgaagaggccgcacaggttctcccggctggtaaggttcgtgttgccgtgttgccgtgtaaggacgccaacgagtgtcacatcatgggtgaagacaaagcaatcttggagcaggtctggaacgcaaacccttgggtgcctgatggcgttgtctctgcgttgtcactcaaagaccgcgtcaaggaagctatgacctccgaggacgctgtaggtttattatttgatggctgtcaaggtctgaacgatagaaccttgggtgctcgtggcggtgaagtcgttatggttacttccggttccggcatgggtaagtcaaccttcgttcgtcaacaggctctggcttggggcaagcgaatgggtaaacgtgtgggcctagcgatgctggaggaatccgttgaggataccattcaggacatgatgggcttgaacaataaggttcgtctgcgtcagtctgatgaagtcaagaaggctatcgcagaggacggacgtttcgatgaatggtatgatgaactatttggagacgatacgttccacctttatgactcctttgcggaggccgaagctgacaggctgttagcgaagctggcctacatgcgaacaggcttagggtgtgatgttatagtgctcgaccacatatcaatcgtcgtgtctgcctctgaggaatcggatgagcgtaagatgattgaccgcctcatgacgaagctcaaagggttcgctaagtcaactggtgttgtgctcgtagtgatttgtcacttgaagaacccggataagggaaaagcacatgaagaaggacgcgctgtttctattactgacctacgcggttctggtgccctgcgccagctttctgatactatcatcgccttggagcgtaaccagcaaggtgatatgcctaacttggtgttggttcgcctgcttaagtgtcgtttcactggcgacactggaattgctggatacatggaatacaacagagaaaccgggtggcttgaaccgtctagctacactggcgaagaaggagaaggagatactggctggactgaacatgacggacagtcagacttctaaaggatgcccgtgtgggcattccgattgcgatggaatcatgtaccactaattaaccctcactaacgggaacaaccattaaaccataggagacacatcatgtttaaattcattaacgctttaggtaagctggtagttaaactgtacttcatcgaagccaagaagctggacaagaaggccaaagctgattcacagcgagccattgagttggcgaaacagtcccgtgagaaatccgatgcggctgttaatggcatccacaagtcggcagcgattgcagccaaagcacaatccatgagcaaattctttgagtaaggagtgcacattatgagcaagtcaatcacccacgcaaacaccatccgtcttccagacaccgctgaccagttcgctcgtcgagtacacatcaatgtgcgcggtgagaaggtaacgatggtctaccgctggaaagaccacaagtctccgaaagcacacactcaacgcatgaccttggatgacaagcaggtcggtcgcctgatgggtgccctgactatggctgctgacaaggtggtcggtgataaccgtgagcgtctggtagagttcggcgctggtatgcaagagattatcgagaagtgataaactcaaggtcgcccaagggtggcctttatgattatcatttagcacgaaaccaaaggagggcattatgctcgtaagtgacattgaggccaacaacctcttagagaaagtcaccaagtttcactgtggcgttatctatgactaccgtgatggtgagtatcatagttatcgtccgggcgacttcggggcgtatctggatgcgctggaagccgaggtgaagcgaggtgggcttattgttttccataacggtcacaagtatgacgttccggctttagagaaactcgcaaagctgcaactcaatcgtgacttcaagttaccacgtgagaattgtattgacacattggtactctcgcgtttacttcatgcgaaccttaaagacacagacatggggcttcttcgttccgggaaactacccggtcgtcgcttcgggtctcacgctctggaggcatggggttatcgcttgggcgagatgaaaggtgaatacaaggacgacttcaaggctatgctggaagagcagggcgaagaatatgttgacggtgctgagtgggtttcattcaacgagccgatgatggcgtataacgttcaagacgttgtggtcactgtcaagctcttcgagaaattgctgagtgacctccactacttccctgcgggtatggacttcacgaagtacgatgcggatttattctggcgtgaagctggtgagtctgtggatattgaacatcgtgcagcgtggcttttagcgaagcaggagcgtaacggcttcccattcaacaccaaggcaattgaggaactttatgtagaactggcagcgaaacgcgcagaacttctgcgaaagttaacagaaacgtttggctcgtggtatcaaccgaaaggtggtaaggaactcttcaagcacccacggacaggaaaaccacttccgagttaccctcgcgtggtctatccgaaacagggtggcgtgtacaagaagcctcgtaataaggcacagcgcgaaggtcttgaaccttgcgacttggacacgagggattacatggagggtgctccgtatactccggtcgagttcgttacgttcaagccaagcagccgtgaccacattcagaagaaactacaggaggccggatgggttcctgagaagttcaccgagaagggtgcgcctgtggtggatgatgaggtcttggagcatgtacgagtggatgaccctgagaagcaggcgtgcattgacttgattaaagagtacctgatgatacagaagcgtatcggtcaggcggcagaaggtgacaaagcgtggttacggtatgttcaagatgatggtaagattcatggagccgttaaccctaacggtgcagttactggtcgtgctactcatagtttcccaaaccttgcacaagtacccggcgttcgttctccttacggggagcagtgtcgtagcgcttttggtgctgaacatcatttggatgggattactggcaagccgtgggttcaagcggggatagacgccagtggcttagagttgcgctgtctggcacacttcatggctcgcttcgataacggagagtatgcgaatgagattctcaacggtgacattcacaccaagaaccagaacgctgcggaactcccaacgcgagacaacgccaagaccttcatttacgggttcctttacggagcaggagatgagaagattggtcagattgttggggccgggaaggagcgcgggaaggaactcaagaagaaattcttagagaacaccccggcgattgcagcgctacgagaagctatccaacagtctctcgttaagtcttccgcttggattggcggtgagcagaaagtccagtggaaacgccgttggattaagggtctggatggtcgcaaggttcacgtcaggtctccacacgcagcgctcaacacattgttgcagtctgctggtgctctgatttgtaagctgtggattatcaagaccgaagagatgctcattgagaaaggcttgaagcatggctgggatggtgactttgcgcagatgggatggattcatgatgaagtccagattgcgtgccgaacagaagagatagccaaggtcgtcgtagaggtagctcaagaagctatgcgatgggttggcgaacattggaacttccgttgtcgcttagacacagaaggtaagattggcccgaactgggcggtttgtcactaaggagtatttatgggaggcgtggctacactaaggttccacaagatgccgaccgggtgtgtagtctgcgtttcacataagcgcaatcacgatggctacttccggtacagtatagggtcgtccagaaagggcgagaagaaatgctttatgtttcaccgctgggtttgggaacgacaccgtgggcctataccagaagggtacgagatagaccacttgtgtctgaaccgtgggtgctgcaacgtagaacacttgcagtgcatcccgaagcgtgagcacataatcaaaaccaacaaagagcgcaagctcgtaaaggagaaacattatggcaatgaccaaacactttaaagtaaccttcgacgttaccgctgtgattgacagtgaatccgagaagaatctgaacgagttgctggtagacctagctaagaaggccggggctggcgagaagctgaatccgttcaaacaagaactgcttattcaaggcctgacacacgggccggaaggtgctgctgcgttctgtatcaagcaaggtctccgtgagtttatccgcgatggtcacagtgagttaagctctaccgagcagaagctgatgagattctcgcctgcaactgtgcgcgaggtgttcaaatgagtgaatacctgaaagttctggcagctatcaaaggctgccctaagtcctttcagtcgaactatgtgcgaaacaatgcggctctcgtagctgaggccgcttctcgtggacacattagctgtttgactgttggtggtcgtaatggtggagcgtgggaggtcacatccgctggtgtgcgcttcctgaaaagaatgggaggttgcgtatgattatgcctaagagtgacactgtaacgatgactcgcgatgcgtggaacgatgttagcgcatatattgagttccttgaaggtcgcctagcgaaactgaacgcgctggaggcacacggagttgacaactggtgtggttatgatgatgcaaccgctgaactctttaaggaggacgaatgagcctaatcacactgaaagacttcgctgagatgcgcgaaggcaaaccgatggagaagggtgtgctggtcatggatggtgactggcttgtgtatcagtcgatggctgctgccgaagttgagacggattggggtgatgatatttggactctggagtgtgaccacgctaaggctcgtagcattcttgattctgcaatcgagtcataccgaacccgtaagaaggcttggagtgacgctatggttgttctggcgtataccgacgatgtgaactggcgtaaggtactggttgatgagacctataaggagaaccgcaaggcgacccgtaaacctgtgggctaccgtgacttcttagcgaagctgtgggagcgcgatgagttcattcacatcaaagaggacatgcttgaaggtgatgacgttatgggcatcattgggtctggtcacgaggtcttcggcttcaagaaggctgtgttggtctcctgtgacaaggacttcaagactatcccggacgttgacttcctgtggtgtaccactggcaacatcttgacgcagacaaaagagaccgctgattggtggcatctcttccagactatcaaaggtgatatgaccgatggctactccgggattcccggctggggcgatacggcagaaggtttcctgaatgacccgttcattgttgagcctgtagagtccgtgttgaagtccggtaagaacaaggggcagacagtaaccaagtgggtgaagcgtgctcctgatgcgactgagacgctgtgggactgcattaaatccattggtgccaaagctgggatgaccgagcaggaaatcatcaagcaaggccagatggctcgcattcttcgcttcgaggaatacaattacattgacaaggagatttacctatggacgccgcaaagtacataaccatcgctgtgctggtaggtatgctggcgcgaggtctctggatgttcactctcatagtccgagacgtgaagcgagactccgagattaagtgataaactcaaggctctctgtattaaccctcactaaagggaagagggagcctttatgattattactttaagacttaaccttaagaggtgaaattatgttacaaccaattaatcatgttttaactcatcccgatgatattcctagtatgcctcgtgcagctaaagagtatctacaggtgcgcttcaatcagacctatgtgatggagtccggggagtaccgtgcgctacgcgctgctgggtactctgagtctttcattgcgggtgtgatgcatggtctgtaccttgcctctcgaacacttgatgagattgaggtgcgtaaagagcaactgagacaggagtaattatatgtgctggaaaccgaaggtgaaagtccctaagatggacactaaccagattcgcgctgccgaaccagcacctttgactgagccaccgaaatctgtggtatggggaggcgatgacgatgaggacaccagcgtgtcttcctctgaggtgccaacctcaccgagcagcggtaagagcagtcttaaggtaaagctggatgacaacgcagccaagaacaagagtaaatcctccattcgctccaaggcgtttgggtaactgagtcataacatagggagaaacatcatgggattcttcaagaaaatcaagaaggccgttaagaaagtcgtgaaggaagttaccagaccagtcgagaaggcaggtaaggaagtcggtaaagtcgttggcggtgcgctgggtacaggtaagcaggagattatccaacaagaggctccagcaccagtagtgactgcgccacctccagcacagattgtagatgtacctgaacaggataaggctgagggtgaggatgaggctcaaaccgaaagcgcacgtaagaaagcacgcgctggcggtaagaaggcacttagcgtagcccgtagctccggcggtggcattaacatctaaggaggactgaatggctgattcaaaacgtacaggcttgggcgaagacggtgctaaagctacctatgaccgcctaacgaacgaccgtagagcctatgagactcgtgcggaaaactgtgcgcaatacaccattccgtccttgttcccgaaggagtccgataacgaatctaccgactacacgactccgtggcaggctgtaggtgcgcggggtcttaacaatctggcctctaagttaatgcttgcgttattcccgatgcagtcgtggatgaagctgaccattagcgaatatgaggcgaagcagcttgttggagaccctgatggactcgctaaggtggacgaaggtctgtctatggttgagcgtattatcatgaattatatcgaatccaacagctaccgtgtgacgctctttgagtgcctcaagcagttgatagtggcaggtaatgcactgctttacttaccggaacccgaaggtagctacaatccgatgaagctgtaccgattgtcttcttatgttgtccaaagagacgcatacggcaatgtgttacagattgtcactcgtgaccagatagcctttggtgctctcccggaagacgttcggtctgcggtagagaaagctggtggtgagaagaagatggacgaaatggtcgatgtatacacccatgtgtatctcgatgaagagtccggcgattacctcaagtacgaggaagtagaggaagttgagattgatggctccgatgccacatatccgactgacgctatgccctacattccggttcgcatggttcgcattgatggcgagtcttacggtcgctcctactgtgaagaatacttaggtgacttaaggtctcttgagaatctccaagaggctatcgttaagatgagcatgattagcgctaaggtcatcggtctggtgaacccggctggcattacgcagccacgcagattaaccaaagctcagactggtgacttcgttcccggtcgtcgagaagacattgacttcctccaactggagaagcaagctgactttaccgtagcgaaagctgtgagtgaccagatagaagcacgcttatcgtatgcctttatgttgaactctgcggtacagcgcacaggtgaacgtgtgaccgccgaagagattcgatacgttgcgtcagaactggaagatacgcttggtggcgtctattcgattctgtctcaagaactgcaattgcctctggttcgtgtgctcttgaagcaactccaagcaacctcgcagattcctgagctaccgaaagaagccgttgagcctactatcagtacaggtctggaagcaatcgggcgtggtcaagacctcgataaactggagcgctgtatctccgcttgggctgctctggctcctatgcagggagacccggacattaaccttgctgtcattaagctgcgcattgctaacgccattggtattgatacttctggtatcctactgacggacgagcagaagcaagcactgatgatgcaggatgctgcccaaacaggtatcgagaacgctgccgccactggtggggctggtgtgggtgctctggcgacctcaagtccagaagctatgcagggtgccgcagcacaggctggcctagacgccacctaataaccctcactaaagggagacctcatctttgaaatgagcgatgactaaaggttggagtcctttggtttccctttatctttaacaacttaggagatttaacaatggctgaatctaatgcagacgtttatgcgtccttcggtgtgaacaacgcggtaatgaccggaagcacacctactgaacacgaacagaatatgctgagtctcgatgttgctgcccgtgatggcgatgatgcaatcgtacttagcgaggaaccgacttctcataacgatgacccatatgcatccggtgtagacccgttcgctgatggtgaagacgatgagggccgcattcaggttcgtatcagtgaagatggtaatgaagccgagttcgacactggtagcgataacgctgaggtggagaccgaaggtgaggccgctgagtttgaaccgctgggtgacactccagaagaactgagccaagtgactgaacaattaggtcagcacgaagaaggctttcaggcgatggtcgagcaggccgttgagcgtggactgagcgcagagtctgtgactcgcatctacgaagagtacgaagccgatggtatctctgagaaatcctacgcggaactcgaagctgctggatatagtcgtgcctttgtggactcctacatctccggtcaggaagcccttgtagaccagtacgtcaatcaggtagttgcctttgctggtggtaaggagcgctttagcgcaatccatacgcaccttgaagcaaccaacccggctgcggctgagtcccttgaggctgccatgatgaaccgagacttggcgactgtcaaagcaattatcaatctggctggtgagagttacacgaagaaattcggtaagcctgccaaccgtagtgttgccaagcgtgctactccggttaaacctgtagctcgtcagaaagagggctttacgaatcaggctgagatgattaaagctatgagtgacccacgttaccgtagtgatgctgcctaccgtcaaatggtagaacagaaggttatcgactccagtttctaattaaccctcactaaagggagagaccatagatgcctacaatggttgaatcacctgagcacagaactttgtggtcactcccgtaggtgaaacattgagaaccaactcgattcaagtagtaaccaaacttttctttaaattaacataaggagattcaacatggctaacattcaaggcggacagcaaattggtactaatcagggtaagggtcagtccgcagcggacaaattggcgctgttcctgaaagtgttcggcggtgaagtcctgacggctttcgctcgcacctccgtgaccatgcctcgtcacatgctgcgctctattgcttctggtaagtccgcacagttccctgtgattggtcgcaccaaagctgcttacctgaaaccgggtgagaacctcgatgacaaacgtaaggatatcaaacacaccgagaaggtaatccacattgatggcctgctgactgcggacgttctgatttacgacattgaggacgcgatgaaccactacgacgttcgcgccgagtacaccgcacagttgggtgaatctctggcgatggcggctgacggtgctgtactggctgaactggctggtctggttaacctgcctgacgcctccaatgagaacatcgagggtctcggtaagcctaccgtactgactctggttaagccgaccacaggcgacctgactgacccggttgagctgggtaaagcgattatcgctcagttgactatcgcgcgtgcgtctctgaccaagaactacgttccggctgctgaccgtaccttctacaccactcctgataactactctgcgattctggctgccctgatgccgaacgctgcaaactatcaggcactgattgaccctgagcgcggtactatccgtaacgtgatgggcttcgaagtggttgaggttccgcacctgaccgctggtggcgctggtgatacccgtgaggatgccccggctgaccagaagcacgctttcccggcgacttccagcactaccgttaaggttgctctggataacgttgttggcctgttccagcaccgctctgcggttggtacggtcaagctgaaagacttggctctggagcgcgctcgtcgtgcgaactatcaggctgaccagattatcgctaaatatgcgatgggtcacggcggtctgcgtccagaagctgctggcgctatcgttctcccaaaggtgtcggagtaattcccgaccccactggagttactcttagtcagaagactatgagcttagacgttggggcttctaaagccctgacttctacggtaactccggctgatgcagtacagacagtgacctttacgtcttccaatgcgaagattgccacggtcgatgcctctggtactgtaactgctgtgggcgctggctccgctgacatcactgcgactactgtgaatggcctgacggctgtctgcaaggtcactgtgaaagcagtagagcctcccgtagaaggctaaggtctttaccggggatttactttccttcattactttatgaaccccttgggtgccctctgagggtatctgaggggttttttgctttaaaccctcactaacaggaggtaacatcatgcgctcttatgagatgaacattgagaccgcagaagagctatcagccgtcaacgacattctggcttccatcggtgagccaccagtatcgacacttgagggtgatgcgaatgctgacgttgcgaatgctcgacgtgtactcaataagattaaccgacagattcaatcacgaggatggacattcaatattgaggaaggtgtgactcttctaccggatgcgttctctggtatgattccatttagctctgactacctgtccgtaatggcaaccagcggtcagacccaatatatcaaccgtggtggctatctctatgaccgctctgcgaagactgaccgattcccatctggtgttcaggtcaacctgattcgtctgagagagttcgatgagatgccagagtgcttccgaaactacatcgttaccaaggcttcccgtcagtttaacaaccgcttcttcggtgcgccggaggtagacggagtgttgcaggaagaagaacaggaagcgtggcgtgcgtgcttcgagtacgaactagactacggcaactacaacatgctggacggtgatgcattcacctctggtctacttaaccgctaataacaaggaggctctatggctctcattagtcaatcaatcaagaacctcaagggtggtatcagccaacagccagatattctccggttcgctgaacaaggtagcgtacagattaacggttggtcttctgagtcagagggtctccagaagcgcccaccgatgattcaccttaagacccttggcgctgctgggtatgtgggtgcgcaaccttacgtgcatcttatcaaccgtgatgagttcgagcagtatttcgttgtgttcactggtgaagacattaaggtgttcgacctcgatggtaaggagtatcaagtccgtggagaccgctcatatgttcgtacagctaacccacgagaagaccttcggatggtaactgtggctgattatacctttgtgaccaaccgcaaggtggttgtgcagagtaacgaccaatcggtcaaccttccgggctttaaagaccaaggcgatgcgctaattaatgttcgtggtggacaatatgggcgtagactatcaatcgagttcaacggggctgagcgtgctgctgtgcagctaccagatggttcacaacccgcacacgtcaatgaggttgacggtcaggctatcgctgagaagctggcggtgcagttgaggaacaaccttgggaatccaaacaataagcaagacccgaataagtggcgcttcaacgttggccccggattcatccacatccttgcgccaaataacgataacgtttggggactacagactaaggatggttatgcagaccagctaatcaaccctgtaacccattacactcagtcgttccagaagttgcctattaacgctccagatgggtacattgtgaagattgtaggtgacacctcaaagactgccgaccagtattacgttaggttcgacctcaaccgtaaggtatgggtagaaacaatcggctggaacacaaggactcacctacattaccacactatgccttgggcgctggtacgtgcttctgacgggaactttgacttcaaggtacttgagtggggtgctcgtactgtgggcgatgatacaaccaacccatacccatcgtttaccggacagacaatcaacgatattttcttcttccgtaaccgtttaggcttccttagcggggagaacatcatcttgtctcgcacctcgaaatacttcaacttcttcccggcctccgtgtctaactactctgacgatgacccaatcgacgttgccgttagtcacaaccgggtgtcaaccttgaagtatgccgttccgttctccgaagagttgctcctgtggtctgaccaagcgcagttcgttctgacggcctctggtatcctttcgagtcgctccgtagagttgaaccttacgactcagttcgacgtacaagacagggcacgcccacatggtgtaggacgtaatgtatactttgcatcacctcgcgcttccttcacatccattaaccgatactatgcggtacaggatgtaagctctgtgaagaacgcagaggacatgacggctcacgttccgaactacataccgaatggagtattcagtatatcgggtacaaccgctgagaacttcgcggctatccttacgagcggagcaccgaaccgggtgtatatctacaagttcctctatattgatgaagaaatcaggcagcagtcgtggtctcattgggactttggggacaacgttacggtgtttgcagcacaggtgataaactcaacaatgactgtattgatgagcaacgaacatgctgtgtggatgggacgcttgcacttcacgaagaactccatagacattccgggagagccttacagattatacatcgacgctaagaggaaatacaccatccctgccgggacgtataatgatgatacctaccagacgtccataagcctcgcagcgatttatgggatgaacttcactaagggtaaagtgtctgtggtcttccccgatggaaagattatagaggtagacccgccaatcaacggttggggcagtgacccggtgttacgacttgatgggaaccaagagggccaagtggtttacattgggttcaacatcccattcacgtatacgttctcgaagttcctcattaagaagactgctgaggacggctcgacggctaccgaggatattggtcgcttacagcttcggcgtgcgtgggtaaactatgaggactctggagcgttcaccatccgcgtgaacaacctgtcccgtgagttcatctacacaatggctggtgctcgcttgggttctgacaatctgcgtgttggtaggtcgaacattggcacagggcagtaccgcttcccggtggtaggtaatgcgcagacgaacatagtaactatcgagtcagatgcgtcaacaccactgaacatcattgggtgcggctgggaggggaactaccttcgtcgttcttctggcatttaacttaaagtctccctgcggtgaattaaccctcactaaagggagacactaatagatacgaggggttaaagcattatgtatattacaaagtgtttacaagtccacgctgacaactttcagccgtccatagaggacattctggaagctgaggcattgggtgtcgaacctaaagtaattcctgatgagaacactgtggcaatgctcagcgatggcgctgtgttggcaatcggtggcaatcagggagaccgagtgtggttccttacctctaagtacgtcccactgtttaccttgaaggagcgcttagagtttcgtaagttaatagttgaatatcgtgatatgatgctgaaccagtacgagtccatttggaatttcgtttgggtaggcaataagtcacacattcgtttcctaaagacaatcggagcggtattccacaacgagtacacactcgatggtcagttccaactattcacaatctcaaggaggcaacgtgaagaaatgtaagaaatgcggagagttgaaagctgtctccgagttctataaggacaagaagagtaaggacggcctacggagtcattgtaagccctgtcactacacgtattacaagaaggactactcaaaggcgcgagagatgaaccttaagcgtctgtacggaatcactctggaagaatacgaagcgatgctccttaagcaagacggagcgtgtgctatctgcggtcttaccgagagagttgagggacgggcgttagcggttgaccattgccacgccactggcgctgttcgtggtctcctttgctctgcctgtaacatcgctcttgggaaattcgaggacgacaccgagcgtcttcggaaggcaatcacttacctaagaggagaataattatgtgctggatggcagcgattcctatcgccatgatgggtgcccaagctctgagtagccagaacagcgctgataaggcgcgagtggcacagaccgaagctggacgccgacaggcaatggagatggtcaaagagatgaatatccagaatgcaaacgcctcgctggaacaacgggacgcccttgaagctgcatcctctgagttgacttcgcgtaacatgcagaaggtacaggctatgggaacaatccgtgcagctatcggcgagagtatgctggaaggtgagtccatgaagcgcatcaagcgtatcgaagaaggtaactacatccgggaggcaaatagtgtcaccgagaattaccgccgagactacgcgagtatctttgcgcaacagttgggacgcactcagtcaacagcaagtcaagtcgatgcaatgtacaagagcgaggccaagggtaagtctggtctgatgcgtgtactagaccctttgtccattatgggtcaggaagctgcaagtcaatatgcggctggtggatttgacaagaaaggtggaaaccaagcagcacctatcagtgccgccaaaggaaccaagaccgggaggtaataatggctagtaaactaaatagtgttttaggcaacatggcgactcccggtatggaacgactccggggcgtcaaaggtatggactaccgggcagcaaccattcaggctgagcaaccaagagcgagtcttctggactccctaggtcgattcgctaaggctggtgccgatatgtacatggcgaaagaggaacgtgataagcaacgagccgatgagcgctccaacgagattatccgtaagctgacccctgagcagcgccgacaggctatccagaatggtacattactgtatcaggatgacccatacgcaatgcaagccttgaagttcaagaccgggcgtaacgctgcgttcctcgttgacgatgaggttcaacaggccatcaaagagggtcgcttccgtactcgtgaggagatggagcagtatcgtcactcacgcctacaggagcactcgaaggcgttcgctgagcagttcggcatcaatgagatggacgaggaataccagaagggtttcaacgcgaatatcaccgagcgtaacattgctctgtatggcgcacatgataccttcctgagtgaccaagcgcagaagggtgcaatcctgaactcgaaggttgaactcaatggtgtcctgtctgaccctgacctactgtctcgtcctgagtccggtgagttcttccagaactacatcgacaactccttggtgacagggatgactgacaatcaggctcaacaggttatctcttcgtccctgaatgacgtgctacagcgtccgggtggtgccgccttcttgcagaacattgagaaccgcaaggtgactcttaatggtgctacgactacctatcgtgaactgatgggtgatgagcagtggcaggcaatgatgattaaggcacagcacactcaattccagaacaacgcgaagttaaccgagaagttccgactggatattaactcagcgcttaaccaagcggacactggtaaaggatgggagactcttcaaggcatcaaggccgaactcgataagattcagccgggtgaagagatgactcctgagcgtgagtggttgatttccgcacaggaacagatgcgcacacgcttcaagcaggaacaggctgagacagcaaagctgatggacaagcaacagaagaccctgaataaatctttggtcatcgacaagcagttccagaagcgcctcaacggtgaatacgtctcgaccaactataaggacatgccgaccaacgagaacactggtgagtttacacatagcgatatggtaaactatgcgaaccagaagttagcggaaatcgaagcgatggacttaacgccagaacagaaagacaaactgaaattggactacctacgggcagactccaaggagggtgctttccgtgcagcgtttggtgagatgattactgatgctggaaacgaatggcaggctgcggtgattaacggtaagatgcctgagagcacaccagcgatggataaccttcgtcgcatccgcaacactgaccctgacctgattgcctctctgtatcctgacaaggccgagttgttcctgacgatggacatgttggataaccaaggcatcgacacgcaggttcttatcgacgctgataaggcccgcgcacagaagaccaaggagatgcagtttgaggatgaccgagcgtgggctgctatgatgaacgattcaacgaatcctcaaatcaagtacatgccttcgagtgtccaagggtatgcccggaagatttatgattccgtgaagtaccggacagggaaccctgacatggcaaccgaacaggtcgcaaagttcctctccgattcgacgaccacgttctccagtagcgatgttgagggtgatacctacggcgtcctaccgaagaacatcctgactgtttcggatgaccctaagtcgtgggagcaagggaagaacattctggacgaagccattaagggaatcacagcggcgaacccttggattaccaacaagcaactgtcggtgtaccagcaaggtgattcaatctacctgatggacacaaccggacaggttcgcattcggtatgaccaagagttactcaaacgcgaataccagcgtaccgcacagatgcaagctgaggcagcgcgagagaaagctctcaaagaggccaataagcgtgctccaatcagtcgcgcaacgcaggcgcgtgaagaagcgcgtaaacgtgtccaagagaaacggaagaagactccgaagtacatctatggacgtaaagaagactaacagtgataaggaggctccatgagctacgataagaacaaacctagcgagttcgatgggttatttcaaaaagcggcagacaatcatggggtctcctatgacctgcttcgtaaattagcattcaacgaatccagctttaatccaaaggccaaatccccaactggcccgaagggtctcatgcagttcaccaaaggtacagccactgcgcttggcctcaaggttactgacgatgatgacgatgaccgttacaaccctgagttggctgtggatgcagccgctcgtcacctgagtgacctcattcggaagtacgatggggatgagcttaaggcagccctagcatacaaccaaggcgaggggcgcaacggtgctccacagatacaggcctacgacaaaggtgattgggcttcaatctctgaggaaggtcgtaactatatgcgtaacctgatggacgtagctaacagtcctcgcaagggggacttggaggcgttcggcggtatcaccccaaaggctaagggcattccatcgggggatgcatttgctggaatcgggaagaagcagacggtaggcactgacctgccggagtcaactggattcaaagtggagggtaaagagcagaaagcacctaacgtgccttatgccaaggacttttgggaaaagactggaacaacgctggacgagtttaattcacgttcgaccttcttcggaatcggagatgccacgagtgcagaacttcacaactccgtattgggtgtggcttttcgtgccgctcgtagtgatgacggttttgatttattcaaggacaccattactccgactcgctggaacagccatacgtggactccagaagagctagagcgtatccgtaaggaagtgaagaacccatcgtacatcaacgtagtcactggaggctctcctgagaatctggacgccctcattaagatggcgaatgacaactatgagatggacgcacggtctgccgatgctggtgttggtgccaaacttactgctggtatcgtcggtgctggtgtagacccgctgagttacgtgccgctagtaggcgtagccgggaagggtctcaaggtggttaacaaggctttcattgtgggtactcaaagtgctggcctcgcggttgcctctgagggtatccgtacatcaatcgctggtggagaagcccactatgctgatgctgctttaggcggtctgatgttcggtgctgggatgagtgcaataagcgatgctatcgcggctggtattcgccgttcccgtgggactgaggttgttaatgacttcgctcctatggcacaccgcttggaagcccgcgaaaccgctctgaactctggtggtgaagacctgacccgtatgcctagcgagaaccgtgtgttcgaccgtgagcacgctggagttgagtattcccctctggagaccgagccgggtgccgttgtgttgcctcaaggtcaaatcctgagcgacaccaacccactcaaccctcagactcttagcgagttcgaggcggtcaaccctgagcgtgccgctcgtggtatctctttgggcggtttcactgagattggcttgaagactctccgctctgagaacccgactgttcgctccattgcgagtgaccttgtgcgttctccgacagggatggaatcaggctctaatggtaagttcggtgcgactgcttctgacattaaggagcggctccacgcgaacaatcagcgcacctacaatcagctttatgatgctgtgcgtactgcaatgaaagaccctgagttctccacaggtggggccacaatgagccgtaaggaaatccgacaggaaatctacaagcgtgcagccttggcgattgagcgacctgagcttcaagcaaacctgacaaagggtgagcggaacgtgatgaacatcctcaagcagcactttgacctcaaacgtgaaatcatggagaacccgtcaatcttcggcaacaccaaggcggtcagtatcttccccggctcacgccacaagggaacctacgtgccaaacgtgtacgaccgcgctataaagattgagatggttaaacgttacggtaatgatggcttgcagcgagcaatcgcggagtcatggttgacgtcttatcgtgctcgtccagaagtcaaggcgagggtcgatgagtacctgatggaacttaacggtctcaaatccgtgcaggaagttacgcctgagatggtgcagaagcacgcgatggataaggcgtatggtatttcacacaccgaccagttctctgcctcctctgtcattgaggataacattgagggtctggtgggtatcgagaataacaacttcttggaagcccgtaacatgttcgacagtgacatggcggtgactctccctgatggtaacacgttctctgtgaatgacctccgtacctatgacatggctgaaattctacctgcatacgaccgacgagtggatggtgacgtggcaatcatgggtggttccggtaagacgactaaagacctgaaagatgaaatcatggcgctggataagcagtcagagggtaacggcacactgaaaggtgaagtggaagccctcaaggacaccgtgaagattctaactggtcgcgctcgaaggaacccggaaggcgcttggggaacagccctacgctccgtcaatgaccttacgttcttcgctaagaacgcctacatgggcgcacagaacattactgaaatagctggtatgctggctaaaggtaacgtctctgcgataactcacggaatacccatgattaacgattgggtcaaccgtggtaaaccgcttcgtgcctctgagattaaggagatacacgggatggtgttcggtaaggaactagaccaactaatccgtccgggacgtgaagaccacgtgcgccgactccgggagtctacggacaccagcgctgcggttgccaatgtggtcggtacgattcgtttcggcactcaagagttggctgcacgctctccttggacaatgctcctaaacggaacatcaaactacattcttgatgctgcccgtcagggtgtgcttggggatgtggctggagcggcccttactgggaaagcctctaagttcggtaaggcaaactaccttaagtctgcctctatcagccctgagcagtggaatggaatcaagcagttgttcagagaccatgcgactcgtggagaagacggtaagttcaccattcgtgacaaacaggctttcgctaacgacccacgttcaatggacttgtggcgactggctgacaaggtggcggatgagactatactgcgccctcacaaggtttcctcacaggactccaaagcgttcggtgcaggggtgaagatggtgatgcagtttaagaacttcgtcatcaagtcccttaactcccggttcgtccgtagcttctacgaggcaacgaagaacaaccgtgcgttagaccaagcgttgactcatatcatctctttgggcctagctggtggttactacgttgggcaggcgcaccttaaggctgcaagtctacaggagcacaaacgtaaggagtaccttaagaacgcacttgaccctaagatgattgctcatgcatcaatctctcgtagttcacacttaggctcgccattgagtatctacgacatgttcgctgggatggttggtagcgatacctataagtacacccgctctactgtactccctaaagagtccgagaagcgtgaccctaacaaggcagtgacaggtagacaggtggcttcaactatcgcaggtgcagttggtgagcaggttccgggtttaggttttgtgggttctgtgggcgcaacagcaattaacgccgcttccctgctgtcttctccaaacaaggctaccgctctggagttccgtacaggactcttcaacacctctcgtgagttgattcctaatgacccgctatcgcagcaactcattatgaaaatctacgaggccaacggtatccgcataaaggagacgccgaagaaacaataaaccctcactaaagggagagaggtcacattctggcctcttctctctcttaatgctaatttacaaaggaggtcacatggctacaactattaagaccgtgatgacttacccgctggatggctccactacggacttcaatattccgtttgagtatctggcgcgtaagttcgtcagagtgacccttatcggtgttgaccgaaaggaactcatcttgaatcaagactatcgttttgcaactaagaccacaatctccacaacgagagcattggggccagcggacggttataacatgattgaaatccgtcgattcacctccgctaccgataggctggttgactttacggatggctcaatcctccgtgcgtatgacctgaacatctcgcaggtgcagaccctccacgttgctgaggaagcgcgtgaccttaccgctgatacgattggcgttaacaacgatggtgacttggatgctcgtggtcgtcgtatcgtgaacgttgcggacgctaaagaccccggtgatgcaataactttaggtcaagtctctcgatggaatgagtcggcactgaactctgcgaatgctgctgctgcatctcaacaggccgctgctgcatctcaacaggccgcaaagtcctcagagaacaactcgaaggtatctgaggacaacgcaaagacctccgagaacaacgcgcatcaatgggcgcagcgtgcagaggactctccggttcagggtagcgagttctctgcgtatcactactcacggaaggcctccaagagtgccgccgccgcaagtacgtctgaggggaatgcaaagacctctgagaccaacgctaagtcctctgagaccaacgctaagtcctctgagactaacgctgcatcgagtgctgctaaggcttctgaggaggctgctaagctgactaacatgaatgactttgctgctgctattgattcagtcaacggtaacaatgttgtcatgaagggtgacttcaccattaaaggaaacggtaaagtatcaatactgaaccacagtgggctataccaagataagaccgtgaatggcgtgaactatgccaacaggatttatatggatgatgcggggggcatgcactttgagaactaccgtgtgtctggtacttcatccaccttacgtgctggttttgttattacagataccaacaggtttgactttacagggccaacgcgagttaagggtgatatcagcgcatatgtggatgcgccacctaatccaggtattggccaatacctcaattctgtgtcagttcgctcacagcttcggggccgtggtgctaagaatgatccacttggtgcgtactgtgctatgtattttcaggagcacgttggtacagaccacgctataatccttaacctcaatggttatagcaaggatactaactggcagctattctccaatggtaaaatatctacaccacttggtgatgtgatgacctcaggttctgatgttagaatcaaggatgatatcactaaacctcttgatggtgctggtgagcgtattgacgcaattggcatagtggaatacacagagattgccaccggggaacgtaaacgtgggtggctggcccaacagcttgacacgattgacccgctgtacacatacctcacgaccaccgcagaaggtagtcttttgaataccaacgacagggcgttgcttgctgacgtaatcactgagattcaggcactgcgtcaacgcgttaaagaactcgaaggacaatcaacaaagccagagggcggcacaacataaggagaacaagaatgttatcttttgacttcaataacggggtcgttaaggctgcgccgattgttggcacaggggtcgctgatggtgcggcccgactcttttggggactatcgttaaacgagtggttctacgttgcagctatcgcctacacagtggttcagattggtgccaaggtagtcgataaaatgattgactggaaacgtgcaaataaggagtaacctatgagcgacaagactttaatcaagctgctggagatgctggacacggagatggcacagcgtatgcttgctgacctccagagcgaggaacgccgaacgccgcagctttacaacgcaatcggcaaactgttagaccgccataagttccaaatcagtaagctgaccccggatgagaacatcctcggtggactggcggctggtctggaagactacaacaaagtggtcggccctaatggtctgactgacgatgagactatcacgctacagtaagtgacatactcaaggttctccacgcggggagcctttatggatgttatttggcgcatctatgtaaaatctgaaaattgatgggaggtgttatgctaaaacttttacgcagcgcactcccttgggtactcgccgggacactctttatgggtggctggcacttagggtcaacccatgagagagcaaactggaaggaggtaatccaaaatgagtacattgcgaaaacaaaagcaaccgcagcaactcaggcagaggtcagtcgggtatcccgtgagtaccaagaagagattgcagccattgaaggcagcactgataggatgcttaatgacctgcgtagtaataataagcggctgtcagtccgcatcaaaacccttaccggactaccagaagataacggtagatgcgagtttaatggtcgagccgaactacacgagtcagatgctaagcgtattatcggaataacccaagctgctgatgctcacgtaagagcgctccagcgtactattaaggagatgcagaatgagcgacacccaagcaaaccgtaatgcgctaatcattgcgcagcttaagggtgacttcgtggccttcctgttcgtattgtggaaggctttggctctcccgccgccgactaagtgtcagattgatatggcccggtgtctggctaacggagacaacaagaagtttatcctacaggctttccgtggtatcggtaagtcattcatcacctgtgcgttcgttgtgtggacgttatggcgtgaccctcggttgaagatactgattgtctctgcatcaaaagaacgtgcggacgctaactccatcttcatcaagaacatcattgacctgctgcccttcttggctgagctaaagcctcgccccggtcagcgtgactctgtgattagtttcgatgttggccctgccaagcctgaccactctccgtctgtgaagtcggtgggtatcactggtcagttgactggtagtcgtgctgatatcatcatagcggatgacgttgagattccgtctaactccgcaactcaaggtgcccgtgagaagctgtggactctggtgcaggaatttgctgcgcttctgaaaccactgccgacttctcgcgttatctaccttggtacgcctcaaaccgaaatgaccttgtacaaggaactcgaagataaccgtgggtacaccacaatcatctggcctgcgctctatccgcgtagccgtgaggaagacttgtactatggcgaccgtctggccccgatgctccgcgaagagttcaacgatgggttcaagatgctccaaggtcaaccaactgaccccgtgcgcttcgatatggaagacctgcgtgagcgtgagttggaatacggtaaggctggcttcactttgcagttcatgctcaacccgaacctgagtgatgccgagaagtaccccttacgcctccgtgacgctatcgtgtgcggtctggacttcgagaaagccccaatgcattaccagtggcttccgaaccgtcagaatcgcaatgaagagctacctaacgtgggccttaagggtgatgatattcatagctatcattcgtgcagccagaacactggacagtaccagcaacgcatcctcgtgattgaccctagtggtcgaggtaaggatgagacaggttacgcagtgttgttcaccctgaatggctacatctatctgatggaagctggcgggttccgcgatggttattccgataagacccttgagtccctcgctaagaaagcgaagcagtggaaggttcagacagtggtcttcgagagtaacttcggggatggtatgtttggtaaggtattcagccctgtgctcctgaaacaccatgcagcgcaacttgaagagattcgtgctcgtggtatgaaggaactacgcatttgtgatacgctggaacctgtgctctctacgcaccgccttgttattcgtgacgaggtgattcgtgaggactaccagactgcccgtgacgctgatggcaagcatgacgttcgctattcgctgttctaccagttgacccgtatggcccgtgagaagggcgctgtggcacatgatgaccgacttgatgcgttagcattgggtgtggagttcttacgctctacgatggaactggacgccgtgaaggtggaggctgaggtgcttgaggcgttcttagaggaacacatggagcacccaatccattcggctggtcacgtagtcacctctatggttgacggtatggaactctattgggaggatgacgatgtgaatagcaataggttcattgactggtagttatgcatattgagtgcataaggaatcatttagaccacggatggtcactttaagaaattccttaataatcaatgagtttgaattaaccctcactaaagggagagaggggacttaaagctactatataggttagtcattcaggttatgcaatgaccctttatgcactttaagtctacctctgtgattggtgatattatcattgtataatcaccctaccttagagcaactgaaaggaggtggctcaatgttacgcttgctgattgccctgctgcgtcatagagtcacttggcgatttcttctggtacttactgctacccttgggtacgcaggtcttactgaccacctcggtcaactggaagtggccttttgctctatactctcttgtggggattaaattattgttgatgaacgacaagcggctctgagggattcgtaggtatagtttcactacaccaactcatccctgtagagtcaaccctaaaggttatacctaaagatgccctgtagttcgtaatggtcttacagggtcttctggtgtctcctagctatcccttcgggatgcgcctatggtctcacctatggtgtggccttacctaaagtgggttcataaagagaccctttaagaatttaccacaaaaatctgaatgggtatctcatagttcaagaacccaaagtacccccccatagccctcttaaagccacctaaaaccagccctacccctagggtttaaccttcggttaaccttgggtatctcctcaagtggcctataggatagcctaaagtgttgcctaaagtcaatacctaaagtggtggatggcttaaggaggacttaaagagtgtcctagtgtaccagttcgatagtacatctctatgtgtccct

SEQ ID NO: 27 - DNA, 39030 bp, Unknown
  source: /note="Description of Unknown: KP2-7-1c Bacteriophage Sequence"
gatattgacttcctgcaactggagaagcaagctgactttaccgtagcgaaagctgtgagtgaccagatagaagcacgcttatcgtatgcctttatgttgaactctgcggtacaacgcactggtgaacgtgtgaccgccgaagagattcgatacgttgcgtcagaactggaagatacgcttggtggcgtctattcgattctgtctcaagaactgcaattgcctctggttcgtgtgctcttgaagcaactccaagcaacctcgcagattcctgagctaccgaaagaagccgttgagcctactatcagtacaggtctggaagcaatcggtcgtggtcaagacctcgataagctggagcgctgtatctccgcttgggctgctctggcccctatgcagggagacccggacattaaccttgctgtcattaagctgcgcattgctaacgccattggtattgatacttctggtatcctactgacggacgagcagaagcaagcactgatgatgcaggatgcggcccaaacaggtatcgagaacgctgccgccgctggtggggctggtgttggtgctctagcgacctcaagtccagaagctatgcagggtgcagcagcacaggctggcctagacgccacctaataaccctcactaaagggagacctcatctttgaaatgagcgatgactaaaggttggagtcctttggtttccctttatctttaacaacttaggagatttaacaatggctgaatctaatgcagacgtttatgcgtccttcggtgtgaacaacgcggtaatgaccggaagcacacctactgaacacgaacagaatatgcttagtctcgatgttgctgcccgtgacggcgatgatgcaatcgtacttagcgaggaaccgagttcccataacgatgacccatatgcatccggtgtagacccgttcgctgatggtgaagacgatgagggccgcattcaggttcgtatcagtgaagatggtaatgaagccgagttcgacactggtagcgataacgctgaggtggagaccgaaggtgaagccgatgagtttgagccgctgggtgacactccagaagaactgagccaagttactgaacaattaggacagcacgaagaaggctttcaggcgatggtcgagcaggccgttgagcgtggactgagcgcagagtctgtgactcgcatctacgaagagtacgaagccgatggcatctctgagaaatcctacgcggaactcgaagctgctggctatagtcgtgcctttgtggactcctacatctccggtcaggaagcccttgtagaccagtacgtcaatcaggtagttgcctttgctggtggtaaggagcgctttagcgcaatccatacgcaccttgaagcaacaaacccggctgcggctgagtcccttgagactgccatgatgaaccgagacttggcgactgtcaaagcaattatcaatctggctggtgagagttacacgaagaaattcggtaagcctgccaaccgtagtgttaccaagcgtgctactccggttaaaccagtagctcgtcagaaagagggctttacgaatcaggctgagatgattaaagctatgagcgacccgcgctatcgtagcgattctgcctaccgccaaatggtagaacagaaggttatcgactccagtttctaattaaccctcactaaagggagagaccatagatgactacaatggttgaatcacctgagcacagaactttgtggtcactcccgtaggtgaaacattgagaaccaactcgattcaagtagtaaccaaacttttctttaaattaacataaggagattcaacatggctaacattcaaggcggacagcaaattggtactaatcagggtaagggtcagtccgcagcggacaaattggcgctgttcctgaaagtgttcggcggtgaagtcctgacggctttcgctcgcacctccgtgaccatgcctcgtcacatgctgcgctctattgcttctggtaagtccgcacagttccctgtgattggtcgcaccaaagctgcttacctgaaaccgggtgagaacctcgatgacaaacgtaaggatatcaaacacaccgagaaggtaatccacattgatggcctgctgactgcggacgttctgatttacgacattgaggacgcgatgaaccactacgacgttcgcgctgagtacaccgcacagttgggtgaatctctggcgatggcggctgacggtgccgtactggctgaactggctggtctggttaacctgcctgacgcctccaatgagaacatcgagggtctcggtaagcctaccgtactgactctggttaagccgacctctggcgacctgactgacccggttgagctgggtaaagcgattatcgctcagttgaccgttgctcgtgcggctctgaccaagaattacgttccggctgctgaccgtaccttctacaccactcctgataactactctgcgattctggctgccctgatgccgaacgctgcaaactatcaggcattgattgaccctgagcgcggtactatccgtaacgtgatgggcttcgaagtggttgaggttccgcacctgaccgctggtggcgctggtgatacccgtgaggatgccccggctgaccagaagcacgctttcccggcgacttccagcactaccgttaaggttgctctggataacgttgtgggcctgttccagcaccgctctgcggttggtacggtcaaactgaaagacttggctctggagcgcgctcgtcgtgcgaactatcaggctgaccagattatcgctaagtacgcgatgggtcacggcggtctgcgtccagaagctgctggcgctatcgttctcccaaaggtgtcggagtaattcccgaccccactggagttactcttagtcagaagactatgagcttagacgttggggcttctaaagccctgacttctacggtaactccggctgatgcagtacagacagtgacctttacgtcttccaatgcgaagattgccacggtcgatgcctctggtactgtaactgctgtgggcgctggctccgctgacatcactgcgactactgtgaatggcctgacggctgtctgcaaggtcactgtgaaagcagtatagcctcccgtagaaggctaaggtctttaccggggatttactttccttcattactttatgaaccccttgggtgccctctgagggtatctgaggggttttttgctttaaaccctcactaacaggaggtaacatcatgcgctcttatgagatgaacattgagaccgcaggagagctatcagccgtcaacgacattctggcttccatcggtgagccaccagtatcaacccttgagggtgatgcgaatgctgacgttgcgaatgctcgacgtgtactcaataagattaaccgacagattcaatcacgaggatggacattcaatattgaggaaggtgtgactcttctaccggatgcgttctctggcatgataccgtttagctctgactatctgtccgtaatggcaacaagcggtcagacccaatatatcaaccgtggtggctatctctatgaccgctctgcgaagaccgacagattcccttctggtgtgcaggtaaacctgattcgtctgagagagttcgatgagatgcctgagtgcttccgaaactatatcgtcaccaaggcttcccgccagtttaacaaccgcttcttcggtgcgccggaggtagacggagtgttgcaggaagaggaacaggaagcgtggcgtgcgtgcttcgagtacgaactagactacggcaactacaacatgctggatggtgacgcattcacctctggtctacttaaccgctaataacaaggaggctctatggctctcattagtcaatcaatcaagaacctcaagggtggtatcagccaacagccagatattctccggttcgctgaacaaggtagcgtacagattaacggttggtcttctgagtcagagggtctccagaagcgcccaccgatgattcaccttaagacccttggcgctgctgggtatgtgggtgcgcaaccttacgtgcatcttatcaaccgtgatgagttcgagcagtatttcgtggtgttcactggtgaagacattaaggtgttcgacctcgatggtaaggagtaccaagtacgtggagaccgctcatatgttcgtacagctaacccacgagaagaccttaggatggtaactgtggctgattatacctttgtgactaaccgcaaggtggttgtgcagagtaacgaccaatcggtcaaccttccgggctttaaagaccaaggcgatgcactgattaatgttcgtggcggacaatatgggcgtagattatcaatcgagttcaacggggttgagcgtgctgctgtgcaactaccagatggttcacaaccagcacacgttaacgaggtggatggtcaggctatcgctgagaagctggcggtgcagttgcggaataacctagggaacccaaacaatgagcaagacccaaataagtggcggttcaatgttggccccggattcatccatatccttgcgcctaataacgataacgtttggggactacagactaaggatggttacgcagaccagctaatcaaccctgtaacccattacactcagtcgttccagaagttgccgattaatgctccagatgggtacatcgtgaagattgttggtgatacctcaaagactgccgaccagtattacgttaggttcgacctcaaccgtaaggtatgggtagaaacaattggctggaacacaaggactcacctacattaccacacgatgccttgggcgctggtacgtgcttctgatgggaactttgacttcaagtaccttgagtggggtgctcgtactgtgggggacgatacaaccaacccatacccatcctttaccggacagacaatcaatgatattttcttcttccgtaaccgtttaggattccttagtggggagaacatcatcttgtctcgcacctcgaaatacttcaacttcttcccggcctccgtgtcaaactactccgacgatgacccaatcgacgttgctgttagccacaaccgggtgtcaaccttgaagtatgccgttccgttctccgaagagttgctcctgtggtctgaccaagcgcagttcgttctgacagcctctggtatcctttcgagtcgctccgtagagttgaaccttacgactcagttcgacgtacaagacagggcacgcccacatggtgtaggacgtaatgtatactttgcgtcacctcgcgcttccttcacatccattaaccgatactatgcggtacaggatgtaagctctgtgaagaacgcagaggacatgacggctcacgttccgaactacatacctaatggggtatttagtatctcaggcacaactgctgagaacttcgtggctatccttacgagcggtgcgccgaaccgagtgtatatctataagttcctctacattgacgaggaaatcaggcagcagtcatggtctcattgggactttggggacaacgttacggtgtttgcagcacatgtgataaactcaacaatgactgtattgatgggcaatgaacatgctgtgtggatgggacgcttgcacttcacgaagaactccatagacattccgggagagccttacagattatacatcgacgctaagaggaaatacaccatccctgccgggacgtataatgatgatacctaccagacgtccataagcctcgcaacgatttatgggatgaacttcaccaagggtatggtttcggtggtctttcctgatgggaagattgtagagatagacccgccaatcaacgggtggagtagcgacccaatattgagactcgatggaaaccaagagggccaagtggtttacattgggttcaacatcccgttcacttatacgttctcgaagttcctcattaagaagactgctgaggatggctcgacggctaccgaggatattggtcgcttacagcttcggcgtgcgtgggtaaactatgaggattctggcgcgttcaccatccgtgtgaacaacctgtcccgtgagttcatctacacaatggctggcgctcgcttgggttctgacaatctgcgtgttggcaggtcgaacattggcacagggcagtaccgcttcccggttgttggaaacgctcagacgaacatagtaaccatcgagtcagatgcgtcaacaccactgaacatcattgggtgcggctgggaggggaactaccttcgtcgttcttctggcatttaacttaaagtctccctgcggtgaattaaccctcactaaagggagacactaatagatacgaggggttaaagcattatgtacattacaaagtgtttacaaatccatgccgacaactttcagccgtccatagaggacattctggaagctgaggcactaggtgttgaaccaaaggtaattcctgatgagaacactgtggcaatgcttagcgataacgctgtgttggcaattggtggtaatcagggagaccgagtgtggttccttacctctaagtacgtcccactgtttaccttgaaggagcgcttagagtttcgtagacttatcattgaatatcgtgatatgatgctgagccagtatgagtccatttggaatttcgtttgggtaggcaataagtcacacattcgtttcctaaagaccataggtgcggtattccataatgagtttaccgctgatggtcaatttcaattattcactatcagtaggaggtaactatgtgctggatggcagcgattcctatcgccatgatgggtgcccaagctctgagtagccagaacagtgctgacaaggcacgagtggcacagacagaagctggacgccgacaggcaatggagatggtcaaagagacgaatatccagaatgccaacgcctcattggaacaacgagacgcccttgaagctgcatcctctgagttgactacacgtaacatgcagaaggtacaggctatgggaacaatccgtgcagctatcggcgagagtatgctagaaggcgaatcaatgaagcgcatcaagcgtatcgaagagggcaactacattcgggaggcaaatagtgtcaccgagaattaccgccgagactacgctagtatctttgcgcaacagttgggacgcactcagtccacagcaagtcaagtcgatgcaatgtacaagagcgaggccaaaggtaagtccggcctgatgcgtgtactagaccctctgtccattatgggtcaggaagctgcaagtcaatatgcggctggtggatttgacaagaaaggtggaaaccaagcagcacctatcagtgccgccaaaggaaccaagaccgggaggtaataatggctagtaaactaaatagtgttttaggcaacatggcgactcccggtatggaacgactccggggcgtcaaaggtatggactaccgggcagcaaccattcaggctgaacaaccaagagcgagtcttctggactccattggtcgattcgctaaggctggtgccgatatgtacatggcgaaagatgaacgtgataagcaacgagccgatgagcgctccaacgagattatccgtaagctgacccctgagcagcgccgacaggctatccagaatggtacactgctgtatcaggatgacccatacgcaatgcaagccttgaagttcaagaccgggcgtaacgctgcgttcctcgttgacgatgaggttcaacaggccatcaaagagggtcgcttccgtactcgtgaagagatggagcagtatcgtcactcacgcctacaggagcactcgaagtcgttcgctgagcagttcggcatcaatgagatggacgaggaatacctgaagggtttcaacgcgaatatcaccgagcgtaacattgctctgtatggggcacatgataccttcctgagtgaccaagcgcagaagggtgcaatcctgaactcgaaggttgaactcaatggtgtcctgtctgaccctgacctactgtctcgtcctgagtccggtgagttcttccagaactacatcgacaactccttggtgacagggatgaccgacaatcaggctcaacaggttatctcttcgtccctgaatgacgtgctacagcgtccgggtggtgccgccttcttgcagaacattgagaaccgcaaggtaactctaaatggcgctacgactacctatcgtgaactgatgggtgatgaacagtggcaggccatgatgattaaggcacagcacactcaattccagaacaacgcgaagttaacagagaagttccgactggatattaactcagcgcttaaccaagcggacactggtaaaggttgggagactcttcaaggtatcaaggccgaactcgataagattcagccgggtgaagagatgactcctgagcgtgagtggttgatttccgcacaggaacagatgcgcacccgcttcaagcaggaacaagctgagacagccaagctgatggacaagcaacagaagaccctgaataaatctttggtcatcgacaagcagttccagaagcgcctcaacggtgaatacgtctcgaccaactataaggacatgccgaccaacgagaacactggtgagtttacacatagtgatatggtcaactacgcgaaccagaagttagcggaaatcgaggcgatggacttaacgcctgaacagaaagacaaactgaaattggactacctacgggcagactccaaggagggtgctttccgtgcagcgtttggtgagatgattactgatgctggaaacgaatggcaggctgcggtgattaacggcaagatgcctgagagcacaccagcgatggacaaccttcgtcgcatccgcaacactgaccctgacctgattgcctctctgtatcctgacaaggccgagttgttcctgacgatggacatgttggataaccaaggcatcgacacgcaggttcttatcgacgctgataaggcccgcgcacagaagaccaaggagatgcagtttgaggatgaccgagcgtgggccgctatgatgaacgattcaacgaatcctcaaatcaagtacatgccttcgagtgtccaagggtatgccaggaagatttatgattccgtgaagtaccggacagggaaccctgacatggcaaccgaacaggtcgcaaagttcctctccgattcgacgaccacgttctccagtagcgatgttgagggtgatacctacggcgtcctaccgaagaacatcctgactgtttcggatgaccctaagtcgtgggagcaagggaagaacattctggacgaagccattaagggaatcacagcggcgaacccttggattaccaacaagcaactgtcggtgtaccagcaaggtgattcaatctacctgatggacacaaccggacaggttcgcattcggtatgaccaagagttactccagcgtgagtaccagcgtaccgcacagatgcaagctgaggcagcacgagagaaagccctcaaagaggccaacaagcgtgccccaataagccgtgcaacacaggcgcgtgaagaagcgcgtaaacgtgtccaagataaacggaagaagactccgaagtatatctatggacgtaaagaagactaacagtgataaggaggctccatgagctacgataagaacaaacctagcgagttcgatgggttatttcaaaaagcggcagacaatcatggggtctcctatgacctgcttcgtaaattagcattcaacgaatccagctttaatccaaaggccaaatccccaacaggcccgaagggtctcatgcagttcaccaaaggtacagccactgcgcttggcctcaaggttactgacgctgatgacgatgaccgttacaaccctgagttggctgtggatgcagccgctcgtcacctgagtgacctcattcggaagtacgatggggatgaactcaaagctgccttggcgtataatcagggcgaggggcgcaacggtgctccacagatacaggcttatgacaaaggcgattgggcttcaatctctgaggaaggtcgtgactacatgcgtaacctgatggatgtagccaacagtcctcgcaagggggacttggaggcgttcggcggtatcaccccaaaggctaagggcattccatcgggggatgcatttgctggaatcgggaagaagcagacggtaggcactgacctgccggagtccactggattcaaagtggagggtaaagagcagcaagcgcctaacgtgccttatgctaaggacttttgggaaaagactggaacaacactggacgagtttaattctcgttcaaccttcttcggaatcggagatgccacaagtgcagaacttcacaactccgtattgggtgtggcttttcgtgccgctcgtagtgatgacggttttgatttattcaaggacaccattacgccgactcgctggaacagccatacgtggactccagaagagttagagcgtatccgtaaggaggtgaagaacccatcgtacatcaatgtagtcactggaggctctcctgagaatctggacgccctcattaagatggcgaatgacaactacgagatggacgcgcggtctgccgatgcgggtgttggtgccaaacttactgctggtatcgtcggtgctggtgtagacccgctgagttacgtgccgctagtgggtgtagccgggaagggtctcaaggtggctaacaaggctttcattgtcggtactcaaagtgctggcctagctgttgcctctgagggtatccgcacatcaatagctggtggtgaagcacactacgctgatgctgctttaggtggtctcatgttcggtgccggtatgagtgcaatcagtgacgctatcgctgctggtattcgccgttcccgtgggactgaggtcgttaatgacttcgctcctatggcacaccgcttggaagcccgcgagaccgctctgaactctggtggcgaagacctgacccgtatgcctagcgataaccatgtgttcgaccgtgagcacgctggcgttgagtattcacctctggagaccgagccgggtgcagttgtgttgcctcaaggtcaaatcctgagcgacaccaacccactcaaccctcagactcttagcgagttcgaggcggtcaaccctgagcgtgccgctcgtggtatctctttgggtggtttcactgagattggcttgaagactctccgctctgagaacccgactgttcgctccattgcgagtgaccttgtgcgctctccgactggtatggagtccgggacttctggtaagttcggtgcgacagcttctgacattaaggagcgactccacgcgaacaaccagcgcacctacaatcagctttatgatgctgtgcgtactgcaatgaaagaccctgagttctccaccggtggttccaagatgagccgtaaggaaatccgacaggaaatctacaagcgtgcagccttagcgattgagcggcctgagcttcaagcaaatctgacaaagggtgagcggaatgtgatgaacatcctcaagcagcactttgacctcaaacgcgaaatcatggagaacccgtcaatcttcggcaacaccaaggcggtcagtatcttccccggctcacgccacaagggaacctacgtgccaaacgtgtacgaccgcgctataaagattgagatggttaaacgttacggtaatgatggcttgcagcgagcaatcgcggagtcatggttgacgtcttatcgtgctcgtccagaagtcaaggcgagggtcgatgagtacctgatggaacttaacggtctcaaatccgtgcaggaagttacgcctgagatggtgcagaagcacgcgatggataaggcgtatggtatttcacacaccgaccagttctctgcctcctctgtcattgaggataacattgagggtctggtgggtatcgagaacaacaacttcttggaagcccgtaacatgttcgacagtgacatggcggtgactctccctgatggtaacacgttctctgtgaacgacctgcgtacatatgacatggctgaaattctgcctgcatacgaccgacgagtagatggtgatgttgcaatcatgggtggttccggtaagactaccaaagacctgaaagatgaaatcatggcgctggataagcagtcagagggcaacggcacactgaaaggtgaagtggaagccctcaaggataccgtgaagattctaactggtcgtgctcgaaggaacccggaaggcgcttggggcacagccctacgctccgtcaatgaccttacgttcttcgctaagaacgcctacatgggtgcgcagaacatcactgaaatcgctggtatgctggctaaaggtaacgtctctgcgataactcatggcatccctatgattaacgattgggtcaaccgtggtaaaccgcttcgtgcctctgagattaaggagctacacgggatggtgttcggtaaggaactcgaccaactaatccgtccgggacgtgaagaccacgtgcgccgactccgggagtctacggacaccagcgctgcggttgccaatgtggtcggtacgattcgtttcggtactcaagagttggctgcacgctccccttggacaatgctcctaaacggaacatcaaactacattcttgatgctgcccgtcagggtgtgcttggggatgtggctggagcggcccttgctgggaaagcctctaagttcggtaaggcaaactaccttaagtctgcctctatcagccctgagcagtggaatggaatcaagcagttgttcagagactatgcgactcgtggggaagacggtaagttcaccattcgtgacaaacaggctttcgctaacgacccacgctcaatggacttgtggcgtctggctgacaaggtggctgatgagactatactgcgccctcacaaggtttcctcacaggacgccaaagcgttcggtgctggggtcaagatggtgatgcagtttaagaacttcgtcattaagtcactgaactcccggttcgtccgcagcttctatgaggccacgaagaacaaccgagcgttagaccaagcgctgacccacatcgtctctttgggtctagctggtggttactacgttgcgcaggcgcaccttaaggcctcaagtctacaggagcacaaacgtaaggagtaccttaagaacgcccttgaccctaagatgattgctcatgcgtcaatctctcgtagttcacacttaggctcaccattgagtatctacgacatgttcgctgggatggttggtagcgatacctataagtacacacgctctactgtactacctaaagagtccgagaagcgcgaccctaccaaggcagtgacaggtagacaggtggcttcaactatcgcaggtgcagttggtgagcaggttccgggtttaggttttgtgggttctgtgggcgcaacagcaattaacgccgcttccctgctatcttctccaaacaaggctaccgctctggagttccgtacaggactcttcaacacctctcgtgagttgattcctaatgacccgctatcgcagcaactcattatgaaaatctacgaggccaacggtatccgcataaaggagacgccgaagaaacaataaaccctcactaaagggagagaggtcacattctggcctcttctctcttaatgctaatttacaaaggaggtcacatggctacaactattaagaccgtgatgacttacccgctggatggctccactacggacttcaatattccgtttgagtatctggcgcgtaagttcgtcagagtgacccttatcggtgttgaccgaaaggaactcatcttgaatcaagactatcgttttgcgactaagaccacaatctccacaacgagagcgttggggccagcggacggttataacatgattgaaatccgtcgattcacctccgctaccgataggctggttgactttacggatggctcaatcctacgtgcgtatgacctgaacatctcgcaggtacagaccctccacgttgctgaggaagcgcgtgaccttaccgctgatacgattggcgttaacaacgatggtgacttggatgctcgtggtcgtcgtatcgtgaacgttgcggacgctaaagaccccggtgatgcaataactttaggtcaagtctctcgatggaatgagtctgcgctgaactctgcgaaggctgctgctgcatctcaacaggccgctgctgcatctcaacaggccgctaagtcctcagagaacaactcgaaggtatctgaggacaacgcaaagacctccgagaacaacgcgcatcaatgggcgcagcgtacagaggactctccggttcagggtagcgagttctctgcgtatcactactcacggaaggcctccaagagtgccgccgccgcaagtacgtctgaggggaatgcaaagacctctgagaccaacgctaagacctctgagaccaacgctaagacctctgagactaacgctgcatcgagtgctgctaaggcttctgaggaggctgctaagctgactaacatgaatgactttgctgcttctattgattcagtcaacggtaacaatgttgtcatgaagggtgacttaaccattaaaggaaacggtaaagtatcaatactgaaccacagtgggctataccaagataagaccgtgaatggcgtgaactatgccaacaggatttatatggatgatgctgggggcatgcactttgagaactaccgtgtgtctggtacttcagtcaccttacgtgctggttttgttattacagataccaacaggtttgactttacagggccaacgcgagttaagggtgatatcaccgcatatgtggatgcgccacctaatccagccatcggtcaatacctcaattctgtggcagttcgctcacagcttcggggccgtggtgctaagaatgatccacttggtgcgtactgtggtatgtatattcaggagcacgttggtacagaccacgcgataatccttaacctcaatggttatagcaaggatactaactggcagctattctccaatggtaaaatatctacaccacttggtgatgtgatgacctcaggttctgatgttagaatcaaggatgatatcactaaacctcttgatggtgctggtgagcgtattgacgcaattggcatagtggaatacacagagattaccaccggggaacgtaaacgtgggtggctggcccaacagcttgacacgattgacccgctgtacacatacctcacgaccaccgcagaaggtagtcttttgaataccaacgacagggcgttgcttgctgacgtaatcactgagattcaggcactgcgtcaacgcgttaaagaactcgaaggacaatcaacaaagccagaggacggcacaacataaggagaacaagaatgttatcttttgacttcaataacgaggtcgttaaggctgcgcctattgttggcacaggggtcgctgatggggcggcccgactcttttggggactatcgttaaacgagtggttctacgttgcagctatcgcctacacagtggttcagattggtgccaaggtagtcgataagatgattgactggaaacgtgcaaataaggagtaacccatgagcgacaagactttaatcaagctgctggagatgctggacacggagatggcacagcgtatgcttgctgacctccagagcgaggagcgccgaacgccgcagctttacaacgcaatcggcaaactgttagaccgccataagttccaaatcagtaagctgaccccggatgagaacatccttggtggtctcgcggctggtctggaagactacaacaaagtggtcggccctaatggtctgactgacgatgagactatcacgctacagtaagtgacatactcaaggttctccacgtggggagcctttatggatgttatttggtgcatctacgtgaagtctaaaattgatgggaggtgttatgctaaaacttttacgcagcgcactcccttgggtactcgccgggacactctttatgggtggctggcacttagggtcaacccatgagagagcaaactggaaggaggtaatccaaaatgaatacattgcgaaaacaaaagcaaccgcagcaactcaggcagaggtcagtcgggtatcccgtgagtaccaagaagagattgcagccattgagggcagcactgataggatgcttaatgacctgcgtagtaataataagcggctgtcagtccgcatcaagacccttaccggactaccagaagataacggtagatgcgagtttaatggtcgagccgaactacacgagtcagatgctaagcgtattatcggaataacccaagctgctgatgctcacgtaagagcgctccagcgtactattaaggagatgcagaatgagcgacacccaagcaaaccgtaatgcgctaatcattgcgcagcttaagggtgacttcgtggccttcctgttcgtattgtggaaggctttggctctcccgccgccgactaagtgtcagatagatatggcccggtgtctggctaacggagacaacaagaagtttatcctacaggctttccgtggtattggtaagtcattcatcacctgtgcgttcgttgtgtggacgttatggcgtgaccctcagttgaagatactaattgtctctgcatccaaagaacgtgcggacgctaactccatcttcatcaagaacatcattgacctgctgcccttcttggctgagctaaagcctcgccccggtcagcgtgactctgtgattagtttcgatgttggccctgccaagcctgaccactctccgtctgtgaagtcggtgggtatcactggtcagttgactggtagccgtgctgatatcatcatagcggatgacgttgagattccgtctaactccgcaactcaaggtgcccgtgagaagctgtggactctggtgcaggaatttgctgcgcttctgaaaccgctgccgacttctcgcgttatctaccttggcacgcctcaaaccgaaatgaccttgtacaaggaactcgaagataaccgtgggtacaccacaatcatctggcctgcgctctatccgcgtagccgtgaggaagacttgtactatggcgaccgtctggccccgatgctccgcgaagagttcaacgatgggttcgagatgctccaaggtcaaccgactgaccccgtgcgcttcgatatggaagacctccgggagcgtgagttggaatatggtaaggctggcttcactttgcagttcatgctcaacccgaacctgagtgatgccgagaagtaccccttacgcctccgtgacgctatcgtgtgcggtctggacttcgagaaagccccaatgcattaccagtggcttccgaaccgtcagaatcgcaatgaagagcttcctaacgtgggccttaagggtgatgatattcatagctatcattcgtgcagccagaacactggacagtaccagcaacgcatcctcgtgattgacccaagtggtcgcggtaaggatgagacaggttacgcagtgttgttcaccctgaatggctacatctatctgatggaagctggcgggttccgcgatggttattccgataagacccttgagtccctcgctaagaaagcgaagcagtggaaggttcagacagtggtcttcgagagtaacttcggggatggtatgtttggtaaggtattcagccctgtgctcctgaaacaccatgcagcgcaacttgaagagattcgtgctcgtggtatgaaggaactacgcatttgtgatacgctggagcctgtactctctacgcaccgccttgtgattcgtgacgaggtgattcgtgaggactaccagactgcccgtgacgctgatggcaagcatgatgttcgctattcgctgttctaccagttgacccgtatggcccgtgagaagggcgctgtggcccatgacgaccgacttgatgcattagcattgggtgtggagttcttacgctctacgatggaactggacgccgtgaaggtggaagctgaggtgcttgaggcgttcttagaggaacacatggagcacccaatccattcggctggtcatgtagttacctctatggttgacggtatggaactctattgggaggatgacgatgtgaatagcaacaggttcattgactggtagttatgcatattgagtgcataaggaatcattgagaccacggatggtcactttaagaaattccttaagaatcaatgagtttgaattaaccctcactaaagggagagaggggacttaaagctactatataggttagtcattcaggttatgcaatgaccctttatgcactttaagtctcctctatgattggtgatattatcattgtataatcaccctaccttagagcaactgaaaggaggtggctcaatgttacgcttgctgattgccctgctgcgtcatagagtcacttggcgatttcttctggtacttactgctgcccttgggtacgcaggtcttaatgaccacctcggtcaactggaagtggccttttgctctatactctcttgtggggattaaattattgttgatgaacgacaagcggctctgagggattcgtaggtatagtttcactacaccaactcatccctgtagagtcaaccctaaaggttatacctaaagatgccctgtagttcgtaatggtcttacagggtcttctggtgtctcctagctatcccttcgggatgcgcctatggtctcacctatggtgtggccttacctaaagtgggttcctaaagagaccctttaagaatttactacaaaaatctgaatgggtatctcacagttcaagaacccaaagtaccccccatagccctcttaaagccacctaaagccagccctacccctagggtttaaccttcggttaaccttgagtgtagcgataactcactacggtatctactcgagtggcctataggatagcctaaagtgttgcctaaagtcaatatctaaagtggtggatggcttaatgagggcttaaagagtgtcctagtgtaccagttcaatagtacatctctatgtgtccctatctgttagcctcctaaagtaaaccctaaagccatcacctaaagccatcacctaaagagcgccgctatcttaaagacaaccagaccgatagacccactgttagcctgtagtgatgccttgtagttgcctatggtgtctatcgtcaattcaattaccctcactaaagggaataagggaataagggatacttaaaggggaattagggatttaataaaagattaaaattaatggttgactttaagtaacccttaaggctattattcatctcgtcaacgggacaacggccttaaagccactccctgagataccggagtcaaccggataagtagacagcctgataagtcatacgaaaaacaggcattgacaacatgaagtaaacgcagtaagatacacagcgtcaaccggacacaaggtgtcttctaggtgacttaagcgcaccacggcacataaagtgaaacaaaacggttgacaacatgaagtaaacacggtacgatgtaccacgaaatgacggaacagtgaggcgggacactgaaagccgctagggtctaacgaaaccagaccgacacgctctttaacaatctggataatagctcttgagtgtaccgatgtataagcgaataactcaaggtcgcactaaaagcgtggcctttatgatattcacttaacatgaactaacatgaggtaacaccaaatgattttcactaaagagcctgctaacgtcttctatgtactggtgtcagctttccgttccaacctcgacgatgaggtgaacatgagtcgccaccgccacatggtaagcactttacgtgccgcaccgggtctttatggctccgttgagtcaaccgatttgaccgggtgctatcgtgaggcaatcgcaagcgcaccgactgaggaaaaaacggttcgtgtacgctgcaaggacaaggcgcaggcactcaatgttgcacgcttagcttgtaatgagtgggagcaagattgcgtactggtatacaaatcacagactcacacggctggtctggtgtacgctaaaggtatcgacggttacaaggctgaacgtctgccgggtagcttccaagaagtgcctaaaggcgcaccactgcaaggctgctttacgattgacgagttcggtcgccgctggcaagtacgataagtgttaaactcaaggtcgcacgctgagtgtggcctttatgattaccactaaataaccctgagaggatatgactatgaaacaatacgccatccttattcccggctggtgctactcaatgacctgctacgggtacaacgaaagggacgctcgtgcccgattcagggatcaacaaggcttcggcaagcgtttacctaatggtacggctgtatgggaggttatgtaatgagtaagttactggcaacatccaaaatagcaggccagtgcaccgtaacactgcgtgagtattaccacgggtcaatgggaagcacctacgttgtgcggtatggtaaacaggtcacacattgggtaaacccgattttagcacaagaggattatcaagcctgtgtggtacaccaagcaacatgtgcgggctggaatgattgataacgcgctttgcaatcactggacaacaggcttcaagtctatcaggtggtaaactcaaggtcgctccatgcgagtggcctttatgattaacattacgatagaggatgagagtatgggatacgaagacacgaagaacctgataattctctgtatagcaatacccgctgcaatcaactttgtgtacgaggtatggattaagaaatgattatcgcactaatcgcactggtctatctatgcatcgcaatgtactttatgcgagactttaagcgcggtctggcaatacacaaggcaacgctgagttactttaagtggggattcatcccacggtttacggttcgtgaacgtaacggacgctttaaagccaacaaggtaggagtattctacattgctacgcactaactcaaagcacgtaaagattgcactgtatgcgatggcttatggtgcatcgaaacgcaaggtcaaacgcatcttaacgagacaccgcaagatgaccgcacgacaggctgcaagcgctgtcaaatgggctgaatttactctttactcttcttacagataacaggacactgaacgatgactttcaccgaagcacaagccgcactcgaagctatccgcaacctaccgattgagcgcctgaacgaacgccagccaatgctggtggctcttgcggctgctatcgtgaacgatgagactcaggacggcgaactgacgcaggcagcaggaaacacgtcgctcgaagatatggactactggcagacactggctgagcgtatgcgtgatgttggatttgtacgcttgggtaacggtcactttagcgcagcatatgagcacgcactgttaccgggcaaggtcatcaaggtaggctttaagaaagaggactcaggcgcagcctatgcagccttctgccgtatgaatcagggtcgggagggtatccctacggtgtacgacattcagcgtcatgcaggctgctacacggtggtcttggactatctgacaccgcttaacgattggtgctacggtgaaagcgataagattcgccaccacttccgcgctgcaagggaaatcattgaggaggattgcttcaataccgccgaagagtacccgataagtgacgggttcattgagacctgcaaggatatccgcaagttcttcctaggcattgcatcgttcgattgtcacagcggtaacatgatgaaagaccaaatgggccgcttgattatcacagacccggtatcgttcagcgcagacaacaagttaaagccgggtgagtttcactgtgacccggatgaactaatcgctgagattgaggcgctgagggcgcaggaagcgattgaccgctgtaaggcacgcaaggcacgccgtgaccctaaaggaacctttcaggtagcacgtaaagcccgtgcaaaatggcgcagaaaggcctctaagcgtgctaaacgtgacgctaaggtactcgctaagatgcgcatggacgccaatcagaatcgcagggatgagcctagggcgcgtatggtgtggggcgataagcactggcgcaacgcttgggtgcaccacaataacctaaactttgcagaactggagcgcctcgctgctgcggcaatgatgatgcacgacgaggtgcgcattcagtggggcaaaccgttacacatagacgcgtaccttgacaggagactgcaaggctgatagagtcttttcttacaggtcatcacgaggtggcctgaataggaacgatttattcacaacgaggtaagcaatgaacatcatcgaaactatcgaaaagaatgacttctccgaaatcgaactggctgctatcccgttcaacacactggcagaccactacggtagcgcactggctcgtgaacaactggctttagagcatgagtcttatgagctaggcgagcgccgcttcctcaagatgcttgagcgtcaagcgaaagctggtgagattgcagacaacgcagccgctaagccattactcgctacgcttctccctaagttaaccgcacgtatcgtagagtggctcgaagagtacgcatcgaagaaaggccgcaagcccgtagcctatgcaccgctccagttactcaagccggaagcctccgcgtttatcaccctgaaagttatccttgcgtcactgaccagcacgaacatgacaaccattcaggccgctgctggtatgctagggaaggccattgaggatgaggcacgtttcggtcgcatccgtgacctcgaagcgaagcacttcaagaagcacgttgaggaacagcttaacaagcgccacgggcaagtctacaagaaagcctttatgcaggtggtcgaggccgatatgattggtcgcggtctgcttggtggtgaggcgtggtctagctgggataaagaaaccacgatgcacgtagggattcgcctgattgaaatgctgattgaatccacgggtctggtggaattacagcgccacaacgcaggtaacgcaggctctgaccatgaggcactacaactggcccaagagtacgtggacgtattagcgaagcgtgcaggcgctctggcgggtatctctccgatgttccagccatgtgtcgtaccgccgaaaccttgggtagcaatcaccgggggcggctattgggctaacggtcgcagacctttggcactcgttcgcactcactctaagaagggcttgatgcgctacgaagacgtttacatgccagaagtctacaaggctgtgaacatcgcgcaaaacaccgcatggaaaatcaacaagaaagttcttacggttgtcaatgagattgttaactggaagaattgcccggtcgcagacattccatcgctggagcgccaagagttaccgcctaagccggacgacattgacaccaacgaggcagcactcaaggagtggaagaaagccgccgctggtatctaccgcttggacaaggcacgagtgtctcgccgtatcagcttagagttcatgctggagcaggccaacaagttcgcaagcaagaaagcaatatggttcccttacaacatggactggcgcggtcgtgtgtacgctgtgccgatgttcaacccacaaggcaacgacatgacgaaaggtctgttgaccctcgctaaaggcaagccaatcggtgaggaaggtttctactggctgaaaatccacggtgcgaactgtgcgggtgtcgataaggttcctttccctgagcgcatcgcgttcattgagaagcacgtagacgacattctggcttgcgctaaagacccaatcaataacacttggtgggccgagcaggattcacctttctgtttcctcgcgttctgcttcgagtatgcaggcgttgcgcaccacggtctgagctacaactgctctctgccgctggcgttcgacgggtcttgctctggtatccagcacttctccgcgatgctccgcgatgaggtaggtggtcgtgcggttaacctgctgccaagcgaaaccgtgcaggacatttacggcatcgttgcacagaaagtaaacgagattctcaaacaggatgcaatcaacggcacacctaacgagatgattaccgttaccgacaaggacaccggggaaatctcagagaagctcaagctgggaacctcaacgctggcgcaacagtggctggcatatggtgtaacccgtagcgtaactaaacgttcggtcatgacgctggcttacggctccaaggagttcggctttcgtcaacaggtactggacgacaccattcagcctgcgattgacagcggtaagggcttgatgttcacccaacctaaccaagcggctggttatatggctaagctgatttgggacgcggtgagcgtgaccgtagtcgcagcggttgaggcgatgaactggctcaagtctgccgctaagctgctggctgctgaggtcaaggacaagaagaccaaggagattctgcgccaccgttgcgcggttcactggactacgccggacggcttcccggtctggcaggaataccgcaagccactccagaagcgtcttgatatgattttcttagggcaattccgtctgcaaccgacgattaataccctcaaggattcaggcattgacgcacacaagcaggagtccggcatcgcacctaactttgttcactcacaggatggtagtcacctccgcatgacagtcgtttatgctcacgagaagtatggtattgagtcctttgcgctcatccatgacagctttggtactattccggcagacgctggtaagctctttaaggctgtgcgtgaaacgatggttatcacctatgagaacaacgatgtgctggcagacttctactctcagtttgcagaccagctacacgagacccaactggacaagatgccaccgcttccgaagaaaggaaacctgaacctgcaagacattctcaagtctgactttgcctttgcataacaagcacttagcattaaccctcactaacgggagactacttaaggtctccctctttaagacactttaggtactaagagattaaatttatgattaacattaagactttctttaagaacatctttaagttaaaccgcttgacttccgttaagttctacgcttggatgcccggtagtgatgacctccgcaagaccgaatttaagttaggcttagggccgtgcggtaaggtggtcacgaagttggaatgttactcaacgtcctccgggatggtcatcttccagaccactgaggacaacgaaacgaaatcattctactacccgaagggttcaacgtgtggtcgtatcgaacggacatacagttaaccctcactaacgggagagttaaacttaaggtcatcaccggcggtggcctttgtgattaactttcaatacacatcaacatgaggtaagatactatgcgtaccaactttgagaaatttaccaagcgcgattcagtggtcaacgagcatggcgaacagtggcaagagcgccgtgaccgcatgaagaaacgccacaagcaacagcgcggtaactcacagaaacgggagtggaactaatgatgggacgtatctatagcggcaacctgaacgattacaaagatgcggtagcgcgtctacaggaagaccatgacgtgaccgtgaaggtggagtcattcagctatgaaaacccagcgaagatgtgcaggtcatccggtgaggttctccgcgtgttcacacgctcagggcatccggtggcatccagaaccttcgagcatagcgacagcgatgtacaaatcaacgcgcagactgcatggctccgtaaggttcacagcgatttgaaacactggaagtaataaccctcactaaagggagaacgaaaggaggaaacattatgagaatttcatttgacttaatgagtccttcctttctctcatgggatacgggtcgtcacactggcggctctattcgcaacggctatagaagggttcgttatgaaggtaagtggttaaaccatcacatactcatttgggaacacttcaacggtgcagtcccggagggaatggaagtagaccacattgaccgtaacaaacttaacaacgcgcctagtaaccttagacttgtgacccgctctgagaacaacagaaatcggtcagtacaccggaacaacaagtcaggaatcaaaggtgtctactggcacaaacaccgccaagtttggtacggtcagtgtcgaagaggcaacaaaacatttatcaccgctggttgctccacgaaggaacaggcggcagaacttttagagaaactcaaagaggaaattaattatgatgattttcaaaaccgtcccgtataaggctgtgtcattcgtagagtctgccgttaagaaagcgctggagacctccggctacctgattgctgacattaagtacgatggtgtgcgcggtaacattgtggttgacaacgtggctgaggccgcatggctgtctcgcgtatccaagttcatcccggcgctggaacacctgaacggtttcgataagcgctggcagcaactactgaacgatgaccgctgcatcttcccggatggcttcatgctggatggcgaactgatggtcaaaggtgtagacttcaacaccgggtctggcctgctgcgtaccaagtggctcaagaagaacaacttcatgtttgaccgtggtggtgttgagccgctgaaaggttccaaagtagcctttgagttagaccccaagctactcagtgttcgcctgtatgcggtcatgccgattcacattgcggagtctggcgaggactacgatgtacagaacctgctgatgccgtatcatgtggaagccatgcgctctcttctggttgaatacttcccggaaatcgagtggcttatcgctgagacctacgaggtctacgatatggattcgctgactgaactgtacgaagagaagcgtgccgaaggtcacgagggtctcattgtgaaagacccgcagggcatctataagcgaggcaagaagtctggctggtggaagctcaagcctgagtgtgaagctgatggtatcattcagggtgtcaattggggaaccgaaggtttagccaacgagggcaaagtgattggctttagtgtgcttcttgagactggtcgtttagtagacgccaacaacatctctcgcgcactgatggacgagttcacagccaacgttaaggcacacggtgaagacttctacaatgggtgggcctgtcaggtcaactacatggaagagactccagatggctccctgcgtcaccctagcttcgagaagttccgaggcactgaggacaaccctcaagagaaaatgtaaccaactcactggctcaccttaacgggtgggcctttcttcgttcagcggtattaaccctcactaacaggagacacacacaccatgtggcttatcctattcgctatcgtcgcaacgctgggattaatggctgccgacgacaacatttggcctgattgttaaggagataacatcatgcgtttacatttcaacaaatccaacggtatcttttcggttcgccgtaaagaccgctcgaccgtattggcctctgagcgcaacgccaagctgccgctgattggttcggtcgccacgctatcaccttgtgttcacctgctgattactcgtggtgagttcgtcaaggcgatgaacaaagagcgtcctcatctggaagccgtggtcacttactggcctcgcattcgtctgttcgttaagtggattaaggaggtgctgtaatgctgcaacatcattggaacaaaccagacttagaggctcgcttcccggttaactctgtggtgcgatactccggcggtggcctcaagcgcatcttagggatgagcggagtggtaactggtcactcgcacacaggtcgcgtcaaggttcgcttcggtactcagcacgctgaggttctcccgaacaacctgattccgctaccgaaagctggcgttaagactccgaacgtggaagcaccgaagacagaagtcaagtctgatgttacccatccgaaccactacatgttgttcgacaacgtggaagccattgaggttatcgcccggtcaatgaccgtcgaggcgttccgtgggtactgcttagggaacatccttaagtatcgcctacgtgctggcaagaagtccgaactggcaactatggagaaagacctcaagaaagctgcattctatcaggaactctttgacaaacaccgggggctgtgttatgacgcttcgtgaatgttgcgattggtgtgccgctaagtggaaccaagctatcgaggatggtgacaaggcgtctgctgacgcttaccaacaactgtacgcgctgtgggagcggcgctttaaggaggccaataaatgagccaatgtaacaacgggtgcaagtatgcgaaggacgtagggatggagaaccactcctgcgcaaatcgctgcatgtactcagaacagaaataccttctgacaatggaaggtaacaccgagtcctttgagattccggtattcgcccggtctcttgaagaggcaacgctacaggctgaacattacgaggacgcagggttcgtagttactcgaatccgtccagaagtgaaagcctaattaccctcactaaagggaacaacccaaactatcaaccaaaggagaaatactatggctggtttcaagaagaaaatctacacatctggtcttggcactgctgagccttatgcttacctgagtaagccggattatggcaacgaagagcgtggcttcggcaaccctcgcggtatctataaggtagacctgactctttccaataaagacccgcgctgtcaggcgatggtcgatgaaatcgtgaagactcacgaagaggcttatgctgctgccgtggaagagttcgaagctaacccgccgcaggtacagcgtggtaagaaaccactgaaaccttacgagggcgacatgccgttcttcgataacggtgacggtacgactaccttcaagttcaaatgctatgcgtctttccaagataagaagaccaaagagaccaaacacatcaatctggtcgtggtcgatagcaagggcaagaagattcaggacgttccgattatcggtggaggctccaagctgaaagtgaaatactctctggtgccttacaagtggaacacagctgtgggtgcaagcgttaagctgcaactggagtccgtgatgctggtcgaactggctaccttcggtggtggcggtgaagatgagtgggccgatgaagtcgaagatggtggttacactgcgagtgaatcccgtcagtcccgcgatgagcaggagtggcaggaagacgagcacgaagaaaccccggatgatgacgaggacttctaatggctggcgcatacgctgcgcgaggtgtacgcaaggtcggagcattccgttccggcctagaagataaagtctcaaagcagcttgagagtaagggaattaagttcgactatgaactttggcgtatcccttacgtcatccctgcgagtgaccacttatacactccagacttcctgctacctaacggtatcttcattgagaccaaagggctgtgggattccgatgaccgcaagaaacaccttttgattcgtgagcaacaccccgaactggacatacgcttggtcttctcaagcagccgctcaaagctctacaagggtagcccaacaagctacggtgagtggtgcgagaagcatggcattctgtttgctgacaagctgataccggtggcgtggctcaaagaacccaagaaggaggttccgttcgataaatttcagactaagaaaggagtaaagaaaaatggctaaagttcaattcaaaccacgagcaaccacggaggcaatctttgtgcattgctcagcaaccaagccaagccagaacattggcgttcgtgagattcgtcagtggcacaaagagcagggatggttagacgtaggttatcacttcatcatcaagcgtgatggtactgtggaagcaggccgcgatgaactggctgtaggttcccacgttaaaggttacaaccacaactccgtaggcgtatgcctcgtgggtgggattgatgataaaggcaagttcgacgccaactttacacctgcgcaaatgcaagcgctgcgtagtctgctggtcacgctgctggcgaagtatgagggttcagtccttcgtgctcaccatgacgttgcacccaaagcctgcccgtccttcgacttgaagcgctggtgggagaagaacgaactggttacatctgaccgagggtgataccatgaggatgatttgtattcgctgtgataagccgttgaagagtcgcgtaccgtcacgtcagtgtcagtgcaaagacccaatcaaggctgaggaacacaccgaggaataattaacactcactaaagggatagtcgaaaggccgtccctttgttctcgaaggaggctaaaatatgaacaaaccatacaagcagttctatcaggctccgcgaagacacattcaagtgtgggtagcagctaatgggcctatcccggaagggtattacatagaccacattgacggcaatcctcttaacgatgacctgtccaatctccgtctcgctcttccgaaggagaactcccggaacgccaaaacatccaaagcaaacaagtccggcctcaagggtctctcatggagggacgataggcagtcgtggcgtggtgctgtgatggcagacggtaagcaatacacaaccaccagcaaggacttacttgaggtagtagcgtggatttacagaactaggagagaacttcatggacaattcgctagattcagatagcatatttctctatcacatcccatgcgaaaactgtgggagcagtgatgcaaactcgctgttctccgatggtcatacttattgttacgcctgcgagaactggacgcccggtgacggtgagagacctgagcgggaacgtagacaatcaaatgggagaaagcctatgagctatgacgtatggaatttcggcgacagcaacggtcgatactctgacctgactgcccgtggcatctcgaaggagacatgccaaaaggctggctactggctggcgaaagtggacaaccgaatgtatcaggttgcggattaccgtgaccagaatggttccatcgtgtcacagaaggtgcgcgataaggacaagaactttaagaccactggaagtcacaagagcgatgcgttattcttgaagcacctctggtctggcggtaagaaaattgtggtcactgagggcgaaattgatgcgctcactgtgatggaactccaagactgtaagtacccggtcgtatcattgggtcacggtgcctctgctgctaagaagacatgcgccgctaactatgaatactttgaccagttcgagcagattatcttgatgttcgacatggatgacgcaggccgtaaggcagtcgaagaggccgcacaggttctcccggctggtaaggttcgtgttgccgtgttaccgtgtaaggacgccaacgagtgtcacatcatgggtgaagacaaagcaatcttggagcagatctggaacgcgaacccttgggtgcctgatggtgttgtctctgcgttgtcactcaaagaccgcgttaaggaagctatgacctccgaggacgctgtgggtctgctgttcgatggctgtcaaggcctgaacgatagaaccttgggtgcccgtggaggcgaagtcattatggtcacttccggttccggtatgggtaagtcaacgttcgttcgtcaacaggcgctggcttggggcaagcgaatgggtaaacgtgttggcctagcgatgctggaggaatccgttgaggataccattcaggatatgatgggtctgaacaataaggttcgtctgcgtcagtctgatgaagtcaagaaggctatagcagaggacggacgtttcgatgaatggtatgacgaactatttggagacgatacgttccacctttatgactcctttgcggaggccgaagctgacagactgttagcgaagctggcctacatgcgaacaggcttagggtgtgatgttatagtgctcgaccacatctcaatcgtcgtgtctgcctctgaggaatcggatgagcgtaagatgattgaccgcctcatgactaagctaaaagggttcgctaagtcaactggtgttgtgctcgtagtgatttgtcacttgaagaacccggagaagggaaaaccacatgaagaaggacgcgctgtttctattactgacctacgtggtagcggtgcgctgcgtcagttatctgatactatcatcgccttggagcgtaaccagcaaggtgatatgcctaacttggtgttggttcgcctgcttaagtgtcgtttcactggcgacactggaattgctggatacatggaatacaacagagaaaccgggtggcttgaaccgtctagctacactggcgaagaaggagaaggagatactggctggactgaacaagacggacaatcagacttctaaataccagtgccactgcggtcatccagactgtgatggcggaatgtataattgattaaccctcactaacgggaacaacctcaaaccataggagacacaccatgtttaaattcattaacgctttaggtaagctggtagttaaactgtacttcgtcgaagccaagaagctggacaagaaggccaaagctgattcacagcgagccattgagttggcgaaacagtcccgtgagaaatccgatgcggctgttagtggcatccacaagtcggcagcgattgcagccaaagcacaatccatgagcaaattctttgagtaaggagcacaccatgagcaagtcaatcactcacgcaaacaccatccgtctgccggacaccgctgaccagttcgctcgtcgagtacatattaatgtgcgcggtgagaaggtaacgatggtctaccgctggaaagaccacaagtctccgaaagcacacactcaacgcatgaccttgactgacaagcaggtaggccgcctgatgggtgccctgactatggctgctgacaaggtggtcggtgataaccgtgagcgtctggtagagttcggcgctggtatgcaagagattatcgagaagtgataaactcaaggtcgcccaagggtggcctttatgattatcatttatcctgaaatgaaaggagggcattatgctcgtaagtgacattgaggccaacaacctcttagagaaagtcaccaagtttcactgtggcgttatctatgactaccgcgatggtgagtatcatagttatcgtccgggcgacttcggggcgtatctggatgcgctggaagccgaggtgaagcgaggtgggcttattgttttccataacggtcacaagtatgacgttccggctttagagaaactagcaaagctgcaactcaatcgtgacttcaagttaccccgtgagaattgtattgacacattggtactctcgcgtttacttcatgcgaaccttaaagacacagacatggggcttcttcgttccgggaaactacccggtcgtcgcttcgggtctcacgccctggaggcatggggttatcgcttgggcgagatgaaaggtgaatataaggacgacttcaaggctatgctagaagagcagggcgaagaatatgttgatggtgctgagtgggtttcgttcaacgagccgatgatggcttataacgttcaagacgttgtggtcactgtcaagctcttagagaaattccttacagacctccactacttccctgcgggtatggacttcacgaagtacgatgcggatttattctggcgagaagctggcgagtctgtggatattgaacatcgtgcagcgtggctgttagcgaagcaggagcgtaacggcttcccgttcaacacacaggccattgaggaactttatgtagaactggcagcgaaacgcgccgaacttctgcgaaagttaaccgaaacgtttggctcgtggtatcaaccgaaaggtggtaaggaactcttcaagcacccacggacaggcaagccgctgccgagttatcctcgcgtggtctatccgaaacagggtggcgtgtacaagaagcctcgtaataaggcacagcgcgaaggtcttgaaccttgcgacttggacacgagggattacatggaaggtgctccatatactccggtcgagttcgttacgttcaagccaagtagccgtgaccacattcagaagaaactacaggaggccggatgggttcctgagaagttcaccgagaagggtgcgcctgtggtggacgatgaggtcttggagcatgtacgagtggatgaccctgagaagcaggcgtgcattgacttgattaaagagtacctgatgattcagaagcgaatcggtcaggcggcagaaggtgacaaggcgtggttacgttatgttcaagatgatggtaagattcacggagccgttaaccctaacggtgcagttactggtcgtgctactcatagtttcccaaaccttgcacagatacccggtgttcgttctccttacggggagcagtgtcgtagtgcttttggtgctgaacatcatttggatgggattactggcaagccgtgggtgcaagcggggatagacgccagtggcttagagttgcgctgtctggcacacttcatggctcgcttcgacaacggagagtatgcgaatgagattctcaacggtgacattcacaccaagaaccagaacgctgcggaactcccgacacgcgacaacgccaagactttcatttacgggttcctttacggagcaggagatgagaagattggtcagattgttggggcagggaaggagcgcgggaaggaactcaagaagaaattcttagagaacaccccggcgattgcagcattgcgagaagctatccaacagtctctcgttaagtcttccgcttggattggcggtgagcagaaagtccagtggaaacgccgttggattaaaggtctggatggtcgcaaggttcacgtcaggtctccacatgcagcgctcaacacattgttgcagtctgctggtgctctgatttgtaagctgtggattattaagaccgaagagatgctcattgagaaaggcttgaagcatggctgggatggtgactttgcgtacatggcttgggttcacgatgagattcaggtggcctgccgtaccgagcacatcgctcagattgttattgacaccgcgcaggaagctatgcgttgggtcggagagcattgggctttccgttgtcgtttagataccgaaggtaagatggggccaaattgggccgtctgccactaacagtaggagaaacattatggcaatgaccaaacactttaaagtaaccttcgacgttactgctgtgattgacagtgaatccgagaagaatctgaacgagttgctggtagacctagctaagaaggccgggtctggcgagaagctgaatccgttcaaacaagaactgcttattcaaggtctgacacacgggccggaaggtgcggctgcgttctgcatcaagcaaggtctccgtgagtttatccgcgatggtcacagtgagttaagctctaccgagcagaagcggatgaaattctcacctgcaactgtgcgggaggtgttcaaatgagtgaatacctgaaagtgcttgcagctatcaagggttgccctaagtcctttcagtcgaactatgtgcgaaacaatgcggctctcgtagctgaggccgcgtctcgtggacacattagctgtttgactgttggtggtcgtaatggtggagcgtgggaggtcacatccgctggtgtgcgcttcctgaaacgaatgggaggttgtgtatgattatgccaaagagtgacaccgtaacgatgactcgtgatgcgtggaatgatgttagcgcgtacattgataagctggagaaagacctagagttcctgaatgctcttaaggcgtgtggtgtggataattgggacggatactctgatgcaatcgagatggtttacggggaggaagacctatgagtttgattaccctcaaagacttcgctgagatgcgtgaaggtaaaccgatggagaagggcgtgctggtcatggatggtgactggctggtgtatcagtcgatggctgctgccgaagttgagacggattggggcgatgacatttggactctggagtgtgaccacgctaaggcgcggagcattctggattctgcaatcgaatcgtaccgaacccgtaagaaagcatggcgtgacgctacggttgtgctggcgtttaccgacgatgtgaactggcgcaaggaacttgtagacccgacttacaaggagaaccgcaaggcgacccgtaaacctgtgggctaccgtgacttccttcaagctctgtgggagcgcgatgagttcattcacatcaaagaggacatgcttgaaggtgatgacgttatgggcatcattgggtctggtcacgaggtcttcggcttcaagaaggctgtgttggtctcctgtgataaggacttcaagactatcccggacgttgacttcctgtggtgtaccactggtaacatcttgacgcagaccaaagagaccgctgattggtggcatctcttccagaccatcaagggtgatatgactgatggctactccgggattcccggctggggcgatacggcagaaggtttcctgaatgacccgttcattgtggagcctgtagagtccgtgttgaagtccggtaagaacaaggggcagacagtaaccaagtgggtgaagcgtgctcctgatgcgactgagacgttgtgggactgcattaaatccattggtgccaaagctgggatgaccgagcaggaaatcatcaagcagggccagatggctcgcattcttcgcttcgaggaatacaattacattgacaaggagatttacctatggacgccgcgaagctgattaccgtcgctgtgctggtaggtatgctggcgcgaggtctctggatgctcgctctcatagtccgagacgtgaagcgagactccgagattaagtgataaactcaaggctctctgtattaaccctcactaaagggaagagggagcctttatgattattactttaagacttaaccttaagaggtgaaattatgttacaaccaattaatcatgttttaactcatcccgatgatattcctagtatgcctcgtgcagctaaagagtatctacaggtgcgcttcaatcagacctatgtgatggagtccggggagtaccgtgcgctacgcgctgctggatactctgagtctttcattgctggtgtgatgcatggtctgtaccttgcctctcgaacacttgatgagattgaggtgcgtaaagagcaactgagacaggagtaattatatgtgctggaaaccgaaggtgaaagtccccaagatggacactaaccagattcgcgctgctgaaccagcacctttgactgagccacctaaatctgtggtatggggaggcgatgatgatgaggacaccagcgtgtcttcctctgaggttccaaccacacagagcagcggtaagagcagtcttaaggtaaagctggatgacaacgcagccaagaacaagagtaaatcctccattcgctccaaggcgtttgggtaactgtgacataacataggggacacattatgggattcctcaagaaaatcaagaaagccgttaagaaagttgtgaaggaagttagcagaccagtcgagaaggcaggtaaggaagtcggtaaagccgttggcggtgcgctgggtgcaggtaagcaggagattatccaacaagaggctccagtaccagtagtgactgcgccacctccagcacagattgtagatgtacctgaacaggataaggctgagggtgaggatggggcacaaaccgagagcgcacgtaagaaggcccgcgctggcggtaagaaggcacttagcgtagcccgtagctccggcggtggcattaacatctaaggaggactgaatggctgattcaaaacgtacaggcttgggcgaagacggtgctaaagctacctatgaccgcctaacgaacgaccgtagagcctatgagactcgtgcggaaaactgtgcgcaatacaccattccgtccttgttcccgaaggagtccgataacgaatctaccgactacacgactccgtggcaggctgtaggtgcgcggggtcttaacaatctggcctctaagttaatgcttgcgttattcccgatgcagtcgtggatgaagctgaccattagcgaatatgaggcgaagcagcttgttggagaccctgatggactcgctaaggtggacgaaggtctgtctatggttgagcgtattatcatgaattatatcgaatccaacagctaccgtgtgacgctctttgagtgcctcaagcagttgatcgtggcaggtaatgcactgctttacttaccggaacccgaaggtagctacaatccgatgaagctgtaccgattgtcttcttatgttgtccaaagagacgcatacggcaatgtgttacagattgtcactcgtgaccagatagcctttggtgctctcccggaagacgttcggtctgcggtagagaaagctggtggtgagaagaagatggacgaaatggtcgatgtgtacacccatgtgtatctcgatgaagagtccggcgattacctcaagtacgaggaagtagaggacgttgagattgatggctccgatgccacatatccgactgacgctatgccctacattccggttcgcatggttcgcattgatggcgagtcttatggtcgctcctactgtgaagaatacttaggtgacttaaggtcgcttgagaatctccaagaggctatcgttaagatgagcatgattagtgctaaggtcatcggtctggtcaaccccgctggtattacacaaccgcgtcgattaaccaaggctcagactggcgacttcgttccgggtcgtcgagaagatattgacttcctgcaactggagaagcaagctgactttaccgtagcgaaagctgtgagtgaccagatagaagcacgcttatcgtatgcctttatgttgaactctgcggtacaacgcactggtgaac

SEQ ID NO: 28 - DNA, 39030 bp, Unknown
  source: /note="Description of Unknown: KP2-8a Bacteriophage Sequence"
catcatatcacgatattcaatgataagtctacgaaactctaagcgctccttcaaggtaaacagtgggacgtacttagaggtaaggaaccacactcggtctccctgattaccaccaattgccaacacagcgttatcgctaagcattgccacagtgttctcatcaggaattacctttggttcaacacctagtgcctcagcttccagaatgtcctctatggacggctgaaagttgtcggcatggatttgtaaacactttgtaatgtacataatgctttaacccctcgtatctattagtgtctccctttagtgagggttaattcaccgcagggagactttaagttaaatgccagaagaacgacgaaggtagttcccctcccagccgcacccaatgatgttcagtggtgttgacgcatctgactcgatggttactatgttcgtctgagcgtttccaacaaccgggaagcggtactgccctgtgccaatgttcgacctgccaacacgcagattgtcagaacccaagcgagcgccagccattgtgtagatgaactcacgggacaggttgttcacacggatggtgaacgcgccagaatcctcatagtttacccacgcacgccgaagctgtaagcgaccaatatcctcggtagccgtcgagccatcctcagcagtcttcttaatgaggaacttcgagaacgtataagtgaacgggatgttgaacccaatgtaaaccacttggccctcttggtttccatcgagtctcaatattgggtcgctactccacccgttgattggcgggtctatctctacaatcttcccatcaggaaagaccaccgaaaccatacccttggtgaagttcatcccataaatcgttgcgaggcttatggacgtctggtaggtatcatcattatacgtcccggcagggatggtgtatttcctcttagcgtcgatgtataatctgtaaggctctcccggaatgtctatggagttcttcgtgaagtgcaagcgtcccatccacacagcatgttcattgcccatcaatacagtcattgttgagtttatcacatgtgctgcaaacaccgtaacgttgtccccaaagtcccaatgagaccatgactgctgcctgatttcctcgtcaatgtagaggaacttatagatatacactcggttcggcgcaccgctcgtaaggatagccacgaagttctcagcagttgtgcctgagatactaaataccccattaggtatgtagttcggaacgtgagccgtcatgtcctctgcgttcttcacagagcttacatcctgtaccgcatagtatcggttaatggatgtgaaggaagcgcgaggtgacgcaaagtatacattacgtcctacaccatgtgggcgtgccctgtcttgtacgtcgaactgagtcgtaaggttcaactctacggagcgactcgaaaggataccagaggctgtcagaacgaactgcgcttggtcagaccacaggagcaactcttcggagaacggaacggcatacttcaaggttgacacccggttgtggctaacagcaacgtcgattgggtcatcgtcggagtagtttgacacggaggccgggaagaagttgaagtatttcgaggtgcgagacaagatgatgttctccccactaaggaatcctaaacggttacggaagaagaaaatatcattgattgtctgtccggtaaaggatgggtatgggttggttgtatcgtcccccacagtacgagcaccccactcaaggtacttgaagtcaaagttcccatcagaagcacgtaccagcgcccaaggcatcgtgtggtaatgtaggtgagtccttgtgttccagccaattgtttctacccataccttacggttgaggtcgaacctaacgtaatactggtcggcagtctttgaggtatcaccaacaatcttcacgatgtacccatctggagcattaatcggcaacttctggaacgactgagtgtaatgggttacagggttgattagctggtctgcgtaaccatccttagtctgtagtccccaaacgttatcgttattaggcgcaaggatatggatgaatccggggccaacattgaaccgccacttatttgggtcttgctcattgtttgggttccctaggttattccgcaactgcaccgccagcttctcagcgatagcctgaccatccacctcgttaacgtgtgctggttgtgaaccatctggtagttgcacagcagcacgctcaaccccgttgaactcgattgataatctacgcccatattgtccgccacgaacattaatcagtgcatcgccttggtctttaaagcccggaaggttgaccgattggtcgttactctgcacaaccaccttgcggttagtcacaaaggtataatcagccacagttaccatcctaaggtcttctcgtgggttagctgtacgaacatatgagcggtctccacgtacttggtactccttaccatcgaggtcgaacaccttaatgtcttcaccagtgaacaccacgaaatactgctcgaactcatcacggttgataagatgcacgtaaggttgcgcacccacatacccagcagcgccaagggtcttaaggtgaatcatcggtgggcgcttctggagaccctctgactcagaagaccaaccgttaatctgtacgctaccttgttcagcgaaccggagaatatctggctgttggctgataccacccttgaggttcttgattgattgactaatgagagccatagagcctccttgttattagcggttaagtagaccagaggtgaatgcgtcaccatccagcatgttgtagttgccgtagtctagttcgtactcgaagcacgcacgccacgcttcctgttcctcttcctgcaacactccgtctacctccggcgcaccgaagaagcggttgttaaactggcgggaagccttggtgacgatatagtttcggaagcactcaggcatctcatcgaactctctcagacgaatcaggtttacctgcacaccagaagggaatctgtcggtcttcgcagagcggtcatagagatagccaccacggttgatatattgggtctgaccgcttgttgccattacggacagatagtcagagctaaacggtatcatgccagagaacgcatccggtagaagagtcacaccttcctcaatattgaatgtccatcctcgtgattgaatctgtcggttaatcttattgagtacacgtcgagcattcgcaacgtcagcattcgcatcaccctcaagggttgatactggtggctcaccgatggaagccagaatgtcgttgacggctgatagctctcctgcggtctcaatgttcatctcataagagcgcatgatgttacctcctgttagtgagggtttaaagcaaaaaacccctcagataccctcagagggcacccaaggggttcataaagtaatgaaggaaagtaaatccccggtaaagaccttagccttctacgggaggctatactgctttcacagtgaccttgcagacagccgtcaggccattcacagtagtcgcagtgatgtcagcggagccagcgcccacagcagttacagtaccagaggcatcgaccgtggcaatcttcgcattggaagacgtaaaggtcactgtctgtactgcatcagccggagttaccgtagaagtcagggctttagaagccccaacgtctaagctcatagtcttctgactaagagtaactccagtggggtcgggaattactccgacacctttgggagaacgatagcgccagcagcttctggacgcagaccgccgtgacccatcgcgtacttagcgataatctggtcagcctgatagttcgcacgacgagcgcgctccagagccaagtctttcagtttgaccgtaccaaccgcagagcggtgctggaacaggcccacaacgttatccagagcaaccttaacggtagtgctggaagtcgccgggaaagcgtgcttctggtcagccggggcatcctcacgggtatcaccagcgccaccagcggtcaggtgcggaacctcaaccacttcgaagcccatcacgttacggatagtaccgcgctcagggtcaatcaatgcctgatagtttgcagcgttcggcatcagggcagccagaatcgcagagtagttatcaggagtggtgtagaaggtacggtcagcagccggaacgtaattcttggtcagagccgcacgagcaacggtcaactgagcgataatcgctttacccagctcaaccgggtcagtcaggtcgccagaggtcggcttaaccagagtcagtacggtaggcttaccgagaccctcgatgttctcattggaggcgtcaggcaggttaaccagaccagccagttcagccagtacggcaccgtcagccgccatcgccagagattcacccaactgtgcggtgtactcagcgcgaacgtcgtagtggttcatcgcgtcctcaatgtcgtaaatcagaacgtccgcagtcagcaggccatcaatgtggattaccttctcggtgtgtttgatatccttacgtttgtcatcgaggttctcacccggtttcaggtaagcagctttggtgcgaccaatcacagggaactgtgcggacttaccagaagcaatagagcgcagcatgtgacgaggcatggtcacggaggtgcgagcgaaagccgtcaggacttcaccgccgaacactttcaggaacagcgccaatttgtccgctgcggactgacccttaccctgattagtaccaatttgctgtccgccttgaatgttagccatgttgaatctccttatgttaatttaaagaaaagtttggttactacttgaatcgagttggttctcaatgtttcacctacgggagtgaccacaaagttctgtgctcaggtgattcaaccattgtagtcatctatggtctctccctttagtgagggttaattagaaactggagtcgataaccttctgttctaccatttggcggtaggcagaatcgctacgatagcgcgggtcgctcatagctttaatcatctcagcctgattcgtaaagccctctttctgacgagctactggtttaaccggagtagcacgcttggtaacactacggttggcaggcttaccgaatttcttcgtgtaactctcaccagccagattgataattgctttgacagtcgccaagtctcggttcatcatggcagtctcaagggactcagccgcagccgggtttgttgcttcaaggtgcgtatggattgcgctaaagcgctccttaccaccagcaaaggcaactacctgattgacgtactggtctacaagggcttcctgaccggagatgtaggagtccacaaaggcacgactatagccagcagcttcgagttccgcgtaggatttctcagagatgccatcggcttcgtactcttcgtagatgcgagtcacagactctgcgctcagtccacgctcaacggcctgctcgaccatcgcctgaaagccttcttcgtgctgtcctaattgttcagtaacttggctcagttcttctggagtgtcacccagcggctcaaactcatcggcttcaccttcggtctccacctcagcgttatcgctaccagtgtcgaactcggcttcattaccatcttcactgatacgaacctgaatgcggccctcatcgtcttcaccatcagcgaacgggtctacaccggatgcatatgggtcatcgttatgggaactcggttcctcgctaagtacgattgcatcatcgccgtcacgggcagcaacatcgagactaagcatattctgttcgtgttcagtaggtgtgcttccggtcattaccgcgttgttcacaccgaaggacgcataaacgtctgcattagattcagccattgttaaatctcctaagttgttaaagataaagggaaaccaaaggactccaacctttagtcatcgctcatttcaaagatgaggtctccctttagtgagggttattaggtggcgtctaggccagcctgtgctgctgcaccctgcatagcttctggacttgaggtcgctagagcaccaacaccagccccaccagcggcggcagcgttctcgatacctgtttgggccgcatcctgcatcatcagtgcttgcttctgctcgtccgtcagtaggataccagaagtatcaataccaatggcgttagcaatgcgcagcttaatgacagcaaggttaatgtccgggtctccctgcataggggccagagcagcccaagcggagatacagcgctccagcttatcgaggtcttgaccacgaccgattgcttccagacctgtactgatagtaggctcaacggcttctttcggtagctcaggaatctgcgaggttgcttggagttgcttcaagagcacacgaaccagaggcaattgcagttcttgagacagaatcgaatagacgccaccaagcgtatcttccagttctgacgcaacgtatcgaatctcttcggcggtcacacgttcaccagtgcgttgtaccgcagagttcaacataaaggcatacgataagcgtgcttctatctggtcactcacagctttcgctacggtaaagtcagcttgcttctccagttgcaggaagtcaatatcttctcgacgacccggaacgaagtcgccagtctgagccttggttaatcgacgcggttgtgtaataccagcggggttgaccagaccgatgaccttagcactaatcatgctcatcttaacgatagcctcttggagattctcaagcgaccttaagtcacctaagtattcttcacagtaggagcgaccataagactcgccatcaatgcgaaccatgcgaaccggaatgtagggcatagcgtcagtcggatatgtggcatcggagccatcaatctcaacgtcctctacttcctcgtacttgaggtaatcgccggactcttcatcgagatacacatgggtgtacacatcgaccatttcgtccatcttcttctcaccaccagctttctctaccgcagaccgaacgtcttccgggagagcaccaaaggctatctggtcacgagtgacaatctgtaacacattgccgtatgcgtctctttggacaacataagaagacaatcggtacagcttcatcggattgtagctaccttcgggttccggtaagtaaagcagtgcattacctgccacgatcaactgcttgaggcactcaaagagcgtcacacggtagctgttggattcgatataattcatgataatacgctcaaccatagacagaccttcgtccaccttagcgagtccatcagggtctccaacaagctgcttcgcctcatattcgctaatggtcagcttcatccacgactgcatcgggaataacgcaagcattaacttagaggccagattgttaagaccccgcgcacctacagcctgccacggagtcgtgtagtcggtagattcgttatcggactccttcgggaacaaggacggaatggtgtattgcgcacagttttccgcacgagtctcataggctctacggtcgttcgttaggcggtcataggtagctttagcaccgtcttcgcccaagcctgtacgttttgaatcagccattcagtcctccttagatgttaatgccaccgccggagctacgggctacgctaagtgccttcttaccgccagcgcgggccttcttacgtgcgctctcggtttgtgccccatcctcaccctcagccttatcctgttcaggtacatctacaatctgtgctggaggtggcgcagtcactactggtactggagcctcttgttggataatctcctgcttacctgcacccagcgcaccgccaacggctttaccgacttccttacctgccttctcgactggtctgctaacttccttcacaactttcttaacggctttcttgattttcttgaggaatcccataatgtgtcccctatgttatgtcacagttacccaaacgccttggagcgaatggaggatttactcttgttcttggctgcgttgtcatccagctttaccttaagactgctcttaccgctgctctgtgtggttggaacctcagaggaagacacgctggtgtcctcatcatcatcgcctccccataccacagatttaggtggctcagtcaaaggtgctggttcagcagcgcgaatctggttagtgtccatcttggggactttcaccttcggtttccagcacatataattactcctgtctcagttgctctttacgcacctcaatctcatcaagtgttcgagaggcaaggtacagaccatgcatcacaccagcaatgaaagactcagagtatccagcagcgcgtagcgcacggtactccccggactccatcacataggtctgattgaagcgcacctgtagatactctttagctgcacgaggcatactaggaatatcatcgggatgagttaaaacatgattaattggttgtaacataatttcacctcttaaggttaagtcttaaagtaataatcataaaggctccctcttccctttagtgagggttaatacagagagccttgagtttatcacttaatctcggagtctcgcttcacgtctcggactatgagagcgagcatccagagacctcgcgccagcatacctaccagcacagcgacggtaatcagcttcgcggcgtccataggtaaatctccttgtcaatgtaattgtattcctcgaagcgaagaatgcgagccatctggccctgcttgatgatttcctgctcggtcatcccagctttggcaccaatggatttaatgcagtcccacaacgtctcagtcgcatcaggagcacgcttcacccacttggttactgtctgccccttgttcttaccggacttcaacacggactctacaggctccacaatgaacgggtcattcaggaaaccttctgccgtatcgccccagccgggaatcccggagtagccatcagtcatatcacccttgatggtctggaagagatgccaccaatcagcggtctctttggtctgcgtcaagatgttaccagtggtacaccacaggaagtcaacgtccgggatagtcttgaagtccttatcacaggagaccaacacagccttcttgaagccgaagacctcgtgaccagacccaatgatgcccataacgtcatcaccttcaagcatgtcctctttgatgtgaatgaactcatcgcgctcccacagagcttgaaggaagtcacggtagcccacaggtttacgggtcgccttgcggttctccttgtaagtcgggtctacaagttccttgcgccagttcacatcgtcggtaaacgccagcacaaccgtagcgtcacgccatgctttcttacgggttcggtacgattcgattgcagaatccagaatgctccgcgccttagcgtggtcacactccagagtccaaatgtcatcgccccaatccgtctcaacttcggcagcagccatcgactgatacaccagccagtcaccatccatgaccagcacgcccttctccatcggtttaccttcacgcatctcagcgaagtctttgagggtaatcaaactcataggtcttcctccccgtaaaccatctcgattgcatcagagtatccgtcccaattatccacaccacacgccttaagagcattcaggaactctaggtctttctccagcttatcaatgtacgcgctaacatcattccacgcatcacgagtcatcgttacggtgtcactctttggcataatcatacacaacctcccattcgtttcaggaagcgcacaccagcggatgtgacctcccacgctccaccattacgaccaccaacagtcaaacagctaatgtgtccacgagacgcggcctcagctacgagagccgcattgtttcgcacatagttcgactgaaaggacttagggcaacccttgatagctgcaagcactttcaggtattcactcatttgaacacctcccgcacagttgcaggtgagaatttcatccgcttctgctcggtagagcttaactcactgtgaccatcgcggataaactcacggagaccttgcttgatgcagaacgcagccgcaccttccggcccgtgtgtcagaccttgaataagcagttcttgtttgaacggattcagcttctcgccagacccggccttcttagctaggtctaccagcaactcgttcagattcttctcggattcactgtcaatcacagcagtaacgtcgaaggttactttaaagtgtttggtcattgccataatgtttctcctactgttagtggcagacggcccaatttggccccatcttaccttcggtatctaaacgacaacggaaagcccaatgctctccgacccaacgcatagcttcctgcgcggtgtcaataacaatctgagcgatgtgctcggtacggcaggccacctgaatctcatcgtgaacccaagccatgtacgcaaagtcaccatcccagccatgcttcaagcctttctcaatgagcatctcttcggtcttaataatccacagcttacaaatcagagcaccagcagactgcaacaatgtgttgagcgctgcatgtggagacctgacgtgaaccttgcgaccatccagacctttaatccaacggcgtttccactggactttctgctcaccgccaatccaagcggaagacttaacgagagactgttggatagcttctcgcaatgctgcaatcgccggggtgttctctaagaatttcttcttgagttccttcccgcgctccttccctgccccaacaatctgaccaatcttctcatctcctgctccgtaaaggaacccgtaaatgaaagtcttggcgttgtcgcgtgtcgggagttccgcagcgttctggttcttggtgtgaatgtcaccgttgagaatctcattcgcatactctccgttgtcgaagcgagccatgaagtgtgccagacagcgcaactctaagccactggcgtctatccccgcttgcacccacggcttgccagtaatcccatccaaatgatgttcagcaccaaaagcactacgacactgctccccgtaaggagaacgaacaccgggtatctgtgcaaggtttgggaaactatgagtagcacgaccagtaactgcaccgttagggttaacggctccgtgaatcttaccatcatcttgaacataacgtaaccacgccttgtcaccttctgccgcctgaccgattcgcttctgaatcatcaggtactctttaatcaagtcaatgcacgcctgcttctcagggtcatccactcgtacatgctccaagacctcatcgtccaccacaggcgcacccttctcggtgaacttctcaggaacccatccggcctcctgtagtttcttctgaatgtggtcacggctacttggcttgaacgtaacgaactcgaccggagtatatggagcaccttccatgtaatccctcgtgtccaagtcgcaaggttcaagaccttcgcgctgtgccttattacgaggcttcttgtacacgccaccctgtttcggatagaccacgcgaggataactcggcagcggcttgcctgtccgtgggtgcttgaagagttccttaccacctttcggttgataccacgagccaaacgtttcggttaactttcgcagaagttcggcgcgtttcgctgccagttctacataaagttcctcaatggcctgtgtgttgaacgggaagccgttacgctcctgcttcgctaacagccacgctgcacgatgttcaatatccacagactcgccagcttctcgccagaataaatccgcatcgtacttcgtgaagtccatacccgcagggaagtagtggaggtctgtaaggaatttctctaagagcttgacagtgaccacaacgtcttgaacgttataagccatcatcggctcgttgaacgaaacccactcagcaccatcaacatattcttcgccctgctcttctagcatagccttgaagtcgtccttatattcacctttcatctcgcccaagcgataaccccatgcctccagggcgtgagacccgaagcgacgaccgggtagtttcccggaacgaagaagccccatgtctgtgtctttaaggttcgcatgaagtaaacgcgagagtaccaatgtgtcaatacaattctcacggggtaacttgaagtcacgattgagttgcagctttgctagtttctctaaagccggaacgtcatacttgtgaccgttatggaaaacaataagcccacctcgcttcacctcggcttccagcgcatccagatacgccccgaagtcgcccggacgataactatgatactcaccatcgcggtagtcatagataacgccacagtgaaacttggtgactttctctaagaggttgttggcctcaatgtcacttacgagcataatgccctcctttcatttcaggataaatgataatcataaaggccacccttgggcgaccttgagtttatcacttctcgataatctcttgcataccagcgccgaactctaccagacgctcacggttatcaccgaccaccttgtcagcagccatagtcagggcacccatcaggcggcctacctgcttgtcagtcaaggtcatgcgttgagtgtgtgctttcggagacttgtggtctttccagcggtagaccatcgttaccttctcaccgcgcacattaatatgtactcgacgagcgaactggtcagcggtgtccggcagacggatggtgtttgcgtgagtgattgacttgctcatggtgtgctccttactcaaagaatttgctcatggattgtgctttggctgcaatcgctgccgacttgtggatgccactaacagccgcatcggatttctcacgggactgtttcgccaactcaatggctcgctgtgaatcagctttggccttcttgtccagcttcttggcttcgacgaagtacagtttaactaccagcttacctaaagcgttaatgaatttaaacatggtgtgtctcctatggtttgaggttgttcccgttagtgagggttaatcaattatacattccgccatcacagtctggatgaccgcagtggcactggtatttagaagtctgattgtccgtcttgttcagtccagccagtatctccttctccttcttcgccagtgtagctagacggttcaagccacccggtttctctgttgtattccatgtatccagcaattccagtgtcgccagtgaaacgacacttaagcaggcgaaccaacaccaagttaggcatatcaccttgctggttacgctccaaggcgatgatagtatcagataactgacgcagcgcaccgctaccacgtaggtcagtaatagaaacagcgcgtccttcttcatgtggttttcccttctccgggttcttcaagtgacaaatcactacgagcacaacaccagttgacttagcgaacccttttagcttagtcatgaggcggtcaatcatcttacgctcatccgattcctcagaggcagacacgacgattgagatgtggtcgagcactataacatcacaccctaagcctgttcgcatgtaggccagcttcgctaacagtctgtcagcttcggcctccgcaaaggagtcataaaggtggaacgtatcgtctccaaatagttcgtcataccattcatcgaaacgtccgtcctctgctatagccttcttgacttcatcagactgacgcagacgaaccttattgttcagacccatcatatcctgaatggtatcctcaacggattcctccagcatcgctaggccaacacgtttacccattcgcttgccccaagccagcgcctgttgacgaacgaacgttgacttacccataccggaaccggaagtgaccataatgacttcgcctccacgggcacccaaggttctatcgttcaggccttgacagccatcgaacagcagacccacagcgtcctcggaggtcatagcttccttaacgcggtctttgagtgacaacgcagagacaacaccatcaggcacccaagggttcgcgttccagatctgctccaagattgctttgtcttcacccatgatgtgacactcgttggcgtccttacacggtaacacggcaacacgaaccttaccagccgggagaacctgtgcggcctcttcgactgccttacggcctgcgtcatccatgtcgaacatcaagataatctgctcgaactggtcaaagtattcatagttagcggcgcatgtcttcttagcagcagaggcaccgtgacccaatgatacgaccgggtacttacagtcttggagttccatcacagtgagcgcatcaatttcgccctcagtgaccacaattttcttaccgccagaccagaggtgcttcaagaataacgcatcgctcttgtgacttccagtggtcttaaagttcttgtccttatcgcgcaccttctgtgacacgatggaaccattctggtcacggtaatccgcaacctgatacattcggttgtccactttcgccagccagtagccagccttttggcatgtctccttcgagatgccacgggcagtcaggtcagagtatcgaccgttgctgtcgccgaaattccatacgtcatagctcataggctttctcccatttgattgtctacgttcccgctcaggtctctcaccgtcaccgggcgtccagttctcgcaggcgtaacaataagtatgaccatcggagaacagcgagtttgcatcactgctcccacagttttcgcatgggatgtgatagagaaatatgctatctgaatctagcgaattgtccatgaagttctctcctagttctgtaaatccacgctactacctcaagtaagtccttgctggtggttgtgtattgcttaccgtctgccatcacagcaccacgccacgactgcctatcgtccctccatgagagacccttgaggccggacttgtttgctttggatgttttggcgttccgggagttctccttcggaagagcgagacggagattggacaggtcatcgttaagaggattgccgtcaatgtggtctatgtaatacccttccgggataggcccattagctgctacccacacttgaatgtgtcttcgcggagcctgatagaactgcttgtatggtttgttcatattttagcctccttcgagaacaaagggacggcctttcgactatccctttagtgagtgttaattattcctcggtgtgttcctcagccttgattgggtctttgcactgacactgacgtgacggtacgcgactcttcaacggcttatcacagcgaatacaaatcatcctcatggtatcaccctcggtcagatgtaaccagttcgttcttctcccaccagcgcttcaagtcgaaggacgggcaggctttgggtgcaacgtcatggtgagcacgaaggactgaaccctcatacttcgccagcagcgtgaccagcagactacgcagcgcttgcatttgcgcaggtgtaaagttggcgtcgaacttgcctttatcatcaatcccacccacgaggcatacgcctacggagttgtggttgtaacctttaacgtgggaacctacagccagttcatcgcggcctgcttccacagtaccatcacgcttgatgatgaagtgataacctacgtctaaccatccctgctctttgtgccactgacgaatctcacgaacgccaatgttctggcttggcttggttgctgagcaatgcacaaagattgcctccgtggttgctcgtggtttgaattgaactttagccatttttctttactcctttcttagtctgaaatttatcgaacggaacctccttcttgggttctttgagccacgccaccggtatcagcttgtcagcaaacagaatgccatgcttctcgcaccactcaccgtagcttgttgggctacccttgtagagctttgagcggctgcttgagaagaccaagcgtatgtccagttcggggtgttgctcacgaatcaaaaggtgtttcttgcggtcatcggaatcccacagccctttggtctcaatgaagataccgttaggtagcaggaagtctggagtgtataagtggtcactcgcagggatgacgtaagggatacgccaaagttcatagtcgaacttaattcccttactctcaagctgctttgagactttatcttctaggccggaacggaatgctccgaccttgcgtacacctcgcgcagcgtatgcgccagccattagaagtcctcgtcatcatccggggtttcttcgtgctcgtcttcctgccactcctgctcatcgcgggactgacgggattcactcgcagtgtaaccaccatcttcgacttcatcggcccactcatcttcaccgccaccaccgaaggtagccagttcgaccagcatcacggactccagttgcagcttaacgcttgcacccacagctgtgttccacttgtaaggcaccagagagtatttcactttcagcttggagcctccaccgataatcggaacgtcctgaatcttcttgcccttgctatcgaccacgaccagattgatgtgtttggtctctttggtcttcttatcttggaaagacgcatagcatttgaacttgaaggtagtcgtaccgtcaccgttatcgaagaacggcatgtcgccctcgtaaggtttcagtggtttcttaccacgctgtacctgcggcgggttagcttcgaactcttccacggcagcagcataagcctcttcgtgagtcttcacgatttcatcgaccatcgcctgacagcgcgggtctttattggaaagagtcaggtctaccttatagataccgcgagggttgccgaagccacgctcttcgttgccataatccggcttactcaggtaagcataaggctcagcagtgccaagaccagatgtgtagattttcttcttgaaaccagccatagtatttctcctttggttgatagtttgggttgttccctttagtgagggtaattaggctttcacttctggacggattcgagtaactacgaaccctgcgtcctcgtaatgttcagcctgtagcgttgcctcttcaagagaccgggcgaataccggaatctcaaaggactcggtgttaccttccattgtcagaaggtatttctgttctgagtacatgcagcgatttgcgcaggagtggttctccatccctacgtccttcgcatacttgcacccgttgttacattggctcatttattggcctccttaaagcgccgctcccacagcgcgtacagttgttggtaagcgtcagcagacgccttgtcaccatcctcgatagcttggttccacttagcggcacaccaatcgcaacattcacgaagcgtcataacacagcccccggtgtttgtcaaagagttcctgatagaatgcagctttcttgaggtctttctccatagttgccagttcggacttcttgccagcacgtaggcgatacttaaggatgttccctaagcagtacccacggaacgcctcgacggtcattgaccgggcgataacctcaatggcttccacgttgtcgaacaacatgtagtggttcggatgggtaacatcagacttgacttctgtcttcggtgcttccacgttcggagtcttaacgccagctttcggtagcggaatcaggttgttcgggagaacctcagcgtgctgagtaccgaagcgaaccttgacgcgacctgtgtgcgagtgaccagttaccactccgctcatccctaagatgcgcttgaggccaccgccggagtatcgcaccacagagttaaccgggaagcgagcctctaagtctggtttgttccaatgatgttgcagcattacagcacctccttaatccacttaacgaacagacgaatgcgaggccagtaagtgaccacggcttccagatgaggacgctctttgttcatcgccttgacgaactcaccacgagtaatcagcaggtgaacacaaggtgatagcgtggcgaccgaaccaatcagcggcagcttggcgttgcgctcagaggccaatacggtcgagcggtctttacggcgaaccgaaaagataccgttggatttgttgaaatgtaaacgcatgatgttatctccttaacaatcaggccaaatgttgtcgtcggcagccattaatcccagcgttgcgacgatagcgaataggataagccacatggtgtgtgtgtctcctgttagtgagggttaataccgctgaacgaagaaaggcccacccgttaaggtgagccagtgagttggttacattttctcttgagggttgtcctcagtgcctcggaacttctcgaagctagggtgacgcagggagccatctggagtctcttccatgtagttgacctgacaggcccacccattgtagaagtcttcaccgtgtgccttaacgttggctgtgaactcgtccatcagtgcgcgagagatgttgttggcgtctactaaacgaccagtctcaagaagcacactaaagccaatcactttgccctcgttggctaaaccttcggttccccaattgacaccctgaatgataccatcagcttcacactcaggcttgagcttccaccagccagacttcttgcctcgcttatagatgccctgcgggtctttcacaatgagaccctcgtgaccttcggcacgcttctcttcgtacagttcagtcagcgaatccatatcgtagacctcgtaggtctcagcgataagccactcgatttccgggaagtattcaaccagaagagagcgcatggcttccacatgatacggcatcagcaggttctgtacatcgtagtcctcgccagactccgcaatgtgaatcggcatgaccgcatacaggcgaacactgagtagcttggggtctaactcaaaggctactttggaacctttcagcggctcaacaccaccacggtcaaacatgaagttgttcttcttgagccacttggtacgcagcaggccagacccggtgttgaagtctacacctttgaccatcagttcgccatccagcatgaagccatccgggaagatgcagcggtcatcgttcagtagttgctgccagcgcttatcgaaaccgttcaggtgttccagcgccgggatgaacttggatacgcgagacagccatgcggcctcagccacgttgtcaaccacaatgttaccgcgcacaccatcgtacttaatgtcagcaatcaggtagccggaggtctccagcgctttcttaacggcagactctacgaatgacacagccttatacgggacggttttgaaaatcatcataattaatttcctctttgagtttctctaaaagttctgccgcctgttccttcgtggagcaaccagcggtgataaatgttttgttgcctcttcgacactgaccgtaccaaacttggcggtgtttgtgccagtagacacctttgattcctgacttgttgttccggtgtactgaccgatttctgttgttctcagagcgggtcacaagtctaaggttactaggcgcgttgttaagtttgttacggtcaatgtggtctacttccattccctccgggactgcaccgttgaagtgttcccaaatgagtatgtgatggtttaaccacttaccttcataacgaacccttctatagccgttgcgaatagagccgccagtgtgacgacccgtatcccatgagagaaaggaaggactcattaagtcaaatgaaattctcataatgtttcctcctttcgttctccctttagtgagggttattacttccagtgtttcaaatcgctgtgaaccttacggagccatgcagtctgcgcgttgatttgtacatcgctgtcgctatgctcgaaggttctggatgccaccggatgccctgagcgtgtgaacacgcggagaacctcaccggatgacctgcacatcttcgctgggttttcatagctgaatgactccaccttcacggtcacgtcatggtcttcctgtagacgcgctaccgcatctttgtaatcgttcaggttgccgctatagatacgtcccatcattagttccactcccgtttctgtgagttaccgcgctgttgcttgtggcgtttcttcatgcggtcacggcgctcttgccactgttcgccatgctcgttgaccactgaatcgcgcttggtaaatttctcaaagttggtacgcatagtatcttacctcatgttgatgtgtattgaaagttaatcacaaaggccaccgccggtgatgaccttaagtttaactctcccgttagtgagggttaactgtatgtccgttcgatacgaccacacgttgaacccttcgggtagtagaatgatttcgtttcgttgtcctcagtggtctggaagatgaccatcccggaggacgttgagtaacattccaacttcgtgaccaccttaccgcacggccctaagcctaacttaaattcggtcttgcggaggtcatcactaccgggcatccaagcgtagaacttaacggaagtcaagcggtttaacttaaagatgttcttaaagaaagtcttaatgttaatcataaatttaatctcttagtacctaaagtgtcttaaagagggagaccttaagtagtctcccgttagtgagggttaatgctaagtgcttgttatgcaaaggcaaagtcagacttgagaatgtcttgcaggttcaggtttcctttcttcggaagcggtggcatcttgtccagttgggtctcgtgtagctggtctgcaaactgagagtagaagtctgccagcacatcgttgttctcataggtgataaccatcgtttcacgcacagccttaaagagcttaccagcgtctgccggaatagtaccaaagctgtcatggatgagcgcaaaggactcaataccatacttctcgtgagcataaacgactgtcatgcggaggtgactaccatcctgtgagtgaacaaagttaggtgcgatgccggactcctgcttgtgtgcgtcaatgcctgaatccttgagggtattaatcgtcggttgcagacggaattgccctaagaaaatcatatcaagacgcttctggagtggcttgcggtattcctgccagaccgggaagccgtccggcgtagtccagtgaaccgcgcaacggtggcgcagaatctccttggtcttcttgtccttgacctcagcagccagcagcttagcggcagacttgagccagttcatcgcctcaaccgctgcgactacggtcacgctcaccgcgtcccaaatcagcttagccatataaccagccgcttggttaggttgggtgaacatcaagcccttaccgctgtcaatcgcaggctgaatggtgtcgtccagtacctgttgacgaaagccgaactccttggagccgtaagccagcgtcatgaccgaacgtttagttacgctacgggttacaccatatgccagccactgttgcgccagcgttgaggttcccagcttgagcttctctgagatttccccggtgtccttgtcggtaacggtaatcatctcgttaggtgtgccgttgattgcatcctgtttgagaatctcgtttactttctgtgcaacgatgccgtaaatgtcctgcacggtttcgcttggcagcaggttaaccgcacgaccacctacctcatcgcggagcatcgcggagaagtgctggataccagagcaagacccgtcgaacgccagcggcagagagcagttgtagctcagaccgtggtgcgcaacgcctgcatactcgaagcagaacgcgaggaaacagaaaggtgaatcctgctcggcccaccaagtgttattgattgggtctttagcgcaagccagaatgtcgtctacgtgcttctcaatgaacgcgatgcgctcagggaaaggaaccttatcgacacccgcacagttcgcaccgtggattttcagccagtagaaaccttcctcaccgattggcttgcctttagcgagggtcaacagacctttcgtcatgtcgttgccttgtgggttgaacatcggcacagcgtacacacgaccgcgccagtccatgttgtaagggaaccatattgctttcttgcttgcgaacttgttggcctgctccagcatgaactctaagctgatacggcgagacactcgtgccttgtccaagcggtagataccagcggcggctttcttccactccttgagtgctgcctcgttggtgtcaatgtcgtccggcttaggcggtaactcttggcgctccagcgatggaatgtctgcgaccgggcaattcttccagttaacaatctcattgacaaccgtaagaactttcttgttgattttccatgcggtgttttgcgcgatgttcacagccttgtagacttctggcatgtaaacgtcttcgtagcgcatcaagcccttcttagagtgagtgcgaacgagtgccaaaggtctgcgaccgttagcccaatagccgcccccggtgattgctacccaaggtttcggcggtacgacacatggctggaacatcggagagatacccgccagagcgcctgcacgcttcgctaatacgtccacgtactcttgggccagttgtagtgcctcatggtcagagcctgcgttacctgcgttgtggcgctgtaattccaccagacccgtggattcaatcagcatttcaatcaggcgaatccctacgtgcatcgtggtttctttatcccagctagaccacgcctcaccaccaagcagaccgcgaccaatcatatcggcctcgaccacctgcataaaggctttcttgtagacttgcccgtggcgcttgttaagctgttcctcaacgtgcttcttgaagtgcttcgcttcgaggtcacggatgcgaccgaaacgtgcctcatcctcaatggccttccctagcataccagcagcggcctgaatggttgtcatgttcgtgctggtcagtgacgcaaggataactttcagggtgataaacgcggaggcttccggcttgagtaactggagcggtgcataggctacgggcttgcggcctttcttcgatgcgtactcttcgagccactctacgatacgtgcggttaacttagggagaagcgtagcgagtaatggcttagcggctgcgttgtctgcaatctcaccagctttcgcttgacgctcaagcatcttgaggaagcggcgctcgcctagctcataagactcatgctctaaagccagttgttcacgagccagtgcgctaccgtagtggtctgccagtgtgttgaacgggatagcagccagttcgatttcggagaagtcattcttttcgatagtttcgatgatgttcattgcttacctcgttgtgaataaatcgttcctattcaggccacctcgtgatgacctgtaagaaaagactctatcagccttgcagtctcctgtcaaggtacgcgtctatgtgtaacggtttgccccactgaatgcgcacctcgtcgtgcatcatcattgccgcagcagcgaggcgctccagttctgcaaagtttaggttattgtggtgcacccaagcgttgcgccagtgcttatcgccccacaccatacgcgccctaggctcatccctgcgattctgattggcgtccatgcgcatcttagcgagtaccttagcgtcacgtttagcacgcttagaggcctttctgcgccattttgcacgggctttacgtgctacctgaaaggttcctttagggtcacggcgtgccttgcgtgccttacagcggtcaatcgcttcctgcgccctcagcgcctcaatctcagcgattagttcatccgggtcacagtgaaactcacccggctttaacttgttgtctgcgctgaacgataccgggtctgtgataatcaagcggcccatttggtctttcatcatgttaccgctgtgacaatcgaacgatgcaatgcctaggaagaacttgcggatatccttgcaggtctcaatgaacccgtcacttatcgggtactcttcggcggtattgaagcaatcctcctcaatgatttcccttgcagcgcggaagtggtggcgaatcttatcgctttcaccgtagcaccaatcgttaagcggtgtcagatagtccaagaccaccgtgtagcagcctgcatgacgctgaatgtcgtacaccgtagggataccctcccgaccctgattcatacggcagaaggctgcataggctgcgcctgagtcctctttcttaaagcctaccttgatgaccttgcccggtaacagtgcgtgctcatatgctgcgctaaagtgaccgttacccaagcgtacaaatccaacatcacgcatacgctcagccagtgtctgccagtagtccatatcttcgagcgacgtgtttcctgctgcctgcgtcagttcgccgtcctgagtctcatcgttcacgatagcagccgcaagagccaccagcattggctggcgttcgttcaggcgctcaatcggtaggttgcggatagcttcgagtgcggcttgtgcttcggtgaaagtcatcgttcagtgtcctgttatctgtaagaagagtaaagagtaaattcagcccatttgacagcgcttgcagcctgtcgtgcggtcatcttgcggtgtctcgttaagatgcgtttgaccttgcgtttcgatgcaccataagccatcgcatacagtgcaatctttacgtgctttgagttagtgcgtagcaatgtagaatactcctaccttgttggctttaaagcgtccgttacgttcacgaaccgtaaaccgtgggatgaatccccacttaaagtaactcagcgttgccttgtgtattgccagaccgcgcttaaagtctcgcataaagtacattgcgatgcatagatagaccagtgcgattagtgcgataatcatttcttaatccatacctcgtacacaaagttgattgcagcgggtattgctatacagagaattatcaggttcttcgtgtcttcgtatcccatactctcatcctctatcgtaatgttaatcataaaggccactcgcatggagcgaccttgagtttaccacctgatagacttgaagcctgttgtccagtgattgcaaagcgcgttatcaatcattccagcccgcacatgttgcttggtgtaccacacaggcttgataatcctcttgtgctaaaatcgggtttacccaatgtgtgacctgtttaccataccgcacaacgtaggtgcttcccattgacccgtggtaatactcacgcagtgttacggtgcactggcctgctattttggatgttgccagtaacttactcattacataacctcccatacagccgtaccattaggtaaacgcttgccgaagccttgttgatccctgaatcgggcacgagcgtccctttcgttgtacccgtagcaggtcattgagtagcaccagccgggaataaggatggcgtattgtttcatagtcatatcctctcagggttatttagtggtaatcataaaggccacactcagcgtgcgaccttgagtttaacacttatcgtacttgccagcggcgaccgaactcgtcaatcgtaaagcagccttgcagtggtgcgcctttaggcacttcttggaagctacccggcagacgttcagccttgtaaccgtcgatacctttagcgtacaccagaccagccgtgtgagtctgtgatttgtataccagtacgcaatcttgctcccactcattacaagctaagcgtgcaacattgagtgcctgcgccttgtccttgcagcgtacacgaaccgttttttcctcagtcggtgcgcttgcgattgcctcacgatagcacccggtcaaatcggttgactcaacggagccataaagacccggtgcggcacgtaaagtgcttaccatgtggcggtggcgactcatgttcacctcatcgtcgaggttggaacggaaagctgacaccagtacatagaagacgttagcaggctctttagtgaaaatcatttggtgttacctcatgttagttcatgttaagtgaatatcataaaggccacgcttttagtgcgaccttgagttattcgcttatacatcggtacactcaagagctattatccagattgttaaagagcgtgtcggtctggtttcgttagaccctagcggctttcagtgtcccgcctcactgttccgtcatttcgtggtacatcgtaccgtgtttacttcatgttgtcaaccgttttgtttcactttatgtgccgtggtgcgcttaagtcacctagaagacaccttgtgtccggttgacgctgtgtatcttactgcgtttacttcatgttgtcaatgcctgtttttcgtatgacttatcaggctgtctacttatccggttgactccggtatctcagggagtggctttaaggccgttgtcccgttgacgagatgaataatagccttaagggttacttaaagtcaaccattaattttaatcttttattaaatccctaattcccctttaagtatcccttattcccttattccctttagtgagggtaattgaattgacgatagacaccataggcaactacaaggcatcactacaggctaacagtgggtctatcggtctggttgtctttaagatagcggcgctctttaggtgatggctttaggtgatggctttagggtttactttaggaggctaacagatagggacacatagagatgtactattgaactggtacactaggacactctttaagccctcattaagccatccaccactttagatattgactttaggcaacactttaggctatcctataggccactcgagtagataccgtagtgagttatcgctacactcaaggttaaccgaaggttaaaccctaggggtagggctggctttaggtggctttaagagggctatggggggtactttgggttcttgaactgtgagatacccattcagatttttgtagtaaattcttaaagggtctctttaggaacccactttaggtaaggccacaccataggtgagaccataggcgcatcccgaagggatagctaggagacaccagaagaccctgtaagaccattacgaactacagggcatctttaggtataacctttagggttgactctacagggatgagttggtgtagtgaaactatacctacgaatccctcagagccgcttgtcgttcatcaacaataatttaatccccacaagagagtatagagcaaaaggccacttccagttgaccgaggtggtcattaagacctgcgtacccaagggcagcagtaagtaccagaagaaatcgccaagtgactctatgacgcagcagggcaatcagcaagcgtaacattgagccacctcctttcagttgctctaaggtagggtgattatacaatgataatatcaccaatcatagaggagacttaaagtgcataaagggtcattgcataacctgaatgactaacctatatagtagctttaagtcccctctctccctttagtgagggttaattcaaactcattgattcttaaggaatttcttaaagtgaccatccgtggtctcaatgattccttatgcactcaatatgcataactaccagtcaatgaacctgttgctattcacatcgtcatcctcccaatagagttccataccgtcaaccatagaggtaactacatgaccagccgaatggattgggtgctccatgtgttcctctaagaacgcctcaagcacctcagcttccaccttcacggcgtccagttccatcgtagagcgtaagaactccacacccaatgctaatgcatcaagtcggtcgtcatgggccacagcgcccttctcacgggccatacgggtcaactggtagaacagcgaatagcgaacatcatgcttgccatcagcgtcacgggcagtctggtagtcctcacgaatcacctcgtcacgaatcacaaggcggtgcgtagagagtacaggctccagcgtatcacaaatgcgtagttccttcataccacgagcacgaatctcttcaagttgcgctgcatggtgtttcaggagcacagggctgaataccttaccaaacataccatccccgaagttactctcgaagaccactgtctgaaccttccactgcttcgctttcttagcgagggactcaagggtcttatcggaataaccatcgcggaacccgccagcttccatcagatagatgtagccattcagggtgaacaacactgcgtaacctgtctcatccttaccgcgaccacttgggtcaatcacgaggatgcgttgctggtactgtccagtgttctggctgcacgaatgatagctatgaatatcatcacccttaaggcccacgttaggaagctcttcattgcgattctgacggttcggaagccactggtaatgcattggggctttctcgaagtccagaccgcacacgatagcgtcacggaggcgtaaggggtacttctcggcatcactcaggttcgggttgagcatgaactgcaaagtgaagccagccttaccatattccaactcacgctcccggaggtcttccatatcgaagcgcacggggtcagtcggttgaccttggagcatctcgaacccatcgttgaactcttcgcggagcatcggggccagacggtcgccatagtacaagtcttcctcacggctacgcggatagagcgcaggccagatgattgtggtgtacccacggttatcttcgagttccttgtacaaggtcatttcggtttgaggcgtgccaaggtagataacgcgagaagtcggcagcggtttcagaagcgcagcaaattcctgcaccagagtccacagcttctcacgggcaccttgagttgcggagttagacggaatctcaacgtcatccgctatgatgatatcagcacggctaccagtcaactgaccagtgatacccaccgacttcacagacggagagtggtcaggcttggcagggccaacatcgaaactaatcacagagtcacgctgaccggggcgaggctttagctcagccaagaagggcagcaggtcaatgatgttcttgatgaagatggagttagcgtccgcacgttctttggatgcagagacaattagtatcttcaactgagggtcacgccataacgtccacacaacgaacgcacaggtgatgaatgacttaccaataccacggaaagcctgtaggataaacttcttgttgtctccgttagccagacaccgggccatatctatctgacacttagtcggcggcgggagagccaaagccttccacaatacgaacaggaaggccacgaagtcacccttaagctgcgcaatgattagcgcattacggtttgcttgggtgtcgctcattctgcatctccttaatagtacgctggagcgctcttacgtgagcatcagcagcttgggttattccgataatacgcttagcatctgactcgtgtagttcggctcgaccattaaactcgcatctaccgttatcttctggtagtccggtaagggtcttgatgcggactgacagccgcttattattactacgcaggtcattaagcatcctatcagtgctgccctcaatggctgcaatctcttcttggtactcacgggatacccgactgacctctgcctgagttgctgcggttgcttttgttttcgcaatgtattcattttggattacctccttccagtttgctctctcatgggttgaccctaagtgccagccacccataaagagtgtcccggcgagtacccaagggagtgcgctgcgtaaaagttttagcataacacctcccatcaattttagacttcacgtagatgcaccaaataacatccataaaggctccccacgtggagaaccttgagtatgtcacttactgtagcgtgatagtctcatcgtcagtcagaccattagggccgaccactttgttgtagtcttccagaccagccgcgagaccaccaaggatgttctcatccggggtcagcttactgatttggaacttatggcggtctaacagtttgccgattgcgttgtaaagctgcggcgttcggcgctcctcgctctggaggtcagcaagcatacgctgtgccatctccgtgtccagcatctccagcagcttgattaaagtcttgtcgctcatgggttactccttatttgcacgtttccagtcaatcatcttatcgactaccttggcaccaatctgaaccactgtgtaggcgatagctgcaacgtagaaccactcgtttaacgatagtccccaaaagagtcgggccgccccatcagcgacccctgtgccaacaataggcgcagccttaacgacctcgttattgaagtcaaaagataacattcttgttctccttatgttgtgccgtcctctggctttgttgattgtccttcgagttctttaacgcgttgacgcagtgcctgaatctcagtgattacgtcagcaagcaacgccctgtcgttggtattcaaaagactaccttctgcggtggtcgtgaggtatgtgtacagcgggtcaatcgtgtcaagctgttgggccagccacccacgtttacgttccccggtggtaatctctgtgtattccactatgccaattgcgtcaatacgctcaccagcaccatcaagaggtttagtgatatcatccttgattctaacatcagaacctgaggtcatcacatcaccaagtggtgtagatattttaccattggagaatagctgccagttagtatccttgctataaccattgaggttaaggattatcgcgtggtctgtaccaacgtgctcctgaatatacataccacagtacgcaccaagtggatcattcttagcaccacggccccgaagctgtgagcgaactgccacagaattgaggtattgaccgatggctggattaggtggcgcatccacatatgcggtgatatcacccttaactcgcgttggccctgtaaagtcaaacctgttggtatctgtaataacaaaaccagcacgtaaggtgactgaagtaccagacacacggtagttctcaaagtgcatgcccccagcatcatccatataaatcctgttggcatagttcacgccattcacggtcttatcttggtatagcccactgtggttcagtattgatactttaccgtttcctttaatggttaagtcacccttcatgacaacattgttaccgttgactgaatcaatagaagcagcaaagtcattcatgttagtcagcttagcagcctcctcagaagccttagcagcactcgatgcagcgttagtctcagaggtcttagcgttggtctcagaggtcttagcgttggtctcagaggtctttgcattcccctcagacgtacttgcggcggcggcactcttggaggccttccgtgagtagtgatacgcagagaactcgctaccctgaaccggagagtcctctgtacgctgcgcccattgatgcgcgttgttctcggaggtctttgcgttgtcctcagataccttcgagttgttctctgaggacttagcggcctgttgagatgcagcagcggcctgttgagatgcagcagcagccttcgcagagttcagcgcagactcattccatcgagagacttgacctaaagttattgcatcaccggggtctttagcgtccgcaacgttcacgatacgacgaccacgagcatccaagtcaccatcgttgttaacgccaatcgtatcagcggtaaggtcacgcgcttcctcagcaacgtggagggtctgtacctgcgagatgttcaggtcatacgcacgtaggattgagccatccgtaaagtcaaccagcctatcggtagcggaggtgaatcgacggatttcaatcatgttataaccgtccgctggccccaacgctctcgttgtggagattgtggtcttagtcgcaaaacgatagtcttgattcaagatgagttcctttcggtcaacaccgataagggtcactctgacgaacttacgcgccagatactcaaacggaatattgaagtccgtagtggagccatccagcgggtaagtcatcacggtcttaatagttgtagccatgtgacctcctttgtaaattagcattaagagagaagaggccagaatgtgacctctctccctttagtgagggtttattgtttcttcggcgtctcctttatgcggataccgttggcctcgtagattttcataatgagttgctgcgatagcgggtcattaggaatcaactcacgagaggtgttgaagagtcctgtacggaactccagagcggtagccttgtttggagaagatagcagggaagcggcgttaattgctgttgcgcccacagaacccacaaaacctaaacccggaacctgctcaccaactgcacctgcgatagttgaagccacctgtctacctgtcactgccttggtagggtcgcgcttctcggactctttaggtagtacagtagagcgtgtgtacttataggtatcgctaccaaccatcccagcgaacatgtcgtagatactcaatggtgagcctaagtgtgaactacgagagattgacgcatgagcaatcatcttagggtcaagggcgttcttaaggtactccttacgtttgtgctcctgtagacttgaggccttaaggtgcgcctgcgcaacgtagtaaccaccagctagacccaaagagacgatgtgggtcagcgcttggtctaacgctcggttgttcttcgtggcctcatagaagctgcggacgaaccgggagttcagtgacttaatgacgaagttcttaaactgcatcaccatcttgaccccagcaccgaacgctttggcgtcctgtgaggaaaccttgtgagggcgcagtatagtctcatcagccaccttgtcagccagacgccacaagtccattgagcgtgggtcgttagcgaaagcctgtttgtcacgaatggtgaacttaccgtcttccccacgagtcgcatagtctctgaacaactgcttgattccattccactgctcagggctgatagaggcagacttaaggtagtttgccttaccgaacttagaggctttcccagcaagggccgctccagccacatccccaagcacaccctgacgggcagcatcaagaatgtagtttgatgttccgtttaggagcattgtccaaggggagcgtgcagccaactcttgagtaccgaaacgaatcgtaccgaccacattggcaaccgcagcgctggtgtccgtagactcccggagtcggcgcacgtggtcttcacgtcccggacggattagttggtcgagttccttaccgaacaccatcccgtgtagctccttaatctcagaggcacgaagcggtttaccacggttgacccaatcgttaatcatagggatgccatgagttatcgcagagacgttacctttagccagcataccagcgatttcagtgatgttctgcgcacccatgtaggcgttcttagcgaagaacgtaaggtcattgacggagcgtagggctgtgccccaagcgccttccgggttccttcgagcacgaccagttagaatcttcacggtatccttgagggcttccacttcacctttcagtgtgccgttgccctctgactgcttatccagcgccatgatttcatctttcaggtctttggtagtcttaccggaaccacccatgattgcaacatcaccatctactcgtcggtcgtatgcaggcagaatttcagccatgtcatatgtacgcaggtcgttcacagagaacgtgttaccatcagggagagtcaccgccatgtcactgtcgaacatgttacgggcttccaagaagttgttgttctcgatacccaccagaccctcaatgttatcctcaatgacagaggaggcagagaactggtcggtgtgtgaaataccatacgccttatccatcgcgtgcttctgcaccatctcaggcgtaacttcctgcacggatttgagaccgttaagttccatcaggtactcatcgaccctcgccttgacttctggacgagcacgataagacgtcaaccatgactccgcgattgctcgctgcaagccatcattaccgtaacgtttaaccatctcaatctttatagcgcggtcgtacacgtttggcacgtaggttcccttgtggcgtgagccggggaagatactgaccgccttggtgttgccgaagattgacgggttctccatgatttcgcgtttgaggtcaaagtgctgcttgaggatgttcatcacattccgctcaccctttgtcagatttgcttgaagctcaggccgctcaatcgctaaggctgcacgcttgtagatttcctgtcggatttccttacggctcatcttggaaccaccggtggagaactcagggtctttcattgcagtacgcacagcatcataaagctgattgtaggtgcgctggttgttcgcgtggagtcgctccttaatgtcagaagctgtcgcaccgaacttaccagaagtcccggactccataccagtcggagagcgcacaaggtcactcgcaatggagcgaacagtcgggttctcagagcggagagtcttcaagccaatctcagtgaaaccacccaaagagataccacgagcggcacgctcagggttgaccgcctcgaactcgctaagagtctgagggttgagtgggttggtgtcgctcaggatttgaccttgaggcaacacaactgcacccggctcggtctccagaggtgaatactcaacgccagcgtgctcacggtcgaacacatggttatcgctaggcatacgggtcaggtcttcgccaccagagttcagagcggtctcgcgggcttccaagcggtgtgccataggagcgaagtcattaacgacctcagtcccacgggaacggcgaataccagcagcgatagcgtcactgattgcactcataccggcaccgaacatgagaccacctaaagcagcatcagcgtagtgtgcttcaccaccagctattgatgtgcggataccctcagaggcaacagctaggccagcactttgagtaccgacaatgaaagccttgttagccaccttgagacccttcccggctacacccactagcggcacgtaactcagcgggtctacaccagcaccgacgataccagcagtaagtttggcaccaacacccgcatcggcagaccgcgcgtccatctcgtagttgtcattcgccatcttaatgagggcgtccagattctcaggagagcctccagtgactacattgatgtacgatgggttcttcacctccttacggatacgctctaactcttctggagtccacgtatggctgttccagcgagtcggcgtaatggtgtccttgaataaatcaaaaccgtcatcactacgagcggcacgaaaagccacacccaatacggagttgtgaagttctgcacttgtggcatctccgattccgaagaaggttgaacgagaattaaactcgtccagtgttgttccagtcttttcccaaaagtccttagcataaggcacgttaggcgcttgctgctctttaccctccactttgaatccagtggactccggcaggtcagtgcctaccgtctgcttcttcccgattccagcaaatgcatcccccgatggaatgcccttagcctttggggtgataccgccgaacgcctccaagtcccccttgcgaggactgttggctacatccatcaggttacgcatgtagtcacgaccttcctcagagattgaagcccaatcgcctttgtcataagcctgtatctgtggagcaccgttgcgcccctcgccctgattatacgccaaggcagctttgagttcatccccatcgtacttccgaatgaggtcactcaggtgacgagcggctgcatccacagccaactcagggttgtaacggtcatcgtcatcagcgtcagtaaccttgaggccaagcgcagtggctgtacctttggtgaactgcatgagacccttcgggcctgttggggatttggcctttggattaaagctggattcgttgaatgctaatttacgaagcaggtcataggagaccccatgattgtctgccgctttttgaaataacccatcgaactcgctaggtttgttcttatcgtagctcatggagcctccttatcactgttagtcttctttacgtccatagatatacttcggagtcttcttccgtttatcttggacacgtttacgcgcttcttcacgcgcctgtgttgcacggcttattggggcacgcttgttggcctctttgagggctttctctcgtgctgcctcagcttgcatctgtgcggtacgctggtactcacgctggagtaactcttggtcataccgaatgcgaacctgtccggttgtgtccatcaggtagattgaatcaccttgctggtacaccgacagttgcttgttggtaatccaagggttcgccgctgtgattcccttaatggcttcgtccagaatgttcttcccttgctcccacgacttagggtcatccgaaacagtcaggatgttcttcggtaggacgccgtaggtatcaccctcaacatcgctactggagaacgtggtcgtcgaatcggagaggaactttgcgacctgttcggttgccatgtcagggttccctgtccggtacttcacggaatcataaatcttcctggcatacccttggacactcgaaggcatgtacttgatttgaggattcgttgaatcgttcatcatagcggcccacgctcggtcatcctcaaactgcatctccttggtcttctgtgcgcgggccttatcagcgtcgataagaacctgcgtgtcgatgccttggttatccaacatgtccatcgtcaggaacaactcggccttgtcaggatacagagaggcaatcaggtcagggtcagtgttgcggatgcgacgaaggttgtccatcgctggtgtgctctcaggcatcttgccgttaatcaccgcagcctgccattcgtttccagcatcagtaatcatctcaccaaacgctgcacggaaagcaccctccttggagtctgcccgtaggtagtccaatttcagtttgtctttctgttcaggcgttaagtccatcgcctcgatttccgctaacttctggttcgcgtagttgaccatatcactatgtgtaaactcaccagtgttctcgttggtcggcatgtccttatagttggtcgagacgtattcaccgttgaggcgcttctggaactgcttgtcgatgaccaaagatttattcagggtcttctgttgcttgtccatcagcttggctgtctcagcttgttcctgcttgaagcgggtgcgcatctgttcctgtgcggaaatcaaccactcacgctcaggagtcatctcttcacccggctgaatcttatcgagttcggccttgataccttgaagagtctcccaacctttaccagtgtccgcttggttaagcgctgagttaatatccagtcggaacttctctgttaacttcgcgttgttctggaattgagtgtgctgtgccttaatcatcatggcctgccactgttcatcacccatcagttcacgataggtagtcgtagcgccatttagagttaccttgcggttctcaatgttctgcaagaaggcggcaccacccggacgctgtagcacgtcattcagggacgaagagataacctgttgagcctgattgtcggtcatccctgtcaccaaggagttgtcgatgtagttctggaagaactcaccggactcaggacgagacagtaggtcagggtcagacaggacaccattgagttcaaccttcgagttcaggattgcacccttctgcgcttggtcactcaggaaggtatcatgtgccccatacagagcaatgttacgctcggtgatattcgcgttgaaacccttcaggtattcctcgtccatctcattgatgccgaactgctcagcgaacgacttcgagtgctcctgtaggcgtgagtgacgatactgctccatctcttcacgagtacggaagcgaccctctttgatggcctgttgaacctcatcgtcaacgaggaacgcagcgttacgcccggtcttgaacttcaaggcttgcattgcgtatgggtcatcctgatacagcagtgtaccattctggatagcctgtcggcgctgctcaggggtcagcttacggataatctcgttggagcgctcatcggctcgttgcttatcacgttcatctttcgccatgtacatatcggcaccagccttagcgaatcgaccaatggagtccagaagactcgctcttggttgttcagcctgaatggttgctgcccggtagtccatacctttgacgccccggagtcgttccataccgggagtcgccatgttgcctaaaacactatttagtttactagccattattacctcccggtcttggttcctttggcggcactgataggtgctgcttggtttccacctttcttgtcaaatccaccagccgcatattgacttgcagcttcctgacccataatggacagagggtctagtacacgcatcaggccggacttacctttggcctcgctcttgtacattgcatcgacttgacttgctgtggactgagtgcgtcccaactgttgcgcaaagatactagcgtagtctcggcggtaattctcggtgacactatttgcctcccgaatgtagttgccctcttcgatacgcttgatgcgcttcattgattcgccttctagcatactctcgccgatagctgcacggattgttcccatagcctgtaccttctgcatgttacgtgtagtcaactcagaggatgcagcttcaagggcgtctcgttgttccaatgaggcgttggcattctggatattcgtctctttgaccatctccattgcctgtcggcgtccagcttctgtctgtgccactcgtgccttgtcagcactgttctggctactcagagcttgggcacccatcatggcgataggaatcgctgccatccagcacatagttacctcctactgatagtgaataattgaaattgaccatcagcggtaaactcattatggaataccgcacctatggtctttaggaaacgaatgtgtgacttattgcctacccaaacgaaattccaaatggactcatactggctcagcatcatatcacgatattcaatgataagtctacgaaactctaagcgctccttcaaggtaaacagtgggacgtacttagaggtaaggaaccacactcggtctccctgattaccaccaattgccaacaca

SEQ ID NO: 29 - DNA, 39030 bp, Unknown
  source: /note="Description of Unknown: KP2-7c Bacteriophage Sequence"
cctcgcggtatctataaggtagacctgactctttccaataaagacccgcgctgtcaggcgatggtcgatgaaatcgtgaagactcacgaagaggcttatgctgctgccgtggaagagttcgaagctaacccgccgcaggtacagcgtggtaagaaaccactgaaaccttacgagggcgacatgccgttcttcgataacggtgacggtacgactaccttcaagttcaaatgctatgcgtctttccaagataagaagaccaaagagaccaaacacatcaatctggtcgtggtcgatagcaagggcaagaagattcaggacgttccgattatcggtggaggctccaagctgaaagtgaaatactctctggtgccttacaagtggaacacagctgtgggtgcaagcgttaagctgcaactggagtccgtgatgctggtcgaactggctaccttcggtggtggcggtgaagatgagtgggccgatgaagtcgaagatggtggttacactgcgagtgaatcccgtcagtcccgcgatgagcaggagtggcaggaagacgagcacgaagaaaccccggatgatgacgaggacttctaatggctggcgcatacgctgcgcgaggtgtacgcaaggtcggagcattccgttccggcctagaagataaagtctcaaagcagcttgagagtaagggaattaagttcgactatgaactttggcgtatcccttacgtcatccctgcgagtgaccacttatacactccagacttcctgctacctaacggtatcttcattgagaccaaagggctgtgggattccgatgaccgcaagaaacaccttttgattcgtgagcaacaccccgaactggacatacgcttggtcttctcaagcagccgctcaaagctctacaagggtagcccaacaagctacggtgagtggtgcgagaagcatggcattctgtttgctgacaagctgataccggtggcgtggctcaaagaacccaagaaggaggttccgttcgataaatttcagactaagaaaggagtaaagaaaaatggctaaagttcaattcaaaccacgagcaaccacggaggcaatctttgtgcattgctcagcaaccaagccaagccagaacattggcgttcgtgagattcgtcagtggcacaaagagcagggatggttagacgtaggttatcacttcatcatcaagcgtgatggtactgtggaagcaggccgcgatgaactggctgtaggttcccacgttaaaggttacaaccacaactccgtaggcgtatgcctcgtgggtgggattgatgataaaggcaagttcgacgccaactttacacctgcgcaaatgcaagcgctgcgtagtctgctggtcacgctgctggcgaagtatgagggttcagtccttcgtgctcaccatgacgttgcacccaaagcctgcccgtccttcgacttgaagcgctggtgggagaagaacgaactggttacatctgaccgagggtgataccatgaggatgatttgtattcgctgtgataagccgttgaagagtcgcgtaccgtcacgtcagtgtcagtgcaaagacccaatcaaggctgaggaacacaccgaggaataattaacactcactaaagggatagtcgaaaggccgtccctttgttctcgaaggaggctaaaatatgaacaaaccatacaagcagttctatcaggctccgcgaagacacattcaagtgtgggtagcagctaatgggcctatcccggaagggtattacatagaccacattgacggcaatcctcttaacgatgacctgtccaatctccgtctcgctcttccgaaggagaactcccggaacgccaaaacatccaaagcaaacaagtccggcctcaagggtctctcatggagggacgataggcagtcgtggcgtggtgctgtgatggcagacggtaagcaatacacaaccaccagcaaggacttacttgaggtagtagcgtggatttacagaactaggagagaacttcatggacaattcgctagattcagatagcatatttctctatcacatcccatgcgaaaactgtgggagcagtgatgcaaactcgctgttctccgatggtcatacttattgttacgcctgcgagaactggacgcccggtgacggtgagagacctgagcgggaacgtagacaatcaaatgggagaaagcctatgagctatgacgtatggaatttcggcgacagcaacggtcgatactctgacctgactgcccgtggcatctcgaaggagacatgccaaaaggctggctactggctggcgaaagtggacaaccgaatgtatcaggttgcggattaccgtgaccagaatggttccatcgtgtcacagaaggtgcgcgataaggacaagaactttaagaccactggaagtcacaagagcgatgcgttattcttgaagcacctctggtctggcggtaagaaaattgtggtcactgagggcgaaattgatgcgctcactgtgatggaactccaagactgtaagtacccggtcgtatcattgggtcacggtgcctctgctgctaagaagacatgcgccgctaactatgaatactttgaccagttcgagcagattatcttgatgttcgacatggatgacgcaggccgtaaggcagtcgaagaggccgcacaggttctcccggctggtaaggttcgtgttgccgtgttaccgtgtaaggacgccaacgagtgtcacatcatgggtgaagacaaagcaatcttggagcagatctggaacgcgaacccttgggtgcctgatggtgttgtctctgcgttgtcactcaaagaccgcgttaaggaagctatgacctccgaggacgctgtgggtctgctgttcgatggctgtcaaggcctgaacgatagaaccttgggtgcccgtggaggcgaagtcattatggtcacttccggttccggtatgggtaagtcaacgttcgttcgtcaacaggcgctggcttggggcaagcgaatgggtaaacgtgttggcctagcgatgctggaggaatccgttgaggataccattcaggatatgatgggtctgaacaataaggttcgtctgcgtcagtctgatgaagtcaagaaggctatagcagaggacggacgtttcgatgaatggtatgacgaactatttggagacgatacgttccacctttatgactcctttgcggaggccgaagctgacagactgttagcgaagctggcctacatgcgaacaggcttagggtgtgatgttatagtgctcgaccacatctcaatcgtcgtgtctgcctctgaggaatcggatgagcgtaagatgattgaccgcctcatgactaagctaaaagggttcgctaagtcaactggtgttgtgctcgtagtgatttgtcacttgaagaacccggagaagggaaaaccacatgaagaaggacgcgctgtttctattactgacctacgtggtagcggtgcgctgcgtcagttatctgatactatcatcgccttggagcgtaaccagcaaggtgatatgcctaacttggtgttggttcgcctgcttaagtgtcgtttcactggcgacactggaattgctggatacatggaatacaacagagaaaccgggtggcttgaaccgtctagctacactggcgaagaaggagaaggagatactggctggactgaacaagacggacaatcagacttctaaataccagtgccactgcggtcatccagactgtgatggcggaatgtataattgattaaccctcactaacgggaacaacctcaaaccataggagacacaccatgtttaaattcattaacgctttaggtaagctggtagttaaactgtacttcgtcgaagccaagaagctggacaagaaggccaaagctgattcacagcgagccattgagttggcgaaacagtcccgtgagaaatccgatgcggctgttagtggcatccacaagtcggcagcgattgcagccaaagcacaatccatgagcaaattctttgagtaaggagcacaccatgagcaagtcaatcactcacgcaaacaccatccgtctgccggacaccgctgaccagttcgctcgtcgagtacatattaatgtgcgcggtgagaaggtaacgatggtctaccgctggaaagaccacaagtctccgaaagcacacactcaacgcatgaccttgactgacaagcaggtaggccgcctgatgggtgccctgactatggctgctgacaaggtggtcggtgataaccgtgagcgtctggtagagttcggcgctggtatgcaagagattatcgagaagtgataaactcaaggtcgcccaagggtggcctttatgattatcatttatcctgaaatgaaaggagggcattatgctcgtaagtgacattgaggccaacaacctcttagagaaagtcaccaagtttcactgtggcgttatctatgactaccgcgatggtgagtatcatagttatcgtccgggcgacttcggggcgtatctggatgcgctggaagccgaggtgaagcgaggtgggcttattgttttccataacggtcacaagtatgacgttccggctttagagaaactagcaaagctgcaactcaatcgtgacttcaagttaccccgtgagaattgtattgacacattggtactctcgcgtttacttcatgcgaaccttaaagacacagacatggggcttcttcgttccgggaaactacccggtcgtcgcttcgggtctcacgccctggaggcatggggttatcgcttgggcgagatgaaaggtgaatataaggacgacttcaaggctatgctagaagagcagggcgaagaatatgttgatggtgctgagtgggtttcgttcaacgagccgatgatggcttataacgttcaagacgttgtggtcactgtcaagctcttagagaaattccttacagacctccactacttccctgcgggtatggacttcacgaagtacgatgcggatttattctggcgagaagctggcgagtctgtggatattgaacatcgtgcagcgtggctgttagcgaagcaggagcgtaacggcttcccgttcaacacacaggccattgaggaactttatgtagaactggcagcgaaacgcgccgaacttctgcgaaagttaaccgaaacgtttggctcgtggtatcaaccgaaaggtggtaaggaactcttcaagcacccacggacaggcaagccgctgccgagttatcctcgcgtggtctatccgaaacagggtggcgtgtacaagaagcctcgtaataaggcacagcgcgaaggtcttgaaccttgcgacttggacacgagggattacatggaaggtgctccatatactccggtcgagttcgttacgttcaagccaagtagccgtgaccacattcagaagaaactacaggaggccggatgggttcctgagaagttcaccgagaagggtgcgcctgtggtggacgatgaggtcttggagcatgtacgagtggatgaccctgagaagcaggcgtgcattgacttgattaaagagtacctgatgattcagaagcgaatcggtcaggcggcagaaggtgacaaggcgtggttacgttatgttcaagatgatggtaagattcacggagccgttaaccctaacggtgcagttactggtcgtgctactcatagtttcccaaaccttgcacagatacccggtgttcgttctccttacggggagcagtgtcgtagtgcttttggtgctgaacatcatttggatgggattactggcaagccgtgggtgcaagcggggatagacgccagtggcttagagttgcgctgtctggcacacttcatggctcgcttcgacaacggagagtatgcgaatgagattctcaacggtgacattcacaccaagaaccagaacgctgcggaactcccgacacgcgacaacgccaagactttcatttacgggttcctttacggagcaggagatgagaagattggtcagattgttggggcagggaaggagcgcgggaaggaactcaagaagaaattcttagagaacaccccggcgattgcagcattgcgagaagctatccaacagtctctcgttaagtcttccgcttggattggcggtgagcagaaagtccagtggaaacgccgttggattaaaggtctggatggtcgcaaggttcacgtcaggtctccacatgcagcgctcaacacattgttgcagtctgctggtgctctgatttgtaagctgtggattattaagaccgaagagatgctcattgagaaaggcttgaagcatggctgggatggtgactttgcgtacatggcttgggttcacgatgagattcaggtggcctgccgtaccgagcacatcgctcagattgttattgacaccgcgcaggaagctatgcgttgggtcggagagcattgggctttccgttgtcgtttagataccgaaggtaagatggggccaaattgggccgtctgccactaacagtaggagaaacattatggcaatgaccaaacactttaaagtaaccttcgacgttactgctgtgattgacagtgaatccgagaagaatctgaacgagttgctggtagacctagctaagaaggccgggtctggcgagaagctgaatccgttcaaacaagaactgcttattcaaggtctgacacacgggccggaaggtgcggctgcgttctgcatcaagcaaggtctccgtgagtttatccgcgatggtcacagtgagttaagctctaccgagcagaagcggatgaaattctcacctgcaactgtgcgggaggtgttcaaatgagtgaatacctgaaagtgcttgcagctatcaagggttgccctaagtcctttcagtcgaactatgtgcgaaacaatgcggctctcgtagctgaggccgcgtctcgtggacacattagctgtttgactgttggtggtcgtaatggtggagcgtgggaggtcacatccgctggtgtgcgcttcctgaaacgaatgggaggttgtgtatgattatgccaaagagtgacaccgtaacgatgactcgtgatgcgtggaatgatgttagcgcgtacattgataagctggagaaagacctagagttcctgaatgctcttaaggcgtgtggtgtggataattgggacggatactctgatgcaatcgagatggtttacggggaggaagacctatgagtttgattaccctcaaagacttcgctgagatgcgtgaaggtaaaccgatggagaagggcgtgctggtcatggatggtgactggctggtgtatcagtcgatggctgctgccgaagttgagacggattggggcgatgacatttggactctggagtgtgaccacgctaaggcgcggagcattctggattctgcaatcgaatcgtaccgaacccgtaagaaagcatggcgtgacgctacggttgtgctggcgtttaccgacgatgtgaactggcgcaaggaacttgtagacccgacttacaaggagaaccgcaaggcgacccgtaaacctgtgggctaccgtgacttccttcaagctctgtgggagcgcgatgagttcattcacatcaaagaggacatgcttgaaggtgatgacgttatgggcatcattgggtctggtcacgaggtcttcggcttcaagaaggctgtgttggtctcctgtgataaggacttcaagactatcccggacgttgacttcctgtggtgtaccactggtaacatcttgacgcagaccaaagagaccgctgattggtggcatctcttccagaccatcaagggtgatatgactgatggctactccgggattcccggctggggcgatacggcagaaggtttcctgaatgacccgttcattgtggagcctgtagagtccgtgttgaagtccggtaagaacaaggggcagacagtaaccaagtgggtgaagcgtgctcctgatgcgactgagacgttgtgggactgcattaaatccattggtgccaaagctgggatgaccgagcaggaaatcatcaagcagggccagatggctcgcattcttcgcttcgaggaatacaattacattgacaaggagatttacctatggacgccgcgaagctgattaccgtcgctgtgctggtaggtatgctggcgcgaggtctctggatgctcgctctcatagtccgagacgtgaagcgagactccgagattaagtgataaactcaaggctctctgtattaaccctcactaaagggaagagggagcctttatgattattactttaagacttaaccttaagaggtgaaattatgttacaaccaattaatcatgttttaactcatcccgatgatattcctagtatgcctcgtgcagctaaagagtatctacaggtgcgcttcaatcagacctatgtgatggagtccggggagtaccgtgcgctacgcgctgctggatactctgagtctttcattgctggtgtgatgcatggtctgtaccttgcctctcgaacacttgatgagattgaggtgcgtaaagagcaactgagacaggagtaattatatgtgctggaaaccgaaggtgaaagtccccaagatggacactaaccagattcgcgctgctgaaccagcacctttgactgagccacctaaatctgtggtatggggaggcgatgatgatgaggacaccagcgtgtcttcctctgaggttccaaccacacagagcagcggtaagagcagtcttaaggtaaagctggatgacaacgcagccaagaacaagagtaaatcctccattcgctccaaggcgtttgggtaactgtgacataacataggggacacattatgggattcctcaagaaaatcaagaaagccgttaagaaagttgtgaaggaagttagcagaccagtcgagaaggcaggtaaggaagtcggtaaagccgttggcggtgcgctgggtgcaggtaagcaggagattatccaacaagaggctccagtaccagtagtgactgcgccacctccagcacagattgtagatgtacctgaacaggataaggctgagggtgaggatggggcacaaaccgagagcgcacgtaagaaggcccgcgctggcggtaagaaggcacttagcgtagcccgtagctccggcggtggcattaacatctaaggaggactgaatggctgattcaaaacgtacaggcttgggcgaagacggtgctaaagctacctatgaccgcctaacgaacgaccgtagagcctatgagactcgtgcggaaaactgtgcgcaatacaccattccgtccttgttcccgaaggagtccgataacgaatctaccgactacacgactccgtggcaggctgtaggtgcgcggggtcttaacaatctggcctctaagttaatgcttgcgttattcccgatgcagtcgtggatgaagctgaccattagcgaatatgaggcgaagcagcttgttggagaccctgatggactcgctaaggtggacgaaggtctgtctatggttgagcgtattatcatgaattatatcgaatccaacagctaccgtgtgacgctctttgagtgcctcaagcagttgatcgtggcaggtaatgcactgctttacttaccggaacccgaaggtagctacaatccgatgaagctgtaccgattgtcttcttatgttgtccaaagagacgcatacggcaatgtgttacagattgtcactcgtgaccagatagcctttggtgctctcccggaagacgttcggtctgcggtagagaaagctggtggtgagaagaagatggacgaaatggtcgatgtgtacacccatgtgtatctcgatgaagagtccggcgattacctcaagtacgaggaagtagaggacgttgagattgatggctccgatgccacatatccgactgacgctatgccctacattccggttcgcatggttcgcattgatggcgagtcttatggtcgctcctactgtgaagaatacttaggtgacttaaggtcgcttgagaatctccaagaggctatcgttaagatgagcatgattagtgctaaggtcatcggtctggtcaaccccgctggtattacacaaccgcgtcgattaaccaaggctcagactggcgacttcgttccgggtcgtcgagaagatattgacttcctgcaactggagaagcaagctgactttaccgtagcgaaagctgtgagtgaccagatagaagcacgcttatcgtatgcctttatgttgaactctgcggtacaacgcactggtgaacgtgtgaccgccgaagagattcgatacgttgcgtcagaactggaagatacgcttggtggcgtctattcgattctgtctcaagaactgcaattgcctctggttcgtgtgctcttgaagcaactccaagcaacctcgcagattcctgagctaccgaaagaagccgttgagcctactatcagtacaggtctggaagcaatcggtcgtggtcaagacctcgataagctggagcgctgtatctccgcttgggctgctctggcccctatgcagggagacccggacattaaccttgctgtcattaagctgcgcattgctaacgccattggtattgatacttctggtatcctactgacggacgagcagaagcaagcactgatgatgcaggatgcggcccaaacaggtatcgagaacgctgccgccgctggtggggctggtgttggtgctctagcgacctcaagtccagaagctatgcagggtgcagcagcacaggctggcctagacgccacctaataaccctcactaaagggagacctcatctttgaaatgagcgatgactaaaggttggagtcctttggtttccctttatctttaacaacttaggagatttaacaatggctgaatctaatgcagacgtttatgcgtccttcggtgtgaacaacgcggtaatgaccggaagcacacctactgaacacgaacagaatatgcttagtctcgatgttgctgcccgtgacggcgatgatgcaatcgtacttagcgaggaaccgagttcccataacgatgacccatatgcatccggtgtagacccgttcgctgatggtgaagacgatgagggccgcattcaggttcgtatcagtgaagatggtaatgaagccgagttcgacactggtagcgataacgctgaggtggagaccgaaggtgaagccgatgagtttgagccgctgggtgacactccagaagaactgagccaagttactgaacaattaggacagcacgaagaaggctttcaggcgatggtcgagcaggccgttgagcgtggactgagcgcagagtctgtgactcgcatctacgaagagtacgaagccgatggcatctctgagaaatcctacgcggaactcgaagctgctggctatagtcgtgcctttgtggactcctacatctccggtcaggaagcccttgtagaccagtacgtcaatcaggtagttgcctttgctggtggtaaggagcgctttagcgcaatccatacgcaccttgaagcaacaaacccggctgcggctgagtcccttgagactgccatgatgaaccgagacttggcgactgtcaaagcaattatcaatctggctggtgagagttacacgaagaaattcggtaagcctgccaaccgtagtgttaccaagcgtgctactccggttaaaccagtagctcgtcagaaagagggctttacgaatcaggctgagatgattaaagctatgagcgacccgcgctatcgtagcgattctgcctaccgccaaatggtagaacagaaggttatcgactccagtttctaattaaccctcactaaagggagagaccatagatgactacaatggttgaatcacctgagcacagaactttgtggtcactcccgtaggtgaaacattgagaaccaactcgattcaagtagtaaccaaacttttctttaaattaacataaggagattcaacatggctaacattcaaggcggacagcaaattggtactaatcagggtaagggtcagtccgcagcggacaaattggcgctgttcctgaaagtgttcggcggtgaagtcctgacggctttcgctcgcacctccgtgaccatgcctcgtcacatgctgcgctctattgcttctggtaagtccgcacagttccctgtgattggtcgcaccaaagctgcttacctgaaaccgggtgagaacctcgatgacaaacgtaaggatatcaaacacaccgagaaggtaatccacattgatggcctgctgactgcggacgttctgatttacgacattgaggacgcgatgaaccactacgacgttcgcgctgagtacaccgcacagttgggtgaatctctggcgatggcggctgacggtgccgtactggctgaactggctggtctggttaacctgcctgacgcctccaatgagaacatcgagggtctcggtaagcctaccgtactgactctggttaagccgacctctggcgacctgactgacccggttgagctgggtaaagcgattatcgctcagttgaccgttgctcgtgcggctctgaccaagaattacgttccggctgctgaccgtaccttctacaccactcctgataactactctgcgattctggctgccctgatgccgaacgctgcaaactatcaggcattgattgaccctgagcgcggtactatccgtaacgtgatgggcttcgaagtggttgaggttccgcacctgaccgctggtggcgctggtgatacccgtgaggatgccccggctgaccagaagcacgctttcccggcgacttccagcactaccgttaaggttgctctggataacgttgtgggcctgttccagcaccgctctgcggttggtacggtcaaactgaaagacttggctctggagcgcgctcgtcgtgcgaactatcaggctgaccagattatcgctaagtacgcgatgggtcacggcggtctgcgtccagaagctgctggcgctatcgttctcccaaaggtgtcggagtaattcccgaccccactggagttactcttagtcagaagactatgagcttagacgttggggcttctaaagccctgacttctacggtaactccggctgatgcagtacagacagtgacctttacgtcttccaatgcgaagattgccacggtcgatgcctctggtactgtaactgctgtgggcgctggctccgctgacatcactgcgactactgtgaatggcctgacggctgtctgcaaggtcactgtgaaagcagtatagcctcccgtagaaggctaaggtctttaccggggatttactttccttcattactttatgaaccccttgggtgccctctgagggtatctgaggggttttttgctttaaaccctcactaacaggaggtaacatcatgcgctcttatgagatgaacattgagaccgcaggagagctatcagccgtcaacgacattctggcttccatcggtgagccaccagtatcaacccttgagggtgatgcgaatgctgacgttgcgaatgctcgacgtgtactcaataagattaaccgacagattcaatcacgaggatggacattcaatattgaggaaggtgtgactcttctaccggatgcgttctctggcatgataccgtttagctctgactatctgtccgtaatggcaacaagcggtcagacccaatatatcaaccgtggtggctatctctatgaccgctctgcgaagaccgacagattcccttctggtgtgcaggtaaacctgattcgtctgagagagttcgatgagatgcctgagtgcttccgaaactatatcgtcaccaaggcttcccgccagtttaacaaccgcttcttcggtgcgccggaggtagacggagtgttgcaggaagaggaacaggaagcgtggcgtgcgtgcttcgagtacgaactagactacggcaactacaacatgctggatggtgacgcattcacctctggtctacttaaccgctaataacaaggaggctctatggctctcattagtcaatcaatcaagaacctcaagggtggtatcagccaacagccagatattctccggttcgctgaacaaggtagcgtacagattaacggttggtcttctgagtcagagggtctccagaagcgcccaccgatgattcaccttaagacccttggcgctgctgggtatgtgggtgcgcaaccttacgtgcatcttatcaaccgtgatgagttcgagcagtatttcgtggtgttcactggtgaagacattaaggtgttcgacctcgatggtaaggagtaccaagtacgtggagaccgctcatatgttcgtacagctaacccacgagaagaccttaggatggtaactgtggctgattatacctttgtgactaaccgcaaggtggttgtgcagagtaacgaccaatcggtcaaccttccgggctttaaagaccaaggcgatgcactgattaatgttcgtggcggacaatatgggcgtagattatcaatcgagttcaacggggttgagcgtgctgctgtgcaactaccagatggttcacaaccagcacacgttaacgaggtggatggtcaggctatcgctgagaagctggcggtgcagttgcggaataacctagggaacccaaacaatgagcaagacccaaataagtggcggttcaatgttggccccggattcatccatatccttgcgcctaataacgataacgtttggggactacagactaaggatggttacgcagaccagctaatcaaccctgtaacccattacactcagtcgttccagaagttgccgattaatgctccagatgggtacatcgtgaagattgttggtgatacctcaaagactgccgaccagtattacgttaggttcgacctcaaccgtaaggtatgggtagaaacaattggctggaacacaaggactcacctacattaccacacgatgccttgggcgctggtacgtgcttctgatgggaactttgacttcaagtaccttgagtggggtgctcgtactgtgggggacgatacaaccaacccatacccatcctttaccggacagacaatcaatgatattttcttcttccgtaaccgtttaggattccttagtggggagaacatcatcttgtctcgcacctcgaaatacttcaacttcttcccggcctccgtgtcaaactactccgacgatgacccaatcgacgttgctgttagccacaaccgggtgtcaaccttgaagtatgccgttccgttctccgaagagttgctcctgtggtctgaccaagcgcagttcgttctgacagcctctggtatcctttcgagtcgctccgtagagttgaaccttacgactcagttcgacgtacaagacagggcacgcccacatggtgtaggacgtaatgtatactttgcgtcacctcgcgcttccttcacatccattaaccgatactatgcggtacaggatgtaagctctgtgaagaacgcagaggacatgacggctcacgttccgaactacatacctaatggggtatttagtatctcaggcacaactgctgagaacttcgtggctatccttacgagcggtgcgccgaaccgagtgtatatctataagttcctctacattgacgaggaaatcaggcagcagtcatggtctcattgggactttggggacaacgttacggtgtttgcagcacatgtgataaactcaacaatgactgtattgatgggcaatgaacatgctgtgtggatgggacgcttgcacttcacgaagaactccatagacattccgggagagccttacagattatacatcgacgctaagaggaaatacaccatccctgccgggacgtataatgatgatacctaccagacgtccataagcctcgcaacgatttatgggatgaacttcaccaagggtatggtttcggtggtctttcctgatgggaagattgtagagatagacccgccaatcaacgggtggagtagcgacccaatattgagactcgatggaaaccaagagggccaagtggtttacattgggttcaacatcccgttcacttatacgttctcgaagttcctcattaagaagactgctgaggatggctcgacggctaccgaggatattggtcgcttacagcttcggcgtgcgtgggtaaactatgaggattctggcgcgttcaccatccgtgtgaacaacctgtcccgtgagttcatctacacaatggctggcgctcgcttgggttctgacaatctgcgtgttggcaggtcgaacattggcacagggcagtaccgcttcccggttgttggaaacgctcagacgaacatagtaaccatcgagtcagatgcgtcaacaccactgaacatcattgggtgcggctgggaggggaactaccttcgtcgttcttctggcatttaacttaaagtctccctgcggtgaattaaccctcactaaagggagacactaatagatacgaggggttaaagcattatgtacattacaaagtgtttacaaatccatgccgacaactttcagccgtccatagaggacattctggaagctgaggcactaggtgttgaaccaaaggtaattcctgatgagaacactgtggcaatgcttagcgataacgctgtgttggcaattggtggtaatcagggagaccgagtgtggttccttacctctaagtacgtcccactgtttaccttgaaggagcgcttagagtttcgtagacttatcattgaatatcgtgatatgatgctgagccagtatgagtccatttggaatttcgtttgggtaggcaataagtcacacattcgtttcctaaagaccataggtgcggtattccataatgagtttaccgctgatggtcaatttcaattattcactatcagtaggaggtaactatgtgctggatggcagcgattcctatcgccatgatgggtgcccaagctctgagtagccagaacagtgctgacaaggcacgagtggcacagacagaagctggacgccgacaggcaatggagatggtcaaagagacgaatatccagaatgccaacgcctcattggaacaacgagacgcccttgaagctgcatcctctgagttgactacacgtaacatgcagaaggtacaggctatgggaacaatccgtgcagctatcggcgagagtatgctagaaggcgaatcaatgaagcgcatcaagcgtatcgaagagggcaactacattcgggaggcaaatagtgtcaccgagaattaccgccgagactacgctagtatctttgcgcaacagttgggacgcactcagtccacagcaagtcaagtcgatgcaatgtacaagagcgaggccaaaggtaagtccggcctgatgcgtgtactagaccctctgtccattatgggtcaggaagctgcaagtcaatatgcggctggtggatttgacaagaaaggtggaaaccaagcagcacctatcagtgccgccaaaggaaccaagaccgggaggtaataatggctagtaaactaaatagtgttttaggcaacatggcgactcccggtatggaacgactccggggcgtcaaaggtatggactaccgggcagcaaccattcaggctgaacaaccaagagcgagtcttctggactccattggtcgattcgctaaggctggtgccgatatgtacatggcgaaagatgaacgtgataagcaacgagccgatgagcgctccaacgagattatccgtaagctgacccctgagcagcgccgacaggctatccagaatggtacactgctgtatcaggatgacccatacgcaatgcaagccttgaagttcaagaccgggcgtaacgctgcgttcctcgttgacgatgaggttcaacaggccatcaaagagggtcgcttccgtactcgtgaagagatggagcagtatcgtcactcacgcctacaggagcactcgaagtcgttcgctgagcagttcggcatcaatgagatggacgaggaatacctgaagggtttcaacgcgaatatcaccgagcgtaacattgctctgtatggggcacatgataccttcctgagtgaccaagcgcagaagggtgcaatcctgaactcgaaggttgaactcaatggtgtcctgtctgaccctgacctactgtctcgtcctgagtccggtgagttcttccagaactacatcgacaactccttggtgacagggatgaccgacaatcaggctcaacaggttatctcttcgtccctgaatgacgtgctacagcgtccgggtggtgccgccttcttgcagaacattgagaaccgcaaggtaactctaaatggcgctacgactacctatcgtgaactgatgggtgatgaacagtggcaggccatgatgattaaggcacagcacactcaattccagaacaacgcgaagttaacagagaagttccgactggatattaactcagcgcttaaccaagcggacactggtaaaggttgggagactcttcaaggtatcaaggccgaactcgataagattcagccgggtgaagagatgactcctgagcgtgagtggttgatttccgcacaggaacagatgcgcacccgcttcaagcaggaacaagctgagacagccaagctgatggacaagcaacagaagaccctgaataaatctttggtcatcgacaagcagttccagaagcgcctcaacggtgaatacgtctcgaccaactataaggacatgccgaccaacgagaacactggtgagtttacacatagtgatatggtcaactacgcgaaccagaagttagcggaaatcgaggcgatggacttaacgcctgaacagaaagacaaactgaaattggactacctacgggcagactccaaggagggtgctttccgtgcagcgtttggtgagatgattactgatgctggaaacgaatggcaggctgcggtgattaacggcaagatgcctgagagcacaccagcgatggacaaccttcgtcgcatccgcaacactgaccctgacctgattgcctctctgtatcctgacaaggccgagttgttcctgacgatggacatgttggataaccaaggcatcgacacgcaggttcttatcgacgctgataaggcccgcgcacagaagaccaaggagatgcagtttgaggatgaccgagcgtgggccgctatgatgaacgattcaacgaatcctcaaatcaagtacatgccttcgagtgtccaagggtatgccaggaagatttatgattccgtgaagtaccggacagggaaccctgacatggcaaccgaacaggtcgcaaagttcctctccgattcgacgaccacgttctccagtagcgatgttgagggtgatacctacggcgtcctaccgaagaacatcctgactgtttcggatgaccctaagtcgtgggagcaagggaagaacattctggacgaagccattaagggaatcacagcggcgaacccttggattaccaacaagcaactgtcggtgtaccagcaaggtgattcaatctacctgatggacacaaccggacaggttcgcattcggtatgaccaagagttactccagcgtgagtaccagcgtaccgcacagatgcaagctgaggcagcacgagagaaagccctcaaagaggccaacaagcgtgccccaataagccgtgcaacacaggcgcgtgaagaagcgcgtaaacgtgtccaagataaacggaagaagactccgaagtatatctatggacgtaaagaagactaacagtgataaggaggctccatgagctacgataagaacaaacctagcgagttcgatgggttatttcaaaaagcggcagacaatcatggggtctcctatgacctgcttcgtaaattagcattcaacgaatccagctttaatccaaaggccaaatccccaacaggcccgaagggtctcatgcagttcaccaaaggtacagccactgcgcttggcctcaaggttactgacgctgatgacgatgaccgttacaaccctgagttggctgtggatgcagccgctcgtcacctgagtgacctcattcggaagtacgatggggatgaactcaaagctgccttggcgtataatcagggcgaggggcgcaacggtgctccacagatacaggcttatgacaaaggcgattgggcttcaatctctgaggaaggtcgtgactacatgcgtaacctgatggatgtagccaacagtcctcgcaagggggacttggaggcgttcggcggtatcaccccaaaggctaagggcattccatcgggggatgcatttgctggaatcgggaagaagcagacggtaggcactgacctgccggagtccactggattcaaagtggagggtaaagagcagcaagcgcctaacgtgccttatgctaaggacttttgggaaaagactggaacaacactggacgagtttaattctcgttcaaccttcttcggaatcggagatgccacaagtgcagaacttcacaactccgtattgggtgtggcttttcgtgccgctcgtagtgatgacggttttgatttattcaaggacaccattacgccgactcgctggaacagccatacgtggactccagaagagttagagcgtatccgtaaggaggtgaagaacccatcgtacatcaatgtagtcactggaggctctcctgagaatctggacgccctcattaagatggcgaatgacaactacgagatggacgcgcggtctgccgatgcgggtgttggtgccaaacttactgctggtatcgtcggtgctggtgtagacccgctgagttacgtgccgctagtgggtgtagccgggaagggtctcaaggtggctaacaaggctttcattgtcggtactcaaagtgctggcctagctgttgcctctgagggtatccgcacatcaatagctggtggtgaagcacactacgctgatgctgctttaggtggtctcatgttcggtgccggtatgagtgcaatcagtgacgctatcgctgctggtattcgccgttcccgtgggactgaggtcgttaatgacttcgctcctatggcacaccgcttggaagcccgcgagaccgctctgaactctggtggcgaagacctgacccgtatgcctagcgataaccatgtgttcgaccgtgagcacgctggcgttgagtattcacctctggagaccgagccgggtgcagttgtgttgcctcaaggtcaaatcctgagcgacaccaacccactcaaccctcagactcttagcgagttcgaggcggtcaaccctgagcgtgccgctcgtggtatctctttgggtggtttcactgagattggcttgaagactctccgctctgagaacccgactgttcgctccattgcgagtgaccttgtgcgctctccgactggtatggagtccgggacttctggtaagttcggtgcgacagcttctgacattaaggagcgactccacgcgaacaaccagcgcacctacaatcagctttatgatgctgtgcgtactgcaatgaaagaccctgagttctccaccggtggttccaagatgagccgtaaggaaatccgacaggaaatctacaagcgtgcagccttagcgattgagcggcctgagcttcaagcaaatctgacaaagggtgagcggaatgtgatgaacatcctcaagcagcactttgacctcaaacgcgaaatcatggagaacccgtcaatcttcggcaacaccaaggcggtcagtatcttccccggctcacgccacaagggaacctacgtgccaaacgtgtacgaccgcgctataaagattgagatggttaaacgttacggtaatgatggcttgcagcgagcaatcgcggagtcatggttgacgtcttatcgtgctcgtccagaagtcaaggcgagggtcgatgagtacctgatggaacttaacggtctcaaatccgtgcaggaagttacgcctgagatggtgcagaagcacgcgatggataaggcgtatggtatttcacacaccgaccagttctctgcctcctctgtcattgaggataacattgagggtctggtgggtatcgagaacaacaacttcttggaagcccgtaacatgttcgacagtgacatggcggtgactctccctgatggtaacacgttctctgtgaacgacctgcgtacatatgacatggctgaaattctgcctgcatacgaccgacgagtagatggtgatgttgcaatcatgggtggttccggtaagactaccaaagacctgaaagatgaaatcatggcgctggataagcagtcagagggcaacggcacactgaaaggtgaagtggaagccctcaaggataccgtgaagattctaactggtcgtgctcgaaggaacccggaaggcgcttggggcacagccctacgctccgtcaatgaccttacgttcttcgctaagaacgcctacatgggtgcgcagaacatcactgaaatcgctggtatgctggctaaaggtaacgtctctgcgataactcatggcatccctatgattaacgattgggtcaaccgtggtaaaccgcttcgtgcctctgagattaaggagctacacgggatggtgttcggtaaggaactcgaccaactaatccgtccgggacgtgaagaccacgtgcgccgactccgggagtctacggacaccagcgctgcggttgccaatgtggtcggtacgattcgtttcggtactcaagagttggctgcacgctccccttggacaatgctcctaaacggaacatcaaactacattcttgatgctgcccgtcagggtgtgcttggggatgtggctggagcggcccttgctgggaaagcctctaagttcggtaaggcaaactaccttaagtctgcctctatcagccctgagcagtggaatggaatcaagcagttgttcagagactatgcgactcgtggggaagacggtaagttcaccattcgtgacaaacaggctttcgctaacgacccacgctcaatggacttgtggcgtctggctgacaaggtggctgatgagactatactgcgccctcacaaggtttcctcacaggacgccaaagcgttcggtgctggggtcaagatggtgatgcagtttaagaacttcgtcattaagtcactgaactcccggttcgtccgcagcttctatgaggccacgaagaacaaccgagcgttagaccaagcgctgacccacatcgtctctttgggtctagctggtggttactacgttgcgcaggcgcaccttaaggcctcaagtctacaggagcacaaacgtaaggagtaccttaagaacgcccttgaccctaagatgattgctcatgcgtcaatctctcgtagttcacacttaggctcaccattgagtatctacgacatgttcgctgggatggttggtagcgatacctataagtacacacgctctactgtactacctaaagagtccgagaagcgcgaccctaccaaggcagtgacaggtagacaggtggcttcaactatcgcaggtgcagttggtgagcaggttccgggtttaggttttgtgggttctgtgggcgcaacagcaattaacgccgcttccctgctatcttctccaaacaaggctaccgctctggagttccgtacaggactcttcaacacctctcgtgagttgattcctaatgacccgctatcgcagcaactcattatgaaaatctacgaggccaacggtatccgcataaaggagacgccgaagaaacaataaaccctcactaaagggagagaggtcacattctggcctcttctctcttaatgctaatttacaaaggaggtcacatggctacaactattaagaccgtgatgacttacccgctggatggctccactacggacttcaatattccgtttgagtatctggcgcgtaagttcgtcagagtgacccttatcggtgttgaccgaaaggaactcatcttgaatcaagactatcgttttgcgactaagaccacaatctccacaacgagagcgttggggccagcggacggttataacatgattgaaatccgtcgattcacctccgctaccgataggctggttgactttacggatggctcaatcctacgtgcgtatgacctgaacatctcgcaggtacagaccctccacgttgctgaggaagcgcgtgaccttaccgctgatacgattggcgttaacaacgatggtgacttggatgctcgtggtcgtcgtatcgtgaacgttgcggacgctaaagaccccggtgatgcaataactttaggtcaagtctctcgatggaatgagtctgcgctgaactctgcgaaggctgctgctgcatctcaacaggccgctgctgcatctcaacaggccgctaagtcctcagagaacaactcgaaggtatctgaggacaacgcaaagacctccgagaacaacgcgcatcaatgggcgcagcgtacagaggactctccggttcagggtagcgagttctctgcgtatcactactcacggaaggcctccaagagtgccgccgccgcaagtacgtctgaggggaatgcaaagacctctgagaccaacgctaagacctctgagaccaacgctaagacctctgagactaacgctgcatcgagtgctgctaaggcttctgaggaggctgctaagctgactaacatgaatgactttgctgcttctattgattcagtcaacggtaacaatgttgtcatgaagggtgacttaaccattaaaggaaacggtaaagtatcaatactgaaccacagtgggctataccaagataagaccgtgaatggcgtgaactatgccaacaggatttatatggatgatgctgggggcatgcactttgagaactaccgtgtgtctggtacttcagtcaccttacgtgctggttttgttattacagataccaacaggtttgactttacagggccaacgcgagttaagggtgatatcaccgcatatgtggatgcgccacctaatccagccatcggtcaatacctcaattctgtggcagttcgctcacagcttcggggccgtggtgctaagaatgatccacttggtgcgtactgtggtatgtatattcaggagcacgttggtacagaccacgcgataatccttaacctcaatggttatagcaaggatactaactggcagctattctccaatggtaaaatatctacaccacttggtgatgtgatgacctcaggttctgatgttagaatcaaggatgatatcactaaacctcttgatggtgctggtgagcgtattgacgcaattggcatagtggaatacacagagattaccaccggggaacgtaaacgtgggtggctggcccaacagcttgacacgattgacccgctgtacacatacctcacgaccaccgcagaaggtagtcttttgaataccaacgacagggcgttgcttgctgacgtaatcactgagattcaggcactgcgtcaacgcgttaaagaactcgaaggacaatcaacaaagccagaggacggcacaacataaggagaacaagaatgttatcttttgacttcaataacgaggtcgttaaggctgcgcctattgttggcacaggggtcgctgatggggcggcccgactcttttggggactatcgttaaacgagtggttctacgttgcagctatcgcctacacagtggttcagattggtgccaaggtagtcgataagatgattgactggaaacgtgcaaataaggagtaacccatgagcgacaagactttaatcaagctgctggagatgctggacacggagatggcacagcgtatgcttgctgacctccagagcgaggagcgccgaacgccgcagctttacaacgcaatcggcaaactgttagaccgccataagttccaaatcagtaagctgaccccggatgagaacatccttggtggtctcgcggctggtctggaagactacaacaaagtggtcggccctaatggtctgactgacgatgagactatcacgctacagtaagtgacatactcaaggttctccacgtggggagcctttatggatgttatttggtgcatctacgtgaagtctaaaattgatgggaggtgttatgctaaaacttttacgcagcgcactcccttgggtactcgccgggacactctttatgggtggctggcacttagggtcaacccatgagagagcaaactggaaggaggtaatccaaaatgaatacattgcgaaaacaaaagcaaccgcagcaactcaggcagaggtcagtcgggtatcccgtgagtaccaagaagagattgcagccattgagggcagcactgataggatgcttaatgacctgcgtagtaataataagcggctgtcagtccgcatcaagacccttaccggactaccagaagataacggtagatgcgagtttaatggtcgagccgaactacacgagtcagatgctaagcgtattatcggaataacccaagctgctgatgctcacgtaagagcgctccagcgtactattaaggagatgcagaatgagcgacacccaagcaaaccgtaatgcgctaatcattgcgcagcttaagggtgacttcgtggccttcctgttcgtattgtggaaggctttggctctcccgccgccgactaagtgtcagatagatatggcccggtgtctggctaacggagacaacaagaagtttatcctacaggctttccgtggtattggtaagtcattcatcacctgtgcgttcgttgtgtggacgttatggcgtgaccctcagttgaagatactaattgtctctgcatccaaagaacgtgcggacgctaactccatcttcatcaagaacatcattgacctgctgcccttcttggctgagctaaagcctcgccccggtcagcgtgactctgtgattagtttcgatgttggccctgccaagcctgaccactctccgtctgtgaagtcggtgggtatcactggtcagttgactggtagccgtgctgatatcatcatagcggatgacgttgagattccgtctaactccgcaactcaaggtgcccgtgagaagctgtggactctggtgcaggaatttgctgcgcttctgaaaccgctgccgacttctcgcgttatctaccttggcacgcctcaaaccgaaatgaccttgtacaaggaactcgaagataaccgtgggtacaccacaatcatctggcctgcgctctatccgcgtagccgtgaggaagacttgtactatggcgaccgtctggccccgatgctccgcgaagagttcaacgatgggttcgagatgctccaaggtcaaccgactgaccccgtgcgcttcgatatggaagacctccgggagcgtgagttggaatatggtaaggctggcttcactttgcagttcatgctcaacccgaacctgagtgatgccgagaagtaccccttacgcctccgtgacgctatcgtgtgcggtctggacttcgagaaagccccaatgcattaccagtggcttccgaaccgtcagaatcgcaatgaagagcttcctaacgtgggccttaagggtgatgatattcatagctatcattcgtgcagccagaacactggacagtaccagcaacgcatcctcgtgattgacccaagtggtcgcggtaaggatgagacaggttacgcagtgttgttcaccctgaatggctacatctatctgatggaagctggcgggttccgcgatggttattccgataagacccttgagtccctcgctaagaaagcgaagcagtggaaggttcagacagtggtcttcgagagtaacttcggggatggtatgtttggtaaggtattcagccctgtgctcctgaaacaccatgcagcgcaacttgaagagattcgtgctcgtggtatgaaggaactacgcatttgtgatacgctggagcctgtactctctacgcaccgccttgtgattcgtgacgaggtgattcgtgaggactaccagactgcccgtgacgctgatggcaagcatgatgttcgctattcgctgttctaccagttgacccgtatggcccgtgagaagggcgctgtggcccatgacgaccgacttgatgcattagcattgggtgtggagttcttacgctctacgatggaactggacgccgtgaaggtggaagctgaggtgcttgaggcgttcttagaggaacacatggagcacccaatccattcggctggtcatgtagttacctctatggttgacggtatggaactctattgggaggatgacgatgtgaatagcaacaggttcattgactggtagttatgcatattgagtgcataaggaatcattgagaccacggatggtcactttaagaaattccttaagaatcaatgagtttgaattaaccctcactaaagggagagaggggacttaaagctactatataggttagtcattcaggttatgcaatgaccctttatgcactttaagtctcctctatgattggtgatattatcattgtataatcaccctaccttagagcaactgaaaggaggtggctcaatgttacgcttgctgattgccctgctgcgtcatagagtcacttggcgatttcttctggtacttactgctgcccttgggtacgcaggtcttaatgaccacctcggtcaactggaagtggccttttgctctatactctcttgtggggattaaattattgttgatgaacgacaagcggctctgagggattcgtaggtatagtttcactacaccaactcatccctgtagagtcaaccctaaaggttatacctaaagatgccctgtagttcgtaatggtcttacagggtcttctggtgtctcctagctatcccttcgggatgcgcctatggtctcacctatggtgtggccttacctaaagtgggttcctaaagagaccctttaagaatttactacaaaaatctgaatgggtatctcacagttcaagaacccaaagtaccccccatagccctcttaaagccacctaaagccagccctacccctagggtttaaccttcggttaaccttgagtgtagcgataactcactacggtatctactcgagtggcctataggatagcctaaagtgttgcctaaagtcaatatctaaagtggtggatggcttaatgagggcttaaagagtgtcctagtgtaccagttcaatagtacatctctatgtgtccctatctgttagcctcctaaagtaaaccctaaagccatcacctaaagccatcacctaaagagcgccgctatcttaaagacaaccagaccgatagacccactgttagcctgtagtgatgccttgtagttgcctatggtgtctatcgtcaattcaattaccctcactaaagggaataagggaataagggatacttaaaggggaattagggatttaataaaagattaaaattaatggttgactttaagtaacccttaaggctattattcatctcgtcaacgggacaacggccttaaagccactccctgagataccggagtcaaccggataagtagacagcctgataagtcatacgaaaaacaggcattgacaacatgaagtaaacgcagtaagatacacagcgtcaaccggacacaaggtgtcttctaggtgacttaagcgcaccacggcacataaagtgaaacaaaacggttgacaacatgaagtaaacacggtacgatgtaccacgaaatgacggaacagtgaggcgggacactgaaagccgctagggtctaacgaaaccagaccgacacgctctttaacaatctggataatagctcttgagtgtaccgatgtataagcgaataactcaaggtcgcactaaaagcgtggcctttatgatattcacttaacatgaactaacatgaggtaacaccaaatgattttcactaaagagcctgctaacgtcttctatgtactggtgtcagctttccgttccaacctcgacgatgaggtgaacatgagtcgccaccgccacatggtaagcactttacgtgccgcaccgggtctttatggctccgttgagtcaaccgatttgaccgggtgctatcgtgaggcaatcgcaagcgcaccgactgaggaaaaaacggttcgtgtacgctgcaaggacaaggcgcaggcactcaatgttgcacgcttagcttgtaatgagtgggagcaagattgcgtactggtatacaaatcacagactcacacggctggtctggtgtacgctaaaggtatcgacggttacaaggctgaacgtctgccgggtagcttccaagaagtgcctaaaggcgcaccactgcaaggctgctttacgattgacgagttcggtcgccgctggcaagtacgataagtgttaaactcaaggtcgcacgctgagtgtggcctttatgattaccactaaataaccctgagaggatatgactatgaaacaatacgccatccttattcccggctggtgctactcaatgacctgctacgggtacaacgaaagggacgctcgtgcccgattcagggatcaacaaggcttcggcaagcgtttacctaatggtacggctgtatgggaggttatgtaatgagtaagttactggcaacatccaaaatagcaggccagtgcaccgtaacactgcgtgagtattaccacgggtcaatgggaagcacctacgttgtgcggtatggtaaacaggtcacacattgggtaaacccgattttagcacaagaggattatcaagcctgtgtggtacaccaagcaacatgtgcgggctggaatgattgataacgcgctttgcaatcactggacaacaggcttcaagtctatcaggtggtaaactcaaggtcgctccatgcgagtggcctttatgattaacattacgatagaggatgagagtatgggatacgaagacacgaagaacctgataattctctgtatagcaatacccgctgcaatcaactttgtgtacgaggtatggattaagaaatgattatcgcactaatcgcactggtctatctatgcatcgcaatgtactttatgcgagactttaagcgcggtctggcaatacacaaggcaacgctgagttactttaagtggggattcatcccacggtttacggttcgtgaacgtaacggacgctttaaagccaacaaggtaggagtattctacattgctacgcactaactcaaagcacgtaaagattgcactgtatgcgatggcttatggtgcatcgaaacgcaaggtcaaacgcatcttaacgagacaccgcaagatgaccgcacgacaggctgcaagcgctgtcaaatgggctgaatttactctttactcttcttacagataacaggacactgaacgatgactttcaccgaagcacaagccgcactcgaagctatccgcaacctaccgattgagcgcctgaacgaacgccagccaatgctggtggctcttgcggctgctatcgtgaacgatgagactcaggacggcgaactgacgcaggcagcaggaaacacgtcgctcgaagatatggactactggcagacactggctgagcgtatgcgtgatgttggatttgtacgcttgggtaacggtcactttagcgcagcatatgagcacgcactgttaccgggcaaggtcatcaaggtaggctttaagaaagaggactcaggcgcagcctatgcagccttctgccgtatgaatcagggtcgggagggtatccctacggtgtacgacattcagcgtcatgcaggctgctacacggtggtcttggactatctgacaccgcttaacgattggtgctacggtgaaagcgataagattcgccaccacttccgcgctgcaagggaaatcattgaggaggattgcttcaataccgccgaagagtacccgataagtgacgggttcattgagacctgcaaggatatccgcaagttcttcctaggcattgcatcgttcgattgtcacagcggtaacatgatgaaagaccaaatgggccgcttgattatcacagacccggtatcgttcagcgcagacaacaagttaaagccgggtgagtttcactgtgacccggatgaactaatcgctgagattgaggcgctgagggcgcaggaagcgattgaccgctgtaaggcacgcaaggcacgccgtgaccctaaaggaacctttcaggtagcacgtaaagcccgtgcaaaatggcgcagaaaggcctctaagcgtgctaaacgtgacgctaaggtactcgctaagatgcgcatggacgccaatcagaatcgcagggatgagcctagggcgcgtatggtgtggggcgataagcactggcgcaacgcttgggtgcaccacaataacctaaactttgcagaactggagcgcctcgctgctgcggcaatgatgatgcacgacgaggtgcgcattcagtggggcaaaccgttacacatagacgcgtaccttgacaggagactgcaaggctgatagagtcttttcttacaggtcatcacgaggtggcctgaataggaacgatttattcacaacgaggtaagcaatgaacatcatcgaaactatcgaaaagaatgacttctccgaaatcgaactggctgctatcccgttcaacacactggcagaccactacggtagcgcactggctcgtgaacaactggctttagagcatgagtcttatgagctaggcgagcgccgcttcctcaagatgcttgagcgtcaagcgaaagctggtgagattgcagacaacgcagccgctaagccattactcgctacgcttctccctaagttaaccgcacgtatcgtagagtggctcgaagagtacgcatcgaagaaaggccgcaagcccgtagcctatgcaccgctccagttactcaagccggaagcctccgcgtttatcaccctgaaagttatccttgcgtcactgaccagcacgaacatgacaaccattcaggccgctgctggtatgctagggaaggccattgaggatgaggcacgtttcggtcgcatccgtgacctcgaagcgaagcacttcaagaagcacgttgaggaacagcttaacaagcgccacgggcaagtctacaagaaagcctttatgcaggtggtcgaggccgatatgattggtcgcggtctgcttggtggtgaggcgtggtctagctgggataaagaaaccacgatgcacgtagggattcgcctgattgaaatgctgattgaatccacgggtctggtggaattacagcgccacaacgcaggtaacgcaggctctgaccatgaggcactacaactggcccaagagtacgtggacgtattagcgaagcgtgcaggcgctctggcgggtatctctccgatgttccagccatgtgtcgtaccgccgaaaccttgggtagcaatcaccgggggcggctattgggctaacggtcgcagacctttggcactcgttcgcactcactctaagaagggcttgatgcgctacgaagacgtttacatgccagaagtctacaaggctgtgaacatcgcgcaaaacaccgcatggaaaatcaacaagaaagttcttacggttgtcaatgagattgttaactggaagaattgcccggtcgcagacattccatcgctggagcgccaagagttaccgcctaagccggacgacattgacaccaacgaggcagcactcaaggagtggaagaaagccgccgctggtatctaccgcttggacaaggcacgagtgtctcgccgtatcagcttagagttcatgctggagcaggccaacaagttcgcaagcaagaaagcaatatggttcccttacaacatggactggcgcggtcgtgtgtacgctgtgccgatgttcaacccacaaggcaacgacatgacgaaaggtctgttgaccctcgctaaaggcaagccaatcggtgaggaaggtttctactggctgaaaatccacggtgcgaactgtgcgggtgtcgataaggttcctttccctgagcgcatcgcgttcattgagaagcacgtagacgacattctggcttgcgctaaagacccaatcaataacacttggtgggccgagcaggattcacctttctgtttcctcgcgttctgcttcgagtatgcaggcgttgcgcaccacggtctgagctacaactgctctctgccgctggcgttcgacgggtcttgctctggtatccagcacttctccgcgatgctccgcgatgaggtaggtggtcgtgcggttaacctgctgccaagcgaaaccgtgcaggacatttacggcatcgttgcacagaaagtaaacgagattctcaaacaggatgcaatcaacggcacacctaacgagatgattaccgttaccgacaaggacaccggggaaatctcagagaagctcaagctgggaacctcaacgctggcgcaacagtggctggcatatggtgtaacccgtagcgtaactaaacgttcggtcatgacgctggcttacggctccaaggagttcggctttcgtcaacaggtactggacgacaccattcagcctgcgattgacagcggtaagggcttgatgttcacccaacctaaccaagcggctggttatatggctaagctgatttgggacgcggtgagcgtgaccgtagtcgcagcggttgaggcgatgaactggctcaagtctgccgctaagctgctggctgctgaggtcaaggacaagaagaccaaggagattctgcgccaccgttgcgcggttcactggactacgccggacggcttcccggtctggcaggaataccgcaagccactccagaagcgtcttgatatgattttcttagggcaattccgtctgcaaccgacgattaataccctcaaggattcaggcattgacgcacacaagcaggagtccggcatcgcacctaactttgttcactcacaggatggtagtcacctccgcatgacagtcgtttatgctcacgagaagtatggtattgagtcctttgcgctcatccatgacagctttggtactattccggcagacgctggtaagctctttaaggctgtgcgtgaaacgatggttatcacctatgagaacaacgatgtgctggcagacttctactctcagtttgcagaccagctacacgagacccaactggacaagatgccaccgcttccgaagaaaggaaacctgaacctgcaagacattctcaagtctgactttgcctttgcataacaagcacttagcattaaccctcactaacgggagactacttaaggtctccctctttaagacactttaggtactaagagattaaatttatgattaacattaagactttctttaagaacatctttaagttaaaccgcttgacttccgttaagttctacgcttggatgcccggtagtgatgacctccgcaagaccgaatttaagttaggcttagggccgtgcggtaaggtggtcacgaagttggaatgttactcaacgtcctccgggatggtcatcttccagaccactgaggacaacgaaacgaaatcattctactacccgaagggttcaacgtgtggtcgtatcgaacggacatacagttaaccctcactaacgggagagttaaacttaaggtcatcaccggcggtggcctttgtgattaactttcaatacacatcaacatgaggtaagatactatgcgtaccaactttgagaaatttaccaagcgcgattcagtggtcaacgagcatggcgaacagtggcaagagcgccgtgaccgcatgaagaaacgccacaagcaacagcgcggtaactcacagaaacgggagtggaactaatgatgggacgtatctatagcggcaacctgaacgattacaaagatgcggtagcgcgtctacaggaagaccatgacgtgaccgtgaaggtggagtcattcagctatgaaaacccagcgaagatgtgcaggtcatccggtgaggttctccgcgtgttcacacgctcagggcatccggtggcatccagaaccttcgagcatagcgacagcgatgtacaaatcaacgcgcagactgcatggctccgtaaggttcacagcgatttgaaacactggaagtaataaccctcactaaagggagaacgaaaggaggaaacattatgagaatttcatttgacttaatgagtccttcctttctctcatgggatacgggtcgtcacactggcggctctattcgcaacggctatagaagggttcgttatgaaggtaagtggttaaaccatcacatactcatttgggaacacttcaacggtgcagtcccggagggaatggaagtagaccacattgaccgtaacaaacttaacaacgcgcctagtaaccttagacttgtgacccgctctgagaacaacagaaatcggtcagtacaccggaacaacaagtcaggaatcaaaggtgtctactggcacaaacaccgccaagtttggtacggtcagtgtcgaagaggcaacaaaacatttatcaccgctggttgctccacgaaggaacaggcggcagaacttttagagaaactcaaagaggaaattaattatgatgattttcaaaaccgtcccgtataaggctgtgtcattcgtagagtctgccgttaagaaagcgctggagacctccggctacctgattgctgacattaagtacgatggtgtgcgcggtaacattgtggttgacaacgtggctgaggccgcatggctgtctcgcgtatccaagttcatcccggcgctggaacacctgaacggtttcgataagcgctggcagcaactactgaacgatgaccgctgcatcttcccggatggcttcatgctggatggcgaactgatggtcaaaggtgtagacttcaacaccgggtctggcctgctgcgtaccaagtggctcaagaagaacaacttcatgtttgaccgtggtggtgttgagccgctgaaaggttccaaagtagcctttgagttagaccccaagctactcagtgttcgcctgtatgcggtcatgccgattcacattgcggagtctggcgaggactacgatgtacagaacctgctgatgccgtatcatgtggaagccatgcgctctcttctggttgaatacttcccggaaatcgagtggcttatcgctgagacctacgaggtctacgatatggattcgctgactgaactgtacgaagagaagcgtgccgaaggtcacgagggtctcattgtgaaagacccgcagggcatctataagcgaggcaagaagtctggctggtggaagctcaagcctgagtgtgaagctgatggtatcattcagggtgtcaattggggaaccgaaggtttagccaacgagggcaaagtgattggctttagtgtgcttcttgagactggtcgtttagtagacgccaacaacatctctcgcgcactgatggacgagttcacagccaacgctaaggcacacggtgaagacttctacaatgggtgggcctgtcaggtcaactacatggaagagactccagatggctccctgcgtcaccctagcttcgagaagttccgaggcactgaggacaaccctcaagagaaaatgtaaccaactcactggctcaccttaacgggtgggcctttcttcgttcagcggtattaaccctcactaacaggagacacacacaccatgtggcttatcctattcgctatcgtcgcaacgctgggattaatggctgccgacgacaacatttggcctgattgttaaggagataacatcatgcgtttacatttcaacaaatccaacggtatcttttcggttcgccgtaaagaccgctcgaccgtattggcctctgagcgcaacgccaagctgccgctgattggttcggtcgccacgctatcaccttgtgttcacctgctgattactcgtggtgagttcgtcaaggcgatgaacaaagagcgtcctcatctggaagccgtggtcacttactggcctcgcattcgtctgttcgttaagtggattaaggaggtgctgtaatgctgcaacatcattggaacaaaccagacttagaggctcgcttcccggttaactctgtggtgcgatactccggcggtggcctcaagcgcatcttagggatgagcggagtggtaactggtcactcgcacacaggtcgcgtcaaggttcgcttcggtactcagcacgctgaggttctcccgaacaacctgattccgctaccgaaagctggcgttaagactccgaacgtggaagcaccgaagacagaagtcaagtctgatgttacccatccgaaccactacatgttgttcgacaacgtggaagccattgaggttatcgcccggtcaatgaccgtcgaggcgttccgtgggtactgcttagggaacatccttaagtatcgcctacgtgctggcaagaagtccgaactggcaactatggagaaagacctcaagaaagctgcattctatcaggaactctttgacaaacaccgggggctgtgttatgacgcttcgtgaatgttgcgattggtgtgccgctaagtggaaccaagctatcgaggatggtgacaaggcgtctgctgacgcttaccaacaactgtacgcgctgtgggagcggcgctttaaggaggccaataaatgagccaatgtaacaacgggtgcaagtatgcgaaggacgtagggatggagaaccactcctgcgcaaatcgctgcatgtactcagaacagaaataccttctgacaatggaaggtaacaccgagtcctttgagattccggtattcgcccggtctcttgaagaggcaacgctacaggctgaacattacgaggacgcagggttcgtagttactcgaatccgtccagaagtgaaagcctaattaccctcactaaagggaacaacccaaactatcaaccaaaggagaaatactatggctggtttcaagaagaaaatctacacatctggtcttggcactgctgagccttatgcttacctgagtaagccggattatggcaacgaagagcgtggcttcggcaaccctcgcggtatctataaggtagacctgactctttccaataaagacccgcgctgtcaggcgatggtcgatgaaatcgtgaagactcacgaagaggcttatgctgctgccgtggaagagttcgaagcta

SEQ ID NO: 30 - skipped

SEQ ID NO: 31 - DNA, 179658 bp, Unknown
  source: /note="Description of Unknown: KP2-4a Bacteriophage Sequence"
ccttcccccgatgcatcaaaataaccgcctgtttggttgatggttcctgttaccgtgcctcctgtatttttcaagaacagtgcatcgatccatcctgaaaacccgcttttgttgatatacacgttcccgtcattagccagaataccaccgccgggtgttttaagtggttgagatatgtttgccagtgttagaacaccagtcatcgcatcaccggatttattgactgcccctacttccgccggagtcggaggaagcgaagtatcataaattcttctccatccattagcatcacccgcactataagaccatgcaccaggagaacccgtcgcagcacgaatccatgttgatgttatatcatagtaagtctgaaccagagaaacaccactattcagagtacggcgatatgtggcaacctgaccgtaatatgttgtgtttccatatggaccgtccgttacgttaccaccgaccgacagaacatcgttcttttcagtaaccgcagcagccccgaaactgtttccagacataccgcgaggaatacccgtgatataacgttcatcatggttagcccagtttgacggagttactgtattcgcagtaatcgcgccactaactgccattgatgtagcattcgttaagccgaggttagaagtcccgattacacggaaagatccttgctcaactgttacctgttgggtttgtgaatccagactcaacagcgtattttgagtaccatttttaaaggcacggatgtatattttattacctccgtctgtgcgagcgttcacgttaattgcacccgctaactgtccgccagaaataccgttgtatgcgttaatgtccatcaacccagattccgcaccaggaaccgaagtaatatcagggcgacggaaaacaaccaccggagcagcagcacttcgagtgatcccgaccgaccggttagattgaatagtgtttgcggtcaacagaacgcctactgtcacgttttgactaaacgtagtattcttcgcaacagtaccgccgttaatcgtcgatagtgcgtttatatcctccgctgttggacgatcgttttcggtgtatactctccagcctttatacgttaattgtccaccagagggcaatagaggaaggttagaagcactccagatacccgcaccacccagcgttgtacctaatttcaaatcagccataaaaatttctcctgtaatgactgtatttatgaaaaaggggctttcgcccctttaacgcacaattgacagattaacgtctttagcggacatcgaacctgtgcttgtgttgtttggataacgatataaaccgaaatcaaacataacagcaccagcaggaataaccccttcgtttttgtagaatgaatatacgttcgggatcgtgccaacatcacgcatgttaattccagagatatacgtattgtttgcatcccagaactgcattacgatgtacgcgcccttactatttgcgattgctgttgcatcacgtttcatttggcattgcatacggatcgtatcaccaggttttattccataactgcttagtgatgctttcgttaccgccgcttgctgggtagcagtccattctttgaactggtactccgctgtattggtagaagtatattcagtcggatcagaaacaatataatcaagttcagcaaagttatgcgaactaattttcttgtcactgataaccccaacaggcgaaacaggcagagaaagcaattgttcaatcgggtttacggttccagcatcagtgacttcggaaagtgtttgcatcctaataccgttgacaccgatagccgccccgtttctgttcacctcttcgcgagggactttacagaattggatatttcggcatcgggcctgacctgtggtaactgttgacggataatgataagcagaaacacccaaacgagttatatcagcattatctggaatagtgtaatatcccgataccgaatgccatgtatccgcagcaagtccagttgttctaagaactgttgatgatatccactgtccagacgcaatatgagtaaaggcatacagataacattctgcccccgcattacgtgcagcctgatcgatatagatgtccgcagtgattttgaaaatatcattacgagaaacatcactcccaacgttccaaaccccgtatgctttgaatggataaccattaccgctatacgtttgaggatcatccagcattctttcaggaataccagttaccccgatatcactaaattcatcaaacacaacttcaacaaaactcgttgtattgtctttcaaccccgtaccagaaccaccgacaaagttttccatgcaaatctttttcatcgttgatgaatagatagctgaataggatgaacggtgagaatagttggttgtggtgatcgggatattaaagaaccgagtttcgggccacgcaacagaaccaattttcctcattgtcgctaaaaagttatcatcacttctgatcgcatcgaaagtataaaaacacacaattctgttcgctggaagtgaattcaggtagtctttaatcgcattcccgttcgtagcaggatcaccatacatatcaaatgatttgtaatccaataatgctaaagttgttccatcaatgactgccaggttaattccgcgagcaacttgtgtccgcctgttaataatatcagccccgttaatagatacctcaaccgagttgaccgcagaatcgttattcgttccacggacaacaaggcgatatttcacggcgtttgcttctgaaaacacattcgccgtgaaactatcagggccgaataacgccataaattcgttattcgccatttaaattattcctcccacacaaattcacaagtcttagttgctgggtttgcgaagattttcacgttaccgattttgatatagttacgtacaaccagagtatcgacggttgaacccgctaccgctaccgccccgatttctgccggagtcggtttacgacccgcatgatagatcaggtttccgttgatcatcgctttgttgtaatcggtgatattgatgttgaactcagtcaataccttatcgtcaatgccagttaagcgcattttctggacgttcccagagaaatcacctgcctgaacatgtgccgtaccgctcacactggtaaagcgtccacccgtaccgtttacgctaactgacagcgcaccagtcatagtatcacccgctacgttgacataggtactgtcaagatgctgggtaaagtttcgggtgttgatcacggttgcagtggttgtgccgccgtcattactgattgttacaccgttccaaccattagttgcagcggttcgtaattgtaccgtaggcgttgctgtactcgcaacaaacaaatcacccgccgtgttgatgttagccagagctttaccattcagacgaatgttcgtaccggaatacgccattgtgccgttaccgacatcacctactgtcagaacgtcaaccagatccgttgtgcccgtcgccaggcgatacgtgcttgcctgaacagtttcatgccagattgtatccgtcacaccaccacggaatgtacgaagcaggtttttggttcccgcagcctcaccactcagaacagtattagcatacaccgtgtttgctttcgcagactggttaatgttattgttcgtggttacggtgttgttaaccgttaccgcagcgttagccgtcagtgttccgttagtggttacgttaccaacgaagttgctcgtaccgttaaacgtgttgtttccagttaccgtctggtttgcatcacgacgcatccagcttgcagcaaccacaccgcccagactcaaactattctgcgccgttgccattttcggtaagaagttttgcagagcaaagttcagaccgcgaggcgatacagcatagaaatcttcgagataatcgtcaacggcctgagtagaaccaaccagattatcaccgatgaaagtgtttgctttggtagtgataaacaccgcaccacgtcgagttgttgttgcaccccacgccggatcagtaccgttcaaaaactgcatggtagccggagtaattgccaggttagtagcagtacccgcacccgcttccgcgttagtcgcacaacgaataataccttcggcggtatccgtcgctttcttcgcttgcagttttttaggcgtaatgaacacggtatccagaagacctgcatcagtttcgccctgagtcgcaacgcgtaaagtaccacgctgtgtttcagtcgcagacgcaatccccaggttaaccgttgtccagatagtgccggactgagttaaaccatcagcagttgcaaccgcaacatgactcgtaacgtcgaagaactctttcagcttaaccggaacaactgccttattcgttaccgtacctgctgaaacttccgcagtggtagcgagggcaataataccatcaagcgattcagtagccttgcgatcgttcagtttcttaggcgttacagcacggagatcatcagttcccgtgtttgtttctgtctgggttgcgatctcaatcaatccgatacgcgattcagtagacgttttacgatgcagcatttcaggagttactacgatcggcattgaagcagatccagcagcagcaccagttaccacttcgttttcagtcgccagaacaaccagaccttttgacttttcggtcgccgtcttctcgttcaatgatttcggggtgacaaggtcaacaccgttattgaagttgtagacgttcgtaccagcatccccacgtaaagccccctccgctgtcgtagcgcccgttgtaacgagttttccgatacctgctaaggtttcgctcgcacgacgcgtatcgagctttttaggcgtgattgcggtagtgtcatcagtacccgcgtttgtttctgcctgagttgcgatttccagcaccccacgacgatcttctgttgctgatcgttcgttcagctttttaggcgtcacgatcacgtcatcaaggaaggttgctgtcgtgttctggttaacttccgcagttgttgccaggcgagcgataccacgacgcgtttcagtagcggttttattcgccagtgtacgcggggttactgccagttcatcagacggcgtatcttcatggttcttgtttacttctgcctgtgtagccagcgcaatcacacccagacgagaacggtttgttggatcgacacgttcaatgatcgggcgatactgtgcaactacccattctttcgtagctttcagatacgacaattccatgtatggaagatagtcagtatcggcattgaaagtcagagtgtcaacactgaaccaatcattaggcggataatccttacgctgtgggaactgcatcatgtttttgttggtgcggatcttttcaccggaaccatctttaactttgatcgtgcagttctgcgttttccccatcatgtacatactgatatatacgcgatcaccttctgcaacatcttgcggaagagtcagcgttacattacgtacagttggtgggttgccagcaatcggagtgatgaacacgtaatcgttaggcaacatgttcaggtcatcactgatacgacgcagacgaacgcgctgatcaccgtcataaacaacccaacggttattagcctgatcgaacatgaagataccataaccggaacgctgtgaagtcacagaggttacgttattgataccgtcatagctgatcgtgtgtccgctaccaggataaacttgcagagtcgcaacgttcaccgaagcaaggcgatccagatcgtaagttgtgattgagtcaccatcgtttgcgtaacgaggcaactgcaacgtaattttacccgtcccactgttacggaatgttaccatacccgcttgcatttggaaagcggttaaaccagtcgcattaacaaactgcgaatcacggttatcacgcatttcagcaacacgccataagttgccgttaaaaataaacgcaacggtcatatatgggtgagtcagtcgataagagcttgactgaatatcacgtaaacggatctgacgggtgtttgaacgcactaacaggttgttaacccctgcaagaccaccaccatctttaatagtgataatatcaccctcaacaggggcatctggcagaatataggtcagttcagagaaacgaccgtcagccattaagtacgtaccggattcaacagggagaccgtcattgctcgttacgttgttatatacccattttggatcgttacgggttgagatccattttgtttcatcgaaagcacccgctggtgatggaatatctgcgcgagcgtaccaaatacgacgcgcgtacatgatagccataaacgcagcataaccacgggtagaatcgtattgttggatcgtgttaaattcgttaaaaaagtcaacgttcacgccgtcgctcaacacagagcgtgatgctttaccaacgttgataactttttcgccagcagcatcaaggccacttgtggcgcggaatgatttagctaccattatcgttttcctttatcttattcaatactgatatttataaacaaaaaaggcgaccatcaagtcgcctttttctcacggtaattgttcagccaatctttaacaatcgcgtgatgaagaggattcgcataatctaatttgtttcttttcttgtatggcgtaaaagcgtttttctctttgtccgtcatttggaaaagggtttgaaatgatttgcgttgccttttcgtttgaactgcttctgtggtttcgataatggcatcaggaaaatatttttccttcatgtatttcgctaaccgcatatcaggcacaaataaattaatctttcttttgctgttgttgtgtcggatatcagaacgagcgcataactgaaaggctggttcgtaatatttactgacaacataagcatcaactaattcttcctcttcaagtccagaggacaccgcaaccgctcggagcatttgacgcagccagggtaacgggttgtaactgaataatgctaccacgttagtatagctcgaatagaagttcaacccgtgcgagttgtacgggatttcctgcccctcgctaaacttcgatctgtatgtgttggtgcaatagatgaactgttcgccccctaaaagcgcctccacgcgttttttaatctgggtgtatactgtcgtcccagattgagagagatcgcccgtataacgcgaataatccccctctgcgagcacatgtattttaatgcgcttcgtgtttttatattgcttaaagtcaaccagcgtttgaagcggtgaatctttgaactcaacatcatgaaacgtttgtaggatcttccctgtaatcgtatctttgatgttggatgaagcaatagttacatttttgaacttccactggcttacgtcatgatcctctacgaagtaacagacatatcccgaatcgctacattgcatcttcaccggaatagcccctaacagagcacggtaaagcgggaacatcttcattgcgatatcatcacgtttacgaagcccatcataggctaatcgtgtaaccagttctcgtttttcttcgtcaagttttaaatcaacgatatcatcggcattgcaactaaacggcaagcaaatctcgcgtatgtgcttgatattgctattaaatcgcagactttcgaacgcaaccaaatcaggaacttcgtcaatgtatagagaaaaatccttatacaaatcaaagtcatcaatgtttttgagtgctgcatgagtgataaagatcacatcataatctttgacaacctcacgcagcgcatcgttattggttcttttggttcggtgatccgtgtccacaatcaccgctcgtttcccttttacctggttgatgtagtagtcataagactgttttgataacatcatggaaatcgaagcgatgattgctttttcgcccgtttgattgatatggttcagaatcgcctttgttttaccgcttgacggaacacattcaatcgtattaaagatcatttattcttagcgtatttcttctggtatttctttattgcttcgtcggtgatctgtttaggcatttgacgtgctttcttcggtttcagtggttcgacaccgaagatttcaacgccgtaatgtttcagcatcattgcaacgatttcctgacgaatgaagttgcggctaaccttttcagggaattgatctttaatctgcttatgaagacgatcttcgagcgcgtccaggtgagtaggagtgatgatcgcggtgttatcgcgttcaacgaatttctccatgtattccattgtttcagcatgaacagcatttgcagcagggagtaaaatttcacggctcatttaatcaccaataagttgtttcagttgcagataaccgccgataagtttgttatcgacaaaaatacgcgggtattgaaacgctaaactacgttgccttacccgttttgctaactcttcgatacgtgggcgatcgtattcaaagcccagatcgtttttcgcttctttcagaacgggataaaatgtatattctatccctttttctgtcaacagcttttgtgcttgtatacacccgtaacagttatgaagactttcgggaattccgtagatttcgactttcattcttctttccgtatggtttgagatcctgcaaaatacgctttttctctttgcctaacagtttttcgatattctcaacagcggttaactgagtgtgcagatcgaacaggtttgcaatctggtcttcctgcattttcagttcagattccatgttgatttgatagatgctaccaccactgaaaacatgttgcaaggcgaaacgcagcatcgcatcagatttacgtactggcatcggtgcgatgctcaacgtttccaggttagccccgaatgatggatcgatgcggagatcacgcagaggattttcctgtacagagcgatacgtgaatttagggatatccatcaggcacagatccgaaccagtgacaccagcggaaacctcttccggtgtagcgatacgcataacgttttcagcctctacacctttacccagattaacttcttctggttcttctggggtgaattcaccatcttccggcgttacttccttgaaccatttccatagtgatgcagggagttcatattcgtagccaccgtccatgataaatgcgcggtcttcaaactcaccgatcgaggtgcgatcaatcgtcacgtaacctttttcacggatgatgtttgcgatacctgttttccaggttttctctgcaaagatttcaggggatacggttaaaccgtaagtttttccagcgaataattccatgattacctcaaataaaaaaggggatgccgtaagcacccccgaattatattacttacttgccagcaatgcaagttttgcggcggcttcacgaactgcgcgagctttctgcgcaacaacttcgatcgctttctggtgttctgccagtgcgtcttctactgccagtgcagcttcgatgatctctttattgcgttgctgtgcagcaacatcaacggcctgaactgctggagcgtttgccggagctttaccagtaccgagttcacggaagaacttacgctcacgatgcatgatatacgggagagtacgatcttgtgtgatagatgcatcaccgtcgccgtcaacagactcaagcaccataataccgttgttatttttgatgtgttgcacaatgcgtttgttcgcggtatgagagcgcaggaaaccagcttcatctaccagaacatacggacgaccagcaacgaaatgtgtaggcatagcttcaaccgttgctggttgtggtgcagcaggttttgcaactggttcagttaccggagcgaggttaacaccaccatccagttcagaatccagatccggtttcgctggtgcaggtgcaacagacggtttgcctactggttttggctttttagcgcgttttggcgctggggctttagccggagcaacttctgtgaagtatttcgcttcccatgcacgaagggtgttcatagcgacacctgctggagcattgaaggtgtagcgatcaccgttacggcttgtgatgtttacaacaccgttcagcaattggtggatctgttttgattgaacactgttcgcaatgtttttgccgttgtcagtgaaaccttcgacatcaaccagcttgtaatctttaccagtttcgaagcgggtttctttggttctcaccgtccacggatgtgaaccgcttcctttggtgatgtttttcagtgggatcgaccacttccagcaatagtcacgggcttctttacgggttttgaaattcagaatcatgatattatctctcaattgggttaaatttatgctacgtggatatcttaacagaactaccaaccaggtcaagcgatatttttaatttcgatggaattctttttgaactcaatcattcgctgattatccgaaccgcgaaacggtttcttagtcggtagatccttttcgtaccgtccatcgatcagaacatcaatgaatggtaacagcttagagcgttctgtatcgccctgtaaggcttcgagggtgtaacccgtccaaacccacacatctttatcagggaacgtcgcacggacgcgctggagcagttttaagagcgtcggatgattggtgcggtaaaacggatcgccgcctgtaagcgtcaacccgtccacatggggatttgaaaggagtttaatcaactcgttttcagtctcttcggtgtatggtgtaccgttgcggggattccatgttgatttgttgtagcaaccttcgcatttatgattgcagccagtcacgaacaacactacacggattcctttaccgttaaccacatccatgttatagatgcggtcaaagttcatcagcctttcgcctctgggaacagacgggctttgatcgcttcgtcgataatttgcgggaattcattattcacgcgcttaacgatttcctgacgaaccgttacttcgaggtttttggttacgcgagcaataaacgcttcttcgtccgctttgaggtttccggttgcatcgttgattgcttccagcttgattgaatccagcaggtcggcgcactgttttttaacgtttgtcgtgatcagttctttgatctggcggataccgcctgaattgatatcgaaaacattgctgtatgcgtaacgtttctgaatgtaatcagcaaactctttatgcacaatcttttcgatttcgtgattggctggcatcatcaaattgacgtgcttgatcaccatgttttcgatttcttcggttacgcgcttaccgataacgctgtcaacaacgttcttgatgacagcggcttgcagatccattcgcgcttgtgttccttctgggaacaggttgttcagcgcctgtgtgtctaatttcagttgaatcattttatagtgcctttcttctcaaggatcagttctttgatccgttccacgattacggcgtattcccagttggctaacttctgggtatcacaccactgttgaaaatccttcattgcttttacgtgaccttctttccagtaagtcaccgcgatttcgttacaaagattttcagtagcagtatttttgattttcatgatttagcccctatagtttgttgtctacaggggcatattataacatcattcgtcgtccgtcaactcttttttgaatccgacataataagcatcagatccattccatgtggaggcgttaacgctacccaacagaacacgacaaggcatattgttatgcgcagactctacaacctgggatactgaatccagcggattgctaccagacacccagcggagcagatgacgatcatcaccgttaatcggatcaacgaattcaaatttgataccgttttcaatcagttcgtgcagaagaaagtttatcgctttgcactgcgctttgttaatcagcataaatcacctaccagatctttatcaattttggtgtatgtgagcgccggatcatacttctccagcacgttctttttgcacgaatggatgaacttttccatcgcacgggctttcatcaatactttgaaatcttcaccaaagcattgtttgattgtgggaattgcacgagccgctttgtcacaatcaatgatcagtttgtactcgccttgtgtcgtgacaaccaccattgagatcagaacacaaccatcaaatcctttttcattgattttatggaagttcagcttatccgtagtgcttgccaggttcgcataacgatccccgcgaatgttacccggagaactataccgcgaaacgttgattgaaggaatacgaatatcttcaacgatatcacatgacgcaacagcttcaacgaaatcaagaattctggtcgctttgatgacgtgcgccttaaacgaaccgacttctaactcatattcatctttccagcctgaatagtagtcaaccgcagggctaatcgctttcatgagcgcttcgggaatgtcaatgtgccatagctgttctgcgtactgtttgcgccagtctggataagttttacgtgctggtttgaatgcactgttgccgtcttcgaacatcatttcacttttcctctctttttcgtaaatgtcgtacacacttcttcgttcgtaagcgtcttttaggttgctgtttactatactatcatgcgtcagttcttcgcaatactttttatcccattcagaacacgcatgttcaaccatttcctgaaaaacgcgctgtggaacattcccatctacaagaatcctcaataagcgatcagtatcatcattcggtaaagtatgaaagtttttaggaagtttaacatagaagtttctcgcacgagaaatcaaccattcttcaccgcgatcacgttcaatagtgtaatcgtacatagcaaaaaaggggctttcgccccttcctcttatttcgcgttcagggagtcgatgtaagcgctaacgtcagcggaggttacggaagcggcatttttgccacccagcaacacatcaatcttcgtcacgatggtatcgacgcttacggaagtgtggcctacagcggcgatcacgtcttccggtacagtcagacccagactttcggtttgcttgttcagttcgatgatctccaggttgattttgacatcagccagtttgcgatccagttcgacgacagagagatcaatctctttgttcatcccttccagttcttcgatcttcgtctgtaagccctgccagatgttacggtgttgcagcgccagcacgtaatgactgttggacacttcctgccccgccgccagcagttttttgatctctgattctttaccagtgtgaaggtttttgtgttcggtaactttctttttcagcttcgcgatttcctgaacagcagaaacgcgagtatgttgcagacggtcgatctctttgatcaggatacgtgcagcactgcgccatgcttcttctggggaagtgttttgttcgattgcagtttcaactttaccagtcacgaacgatacgagtttcttgaacataattttgccttatttgatttcgaattgattggtgaaccattcaggggctttaacaactttcccctctctgatataaccgattttacatagttcgttggttaagtcaagtctttttccacccgccatgtaaaattttaatctgcttactgggatcaccggacggataacgtcacgatagccgaaatgcgcactacgcaccactatagagagcatacgcaagcggttgatacaaccagtatacgaacgcccagtagcgcgggagaagtcctccagcgtaacgccaggggcaattgcacctatcagatcaagataatccttttcaacccagaaccgcccaacagaacatttcgatacaccctcagccattaccgcgtttgggtgtttctcgtcttcgcgcttctttttgtcctcaaggaacttattgaaccggatttcttcgagtcggttttcccgttctacccgtgcgcgtacacggaagggaaacaaagtatcaaggattttcccgatcatatcgttggctttccgtttggtcgtttaagatcgaaaggaacattcacaggccggacggtttctaattggagatattgttccatccccacacgtttaccgcctactttgttataacggatgttctttccgtcatagcctacagcctgtgaaatgtagtagttcttagtttcgcgtaaacactccatccattcttgtgttccggttttgttgcgaacccgcgcctttaatggaaacatcattcaccccgtagaactttcagttcaccagacaaacgatgtagattggcggttgcagtatcataacgtttttcggtgtctttcagggtagtttcccgcgccttacgcaagaatttttccagatcacctggtttcgtcaccagcttaccatctacgtaaattcgtcccagcaggtgagaacaatccagcagttgttgtgcgtcggctttttcaacagcaggtttaatcgcgacaaactttttaaagaatccgcgatcctcgttatcaaacagatacgaatcttcggaataccatgttgtgccattggcatcaacgatcccactaacacctttccggttgcagtgcgttaccttgataggaaacacgacagatgatagttgattaggcgacagaggactaccacgcaaagctaaattgcggtatacagtcccaaaactttcttcatcgcgaaattcaaaatagtcttttgtccagtacatcatttttcaatacctcatagtttcggtatgtgcaatataacaaaagcccctcactttcgcaaggggctttttgattaattttgatgcttagttcggtgcatcatttctttgttcttaccttcgttgaatccacggacagcaggagcacccaaataaccgcatgtacggcgcgtgacgctcattttagccggatcgtgattaccgcagtgcttacagtggaaaccttcttctgtaggcgtgaactcgtcatcagagccacatacaaagcacttatcgaccggaaggttagttccgaagtagtccagtttttccatcgcataatcccagactttttccagggcttgcaggttgtttttcatatcagggaattcaacgtaactgatatgacccgcagtagcgatataatgataatcggcttcatagtcaattttctcgaacggtgttaccttgcggtcaacgtccaggtggaaactgtttgtgtaccagcctttatccgtgacacctttgacgcttccgaacttctcaaagtccagcttacagaagcgatggcagagagattccgctggggttgaatacaggctgaaaccatatcctgttttcttcttccatgcttcggttgccgcgcgaaggtactcaatgatcaatctgccgatattctgggagccgatacgatcgaatgggtgttggcctgagccaaacatcaacagcgtttcatgcagtccgatataacccagactgatagagctacgcccatttttgaacagttccagaatttcatcatccggtttcagtcgaacaccaaaagcaccttctgtgtacaggatcggcgcaacactggctttaacaccgcgtaggctttcgatacgagtcatcagggcttcaaaacacagttccagacgttcatcaaggatgcgccagaatgcgtcgtgtgcgtcttcgttttcctgtgcttccgcttcaatagcgatgcgtgggaggttgattgtcaccacacccaggttattacgtccatccagaacttcattaccgttatcatcatgccacacgctaaggaaactgcgacaacccataggagatacaggaacgctagaaccagtaatagcgcggttattagccgaactaatgatatctgggtacatgcgtttagaagcacattccagagccagttgtttgatgtcatagttgcgatcctctggatcaaggttgattcctttttccatgaacataaccagtttagggaataccggagtgataccctctttacccaggccgcgaatacggtttttcagaatcgctttctggatcattcgttcaaacatacccgtaccagtaccgaaagtgatggtaacgaatggggtttgaccattggcagtatgtagggtgttaacttcatattcgtaagactggaacgcatcaaaaacatctttttcagtcttttccatcgcgtatgtacgatcgccagaaataccgtatttccttgcggttttttcgtgtttttcatacgtcatacgagcgtatggagccagcactttatcaacattcgcaaaggttgtcccgccgtactggtgagaagcaatctgtgcggtgatctgcgccatgagagcggtagcaacaccgatcgatttaggcggttcaatgtccgcgttacccatcttgaaaccgttctccagcatacctttcaggtcaaccagacagcagttagtgtaaggggtgaacgggctatagtccagatcgtgataatggatgtcgccggagtcatgcgcttctacgatatgtttcggaaggatatgattaggggcgaaatgcttcgctacaatgcccgccagcaaatcgcgctgtgtcgggaatacccttgcgtctttgttcgcgttctcgttggtgatctctttgttggacagattcaccataccggagatatctttgaacagcttacttttctgttcacgggcaatatcgcgatcgtggcgatattcgatgtatgcacgggcgaccgctgggttcgttttcatcagggattcttcaacgagttcctggatacgggcgatcttcattgcgctaccatcgcggatctgattgtactgaaccagcatgattgcggcatcagcatccgtcatagtcccgccagctttttctacagcaatacggattttttctttgtcaaaatcaacggctttgccgtctcgtttttctactttcatttcgttgccttcattaattgctttctatattttgcggttaaggctttgcgttcgtctttgtctgcgtattcaaagcccatagaaaccatttcggcaatcatatcaggtttggtaagtcttgaaaaccattttaccttatctggtatgaatttgtcatgaatacggttttcggaatagtcttgtttcagatatgcaagcaagttctctaaccactggatgtaatcaacatcacgggacaccagaccggatctgttgaatttgtgcttcacaataccttctgtaccgttgcataggttacacagtaggccgcgcacacgtccggcgttttcgccgtctaaagcatggtcatggtcaaggtgatgtttctcgatctctccctcaagaggacgtttgcagagagcacaacgcccaccttgtttttcaaagagggcttgcttgatagtcgggtagtcttttttggtaattcgtttcgtcagcataataacaccattcagtaaggtgtcattatttattacagggtgcggacgtactcgcgaagttggtcgaatccgcctacgtgtttcccgtcatggaaaatctgaggcatagtcatccggcgcgtaccaaccagggcttcgagttcgtcgatcaccgcttcattcagcacaggtttaccgtcttccacggaatccgcaacagacacgaactcatacggatgttttttcgcgtccagcaagcgctttgagttcaggcatggagcgcagttatacacagaagggatatagccataaattttaaacatgttaacctacattaaatcgttcagtgttaaagggaatgtatttacgtcgcgtttctggtagttgcacacgtagacttcttgcgttttgttttgctcgtaagagtcggtatgctggcctaacagatactttttatccagattatgaacgcggtatttctgcatccattcaatcaggatatcattttgttttccggcatggtgagtcacgttggacagtccgaacatgattccttcgctgtgtagttcatccaggaaagcatataactcgcgttcgcgatcttcgttccagaacttgttatacactgcatcggtgatcaggtacggcggatcacagtacacgaaatcattttcacagatatcaatgtcacggaatgaaccactggaaaactcaatacctttcacattctttttgaaatgttcaaagcgttttactgttgcatcgttgagcgtccggcatccgaaattagcgttgaagtcgcctttgtcgtttgtccggttaacgttgctgaatgaatgcaggatcaggacatagagccataacggatctttgttctggttgtattcatcacggaatttcaaatactcttctttcttgtctttccccagacccttcgatgcaatcaattctcgcaccggagacaggtcaggaagcgttttaagacgctcatacatatcaatcagcgtcttatcgtaatcgttgcttagaacgggtttagggacgtttaacgacacactaaggccaccgcaaaaacaatcaatgaaacgcatgtatgaacttctttcggggaacagcttgaagagttcaggtaatagcgactgtttgttgcctgtataggggataacacccaaataactcatagaaaagattccagattgttaacgtatggctgaacacgaagaatagaatcgtgataataattctccatcagttcgaagcctttgaaccgtctgttggttagtatcgacattttcatcactgtaccagagccagagaatatatcaagaaccaagtccccttcaaccgtccacgttttaatgtgatcttctgccagttgttcaggaaatattgctgggtgtttgaatgcaatctcgtccttcgttgagtgatttcgccctacagcgtaataccagatattacccttaattttatccttgccaacaggtttacgtttcttaccggaacgggctgaacggttcttttcgttggtttcggaaaagtagctgttttgtcgtgcggtttccttttcagggaacttacacggaatgcggatcgggttgaatgtttttggtgcgccttttgtccacacgaacatgtattcaaagtcctgttcgtatcggttatggttcttcggtagagcggttttgtgatagatcatcgtatcatgcaaccgaaaaccttgttcgagcgcgtacaaggcttgacggaaagatgtacccgtttcactaccgttgatagtcgcgtcacccacaacccacacaaccacaccaccgggcgcggtaacgcggtacagttccgatatcaactctttccatacgtgttcaccccagacatcaccagagccgttataatggcgcaagttgtcatacggaggcgaagttatggtcaagtcaacagaaccagattcaagctgtttaatcagctttacggagtcgcctaaatggaggtcaaccccttctttgattgtggtaatcataattcaccaagtcctttctcaaataaggcgatcgtttcgtacttatacccacgattcaccacgaagcaataattttcgcctaatttctcaagcattgcaatagcacggtgttcatcttttttatctttcaacagataagcaattcgaacaacctcttttagtgtcgcgttgtccacctgttccaacttgaacccgtagcccaccaacttacaaaaaagccccttgcgagcgacaaggggctgattgttgtagaagactaccgatccgttatcgttggcgcggatattaaatccttgctcgctcacggataacccctactgtatcggaggtgtttaatacaccgttgtcgtaatacgtaatcatcgcatcacgccacccgtcaggaatctcagtttccagagtgtcgattgttttgaattccacaccgttagtgatggtcatcagcaaacctttcttactctgtttccattcggaacctttcgggcatttgtaaacgcctttccacacaccattcacgaggatagcgcacagtttttcagcatacttttgagtgtcgcgggtaacttcttgcagcaaaccgccgcccataccgaacgcgatgttctcactcgcccacttgttcgcttccatccaacttaacacacggttgattgtttcaggcccgtggatctcgtcgccctggatgattcgaactgaattatgcagaactttgtaacctttgctgtttacggtgtaaccgaagatttcgcccagtttacgcagggtgtacatgatgttatcaatcatatcaccggaatcaggacgaacaaccagagtaccaccagcagcaatgatttgctctttatattcagcgatgcgatctacagcgcctttgtagtcccaggaatcgtacacacaagcgtagaaccctgtaccgaacatttcgatgctgtttttgtatgcttcgtcttcgttctctttaccgtaggaaatcgtagtcgaatgttcgcgagccggaattgaaacaccgattgcttcgacgttttcaacttcatcaaacagagtttgatagtccgcaaacagactgattgccataatcataccttcaacggtatcagtcccgatgaagttatagaggtgtgccagcccaccaatacccgcagattcagcagaggtcgcgccacgcgccccgaaatcatgcagacgtgtacccagtgtgatgttatatgcttcaccagtcaggtcagaagtcatatcaaggtaatgagccagaacctttttacactcacgcgatagcgttgctacagatgacggataccagataccgcgaatcgtcattgtctccagccacccagccaaccatgagaattcatgttcggcgtacacagtcgcaacggcatttttaaccggaacaaccgtaccttctgggatcgcacggaaagtaacagggacataacccagttctgcgatcttcttccacccttcgtagttgaaaatctctttcccaaagtgcttacggtaaagtacccgtgccaactcaacttgtttcatggtaattggttcagcaagaacccgcgcaacgaagttaacgccagcggttactacttcatcaaacttaccaccgcgagattcaatatagaacatcgctgcatcagtgccttgtggatactgcaaccagtgggacactttgtaggaatcagttgaggtgatcaggctattcagttcattaaaagttttcatttaaacgtactccacgttttgatttaaaagatacgatccaaacgttctggatggatcgtgttccagtatttactcttacagtctttcctggattttttaccattagagcagaacaccttatgatatgtcgtcttcttgtgcaactctttgcacgtaggacaggtgatcatggttcctactttagcggcttttgcaacatcgtacaattgtttgatgtccttctgccgctcggacgtaatgacacgcccgtttacttctttgacaaccgtttcagttcgaatcgaaccatcggaatatttaacaggagttttgacttgcttcggcgcatttgcttgttgcaaaagccttagagtttctcgacgtaaattatgaccacaaaaatcatcatcgtcatcgtcgtagccaccccagctatcaatatattctgcttcactcatgctcgatccttagttgctggtcagtaagaagacccggttgtcgctatagtcgatgtagcaatcccaccaacccgcacagttaacaccatctttttcaaggcttatgattttaacgctggttgcaacgtcatcatattcataaaccgcacccagttcgttcagcattgcttcaacgttagcccgtaagcctttaccgttgtgtgctacaccattcagtgccaagcagtagccagcgcaagtaggtactaatttgatttccatgatgttttccttttgggttagtgtcttgtctacgggagctatattaccacactcataactcccgtcaacaagtttttcgaattattttcaccaggtgatgtaataagtcagatcgctatatccgtcacgcttaggatcgctaaaattggtctggatacgacgcgaacccgcgaaggtattgagtaacgcagcttgtcggttgcgctgtgtatcgaaagtaaacccttcttccgccaaccattcacccagatccgcatatgctttttcggtacattcctgatccatagtcttaccgataaaacgtttcatatcaaaggtatatgattgtttagtcggatatttcaggacatactcggaaatgtctttgcgggatgcttcgaccattttcgcgttgatttcgtcaaccagtttacgcgcacgttctgccagtgtcgggctacgtccgcagcggggatcatcttgcgtttcgcgtttgacccacgatgtcccgcttcccgcctgtgcgttcacaccgattccattgatttctaccattatgtttcgccttttttaatgcctcttcaactgcgaggcgttcgtaattacgtgattgttcgggagttatcaccagagaaaatccagagtaggaggtttagtgttaatccctaaagtatcgcagacttcatccagaacgttttgattccaaaggttgaacgttggaactttatacaatctggcaagccttgcagcgatcgcagtaccacctttaacacaaaaatctttctctaccgcccagaatagaacaaaatctgtaggtttgtccaggttttcggttaatacctgcattgaattgcgagcgtatcggcgttgtgtccattcgctttggttgtcgaagtgtccagctacctttctcgcttcgtcagcggctttgtacgtgtcgtattctgtatagtcgatgatatccttaccattcgaatacaacccgttaaaaccgttctcagggaggattatacgccgtctttctggtgagtagtcaaacatgaaatggctatccattccaggagcaccaccagagtaagcgaagatcccccgatcacttaaagcacgtccaatctttatggctatactcgcgatacgttcagggggttcacggctaccgatcagggtagccgtttttgcgttttcgagaacagttttaaaattcattgttcaggattgcgccccagttctcacgaaccagatttgacgcttcgttagtgaaggttttcttcgccagcgttggattttcgaactgttccaggaaaggcccgtagttacgttcgatttcttccagcgcgtcctgtaccgtcagccccatcacgcgaccgaaatctttcgcggtgagattcgcgctgtcaatttttgacagaacatttttcacacggttttcagtcaggtagcaggtgaattcgttcagcttcactttgtctgtttctgacagttcagaaggagcattgaagcggttcgcttgcttgttcttcttctctgtgaacttcgtcgttttgcatttgattgcaacgcgttcaccgttcggcatgaaagcgggttgaacaggcttcatcacgaaaccttctgcgatgttctcaccttcaccatctttcagcgtcatgaagtttttgaactcaggttcaacgccgttctttgcagggatcgcaccggagttcgccaggttaaccaccgaatcaaaggtgataggcagtgtgcggatctcgtcaaacgtaccgtatgccagcagtggagccattttcaagccaacagcaacagcgtaattcgcaacaacgttatcagggaggaactgaccattgacgcggatatcaaatacgtagaaatctttttctccgtagtcaacatctttctgtacaccacgccccgcgaattcgccgtatacctggatcaccagttcatcgctatactcaccgcttaactgacgcgcagtagagatcatttcccacatcttacgaacaggttcggagtatttcgcaactacgggttcgcaaccgtagaactgttcagcagggagaatttcaccgctacgttttgccggaatgactttgataccgtccgaagtgatcaggctaaagttagccccgtggatcttttcacgcgcaacccatacgccaccagtcaaaccattcatgatcacaccattgatgaatttaccttcataatggttagtcagagaagaatatttcacaaacataattaacccttgattttcagttgtttttcaatttgatacgcagctttgcgtaacagtttcagttttacttctggaaggatcacagaacccttcataaacgcatcgagatttgatttctcgctattcgcggcgctggttactgcgatcgtgttttcaaccgtgtatcccagagaagcgttgattcgttccattgttcgggagtcagagcaaccgcctttgttgctaaacggtctgccggagtaagaacatacgggttcactcattagcttcgcccagtcgcttaacgtcagagcaaattgaaggttgcggttacgcgcatcatcgtttttactgttgtatgaacgagcgacacgcagatcgaattcaatttgctttgcacggcggcggtgttctaactcagcaggatcgagtgataccatagtttgaactttttccggttctactggctttggttttgcttcaaccttcaccaaatcctttttgatagtcgaagttatcacgcccgaccagcgattcatcattgaagacatataaaccccttacaccaaacccgcttcctggaacgccagcgccatagcgccgttgattgctttacgtttgttatctggacgcggatcgcgtttagctttggtcttaggcttacgctgttcttcacgatgtttgttgatatacacacgacgcagaacatgtttcacttttggattttctgcgcggaaagcacgaattcgctcgatttcctgaacaatcacgtaaatgtcgccgttatcgagcatgtgctcacgggcgatctgtgcatagcccagtttcagatcattgaatttaaaatgaatctgtactttttcctgctggctaacttcgctgatattacgctgaacgattttcatagttactttcctttagtagaatcaattttacgaataaactctaacacttcggcatttctgctgtcaacattttttagaacaaaagttacaactacatgaacaccggatgcttcgttccaaccatcagcacacgggatcatcagatcatccagagtgttgacaaggttttccatatccgcagggtgatcgacaaacaaagtttgtgtttcggtgatactggctttgaagcgtttcccgatctgtgcttcgagttcgtccagcataccagcagataacgcggcgatgtcgatatttttcatcccaccatacacaacatgaaatagtttcatatgcaactaacctcattttcatatttttcgcgttcgaaacagtcgggttcgttccagatctggtcaaactcacgtttcgtcatgatatagccacgggcgattttgcgagttagatctgaaccgatcggagcataccacaaaatcaatttacacaccattccctgaaccagacaatcatacagccctttttccagggtgcgtacatctgttacgctatcgactaaatcgggggcacttcgttcaggatggtctttccactgactttcgatgatgtcgtttagttccctgtgaaaataaatccacgattggaacgacgcatcaggcggatttgatttgcaaccagcaggataaaattcaagcattttgatcagcctcattcgcaatacagatcgccataaaggtaaacataacccccaacgcaaccatccagatcgcggttaaatccccatacaaagaagaataaccacccatcacttcaacgcgatatcccagcaagaaaacgagatacgccaacaccttatctttcataattcctcacagaaagcccatgcagcatgataaacgcttgcgcctttgtcatcgttcatgcataccacatctaccggacacacaacccgatacagtaccggatcaccacctattgaacgtgcagcccttccagcatagatacgagccagcccgatatcagcagtgaagaaaacacgatccagatttttctttctgcctttttcagacagagtatcagaatcacaaggaggcaacaacatgctttcgattccggcagcagtacatgatccgtgatagaactcaacgaactctttgcggcagtgaatggtattcatggttatctccttgttttcagagattacagcttatcgctattcgcccgacaagtcaacaaattctttttcaacgtcttcttttgttctgaacaggtaatcagtaaggcgacccgtcatcaattcgcgagttttagcaactgaacgaacacggcgttcacgttggctttcggcatcaccaattccgtgacctggttcccacccttccatatccaacataatgcgcgggtgcatcatcacacgaatatcgtttccatatgaatagctgttatattgcccgaatacaaatcttttgaatttttcatgatgaacatcatcaacttcgacctgttcaccatagtacacaatttcatcacagaacgcagcgagaatcaaaccaccagagttttgaatttttaggatcgcgtagaccatgcggtgacgtgcttctgcaattatatcatgagagccaaatccaatctcttttgtcccgaagcgacagaaaatagaataggtgatgttcagcaggtatttcgcgacgatttgccattcattatagataggattgggattgacacggtatgctgatttatattcgcgacgcagttgaagaagtgtttctatgactttagcaacactccacccgttcggataagtcgaatcgttgcgtttagcaacagcaattgttgaatttgcgtataagtggttgaaagacattacgcggacgttatcgacgtaaccacgatcgcgagcactccatttgaagtaatcccattttggatcacaatctggacgcatagacggggtatgccagcgcttgaaccccaagagattacagaaatcgtcaatcagggtatcgcgacgggatttatattttgactggtcgccaagagcagcggcgttgatgaattcatgcagttcatttttcataattgttaccttatggttaaagttcttccggcctatccgtcgaacaattgcactataaacacactcataaaccgtgtcaataaatacttttaaataaacacctggagttctaagatgaaatcattcaaagactttacgagccttgatgaagcgctgatcaccttcggcggtaaggcttatcctaaatttggtcaggtagtcatcctggctggcggcgcgggttctggtaaagggttcaccctcgaaaagctgttaggcatcgaagggatcaccctggacgttgacgcactcaaaaaattggtcatgggtagtaccaaactggcagcagagatcaaagcgaaaactggtcacgatgtcaaaacaatgaacctgaaaaacccggacaacgtagcaacactgcatcatgtgatcgcagacgtgttcaacgtatccaacaaaaaccaggcgcgtgtgtacgctggtatcacagcagcaccggaagaccgtaaaccaaacctgatctttgacgtaaccctgaaaagcatgagcaagctggcaagtatcgcccgtgatgttgaagcgctgggttatcagaaagaaaacatccatatcgtttgggttatgaacgatgttcatattgctatgcagcagaaccttaaacgcgatcgtgtagtgcctaaagaaatcctcatggatacccacgaaggggcagcgctcactatggcgaagatcctgaatatgggcgactctctgaaacagtacatggacggcgatatctggatcagcttcaacaaagtaggcattgacagcgaaatcaagaaatctgacaaaggcggtatgtttgtcgttaagtctaactacatcaaagttaaggcaaaaggaaagccgcagaaatccattgaccagcttgataaagagttagtggctaaagttgcagcatacgcaccgaaaactgatacatggggttgacaataggaacatatatgaatatgatgcacacacaaaccgaggaattgatatgaaaaagtttttgttcgatatggatggtgtactgttcaactgggaaggttcttttgttccgatgtacggagacccggcgagaatgccggaagaagaattgaaaaaagcgaaacaggctatatcacaaactgacttctacgaaaatctggaaccattacaagagggcatcgacctgttctgtcatttgagaactttaggtcaggttgcgatcttaaccagcgtagggaaatacaattccgatgcggtagcagaacaaaaaagaaaagcgttgatgaaggtgttcggttatctgcctgaattccactacaccaaaagcagcggagagaaagcagcatatgcggacaaaggtatactgattgatgacagggcaaaagctgtgttgccattcagaaaagccggaggtaaagcgattctcttcgttggtagcaaagaagaagcattgaaagaaatcagaaaaattgcataaaagaaagggaaccattgcggttcccttttttgtttatggtgtgtaatccgcaaaggagcggttcacatcatgaatagtgatgttcatatcgtcgttcaggaaaacactacgatatttccctgcgctatcccatgcttgacgatgcttatcattgcgggagatcagagggcaacggtaagcgtgggctttcagttcgttcagatcccgacaagtccagaagtctaaacgtacaatacccatctgtgcgcatactttatccatgtacgcgattttttgactattcacccaggacgggctttttgcttcgttgacgagaataaaaccgacttcgcgatcgcgataggtcatgccccatttcatcatatcccaacccaacacctcgatcgccagtttttcatagaaatctgtacgaaccagggacgatacagcagcttcatattctgcatctgtcatgttttgtgggcgtttgccaaatttggcttcgattgcgtcgctgaattttgcgaatacatcattgaattcaaatagtagcatttttaccttcttagttgttattatggtgcaggtttaacgtttaccgtcagagttgcagtaacagatccagaggttgctgttacgacaacatcaccttcactaaccgcatgaagtttaccaccaacgatagaaccatgaccggaagagtcaacactcagagtcatttctgtaccagaaggatcgatggtaaacagatcagttgcagccagatccgcatcacctactttgaaatcagcaggagcggtttttggtgtaattgttacgacaggatcagcaggagtaaaatcactcagcttatacagataaccgttgcgggattcgatgaaatcaacatcggtgtaatcaatatacgcctgtttcagtgtgtcgaattctttcgcgtatttttcttcggcataatcacgccagtcttcgcttgcagcattcgcagccacgatgatatcaaagatccaccacggcaaataggtaaagctggtgttacgccacgggatcgggtgtaccgtagtccatttttctgtagccattttcaaaacctcttagtttttctctatttagagaagtaaaattttgccgtcacaagacggacatttatcatattggttcacgcgcccatagccgttgcattcaggacagaacgggtttgttacaccgaacacattacggatcgcgtaagtggattgttcttctgtcagccctacgaacccatcggtattgatgaaatgttcactctgttccggtagcatatcggtatcgtcatcaaggataaggtaattcttacatccgaaggtgtcgatccatgctttgatttcatcaccgcgtcctgcttgtcggtctgttagattcgtacaggttttcccaatgatgcgatacaatccccacgggtagaagatttcccgtagagtatgggttgtgttgccgatcctccatgtagaggaaatgacaatatcacagttcgcatgatttacgatccggcgcaggtgtcgagcacattcaatgtccatatgctcaccaaatttcatgcaccgcatattatttagaacgccgtcgatatcaaggaagatgacgtttccgatctctttaccttctgataagtctttcaggcattcgtgatttaattcagtcatattttacctacaaaaaagggggcgtagccccctttgaattttaatagaaaccgcgagcttcgttatccaggcgacggtctgcaatcatgtgcgcttccatttggcgagaaacataatcaggatcgcattccatttttgcttcttcgtagttgtcccaggtatcagcaacccattttgaaccgttccaacgagcataaccaggttcagcagggacaggataatcagcttcgtaagcgtggcgcagtgcttcttcaacagtatagtaaggagcatttgaattgactactttcttcactttaccatcagcccaaacaaacagaactgggtagtaagcatttttcatcatttcgtttttcattttgctttccttcttcactgcgagagccattcccccgccttcgagtacaaatatactttaaacgagggtatgcgtcaacaagttttttagcaaaaagtgctaaaacttaaatgtttcgaatcggctatttctggtttcgcgaacacgaacttcgccatcgcgcacgatatagaacgcaagtgatttgattgtgtcgattgcgcttgcatgtggacagctatcaggatctttgtaccagtctggggtttgtttaatccagtcatagatccaccacggacaggtataatacccgttagaactcgcagagcgccccatcatgaagattgtcgggctaaacccttccaaccataccagttcgcctttggactcgtcagaagcgcttacaggagcttctacgacatcaggtactaattggatttgatcggctacttccggcgcgacctctttaacgtactccataaaatccgcagaagcatcaataaccacatcgggaacgttcggggcttcgatgacaggttcacccatagtcacctcacctttatatgcgacgatttccggttctggtgaatcgatcagcagttccggcttttcttcatcttccggtaaagcagcaaccagatccgccagcatgttatcgaaggatttttgtttgttcagcttaaccgcaaacacagtcatagcgtaatcggctaaagcgcctttctgttcttttgcgtcgagggtacggaacccatcaactttttcgtaatcaatgttcattggtatctccaagtgtttatccaatatttatgacataaatacgtatatactttgtacatagggtaatcatagtggatattgaagtcaaatttttaaacacaagccacgtacagattcaggcagaaccaaacattgtctatgaactgcgtgactatttcagcttccagcccccaggctatcagtatcaggccaaatacaaatatggtggatggaacggttacatttacttgatggactacaacgggaaactcccgtatgggttagcctatctggtatccaaattcgcagaatcacgcgggtattcaatctgggttgatccaaagatccacgaaactgaggatatcacgcaagaagattttgataagtgggttagcgaacatccggtttatgacggcgacaaacagatcgacccgtactggtatcaacgcgaatcagtgttccacggtatcaaaaaccgtcgcggtgttctgaacctgccaacatcagcaggtaaatctctgattcaggggcttatctctcgttggtgtctggaacattacagcgggaaagtgttgatcatcgttccgactaccgcacttgttgaccaaatgatcgaggacatcgcaaactatcgtttgttcccgaaatcggcaatgctgggtatccgttccggtacagcgaaaaacagtaatgcactgatttacgtttctacctggcaatcagcggttaaaatgcctgccgaatggttccaacagttcatgtgtttgatggttgatgaatgccacctctcaacaggcatgagcatcaaaaagattatcgacacgatggatcaatgtatcttcaaactgggcttatccggttccctgaaagaagggaaaacgaacatgatgcaatacatcggtgcgttcggcaaagtctttaaaccagttgatacgcgtcgtttgatggatgatggacaagtcaccaacctgaaaattaacacgatcttccttcgatacaaagaagaagaggtcaaaaaattgaagggtgcggactaccagacggaaatcaagtacgtaaccagccacacacggcgcaacgcgtggattctaaaattagcgctcaaattagcccgtgagaagaacgaaaacgcctttgtgatgttccggtacaaagagcacggaaaatggctgtacgagcagttgagcaaggtttacgataacgtggtgttggtcaatggtgatacagatattgacgatcgtaacgaaatgaagaaaatcgcggaatcgacgaaaggtttaatcgtcatcggttcgatcggggtactgagtacgggtatctcaatcaagaacctacaccacatcatttttgcgcacccttgcaaatctgctgttgtggtgaaacagtctatcggtcgtgtacttcgtaagcacggatcgaaagcgctcgctactgtatgggatatcgttgataacctggctacgctgtcaaagtctaagacagccaaaaataaatacagtgcgacaaactacggtatgaaacatgctatggaacgtgtgcggatctacaatgaagaacgattcgactacgcgatcaaacaggtagaaatttaagaggccaaaatgaaaagttttactacattcgtaaacgaagcagcgattgatgatttcatgaataaggttgcttcgtgccggacactagaaggtttgaaagaacttgaaaagtattacaacacccgcgtgaaagaagtcgaggttgcagcatccgatgacatttcaatgcgtgacgcgatcaagggacggcgagaagaactgaaagccgaacttgaaaccggagaagaagagaagttttaaaaagaaagccccaaccgaaaggaaggggctttttaatttcggaaaccgtttgttccgacacgtacatttattttatttcagtgctgtactattctgaattacaattaactggcctttactcgaaggtatcttaccaatcaccccaccgaaagtaaattctatcggacggcgcaaatgggtacgccacacggtaagcccaagccccacaaggggtacacatctatttactgctataaatctgggcgttcgtcttcgatacaaccgctttcaaacgaaattcgaagtgcatgaaccctggtcacacattcttccatcaatcccagcaaacgaaatacttcgttaaagtcgatttttgaatagtctttcatattcacacctacagcaacatttgaacttcgttcagatcgtcggcttcattgataccgcgatcattcctttcgttgagatattgcaaacatacgacaccgcagatcgggccagcttcattgacaaacgccgtattacgggagttcatcggttgtttgcacacaacgcatttgcaatcaaattcttctgccattttatgcaccactctcaagtttacggatctccaacatgtttttgatggagtagcctttgttcttaacgatatccagcgcttttccggtaaactctgcaatcagttcgaagtattggatcagcttgttaacttcaacggtcttaggatcaccggagatagcaattttgatttcacccgaaccagtgtaaatgacatcggtcatttcgctttcgtgtctaccagtgtagaacagtaaccgatcttttacaatcgcttctttcttcgcctggagttgaataagttttttcttagcattcgaatggtatcgaagccattttgaccaaatcttcggaatgtctgctgattcgctttgtaacttcaacggatcaatacgcatatcctcttcaagttcagcctgtagatcttcaagttttagttcagccatgtatcacctcaaaacaaagtaacattataaccagttagatcaagaagtcaaatctacgagcgaagcgagtacatgaacgaacgtagtgagtgaatgttggttaaaaagtatacggaaatgtactgttttctctatatataaaatataaatattataaacagtacatcgtacttacccatcactcacttcgttcgtgaaaactcgcttcgctcgtttgaccttatagatctttattactataatggtcttctcaaaacaaaacttgttaacccagtttaggtaatttaatacctacgatctgactcagcttagatttacctgcaagagcagaccaatcatcacctttgatcaggcgatcagaatcactttcagcagtatacgggttcacggaaagaccgtaacgcatcagaatagcaacttttggttgcagggatgccggatctacggatactttgattgaacctgcttcgtcagcttcggtatacggagcgaagaacagagagcctacgtgatccatatcacccagatcatatttgcaaccagtcagcatataatcgaacgggctgttggtgtctgtatagacataataaccgttgttcagcttacctgttgccagtgggtgttgttcgtcggtttcgtgcatccaaccagacgcagccagaatgcctacaacacgcgctgttgcgaggacgtaggtagcatcaaatgaagtcgttctattcatttcctgccccatttcacacgctaattgatacaggatacgacccaatgctggggcatccttcgcggtgtatgcggttgtgccgtcaaaaataccatccgtaacgagtccatccacgttgtaacgtttggaaacggtgatcagagtttgaataatgtctttgttgacttcttcacttgccacggttcccagaatgtcttcgatcaccccatcagcttcaaactggtttgcttccaaatcctgcatcagttcaaccgtcatttcggttttaaacttacgcgaacgtaccggaatattccagcgatccatctggaaggaggttgacgcgatatcttcactggtttcatacttagaagtatcagcggcttcgctaaccagacgaatcttgctttggaacacagctttcatgatcgcggtgtctttgtcagtatccagagtgttcagggtaataggtgcaatcacctcataaacaacgtcagtaccgtcatgcttgaacaaatcacctttaacgtaggctttagtcagatcgatttcgtcgatgtctgtacgtccagagattcggcctgaataggttgcagcactggagaaagtcatatcaccgttagggttgcgatagcgaacaccgaacagtgttgcaacagggagttctgtttcttgtacagcaaccagttcatgatagatcaggttgttaaccgcgcgagtcaaagaaaccagttctgggcgcgtgttctgtacgttgatgtcggtcgtacctgttgcttcgttgataactttttctcgtttaccagacggaagcgaagactgacgcatcaacttgtgaattgtgtagtgtttatcactcatttctttggttcctgaattagagggctttttacctgtatctatttacaccaacaaaaaaggcaacccgtaggttgccttttagtgtaaagtcgattacagacctttaacccagaccttacggaagtatgcgtttttaccgcacatttctttgctgatcataccagaggtgatacgatctgccggagcctgagagcgagagttcgcaaacgggttgatgccgataccgtaacgagttttgaagcccattactggctggaagttcttaggatcagaaccacgcagcggagtcagcgcaacgtatggagcgtagtagataccagcatccatttcgttatcacccttgtagcccacggtgaagtaatcctggcgagcgtactggtcgatgtacactttgtaagtgccacccagtacaccagcgaataccgctttagtggtgtctacgttcagagttttctggagaccctgacctgccggagtgatgccgctgtcgatacgagccagagcggaaaccacgttacgggaagcgatgatgaagttaccagcaccacgaccagtttgacgcgcgatttcgttcgcttctttgtcgatctgaatcagcagagctttatagctttcaccagcccaacgagcgccgcgaatatctactggatcttggaagtcaaacgcaccagctttagagccaacggtctgagtgaaaccagtcttaccaatctgcgcggtgtagttgatcaggtcaacgatttcgcggttgatttccagcatgatttcagttgccaggattgcagacagttcggcgtcagcgtccataccgtgtacagcacgaagatcctgtgccagttcaacggaatactgtgctttcagttgacggctacgagcttcgataacctgtttgtcgatacggaaagccatttcgttccacgggttagcgctggaaccgttgaagttttcctggagttctgctacgctggtagccataccttcggaaatttcagccagagtgcctttctcgttttctgcgattacagcagcatccagagcagcagcatcagcaccagttacggttacgttgccggaggttacgttctggaagtacgcgataccagtttcctggaatacgtgcttaacgatagcgccggaagcgatagcagtaccggaagcgatagcagcaaacgcggtgtttgcaccttcaccagaatacatggtgtctggagcgaacatcggatggaatgcttcacgaacgtttgcaggagtaccgccagccagaggatctttaccgtatacagcacggagtgcgaacacctgaccagtagggccagtcataggctgaacaccgcaaatgtcgaatgcgatcaggttaggaatcgcacggcgaaccataccgattacagcagggccgatgttggtgattgcaccgctggatttaccagaggcaatgttggttgcgtcgtaaccgtggtcacccgcgatctctgcttccgccaggaaaccgccgaaggattcaatgattttttcgtcgcgatatactggatcagtatcagcatccttttcctgagtttccagaattgctgcaaccagttgttttttggatttggtagcgatatccggtaaaccttcctgagattccagaagatcgttccatttttccatcaattcgtttttcttagacattgtttcttaccttataagattaggaaagggctttagccgcttgtacatatttattgatcttcgatttctctgctggaggtgtattttcattcaccggaacaaagtcatctttagtggttgtctgagtagtggtactctcttcaacctgtttttccgctttagtcgctaccatttcaacgattgcggtcagtttggattcgaacttgtcggaatattccaaaccttcgatcaggttctgaaccttttcaatttgtgattcagtcagatcttttgttttttctgaaacgatggtatcgcgtttcatgttggcgatctctttagcctgagcctgattagcttcgaacaggcgtttaacttcctgctgattctcggtcagttcatcttcgagttctgcaacaacatcaacctgtgcttctgggataactacgttgtgttcaacgaacagttctttcattcccattaccagagattcgaacagatcggccttgatatcacgggatacagcttctttgttttcagagagccattcctgcgcgatgtggtcgaagtatttattcgcatcttcgtacagtttattttcgatttcgccagctttttcggcaacctgggcttcaaccagttcatcggagcgttccgcgatctgggcgatgtgggtttcagcgagtttcgcagcacctgcttttacagcttgttcgaatacagtggtgaagtttgctttcgcatcatcagaaagttcaactgattcgaaaatgctgtctaactcaactggggtatccaggttctgggcttctgccaacagttgttctttaagcatttctaagtttcctgtttgatatgatattatttatatagacttttcaaacgttcagagagttttctgaaagcgtcatcatcagcactattattctcaacaagcgttttgcttgactgagattcggtaatcggcttaacgtaagcatctggagcgcttggcccccaaacaacatcaacgcctactgccaatttaaacccttcttgtacgataccgtaaccttttccagaatcggaaagtttacccagtccgcgagaagaaacacctggaacccaacctgcgcgaattaacgccgcgagtttatccccatcaccgttatcaccttcgacaacaacagcgcgaccccaaacgtcattacctttccaccataatttttcaattaggatgcaagcattacgcggatcgacattcggtcgcggcggatgattcatttcacccagagcttgacgggtattaacctgagttctgatataatcgtttactgcttcttctaatacttttttcggatacagtcgcttattgcggttaactttttcggcctggaggaaaataccttcaatccgaagtttaccgtcttttttcgactcaccgaccgattctaaaattgaatcggaaatatccgcacaaggtaaaccccattcctcgattagcagcatatcgccgttttcattgagttgggattcattcatatttatagccctaatgcggcgcgtttacggagcgcttttttacgcttacgctgtgcgcgggttgtaatagaagggtttgcacgttttgtttttagcgcacgacgcgcaatttggcgacgttgagatttagttaaaccagttgtttgatacgcattacgttcacgggttttacggtcttttttacgttccacattaccgcgcgaatctacgtgtttaacaatgacttcatctaaactcaaaccctcgacaatggacatcatagccagggctaaatgaggttcattgaccgccaaattttcgatgatcttcacagtgccgtcatcgatccccagaacatcaacacgggctttcgcttcggttaaatggggttcgagatcttcgacgctgatttcttcgagttcgagttgcattatttacacctcttattcgtctttatcgtcgtcttttttatcagacggctttttgtctttgtcgtcgcctttatcatcgccgcctttgtcgtcgtcatcgtcatcgttgtcgtcatcgtcggtttcaccttcgatgcgtacagcttccgcgagttcaacgcgcatttcttggcgaagggcttcggtacggtcttccatgatggaatagaattgcttcttcgcttccaccagatcaccgcttttgattgcttcgataaattctttcatcaaaagttttcctcttcctcttcgggatttttgaaccgttcttctttggattcttcttcgatcagcttcgcttgttcgtcaatgtcttcatcagacattcgaagaatctctttcatgatgtatttatgggagacatatttccctactacaccttcaacctgtgacattaacgttaggcgacgttccataatctcaatatctttcacttccgcataatatgaatcttgctggaaaatgaaggaaattttgctaacgttttcttcccattcttcctctgtgatgatttttttcgcgatcaggttagtttttaacggatcggaaagcacagggctgaactgaatttgcagtgtgcggataaacttactgaatttcagttcatcacgggtgatttcgccaccaccaccaatttgcatacccccatcatcgcgaggcatacggcttaatggcacacgcagtgcttcatagagcttacggttaaaccatttgatatcatccatatcagagaagttcgcaccgcctggaagcgtgtctacttcggtgatagctttaccgtcacgacgcattaaccagtaatcttctgtcattgacaggttgttttgctggttcttaacagtacccgttttagcatcgtacacaacgcggtttttaagcccctgtgcgatgttatttacgtactgtgtcgctttgttgccacccatctgacctacatcgatgtagaacacacggcgttcaggtgcgcgggtgatacggtagatgaccatcgcatcttccagtaaacgcaattggtttgctggcttgactgcgcggtgcagatatccgataatgttgttactgcaatcttccagaccagaatgcgcatacacgatagcggagcgcgggattttaaccttctggttatgctggtagatctgcccgttgtatgtatagccatttttaggagcgctatacacgaaaaattcgcgataaccacggaatactttcacgccaccatcgagggtttcagtgatagattcgcggatcagttccatcgaacgcggatcaagttgacgcagttcgcggatacctttgctttcgtctttatgcatgattttatggaagtatatacgggaatccacataccaatcacggaacagacgcgcacccatgttatcaaaatcatagatatttagaacgttatcaaattcttctacgattttgtcctggattgccttactaaaatctgttttggcaagatccaaagtaatgatatctttgccctgttcattcacgatcgcatcgtcaataatttcagaaacagcgttttctacttctgggtaagacatgatgccgcgatatgtattgattaattgttctttgttctgaatcgccggatcttgtccagaataaaactgctggaatacgcttgcgtatttctgattagtcagatcagtttcgatttcataagcaccatcattatttttaggaggcgcgaccgaacctgtatcattttttaattgctgttcaagatctaattcgtcctcacgggcgaaattcttgaaaaagctaagtacattgccaaagcccaaaaagttcatagtaactccgaaaaataatgataggggtattgctacccctgtatttatagcctttattcccaccagtccagcgcgaaagtaacctcaaaggttgacacttcgttgttgctgtcccagtccagggtaacttcgcctacgttagtagggaaaagaccgtgaatggtatgttcggcggtaatttcatcgttacggtttttctgtttcaccgtagcggtttttttgtagttcgctggaatatcaccactaatctgatcgcccattccgtgcatcatgtttgaccatgctaccagagcgtcacgcgtattatgcgcgtcatcgttatagatcgtgattgtccagtcatcataggtacggtcaccagcaacgttgattttgcggttttggtatcctaccggaactttttcaactgtagccgctggcatggttgccgctttacacttgaatttaaagtttttgcccagatacgggatctctacttcgaacaggttcggacgtgcgaaatcaccggattcaaaggcgcgtaaaatgtcagtaagcatttttaacctcggattatttatgggggcttttcagcccccttgacgttatacggcttgcggccctaccagttcatcgaaatctgcgcccgtagacgttgctacgaagttcagagtgatgtagttgatagaacgaggcggtttcacgtagatcgttgctacaaactcgttacggtcgattacgtccggtgtgttgttcgtggtgtcgcagattacacggtaatcgtagcagccacccagcgcacgaatattagtcatgtactgacctgtatccatacggaacgaagaacgggtgaaatcgtcgttgttttcaaacagtttgtatttcgcgttatcaccgatgtctttcttgatcatgttgaacaagcgacgaacgttgatacggtcaaatggactcggtacgttagtcagtgttttatcaccgaacagaacgaagccggaaccacccgcgaaaccagttaccgggttaatctgaacctgatacattgcgtcacgatgtgctgtgcgcggttcgatagccagtttgatacagttgcggatctgaccacggttgtaacctgctggagacatccacggttgagcaacgctatcagtgtaaacacacaggccagcgatatcacctgccagcggaacccaacggttcacgtcattgtatttatcatactgatatttatagttaccatccaggaagccatagcttgaacttacgttcaggttattgtcaaccggagtaccaccactgagtttatatccagtacgccattcaatgatgttatcaaccgctgttgccagtggaatattcaccatcagagagcgcggaggcgacacaaacacagtacaatcctgacgttcatcaccgatagagataacgtgtttctggacggtagacatgatctctacagtttcaccagcacacgcaccagcaatcagcagaggtacatgcagcgcttcacgatcagcgaacatatcccaaccagtcatcagttcatcagcgcctacagtgtcgtttgaggacaaaccaccgccgaactcaaggataccggagaagcctttaggccagttcagggaagtaccgtaaacgtactgagagccaccgttagcgaaaaagtcatccatgaagatgtttacgccgtagatatctttatcggtcttctcagttgacacgatgaaggattcctgtacaatgccaccacgacgcacaacaaaagcgtactggttgtcggtctgtggcccgtaggtcattacagaacgaccgctattcttaacggaaaccccagaagggtagcctgaaatcatagcgccagaatcgtaagcagctttggagataatctccacctgaacagttgaacccagttcaccaggatacagagccacgacagacgggatctgatatttctgggtaagagtctggaatgcggttccctgaattgtttcttttgcaatatccaggttcaacagagtgatccctgaatcgctttcgatgccgtcaatcgtaatagacgcagaaacaccggaagactgagaaacaatttcggtagtccagccagtagaaatatctgggtaagtgccaatctgtttagcacgggcaacgattttttcgcttgggatgattaccgcgaggatcttgccgttactgtcaacttcggacactttaccgttttcttctacaacaacgctgttgtattttactttaattacatcgtttacagtgtagttagaaccctgtgatgcgatagttgttttgatctggttgaaaattgcgcttgcgtttttagcggcatctttatcgacaacgcgaaccacacggagatcattaccgtactgcaagaagttaacagcactcatgaaatagtcagcggtcaagttgtctggggaaccaaaatagtttaccatttcgacttcgttagaaatctgacggatctgataagctggcccccatgaaaatttaccgacaatggcagcgcgaccagttgaatttcgaacaacggtagattgtaccgatgtttctttggtttcaatacctggagattgtaaagccattatagaatttcctctaatttatataaacgaaataccgtgagaaccaaccgaaatcgtttcatcaccgcttgtaacgataaccggacataatgcgtcttcgtatagctgttcgcgttcccgtgcaaaaacttcattggctagtcttaaatcgtctttctcgcagaattcggcaaatttcatttgagttgtaagccaaccgaaacaagcaagcgacataacgaggtcatcgtgatatccttcttccgcagcccacgaaacgcctttttctgagaaagtacgaaattcgagtattgtctttttgttatttatgatcaatttatctttctcgatcaggtctttcagcgtcgaacatcccatagcttttgatcgcttagtctgtttcatacccagatcgttgtagctgtcacaaataacattctcatattccagttcggaaaacagagatttggcaactgaatgccctgtgctatttagctcaatgtaaatccatgcctcgttatacatattcagataacgtaacaggatatccggcaaaataagatgcgacgttttgtttgagtgatacaccgcaacctgttcaaatggcatcgtcgtaatgtcgatgatatgcattgcatggtaatcctgtccgcgaccttccgctggatcaagtaccgcaacatatttatgcccctctactggacgtttatactgatagaagttcgtttccgtttcatcaatatcaatccatgtgagttttgacaacttccaaccagcgatcagggttccactggttcccatgaattccgcgcagtgttcctgcaagaatgcctctttgctggagccagcgatcatcttcgcagaccacgaataaccgtcatcaaatgtaccgttgtcgccgtctgtatacaatcgctctttaaccgatgtccagatcgccgtgtaaggcacgaagccggattttccttctatagcagcgttccagatatcatagaagtggttaagcccgttaggtgtcgttgtgataaggattttcgatttacgaccagaagaaattactggctgaatcgctaaccacgcatcaacaaagttcgggataaacgcgcattcgtcgatgtagatcatcgcgaaggagttaccacgcaccgcatcgggagaagatgcaaacgcaccaattttacatttgttgtcaagttcaatagaacctttgttccattcaacaataccaggctgcaagaagtcgggcagtagttcgatcgcctgtttggtacgatccagaacttccgcagacatcgaggctttgtgagccagcacaccaacatatttatcttcgttgaaacacacgaagtgagccaggaagattgcaacaacggttgttttacccaactgacgcgacaggttacaggcaaccatacggtttttgtgcatttcgatcagcatttcgcgctgatagtcacgcaactgaaccttgattgtaccatagtcaatgtgggtgatcgcacaatatgtttcagcaaaataaacgatatcatcacgacatttcacccactccatcaacatttgttgcgtccatttagtctggatatacgcacgtttcaggtttgggttgccgttatatcgggttttcttgttgcctttatttttgtacgtggcaaagttcgaactgtccttagactgaatatcgaccttttgaatgccgttaattttcaggtagtcactgaacgttgtcggataccattttttatcgtgttcgctttgtgtccactccatccccaattcatcaattttctttttcagatatttgggatgcattaatccgatagggtgatctgattccttactcggatcgatcgtcggttccatttccatcagggtttacctctacagcttcaccattaatgaagccctctttgggttcatatgcactgccgtatttctgcatcagttccgtaggggaaccaacaaatacggttgcattctcgatattcatttcactaccaccaccgcctttttcagcacctggttttgtagtctcttccgtaatctcacgcatttctttgtgaatcttcatcaggccaatgtttgaaacgtttaactgattcatcaggcttgtgaatacctcgacgtggcgaggcgattcggagttcttcgcgttgtgtaatgcgatctgcgccatatccatgatcatctgattcatatggtgcgcagtcttacgcgcgagcgtataatcctcttccagatccggtttccggtctgctggatgtgattgaacgtcaaccagttcaagtttctcgtaaacaaccacatcctccccagactcaacgccgccagggagggaatcaatattcagcaattgctgtaaatctaatttttcatccattttcattccctcggcttaggaggttcatcaccagacgggatcggcttatcgtgcgagtacgtctgaatatattcttcgcccgtgtagtcctgcataggcaaatctaccggatcggcttgactatccacggattcaaagttatctttatctaacgggttcatgttagcgaagaaatccgtgtaaacggttctgatttcgcctttaacatcagttacaggcgggtacagataaccctgtaattcaaacataaatgaccactcaacatgacggcgttgatttgcatcgccctcgaatgtggtatccggcgcaaccgattggagactgattttgatgtctcggtcaactgtgatatcgttcttatgcagttcggtaatcttacagttgaaatgcggttgaaaatatggcaaaatctgttctgcgatttggaacatatcatcttcatatcgcgtgtaaacacccagttcgaaaatcagacgatatggcacagggttaaactgtgtgatcgtttttcgtggggttgctaactgtgtcattttttggttgaccgcgatactggttttacggattgcgttatattgcagatccaccagtgataagttcatgcgcggtaaaatcgtttccgttttagcaacgttttcctgactcaacgtgtagttaagtttgttcatggaagcgagaaacttctctttcgatgcataggtgatcggaaccttgatgtatttttcttgatcgccgcgtactcttttaacctgaacatggttaaacaattgtcccataagaacaatatagttacgcagtgagctattataccagtagccaaacaattttatactccttctataatattcaacagtttatcgtaattggatatatctgttgtttctgtatatccatccatcatatctgatttatcgactacgccacaaacaagagattgtttgatcttctgttcaatactcattgcatcaatacctttatcgaataatttttgataaaccagttcgtgtttataaacggatttatttgattgcgcacacattcttttttttggtgttctgttggttatcccaaatttcagaaattttccagatagtgattgtacgtatacgtatgctggtttgttcggattgaacccagacgttgcgcattttttacagcgatgaccttgattgagaaaagcaactatacttacatcccaattatggcctttatcgcaaaccattgatatttttgtgtgcgcatctttatacaccccaacgaaatctacgaatgtatatccaattgaatctgcaagagttttgatttcctcgattctgttttcctttgatattttcatcttaggggaacacaaataacatccgtttggacgacttttgttgacaaatggtttgatctgtttttctgttctatgtcctttactgcaaacaacataaaactttgaatattttgtgatcgctgattggtctacccatccatcaaaagatagttctaattccgcacaacgttcttttaattgatgttctctttgttctatagagatttttgcaaccatatcataaaatcctcttcgaagagggtatagacttccgcctatacccatataacgtatttatggcagacttgcaaacggtgaaccgcgtccgttgacaacatcaaaagattcgatgaattcatcaccttctctttcaaattctttgtcttcttcgtactgttcgatgttgatatcagccagcccgtcaagatttcggataggttcgagatccagttctgcatcaggttcgatatggattccttcatttcgctgcaattcaggagccagttcttcaccagtgtagatgaatttcgccaggttgattttacgctgaggacgatcaccgaactgatagaacggatcggcttctacccacgtaatttcaaacaggctattgtccataggaaaataaaccagatcccccagaacaggaataccaccatcagtttgatgtgcgaacaaacgagggttaattaccagcgtcatttcatcgtttgaactcagaccaaatttactaaagaaatctcgttgtccttcatagttggcatacgattcaatatatgcagcaattttccatgacttcgtaaatttggattctcggtcttcgcccaggatcttatcaatattcacgaagtcacgccggacgtaatacatatcaggcgatttcatctggattgattctgctgtcagtgaatcgtgtagctgttgtgtcgggttgtatttgtaccagtttacatacgggttagtgacctgatcctttaagttgcgatcaaccccttcccccgtagacaactgagcgaataaactttcatcccagttttgcattattccccctacaccataatgatcggtactgcgtcagacatagaaatcagttcatcgcgcagactttgcagtttggtttccgcttcctggatcagtcgcgtaccatcaggagcaacaccgccaggcaattgcatcccctggaatttagccagaatttgtccgttgatctctttcaccagtgcggtagagtagtcttttacccagcggttgttatatgcagacgttccgcccgtaacagttgaaccctgtcccgctcgtacaccgcctacaacgctgttatacgggttttcgtagatgtcggctatggattggtcttccactgcgttagaacccgctgtagcgtatcctgcgacgcttcctacggagctagggacatcaacgaaggaacgaaccatcgcttcaataacgataatgtcgcctttgttcacctgcccccatgcgcagaactgaccagtatcatcgttgaaccagtaatcaggcagtggagccagcaggtcttgcattgagcgttgataggacatcatctgggtaaagtagcccatatccgcgccgtatgcgttcataccgtacacactcgatgcacagcgcccacccagagagccaccagtcaaccccatcaggaaatcggtaaaccacggataaaccgctgtaccgtccattgtggtcaatgaacccatgtttgtacgcaacaccttcgtgatcgcgaagatgtgttctttgctcaagtcgaacacgttgcgcgggttatcatcacccagtgtcaaaatcagatacgttttgtttgtgccgttataatgatattctgcatacaggtctaaagcgcgttgaatgcagtcataaatctgatcttgtgtgatttcgattttgatgattggtgcgcccagacgacgaagaatttcatcctttaactgttctggattattcgtaatcatatgatcctcaaaaggggcttgcgccccttgttaaaattatgctaccgtcacagtacattcagcggaggtgatggtcgccggagaagtcgcggaatccgtaacttcaactttgtacacacccgcttctgctactgtagccaggcttgcgccagtttccccagtaacttcaaccgtatctttaaaccatttgtatgtatatggtgttttgccaccagtaacaacaacggctaaatccatattatcgcctgttgtataactcttcgttgccggaagatccgttgtaaacgccagagccggacgagtagttacagtcacagtcgcggttgctgaatcgttggtactgttcatcgcgtcagttacggttacatagtaatcacccgcatctgcgctggttgcagcagacttgacgatagaagaaccagtttcaccactcaatacagatccgtctttatgccatacgtaagtgtacggagttttaccaccgctaaacactacttccagagtcaatggatcaccatcaacaacagaaatatcgctcaagtttgtatcgaactgaggaaccgtatgtaccgcaatgtcaagttcatcagaagtaatcacggtattttcagcgtcggttacgacaactttatatacgccggaatcactcgttgtgatgttctggatcattacactcggtgaatcagtcccgatatttgcggttcctttcttccactggtacacataaggcagtttaccacctgtaacggtaacagataaagaaatatcatcaccctcgatataatcgttacgaccgaccagattttgagtaaatgacagtggaactttcttcgcttcgtatttgttatccgcttcaacttctgtgatatacggaaccagagcatcagcaacatcctggcgagaggctttattctgttccagatcgtccagacgttgttcaacgttaccaccaccgccagcttcgagagcagcaacacgcgcagtcagatcggaaatcagtttataaatccctgtttctgatcctgtagtattaacgccgatcgcagttttgttatcgcgagccgttttctgaataccatctttgaggaatggatcagaactggttgcatcaccataaacagctttacccatcgcgatattagccgcaacgagtccagttgacgtattacccacaattgcggtaacatcaaccagtgcctggtgatcgtcgcgctgtgtgttttccacattcagcagacggcctttgatgcttgttggctgggagtcagtaccgatatcggtcataacctgcgccatttcaccgcgcagaccatcatcacttgtttcaccaacgatcatattcagatcgctaatgctacgtttcattgtgctgatatcgtaacggatactacctggaacctgtgagttaccaacagcgctttccagaaggattacgcgaggcagaacaccaacaaccggatcattcatctgggtttgcagagtagtaatgttcgtttccgcagtttccatgcgggaatcaatactaccagaaccacctgagcctgtacgcccgatataagtgttgatgtttgacagttcggtattaataccagtgatatcgccaccgataccattcagacgaacatacacagattcgaaagtggctaaatgcttcggccccatttcgttacgcagatcggtaacttcatcggttaaattacctacatctgagtttacccagtcatcttccagcttagtaatacgtgcttcatggatagataccgcctgagcgttagccattaccttgtatttcacgccggagccagtagaggacggatcaacatcaccatcttcgttaaagccaggatatgcacccagttcatctttcaggaaaataatatcttttcgaatggtacgatgtttaggatcggttgacgcatcccatacaccaatttccttttcgatatcctgaattttcagggtgttgcttgctgtagttgcctgtacagcagacatatctactttcagcacgtcaacatcagcgacaactttatccagtttgtcgatcacactatcatcagagatcgccgcgaggttttcagtaatgaggttaacctgatcgataacttcgttgatttttgatgtctgggtagttgtatttgcttctaattgtaccgcgttcttttgaaccagaacaccgcatctgtttaaagaaccctcgttagtggttttggtttttgcaccatcgagagtttcgccgttaacaatccaattgatctgggtttgtgtggtgtccgcagggacaccatcaacaaacgggatctttggtaacgggttaagttttgaaatcatggattaacccctttatcgtactcgaattacgtagttgaccgcaaggtttttcattcgcgtttcatttccgccagtacctaatgctttgctgtaatcgttattcaggtgcataacacgttggtcatttttttccgcgcctttcagttcataaactgcttgactcttaggaagattaccgccgttctggtaaatcatctggagatcatgttcgtgatacgcaaacatatcagcctgatatgtaccaaaaccgcgacctgcatccacaccacgcccaccatcaaagccgcgagctacaagaccgcgcatatcaggcaagttgaaaatatcaccagaaccgccgtatgtataaccaattcgggcaaacagttctgggtttgaattgcggttcattgctcgcccgttacagataaacaagttaccaacatcggcgttaaacgctgcaagcatcatacatccgatcgggatatttgcgtcaacatctgtctttgtctggtatttattgtcagcactaatcgaaccctgatacaatgcaccaccagtaattgcactgtttttgttgctcggtactacgttagcaccagcagacaaagcagtattcgctaatccggtattgatatctgttgttaatttaaccataccgaaagtagagccggaacccttcacagcagcgagtttttgcggggtgatcgctttggtgttatcagtacccgcgtttacttctgcctgggtagcgatacggagtaaacctaaatcactttcgcttgcagtcagacgaataaacgtgtatggtgaaatcgcaaacccatcgcgaatagtacccgcgcgaacttctgcaacagttgctaactgaacaagaccaaacgaactttctgttgcgtttgcctgtaccggaaccagagcagagatcgcttgcttcactttaagcggagtcattgcggtagtgtcatcagtaccggatgttgcctgagcagttgttgacagtttcacagaaccccaaacgttttcttttgcatggcgggtgttaaacacatagttcaacgagcgcggagtaagagaaaccagatcgtttgttactgttactgattctgcatcagttgcgtaacgagtgtaaccccatacggtttgtgatgcatgagggttttgcagacggtattccagcaaagcaggagttacgatcgtctgggtatcagtacccgcatcaatcattgcctgtgtcgcaatagcagcaataccgcgcacaccaggcgcggcattaggcaaaccaacatcagtacgcgcccacggcccaatagcggctaatgcctgttgtacgttcttaaacgtgctaggccattgcgtaccagcaggatcaaatgtcacgtaaacggatttatcgcttacgtggttaattgtattgttcatttgttatcctcatgcaatacgcttgaaataataaatcggaactgctggagtaacagcaaggtcaatttcacctaactttgtccatgtaccgtaaccagatttagcctgtacgtcgattgttcctaccatcgaaattccgtattcagttttattagtaaccggatgcggaactgaatcaataaaacgaacttccagaatttccccgttgagacctttacgagtaaccaaatcgaaatatttttcatcgttgacgaattcaacgaatttgttatagactgtctcacatacggtagaggcgttcgttgtattgtcgaaaacgaacgggaaaccataaacgtgaatagtcgcctgtgtttgatctggatctgggtttgaaaccgtcccatcaaacgtaattgattctacctgttgcaccgcagaaggggggctatcttccgtcatcatgattaccccattgatcgggatctgttgagacaaagaatacaggtcatcaattgctgattgtacgttagggtaatctaccccttttcgaagctgatcgacgtttgcaccaccaatagtacgtttaccaccaatcagcggttctttcgtacccatttcatattgcaaaaagtctgcttcacgggaagggactttcgccccctcccttgttttggaaataaactgagtcatttatgctacccttatccagcggtgaacagtaatataaggcgggagcgtttttagtttatctggagtagtgttcccccgatttacttttaatacatcctcgcggtatttagtgtaacctggccctgttgcatctgggtcaacctgacagccaccaataataatgatcccgttgtcatctttaatcaacaccttatcggttgactgaatttgtggaacgttgatcggtttaatttcataaccacgttcgccaccagtaccaccagaagtgtgagttggttgaccggaaccatccagatcgttattgttcagaccaaaatcgctatccgatgcatcggttgtccaacctgcaaggaacataccttccgcgtaacgtgtccagataccaaagcccatataatcgcctgggttagcatcattatgcgcgttttcgtagattgtcccgattgggtgaataacatcaaagaacgcttgcagatccagaagacgaccgctaaatgtatccgctactttacgcgaggttttctgcgttgggttgttataatcggtatattcgatctgattaaccagcgtcacttcttcttcgttgttcaggtaaatcttatcggtgtgttctttaataccgcctacaccgtcccattccattacagtaccgatatcattgttgaaccagcgaatagttaccacatcacgggattccagaggttgagcaaatttaatgccagtaaccacggagtcaacaaaaatcagactgtaatcctgtccagaaggaacccacgcgccggagttcgcaatacagctatcttcatcataaccttctgcgccctcacaaacaaatgtcgggagatccgcatcgcctgctttaacaagctggcgaccgttcagcagcagttcgaacgagttcgggttaatcaaaattcgcggactgataccaaattcagcattagtgaacgtgcgtttgtttggtagatcaccaacccagatttcaccagggatactaacctgttctgtgtctcccgtgttatatacgcgcatggtatgcgcttcatacgtcgctcgccatgcggcaataccatccagataggtaacgaattgaagcgtgtcaccagcgttacacgggtttttaagacggatatttacaccatccagatctaccagttgtccggcgctcgcaccaggcgaaccgtaatcgctgtttgatgaattaaacccgttcttgtcgtcgatgtacagcaagttaccgcgatagtaaacttccagtgcgcggacgttgtacgagttaccagggccgaacacgttcaggaagtcagtttgtccctgagtcgcgatatacgtttctttcgcaacggttgccagatccgaagttgtgattttgtcaacctgtttgttttcaacatattcccaacgtccaggagaacaataaacaagttcaacgtccatcaggtctttgtacagttctttgtaagtcggtgagcctttgatggtatcaccgcttgcagggacgatacggacgttgtttaccgcccacttaccccatacgtcacgtaagcgaataaccttgttataatcgcttacactgcctttagggaggtttaccgtaatacggttgttgctggtattcagcgcccatgattcaccgaaaataggggtcagcgtaggcgctgtgtgcgttttccacgcacccgctgggtgcgggatactcccgtcacccagtttattatataactcggtaaagttggcgttagtcttttgaccaccacgacgcagataatcacctgcgccgtcatcaaccacgttaccgataagaatttcttgtttcatgctgcgatccctgatttaatggtgtcaaccgctttaatcgagaatttaatgcgatcctcggttttggattgtacgtttgcgtaaacaatatcactcgcaccaacagtgaacgtaagcgtgtacatttcatcttcgctatttttgagaactgcgtattcagttgaatacacgcccttagcgacacggtcaacagacaaaagaatttcagccattttattgactgtgcctgtcatattctccgcgtacacgagaattttcgccccactgaattcactataaccaaataaaggaattgcggtcggtgatgctttcagaatgagtttagtagtatctacaggcattgtttttgaaccaaacattgattcaacagaataatcccatgtagtaacggaaccttctttcttcacacaccagattttaatctgagtatatggagaggtcacgtaaagttgatcctgaacccctttgataccatcaccaacttgcggacggaatacaacaggacgatcaacagaaatactaccgttactatttatgaaatagaacccttcgccgggtttacccgatggaagaacaacagtaattggccctgttgaagtatccatatcatgcaatgaacccagttcgatcgggttgcctgaataataagttcgcggtaatttctggaaatatccggtcgcgtggagtaacattgtacccacaccatcattcgcagtcagtaaacgcacatcaccaaacgcgttgtatacgttggtgatgatttcgttaagtttaacaccgccgtcatacagcgggtcaccagttgacgggttgccgatttgccccacgtcaattaattttttaccagtttgatatgccattatggtttccttagaattcgaaaataatactgacttcttcggtctgatcaggagaacgaataatcggttgacggttttccatgtagatcatttgtcctgagtcaagttcaagctgtcctttcgtgtaatactgccccgttgcttttacttctgggtcggatggttgcgcctttttcaacagcggatttacaataacgctgatttgacggaacccacggttgccaggtaaagaggcttgcgggaagaacagggaatccatatacgcgcggaatcgcattgagtgaaccttcattcggtacaccaaatcgtacatatcaggataccatttgatcacgttatcataaccccaacgaaccggatcttcttcaagttcatcagggaacggaacaacgatatgttcatttgtacagcggttgataacaacatctggtggaattgtatacagatattcccagatatagccgtcgcccatgtcgataccgttcgcttccccgcgcggaggttcgatcgattcgtgggtcggtgtccaaatgccaccaatgcgcacacattcaactttacccgtgatactggagattgaacaagatccaatatcaggaacgtctacaacgcggtataccatccatcctttaccgtagtcagtacggttataaggcgcggagtttacaaccacgatgtcattaatgtaaaagatttttgggtttggatatcgagtatcgccccagtctttacgcggaacgattgcatcaatcatttcgcctggtactttcgtcatcccgatcatatgcgtccacatatcaacgataccatctgtatcatcgttcggataagggggagcgaattcagggtcggattcgttatccgcccattgttcggtacgcccgattgacatataaatcgagttatgatcgggggtgtccccgatcatttcgcgaaagttcatcatgttttccgtgcggaacttaccagttacgaccgcacggtagatgttttgttgagccattatgctacctttctctgagtcggtggattcggatcgcgaggattacccgcgtcgtctttcaatcgtttttccactaagttacggaactgagagtatttaaccgctgaactatcgaacagaggactttgatcaaatcgacgcgcggacggcagtacaccattcagcggtttttcatcaatgtcatattgtggcggaacatcaaacggttgtcccgctttcgggtgcgggtcgtacaatgcttcaccagttacaaggtcaaatgtctggtttccgttaccgtccagacgtgctacgcgatcaggccaatacttcggataaccgctatcgaagcgataatttcgaagaatgtcaatgatcgtttcactatgcgtcatagacaaaccggagttgatgaacaccgttagcatggtgatcccgataaagccaaagcctaccggatgcacgaatcgtaaaacgtcatccttataacgggacgctggcagattcgaacgaattttcatcacgtagtaagaacgcccacggttgaagtagtcgatcgagttgttcgccatttgcttaccacgcacaccacgcagaatagtacctgtgaagttagtcttttcagacttgacaacctgcccttcaaggaagttaccgatcacgttgtgcagcgttaccgaccaacgtaattgaccgtcatcatactggcgttcgatatacgtcacgtttgctctcgctgttggtgtgtaaatcgtccggcctacaatgtcctggttgatatttgttgaatgaaccagaatatcatattccagagtgttcgaactttcgatttctacacttacatcttcgttatacaacagtttgaacaggaatttatagcttgcttcgatgcctttcgttgagtagaaatcactacaacgagattcaaagaaacgaaccacctgatcacgcttcgttttatccaggtagatattacggcggtttacttccgaccacagatattctacgctgttcttctcacgcggatatttgttcctgatcaggttcagcagcttgttatagtaggtgttttcacccagcgaaacgaactgcaaatagtattccccgaacttctcgaaatactgctgatccagatagctttgaggcgcaaagcgcgtaatcatatggcttaaatctgggtcaatcaaaccaggtgacagatccggttgatacggtttttcgcgttcctgctgaatcagatcggcaatcaataacgtattgtctggtttccagaaaatcgttaagttgtcgcgagcgcggtaactcagttcaaagaacccgatgatttctcctgaactcttatacagcaacacaccgttcgtatacttcgtgaatccggtaaacttaatgttgttaatgtaaatcgtaacatgtccgcgatcccatacctctttgttcacacgaagtgatgacgaagggccagcactatcggttacaaggctgtaggtgattttcggatacaccaccagaggacggttatcattagtgatccatgtgcgcacagagtcgcggaagaaccagctataattcgcctcgttgtaatattcctgcgcaccaaatttccaaacagtcgggtcgtcgatatgagcgcgaatcgtcgcaaagttaatcgcaaggctggcagtatagccaggacgcaaatcatattttacagcaccgaccagtgcagggttctcgatcaacaattcaggatcgggaagtgtgcctggatatttgtagttcgctacggaaataaaaatctccgtgccgttcgttgacatattggtgtattcatgctggatataaaaacgttcttcctcggtgttcccgtacaggcgcacaaaggttttcgtgtcttcttgccattgatacacaccagcagcagcggacggaaccacgttagcgggttttgtaggatcttgcagagcggttttcacttcacccgtaacgagtgcataaagaatcccgttcatcacatccattttcttgacaacgatcttatcatttccagggacaactgtatagcttgctgtatcgaaaatcttttctccgaacgttggagaactcggatcggtgtcgatcggtgtctgtttcagcgcgatacgacgcacaacgtttttcgcaaccacataaagccagtcatcggaacatgccattgcttctgcatatttcgacacgttaccaggcagtttagcaaacgtgttgtatgagtctacgtcgaaatcaaggccagtctggttccccagtttggcaaacgtaacatcatcagcagagaatcgcacatcgtccgcagaccagcgaatatccgttgaggtgcgcccgtagaagatacgatcgtaacccagtacataggttgtgtttcggctttggtacgcaatagagcgcgatacagggtttcctacgcggtcgttaaatgctttgtagtaatgccatgtctgccctttgtcgtttgacaccttcgccatgttctgaaaacgttcaaacaggtacaataaaccgtttgacgctaccaggaaagttctgttaatgtcattacaaacgtgttcaatatgatcctggatttcgtgatagttttcttgtgtaagaattttatcgctgatctgggatacgtcagtgtaaagtggagaaaacacaaagtcttctttcatcaacgctgccattaccacatctgtattgaagttaacgtagttctgattgttctttgcgaatttttcgtttatgaatgcatcacttggcgtaaattcacgcattgttgaatatgcgtaggcgttaaggctgaacgtccataattcatctgtataaacccaatcagacggttcaaagcccttgtgcgtaaccatgacgcggaatttataaaaattgtttggttggacatcggaagaaaaccattcattcaaaaaagcgtaacccaactggaaccaggttaaatcttcatctggaatagtaacaccacctgccccgcgagtttctgccatttccacgacatagtaaaaatccatgccgacgctatcccacttcaaataaacgaagttagcagccagtttatcaacgcgcaaactggtaattgacggcgctttaatcattatgtttctccaaatttgcgttacttatatcccatatttagcaaacaaaaaacccctgccggatgacaggggttaaaattattgactgattggattcattgtcaatgttgtatattgaggacggagatcgttttcaaacacaatcagagaaccatcacgggtgaaaatgttctcttccaatggtgtaccagtcagttcgatataagcagcgctgaatcgctcggatggaacgttcaggacacccagatcgaaactaatgaaatcagtgtagtgttccacatagccgacttcgtaatatttattacgatcggtcactccaggatatttatcaaaatcggttcctgtataggctgcgatactgatatcaccgtttttgaatggcccgataacaatttttgcacgtccggttgtggtgttcatatcggttgatgcataacgcacatcatacgaatcaccagcagcgtttgtgtatttgaacccgttcgaaacaacagaacgtgatttcacctggtttaagaagtgaataccagacatcggagcgctgtaatagttatcaagttcacgcaatagctgaatagtcgcagaagaaccaatgatcgacacgtccgcgttatcaacataggttaacattttggacttactgaatgatttgttgaaaatttcaacgttatcagtataatatctgtcaacctcattgattacttgaccacgcaaccattcctctgattcaaccaacttactgatatcatacgttactttgatactttgtacgatgtacagatagttcgggtcaaggatcgacggcgtaatcgtcgcaaggttatacttcgccagatagttttgcatatcctctttttgaacagaggtcaaacgcaaccctgatttcggtttaaccgcgatgaacgcatagccaggtttttctttatcagtaaagcactgaaccgcctgaataacagaaccgaaacggtgagacaagaacgattcataatccgatgcagtaacacaacggcgttgtgtctcacgcatgataggcgcgagttcgcgaatacgttcgatatcttccggttcaccaccaccatcagcgcctacatagtccgctgaattagtcgggttctcaacaatactcgtaatgctaatgtttgtcaacgtatccacgtaaacaaagttttcagcaccgtttgcttcttcgccgttggttgaaatatattcaataacaacggttgaaccgtttgcaggtttcaagcccccgatgtaatcagcagtcagagcaccacccgcgacctgttggctggtttcaccttcaccaaagtaaacttcggtatgtccatcaacagtttcacgcatataaaaaacagttgatgcacccgttgcgtttacgatactttcgtttgtccagtcatcccattgtgcgccgttgacggtaacgcgaacctggctacggtcgatgtttggatcgcggatcaggatagtcgaaccatcaaagatgacttcggtacgtactaaacgcccctgaacgatgttcaacatcgaaacatagttattgtttttgtcacgaacgatcaccacgtcatcggatacgacgaacgggaaactgtttgtttctttcactgtaccgatgaatttcgtaccgcgtggaatacggatcgatgttgggttcagtgggtttttcgcagtgatcaggatcgaagtatttgcagcggtgcgggagtccggcatatagcccaaatcctgagcctgttgaacaacagaactacgcaatgcagcggtacgaataaacgattcgaacagtgcggtgttactcatttgctgaatgtacagtgtacagtatgataacagatccacaagtacgttcatgcgcgagccggagaaatcataatccttgaattcgtcctgacctcggagccagtttattaagtcagatttgatttcgtcaaaagtagccccgacaaagatatcggggatctgattaatttgtttctttgtagtagccattattacccctcgttatcgggtatttagtattgaaccatagggacgcaaacactaattgaaccgaatgtgatcgcgagtccgattaatgacagtaatttgtttacgtattgagttaccttacttagagcaagcgtacaaatctggttataaatcaccttgcatgtgtccttaaacgagcgggaactgtcaacaaagtttttatatagcgattgtgcgcccgtcagcgcgttctcatacgtttttaacaggtcatcgaatgcaaccccacagtaacctaagaactggttaatctgagccattacaggcagttttttgagttcagccattgccatgctgtaggtgtctttcatcccatcttgcagagtagcaatctgtgctttgattccctcatatgcggccttagtcgcattcacagcagcgttagcggcatcaagtgcagcctgataagcagcggttgttgcttccgttacaggttcccacatccagtttaggtactgatcgaacttgcgtttaatcgaatccctttcctgtgtctgtgctttcagggtgttgaatagttcttgcccctgatcatacagtgcggagatctgcgcataggatgcatcaatgaacgctttcactttcgcttgtgcttgctgatacagatccattgctgtaaaccctgggaagttaccgcccagaatcacatcaagaggtttaatctgtcgcatgatgttacggatagccagcacagcagaccaaagcgggtttggtgtttcgggaggcattgaccagatctgcatcatacgcccgtacaaatccaccagagcaacgcaaccgttttggaacatagtcaaacaccagtcaaataacgcgctacaagcgtctacaaggtcgcgagcgccagccttgacatattcaacggtgtagttgtaagaactgcctatagccccgtagattgcgtttatgacgctttcatacgtctgtgcgccggagtcaatcagagcctggaaagaatctttcagggattgaaccgaactatcaccaaacaccagatcgtaaatgttgattgcaacacccaggatcgcaacagtcgggaggaagttattgatcagactccatgccccacccacgatgttaaacgcagagctaatgatctgccggaacaccttcattgcggtttgccatgcttgctgtgacaatgccagagcacccgctgtgatttcttccatcccgatcgaaagcccgtcaaacatcgtcgcgataccagagccgtttttaatcgtacccgtcagcatatcgaaagccagcttgaacgttttacgagtctcgttccacgcggaaagcatagcatcgctgatattcgtatacgggaaccctacggtcgccggaatacagcccaatccagagcgagcagaaaacaatctggcttcactcggtagcgccccatacgttgacgggagagcagggggaaccggaggaatgctggtatctgcgttcgtgtttactgacatccctgtatatttgcactggtgcgcgggggattcgtcgtgtttcatgtacgcaatacgattaccattccagtagtaatcaatgctggtaaacgcgcctgtagtctggttgtatacctgtcggattcgcggatcgcaacggggaccggaagtcagcaagtaaccaccggagttttccaccttgtacatcgcgagttcgccagggttcttgaacagattcgcttttgatagatccgccccgtaccagtcattacccgcgagcttagtagccccgatagatgcgatataggcatcaatatccgcttgactggcgaaataataaccaatcttcgtaaccagaatgtcagtagaaacccctggggttccgtctggattcgtgggtacgtttggagagttcaccaccggaagcggatcgcttttctgtccgaaaggggaactcgtatacaggtgagttccgatcgggatgatttcggtcgcccattctaccccaacagcagggtaattttctgtgtgtccctgccagataacgcgtctgtaatatccagcggggatctcagcatcgcaaggatgctgaaaattttgcataatcccatcaatgatggtttcataatccatgatcatgtttagcctacctgtacagtaccgccagtgatcttagtcagtgcgccggaatcaatgaaagtattattcgatgctcgcatgttgatattacgtgcgccaatatccaaatcttgctcaatatcaatcagagcattttttgcggtaattgttgcatcttctgttacggcaacagttgcattctgtttaacgttagccattaaattctgattaacgtttacggttgcatctttttcaacggttaattctgcgttgcctttaatcagccccaaatattcaccttcaacggtttgatttacattaccgcgaacgaactcggtcacgttaccatcaacggtctgttgaacgttacccatattgtaaatgaacgcatcaccctcgataacaacctgtaaattacccttaacgtttaatttacggccttgcatgacgatttgataatcatcaccaacgattttaacaacacgggttccatcagggcgaatttcttcgtatgatcctgctgggtgaacacggttgtaacgttcaaagcctggtgtatcgtcgaattcctgaatgtgtccagaacgggattcgaataccatgttgtatggatattcagcagcgtatgcggatttaggttcctcgaacattacgcgagtatcaccaggaacaaaaggatcttctggatttgatgcagccaacacaacagcattgtatgcagcactcaatgaacgcccttctggatctggaacctgaacaccgtatgattcgaggttgcccgtcagcacgattttagatactcgtgaagaacgtcctggtgtctggttagcccatgttgagtttcgcagttcgttgtaagcggtttgccagtcctgacgcttcatagcagccagagcattagtaaatttggcaacaccaccaacacccatctggaagcacatgttttcgattgccatttgacgaggacggtttaacgtcacgtatacttctcgaacgtttgaagtgttgctgatcccctgccggacttttgccaaatcctgagcaaacagcgttgaaacttcttctgctgtgatcgttccattggttacttctcgaccaactgctttactgatcgcggcgttaatcttcgcagtatcacgggttttttccatgataagcaaatgcccgatcccgatagtcggataaccttcactatcaatataccattttgtgcggataccttcatcctgtttaagcatggtttcgatagtgaacccgccagtatcaggacggttatcttctgggatctcgtcaagtgggcgatcatctggattgacagctaacgaactgttagcatcacgaataatcacgctcgaagaaccgcgcccctctgcgccaccacgagccagtacgttgacatcgttacctacataacgaggatactcgccaaacgggtcacagaagcctttctgggtgtccggcttctctcggtactcacccgcaaaggttcccagtataacgccgtcctggtgccatttatcgcgccagtaaccgataacaaaactaccgcgcgtgataccagtcggggaaaaaccaacaccagaaatagcggcgctgcgaatatcctgaataggcatcatccacggcaattcctcaaccggaataccgatagtttcagatttttgtttctgtgccggatgctcaccgaatacacgcacctgaacacgccccaatagacgaggatcatcgacttcttcgaccaccccctcaaagaaaggggagtatttatttccaccgtatttcataggtttgccttttccatttccttgatataatcacttacaaacgattgaatatcagaggggttaataatcttgatggttcgttttgcttcattttgaagcaccgcatcttcataaatatctacagggactaatgttccctggtactgcaaataacgcatgttcttatcgcctttgtcataccaatgaccgggattgttcgggtcttcaaccaaattgtaataacggttgcccttaccatccatatgataaagaacctgttcaccacctgcttttgaataacgctggatagcgcattgataagccgtttcctgatcggtaatccatccgtaaaacggatcgtaattatcgttaagcatcaggataacccagtagtattgctggtttccgtatagcgtttccgctaattgttcgggtcttaatgaacctgtcagttgatatgtacgcggcttataattcctgatcacgcggttaaagtaaaaacgataatcgcggtagatatcagtagttggtgtgcctttgtaatcaactggtggaaagaacgaaaataacattgtaatttcccctatctaatgtttactatatttaggatctaaaatggctggaagacagacatacaaggggtcttttatgccccagaacatacagaaatataagggagatccgcgaaagataacgtatcgttcaagctgggaaaaatatattatgaactggcttgatagaaacccgcatgtgaaacgctggaacagtgaagaggttgtgatcccttatttcagcaacgcagacggaaagcgacggcgctatttcatggatttctatgttgaaatggataacggtgtgacctacctttgggaagtcaagccgatgaaagaaacgttgcccccaccgaagccagcgaacaacaacgttcacaacaaaaagaaatttgttgatgcgctgtatacttatgcggtaaacattgacaaatggaaagccgcgaatgcagcagcaaaacaaaagggctgggagttcaagatcatcacagaggacacgttgaaacgtgtgttcggatggaaagggcaataaataccctaaacggagggaattatgagttttatttttgagttcgagatcatcgcagaagaagacaagccaaaaccaccaccgaagcgaaagctgggtgaatgggttgaacttggtatcaaattccgacgcgcaaaattaaaaggcatgacagccaaaaagttcgcggacgaaaacgggattgcatacgcaacgttcacaaagtctatgcaccgctataagcagcagattgatgatgaaatcgaacgccgtaaagcagaaaccgaagcccgacgcaaacgtaatgactatcgtaaaaaacacgcggttgatatcgtaaacgatttccgcaacagtttgaagaaaatgactgttggtgtaaccgctgcgaaacgtcagaaagattcgaccgattggtttggtgatttcatcaaaaccagcattaagacgcacagggttgcgaaaccagcaacgggtcgcttgtatacgttcatctacgatgcgaaatacaaagacacccttccatactgggatcggttcccgctgatcattttcctgggttcaggacgttcgaaagcgggtaacttggttctgtacgggctgaacttgcactatgcgccaccgcgagcacgtcaagagtttttagaagaactcctgaaacgtggctacggatcaacagatcgactttctaacaaaaccagactgaaaatcaattggaacaacgtgaagggaatgcgcggggctgatcaaatgatcaaagcctacctgccagcccatctacgttcaccacttgcagagatcgccccaaaagattgggcgaaagcagtttggttgcctacacaggctttccagtccaaaggaaaaccatacagcgcgaagaaagtttggaacagatattaacaaaaagccccaaccgaaaggaaggggctttatttttacagggtactcacgatttccgcgagttttccaggggttgcgccaggtcgaaccttcatcgcatctttcaggtttttatcaaccatcttttctgcgtctttttcgttaaacccacgtttcaccaacaccgcaataactttttcgcgaatatctttagcggcttcgttcaaatcttctgattcagctagaaccagtttagacagaacatcacctttgtattcctgggtaaagcgtttacccgataccagacgaggtttaccagaggcatctacaaccgtaaacacggcgtattcacctgtttctttggttttggtacgtccggtatacagcaagcacatatcgttacttgggagcttgtacacctttcctttcaccaatgcttcatccagaggcagatcaatttcgaaatcttccgccaactgattatacagatccaggttttcttctgcttctttgtacagagaagcgcctttgaatttcagtggcttgtcgaatttcaggtcatcagcaggatcaccgctgtagaatgaaacagtacctttcgcccagtcaatatacgctgcctgagtcttgccagtggttttacctttcaggcggacaacacctttaccgaagtaagcgagatcgtgggagtccggcgcatacacatcgtaatcagcaccatgtgcaaaatgcaggaaaccaatctgaccttttgcagcgttaccacggtcaaccagatcaacggtcttagcaaattttttgttctgaacagattcagaaagtagttctttgaatgatttcatgttttcaatctcttttgaaagtataggtatagtatacctatttattgaatagatcaactaaaaattagatcgcgagcgaagcgagttccgtcaagcgaagcgaagacggatagttaacgattgtataaaaagtatacggaaatgtactgttttctctatatataaaatataaatattataaacagtacatcgtacataacactcacttcgttcgtgtgttcgcttcgctcacggtcttgatctaaatatctataaaatggagatcatcatgaatacaactgctatgatcctgaaccagatttcacctactaacttcatgttagatattcctgacaatgattatgtaaaagggttgaaactacaggttcagggtgttacactacctgctatcaacattccaattacggatgtcccactgaacccaatgattcgagggaagatcccaggatctgcaatggagttcgatccactgactattcgttttgctgttgatgaagaactgcgatcgtatcttggggtttacctttggatgctcggtactgtcgattttaacaccttcgattccgtgcgttggagtgaaccacaacaggcaatggctttgcatatcctggataactcgcagtcaaaaactgtagcgacatttcgcttctatggcgcttggccctccaacctcggagagcttgagcttatgtataccaatgattcggatgaagccgtatcctgtatgacgatgttcaacttcgctcacatggaaattgagatcgacggacgggtgatcgtgcctactccacggaaaacgcaaaaatgatttatggtatttgtggtaaaaagcgaacgggtaaagataccgttgctcaaatggttgtgcataacttccgtaatgttgaagttatcgcgttagccgacgaaatcaaagctatcctgaaacgttctatggaacatcacgataacacgcaattgcgagcgctggcagcgaagaacccattctatgagggtgatcgtgaagccccgctggtgatgtccaataacgatgcatacgcgctgttttctagcggtatcaaaaaattaagttctcgcgggttcttcatgagtaacgcagatgttatcgctcataaaatttgcgaagaaaacagccagccctggacgattcgccgtttgatgcaggtgttcgggactgatattgtttgtaaaatagatccgtctatatggacttcaattgctattcaaaaaatgttgaaatcctacgcggatcactttatcattaccgatgtgcgtcaaccgcacgaatataaatacctgagcaagttcgggactcgctttgtgttccttgaacgtgaaactggtattgaagataatcattcaacggagcaagggttgacacctggcttgagtgattatacaatcctaaataatggtacgttagacgatttgaaacgtaacgtgcttaatgtattcaatcttttaagagtgtaaacaatgactgaacaaaaccaaacccaacagcttcaaaacgatgtcctgatcctgaaagcccgtgtattcgacctgaacgaaatcattcagggtaaagaacaagaactggcaaatcaccgtcaactcgtaggccaaatttgcagtcttctggaaatcgacggttcgcagggtgtatcccctgatgccctggtcggcgcgatcaaagcacttctgccagcaacagcagaaaccgctggcgacgatgaagcgattgatgcatcaaaagcataattaacgcttaggcgtttaaccactggggggcgaaagcccccttttcatttggagtacacatgaaaagttttattgaagtagcgaaacccgtagttgatccggggatctatatgtgtgcgaagttcgatcaggcttcctgtgaagcgctcgcgaaggtgcaaaaacttctgggtgtagagaatcctgtttccgctgcaaagctgcatacaacgattgtgtatagccgtaagacggttgatctgttccctgcatccggtatctctgaacctgtccgactggttgacgtggagaagtgggaaacgaaatacggtaatacgatcgtgggcgttctggagtctgattatctccatagccgcttcaaagatgcaatggatgctggagcaacatacgattatgacgattacaaaccacatgtaaccctcgcgtatgattcccgcatcgaagatatcagcggagttaaaagactgttgacattgcccgtagatttgactatcatccaggaagatgctgaaccgctggatctggataagaaagtcgaagacatcacggagcacatcgaacatcgcggcgataagtgggttatactgaaccatgatcgcacgaaagaacttggtgaatatgattcgaaagaggcagcggaaaaacgtctgcgtcaaatcgaatactttaaacataatgggtgatttatgaacagagcacgattgatgtatgttatcaataacttacgcagagaagttaaccaaaatttcagtaaagcgttaagtgattggtatgtgacaaaggtttcaatgactacagatcacatcgcagaccgattcctggatcgttccgcgtcagtcaaaaaagactttgcggtctacagtgaaattcttaatagtctcgctaaacattattcgtgtaacgttctgtattacgcggtgaaagcgaaaaacgaaggtatgcaggaagtcattgcatatcgccggatcaatggcaaagtgtttgcctgtgcgttcaccgtccagatgttcgaaaacatggatgattcggttgctcacgaaaaaccagtgattgctgtacgattccgaaccgttatccctgagtacacgttgagcctgaacacgcgaaacgcgatccatgtgaactacatcgcacccaaaatcaagttcgagtatgacggctacagacgcgttatgtcacgcctggatcgcctgattgcttcaaaagattgtcctcctcaactgcatatgttgaaaaatatttgaaaaaagcccttgcattcgtgcaggggcttttgttatattaggggtgtcgaaacaaaggagacaatcatgaaactttactggctggtgttctcaaacgggtttgtaatgaaaggcactgttcactgtgcgaaaacttattgcaaatggaatgaatgctctttccgtatcctgagcgttgcatcttctcaacctgtaggggattactaatgactggtgataagtgggttgataaaactttgttgttgacagtaatctactttctggtaaaatacctggtgtagacaaaggagggagttatgagaaacttactgaatatcgcggaaatcttttgctatggtgtcgctgtgtatgtcctgtttaacggtgacggcgcgggatactggatcatgttcggtggtggattgttcctctctttcatcaaaaaattttttaagtgagaaatatactatgcgctcaaatgtaccgaaaaacctgtataccgttattgacgctggttcgattcgtattgctgatgtaatggcactagtcgaacgcttcgatcgttcaacgacgctggggcaactgctgagtatggttaaatcccagtacccgcacaaatgcccgaaatgcgagggtaaagggttcgaagttgtgcgtgtcaacacgtatccttctggcttgccggattctggctgggttgatcagatggaagatttcaacgttacctgtgatatctgtaacgggcaaggcttcaccaaagaacgccttatcgcaaaacctgtcaaagtggaatatgtacccgcatgaaaaacaaaatctatgctcatatgtctgagcacacaacggttcgtgttatcttggtagatgggccaatcgctcaagtagaaaccaacgataaacctttctcgttgcctttacaaaccagtgtcggtactttcgatgaagttatcgaagaattgacaaaacacgccattgtttatctgtgggaagcgcaaagttatccatacccaactcctacaagtccggcgtcagaagataacgtaaaaattcgttggggatatattgaatgaaaattaccgatctcgtaaaagcggctaatgcgctggtgacaagcgaacattacgccaactactgcgagcaataccctgttcccctggaacgcgcaattactcaatccggttatgacggtatcagtaccgtaaccgttgaaaacctgaaaacgttcatcgtgtttgcgaacacgttctggatgtacttacccgataatgtcggaattcgccagcctactttcttcacgctgtgtatgttctgcgaaacttatctccctgaatgcgatgactacgaagaacattatggggaataagatatcaatgggtaacaaagtatccctgatgcagtttgataaaaagctggggtttgcattctctcacggattcgccccagacgcggaaaccatgtttaaaatggcttttggcatcgatccggctaccctcgatcaagaggtgttgtcagacatcaacaaaactggtacgctgtattatgcccgtctgccaaatccagaaaacggcattcagtaccaatcgactctcgaaaaactcaaaactgaactgaaagaaataggtgaattatgacttctacagctattcaacaacaaaccattgatcatgatgctgaattcgcacaactgatcaaagaacataacgcttttgcggcttctcgcgtcaatgaagaaagcgaacagacccgccgatccctctgggttgccatttaccgcgaagtgttcagcgagaaatccgctaacaaacacactcaggcagttgatgcagcagataaagcgctggcagcatacgatcgtaagttcggagcacagtaatggaacggtctgctggtattctcttcctgaataacggcagcgttttaatgggccacgcgaccgaaacgcctcattgggacatcccaaaggggcatatcgaaaaaggcgaagaacctattcacgctgcgatccgtgagtgcttcgaagaaaccggagttcttgttgaaccgcacgaactggaaagcctcggaagactggattataccagtaaaaaagagctttacttattcgtgtataaaggcaataattaccccgaagccgataaatgcttctgtgcgtcaacgttcgtgaagaacgggcgaaccatcacagaaatggacggtttcaaatatgttccgtatagccagatccgcgatcatgcgcgtaagactatgggacaacttctatctaaacttgtgggatatacatcatgaaagcaacaacttttcaaatctgtcaaatgatccttctggctaccgcaacccgcgccgctgaacctatcgcgtatcagtcatggggtgattcattcaccgtgaaaaatattcgcgatctgcctggacgcctttacgcttcccctgatttcgaacccgtcgatccgaatgatttgacgctggaagaaatgaaaaatctgggcttccgtaagtgggaagacgattcaaagatgatgctgatccctctgtatctgttgccatacctgaaagacggtttcagcgctatcagtatcagcggcaagaaattcgaattccgcgctggtgaatcagataacgatcatcgtatggggctgctttcgttcggagcactgcctaatgagtcacgttgatttcaacaccttatctcaattggggttgatctggaaaatcaataaagatatcctacatcccctggggctggcgttgacgcgtgatcctgaaactggcgtatcggttggtgcgctggtttccgatgatggtgtctggtcgttcagcgaaaaatcagactttgagaacatagcaaagctgaataaactttatgctttacaggccgaaggaaagctgttagagttcttacaacaaaacgtgaaagagtgattatattatgaatggtgaacgtgtaattgtcattggcaagtcgaagcataaagctaacgcgaagggtgatcacttgatcatcaacaccgatcgcggtgactggtacggtgcaacgaaagtaacgagtggttatgcaaccatcgttgaaaaagatgcagttcgtcccgcaaccgctgctgatcctggttactatggaacccgcgaagagttcgaaagtgaaaaggatcaggagatcgcagaactgaaaaccaaagttcacaacgcgcgggtgtatgcggtgatttgccttaccgttgcggctatcaatactggtttgctgggttgggtggtgaatcatgtctaaagatgatattccggttcataaccgacttcgggaactccgaacttttcgtagtcgcgatcatgcgatcatggttggaagttatctcaactggtggaagcataatgatctggatctgaatccatcttatcagcgcccctacgtgtggacgcagaaagaacaagatgcgtttctgactaccttaatgacggggttcccttgtggtgtcatcgcgatcgcggttgatagccagttcaatgaaactcactgggtagaagtcatcgacggtaaacaacgcctgacgacgattatcaaattttacgaaggtgaaattggtcttcctatgccggacggttcccgtttattctggcatgaactaccccgacacgaacagcgaacctttgaaaatatgtcattacctgcactggggctggatgaatgcaccaaaaaggatcgtctggaattcttcatcaaactgaacttcgcgggtgtgcctcaatcacaagagcatatgaaccgcgtccttgaaatgtataaggctgcaaaatgaacaaagacgaagaactgaacattgattcagtagaaccaaatcagtttatcatcggtaaagaagatcatgaactgttacaagcggttaaaaacttgctgacgtatgctcatatccgcgtaccgaatggcgataacgcaaaactggaaatcgcgtgtgctggttacggttacaccgctaccgctgataaaatcattagctattcagcatccagaacccgtgaactggttcattaccgcgataaattgagtgaagaaatccatcaaactcaggtaattgtagatcagttgccagaaaaattcgattaaagtgaaaaaagcccttgcagtaatgcaggggctttgttatattacacacatcgaaacgaaacagagaaaggaaaacatcatgaacatgaacaaaaacattgccgctgtagttggttgtgaagtttctaacgcagaacgttatgacaacggtttctctttctgtgttccgactgaactcgatgcgtacaaagccgcttacaaataccgcactatgccgatggtaaacgttacttacgcgccgaacatcgaaatgtggctggttcaggtttacaacaaagtatgaacttccacgaacgcaaggccgcacgaaccgattattacatgcggttcgtgtatggctggaaattacggaaatgtgttgcatgtaacggatcggggcgatatgatagcgaccgatctccgaaatgcagttcatgtaatggaaccggaaaagaacgctttaaacctgtgaggaatatattatgcaacatgtgaatctcaacccaaaaatggaaaagtatctgaatcgccgtcatgacaaccaggcgcaaagggatcaggaacgcgcgatcaacattgaaacggctaaactccttacccagatgttccgtaagtttcctagcaaattcccatgcaattctatgcattcaagtaactgtatcagcgtagaactggctgataagcgttgtatcagggttaacctggcttacgggttatccgaagacggatataacctggtgatgggctggacatcaatgattggcaacttcgttgaacagaacaatattgagttcaatatgatgcgctctgatttgttccagtgtccggtcgattcaatcaatatcggtagcctttacgctatccttcgcgcacaatatgatttgtggagtacaaaatgaaagtaacaagtgaaaaacttgaagaaattgaaaaatcagcccgttcgatttcttctatgatgggtagtaagtggactctcgttgaaaatatgagcatccagggaaatcaggaatatggtttcaggggcaaagagtataaacgcgcgttctcatatggtgttccatatggcgacagccctacacagattaaaagctgggaagagggtctcggaaaatatctggaaaccgtagatccgcaaacggttctggatctggttagcgatctgtcactcgcgcttcgagacaagcaaaaagcagaatcagaagccgcgcactggaaagcaaatcacgaatgcgaagtatcccgcgcccgtgtcctcaaagagcgccctgatatgcctctggagcgcgtcaacgcatacaaccgtatggttgagttagaagaggaaaacaaagccttaaaacagcgtatagcgagcctggaggatgtcaatcaaacccgcatgatgttgcagatgattcagggtatggtgattgatacccaaaacatgaaccgcgaacaactgcgctactggcaaacacatttccgcaatcctaacgggtggtaatatgttcggacgaaaacgagaatgtaaacatgttgctaccggatggatgcggggaactccttacgcctggatgcatcattccgtaaccgatgggatcgggcgtatacatggcgatatgtatgcaacatgcgacaagtgcggggagaagtttttgatgtgtaagatacacgttgaccacgcgatccgtgagctggcaaaacatccaatcacccgcgccgaaatccttcgaatcctcgaagaaacaaaatagcactttttgtttaaaaagccccttgcaaccgccaggggcttttgttatattacacacatcgaaacgaaacagacaaaaaggaaatcatcatgaaacttgttcgcgaagcaatcaaactgggtaacgaatacaacggcaaatggtacttcatcatttatgacgacaatgcagaaaaactggaaaaagttgaagatgcattacgtgcgatggaaactggtgcttctgttggtggtaaagtgatgacctgggaaaactactgcgacggttgcccttgctacaacgatggtttcggttctggtttctgggttgatgttgaagatgttccagcgttcaaagccgcatggaaaatcgctaagaaaatggcataattagcacgaattgctaaaactccataaccctgatctgttattgtacacacatcgaaacgaaggaggaaattatggaaatcatctacaaaagccggaactacaaaaaagaagatgttgcagcagtttacatcaagtaccggaacgtgaaatgtgagtacagtggggcatggggttatgaaatcgttgttgaagaagtcaacgccgacaacaaaaccatttgcagtttcaccactaataccgatagccctctgttcactactgaacagcttgaacaggcttatgaactgcgcaaccaggcttttaacgcggtacgtatcaaatgagattccgtccttatatcgagttccttcgcggtatcagtgagatcctgaaccgcgaaatcaaacccagtccgttagctgttgagctttaccgactggatgcaacccccgaagatgcagcgaaagattacggagatcagttataatgttaacttttgaagagtacaaagcacagcgtgatcagttaagcaactggcacagagagatcggcagggaattgagcgcttaccctaaaaatgaaatgggtatgacgatcgaatcaatccgtaatacgccggaatacaaagcgaaacgtgctttgtgtaacaaagttttccaacagcttcgcatccttaacgggaagtacatcaaaacctacaaaaaagaactggctgacgaacgtaaactgaaacggagtgtaaaatgatgcaacacgaactcaaaacagagattgacaaacgtactttcctggaaaagaataaaacggtaacgctgatgcattactccaccaaaaacggttcgagtgagttctggcgcgttaacattgacagcaaagagaaacaccagtcgataccgttcgacaatgaaagccttgctcgcgctgtcttccaatcccacgttaaattttgagaattatattatgaaatctgtcgatatcgttaccagcatcaaagcgccgtccctgttcatctatcaacacggcaatatgcgcttcgctcgctcgaagttctacaactataatttcaacgttgatactggtgaattcgctcgctggggtgcaacatattcccacgatccagaatacgcaccattccccgaaattctcgatatcgagatcactaccaaatgcaacgggccagcgggtaaactctgcgggttctgctacaagtccaataacccgaacgggttcaacatggatcttgccaacttcaaaaaaatcatcgacaaaatgccctggctgactcaatgcgcactcggtgctgatgcacaggggcaaacaaaccctgatatgttcgatatgatggcgtatgcgcgttctaaaggcattgtgccgaaccttaccattgctgatgtatcaaaagacgttgcagcgcgtttagcggcggttgctggggctgttgcggtatcggtttataaacacgctggctttgatgtcgctttcgactcggtagcgaacctgacagaagccggacaacagcaaatcaacctgcatttcatggttagctcgaaaacctatgatgacgcgtttaacgtggttgatgccgtgaagaatgatccgcgcctgaaacaagtaaacgcgatcgtgttcctgggactgaaacaaaagggacgcggtaagaactgggacaccgttacccgcgaacaatataaaaaacttgttgaatattgcctcgattctggtgtaggatttggattcgatagctgttcagcccccgctttcgttgaagcgatggagggacacccgaacttcgaacagtacaagcaatacgccgaagactgtgaagcaacgatgtttagctcttacattaatgaacgtggtcagttcttcccttgctcgtttaccgaacgttgggttgaaggtggctgggaagaaggtctggatgttctggaagccgaagattttgtgaaggatatctgggaacacccgaaaacaaaacagttccgtaaagaactgacgggcaacaaggatcataacggttgccgtaactgtccggcttatgcggtatgtggtaaagatatgcgcgtacacaaagcccctgaaaccgatgtatatgcagtggagttgaaataatgttaatcgtatctcgtattaaatcatacgttcgtgatcgtgatattctggatgtgtcgcctatggttggtgaaactgttaccgtaagaaactatccggtgaatctggatcacgtaacctggatcgaagatgatgcaacaatcgttgttgaagggaagagacacccagcaatcacttttcacctgatctgttcaaccccgattacctgggctggatatgaaaacaaagaacagcgtgataacgctatccatgcgattgagcgtagaatgcagtttgcggagatcacattctgatgatttatcaatcccataatgattcaacgatgcgaatggttccggtatctattgacattccaacaaaaccgcgtacactggaatcgttgattgaaaaatactctggaatggttatttgtccttctaccgcacaggtggcaatggcagaacgcgatgaaattgtatttgaatgtgatgcgaaaggctatcacaccgttgaagatatgcagatgattgaatatctctggggaatccgaaacgctgtagtacatcacatactcaccgctgaaaagaaagccgaagccgtgagagaagttgaactgcgcgaagagatccgttataatcggatgtctgcacaggaaaaggatgaagcatatgaagtgtaccgccgtagtcgatgaattaatgagcgcgtttaaaacgcgtcgtacagatgggcgtattaaagatccgaagtcaatcgcgatcatcgaacggtacgcgatgaagttaagcgaacaggaattcacgccaaaggcgctcaatagcctgatggttctgaaactgctgatcgcttcgggtgacgatatgccgcacgatgaaaacagtgctgaatcattccaaaaggcttatcgttcatggggagtgatttactcccgctcgctgggttcgtatgactcggttatgtggaacctgatgcacctggatcgtttgatctgggaagtgctcgaagaagagggtattgtatgaaaattcgggtagttgaagttcatacgcctggatgggttcctgaaagaacatacaagttagagaaacgagtatttgggtttttctgggttccattgacttttaaatctggtattcatactatccaatacgatggaagaaccccagaagaagcgctggaattattcaggctaagaaccgaaaagaatttaaccgttgttaaggaaattgattatgaaactcgatcgtgaattaagtatggctatccgtactattgaaatgatacttgataaactgagtgcggaagaagagttttgtgtaagcgatatcgaagcggatttagttgaatggcgtggtgcgctttacgaagcgacaaagggcaacgatcctctgttcgatgaatatgatgtgtacaacgtcaaggtatggaacactgaataccgtttcaagtggcctggcgatgcttacgggcatattcaaaccatttacgtaactggtggtatggtgtttgcgaccagtgttggggctagtgaacttccgatcaatcccgatagtaaagtaacgacaccgaacccattcggacatactaccgtttgtttgggtgtagcggaggacttctccccgttctattcaggctggatcgaagccagcaaaactaaccttaaaagagtataaattatgtggaaaattgttgtgtgtattttgatggttgtcgttgttgtgttcttgcagtcaagctgtactgacgagaaagaggcacagcgtaccctggaagcacagggttatacgaacatccagttcacgggttacaagtggtttgcatgttctgaaaaagacacatactcaaccggattcgaagcaactggtgtgaacggcaagcagatcaaaggatctgtgtgctctggaatatttttcaaaaatagcacaattcgtttcgaataactgttgacactaatccccgttgtgataatatctctctcgtagacaacaaaacagataaacaaggggattaaaatgaacttactgaacgaaatgctggaaatggttgaagcgaacaaagaagcaatgaaagcgaaagaaggttgggtagttgttactgactgctacaaaccgcaaagctggcttcctgtgttcctcaataaagatggtaacgaagaacacggcttctatgatgctgcaatcttcgaaaccgctgaacaggcttgcgatttctggtcttacctgagcggtgacaagcctttcaccaaatacggtgtttgccagtgcaaagacatttaatcccagccccgaaaggggcttttttgtaggtgaaatatgaccaaagcagaaagaattatcaaccatcttcaaaccggattcccgtaccagggagatttacagcgcgatatcatcgaactgttatcccagcatgacgggatggaagcggagataaaggaattgactcaccctgacgtgaacgtattcgcttcactgatggatgatgtgatcgctatcgactcggacgaactgatctgcatcgagacaacgaacccagaagataagacgatcctgaaacaagcgtatgagcggatcgagggattacacgatcgcctgttcacgttaactttcccaaataaaaacgatagaccttgttgacatcaaaacagattgtggtaatctgtatatgaaaactaattgtgaggaatacattatgaaaagtgcttttgaaaaacgtgctctcaagaaagatgtgaaacctggtgcgatcatgtatgaagtgttctgcgtgaacggcgaaaaagcggaaatgggtagcaagatgattgttactggcttccctcgtatgcatcgcggtattgggctgtttgcaaaatgcatcaccctgtacaaagactgggactgtcacacagaattctctcttgacgatcgtagtatgaatgggcgcaacggatataacttccatgcgttcttcctgaccaaagaggatgcacaggcttacattgatgaagtcaatgaagaccgtcttcctcctgatatgaaagagcgaaaagaagaacagatgaaacgtaaacgtgaatttgacgaatgtttcggttatctctattacgatgattattaatcgttgcgcctcttaaaccgtaaataccctgtgtagcccatagggtattttcataaagaggtatgtatgtttaaatttagtcagaaaagcctgaacaacctgcaaggcgtgaagccggaactggttaaggtggtaaaacgtgctctggaactctcgcctgttgatttcggtgtccgcgaaggtctgcgcaccgtagagcaacagcgcgaaaacgtccgcaagggtgtttcccagaccatgaactcaaaacacatcactggtgatgctgtggatctgtatcctagcgttctccctgctggctggcagactaacccgaaagtgtggttgcctgtcctgaatgcagtgaaacaagccgctgatgaacagggcgtaaaactgcgttacggtatcaactggaagaacgatccaaaccttccgattgaaacgaaatttatcgacgcaccacacgttgaacttgcataaggcgacaacatgatttcacaattctatgttgacgctgtaaagcagtcacgtaacctgcacctggcgcgaatcattgatgggcgctgggggcaagaatgcggcggggtgtctatcttcgaaactgcgctggatatgggtcggatgtcgggtaaaaccaaagcggctttcgatatcatcaagcagtctaaagggacactgaatatctatgttgcaccgacaaagcagatgggtatttgtgctgcggtagaacatggactggataagggcgctgattcgtctttcattctgtcgaaacgtcaagatctgacttccattttccgtggacaaacgatcaagtatcaggcaatcaacctgattttcgatgaatgtgacacgacgatcgacgaacggtttgaactggcaaaaacgctgaccttgtgtatgcgttcaagtcatcttcatccgttcccatatatccatattatccgtttgggtatgtaattgcagtgcgcggggtgcgaatccgcgtaccccgcaattaacaggaaaacttctatgaaatatgttctagataccaacgttttaatctcgaacccatattcaatcttctcattcgttgaggcgggtactgaaatcattatcacctctgcgacaatggaagaactggatcacctgaaaagcaaagagcgaaccgctcatgaagcacgattggcgatccgcctcctgtctaaagtaatcctggggcagaagtacgaagcaattacccaaacaggggtttcgttgaacctgacgaacccagcactgccggaaagcgtgaaactccgtatcgttgattatatcggtttagaagagttcccgcttgataaacaagatgcgcgaattatcgctacctgtatgcaggaaaacgcaaccctgatcacccgcgacattaacatgctgttgatcgcgatgtctaagggatgtcctgttgaacaatacacgggcgatgactcgctgaaagatagcgatgtgttgtattctgggtatgtcgatatccctggattctgggatgatgtcgaggtgttgggatatgttggcgaagtagcccaaataagctattcctcgcttcctgacggcgattattacccgaaccaatacattctatcggatggtgaacttgtagggcgtgtagtggctgctggagagtatcagcttgaactcttaccaatcaaacacgaatccgcgatgaagcgtaagctgatgaaaacaattcagcctcgcgatgcactgcaagcgtcattcattgatgcaattatggataaaaataccgatgtggtgaccatcatgggcgctgctggttcaggtaaaacaatgctggctgttgctggtgcaatgcacctggttaacgccggacactttgcaaacctgatgtatgttaaatcggatagtcctctgtcgggcgaaatcgggttcttacctggtactctgggcgaaaaactgcgtcctgctgtggaaccatgtattacgagcctgaacattctgtttaaggatcaaccggaagttgacaaatacgtagaagggctgctggagaaaaacgttgtccagttccctagcctgtattacttccgtgggcgctcaatcgggcatcctgatccgggtaaaggttcggttctgattgttgatgaatgtcaaaacttgagcaatcacgaaatcaaatccatcatttcccgttgcggtgagaacacccttctgatactatgcgggaacattaaacagattgacaacccgcgcaatactgctgttaacaacggctttgtgtatgcggttgaaaaacttaaagagtacggtcattcaagtcatgtgatcctggataccgtatatcgtgggcgactggctgcattcgtcgaagagaacttttaatcaagggggcttcggcccccttttttcgtgaggtatacatgatcaacgttattatcagtccaaagctaattaccgtttgcgctaattgcaaaagtgggttagagtatgaactgtctgatgtacagaagagaaccgaagcgttttataatggtttcttcaatgcagcagattacatcgtgaaaaaacatatcgtctgcccgaaatgcggtagcgaagtgaaactattcttgtgaggttattatggttcaagttgtgagtattaccccaaaacaaactacctgtcgttgtggtgctgtcctgtcatacactgcgcaggatgtcaaagaaaaggtatctactgattacactggcggtcgtgatgtgtatcgtgtgattcggtgtccagtctgtgataaggatgtagtagtatgaaacgcgaagaacgttatgcagtgcttaaatatgcggatattgatgccgcgttaagtgatagcgacaaactgcttctctctgcggtagtgaataaaattgatcgctatcgtaaagagcaaggcaaagaacccataaaaggggttgttgtcgagcatgattggcctgaatatgaacaggtctggaagaagatccaaactcgcgttgaccgtgaagataacaaccgcaagttcgaaacgatgctggacaacaaagaacgtctgggttatttcttcgtggttgagactcaccaggggaaattcctgatcaccagtgacgcacacagcccgaatcgtttgaaagattacagcggatacaaatatcgcgccatgttcagccctgattgcgggttcgacaacagcgaaatctttacgactggctggagtgttcactttaaacatgtggttcaggtatcgtttgatgaaatcgtagctctgtacgatccgaacgcttcgatttcaaactataacattgctgaattcatcgagaaaaaactgaccgaagcaaaacagcgtaaaatcgttgcataaataataagacgagggtatcatagccctctcttgttacaaataggtattacaatgaagaaaattatctttgctgccagcattttcttatgctctttttctggcaacgcggcgactgatccgttaggagagtttatccaaacactcccttctgtgaagtcaacattaccgctacaacaagcaacagtaatgaagaaagccccagccaatgcccccagctatgttaaggaattggacgaaattacaccaaagcagaaaaaggttttggagtatgctttcaggatcggtaacgaatacgatcgaaaaactgcaaagccagttgaatcggaaacatcgaaacgtttgggatatcatttagcggctattgcctggatcgagtctcgcgcatgtgagaacgtagggaaaggcaaaaagaatcatcatgcttatggttgttttcaagtaacagcccgtagcgcgtccgcacgaatggataaatcatattccaaacgcgtagtaatcaataagctcgaaacccttcggggtggttccaagtacgcacttcacgaactggaatactggcttgattaccacaaaggcgacttgaaaaaggcgctggcgagttacaacgcggggttcaagtattcaaagaaagaagcccgtgattatgctcgcatggttaaccataccgcgaagctgttagaagaaaaacgcattatctgataaaaagcccttgcaatttcgcaggggcttttttattatgtgtgtaccaactattgaggattaaattatgagcacatcacatcgagttattaccagtcacccgactatcatcaagccgaacatgctgcacatcattcagggtgtgttagatgaactgaacaaagatccaaaggttaaagtggaaaccatcacggtcgatcgtcatcgcatggaatctttcagcatttacttcgcatatggtgaagaaaaacgcaaactgtttatctgtgaaagtcacgatacatatcttgacgttggcaacaacacaattcatagcggcggtgtttacttcaacctgaacgtgtggggtagcaacaaagagatcatggatatcgtgaaagcgggtattcgtaagcacgtcccgaatgacgttagcatttacgaatgtgttaatgatgcaattgaagatcgctttgtgcgcgtaggggcttaacatggaaactaaactgacaccggaacagcagttagcaattattgatgaacgtatcgacgaaatccgagcgattgtaaaaccctatcaggaaaagctgaacgggttgctgaaagcccgtcaggaggtcaaagacgagatcgatcacaaaaccgcttcccgtgtccgcgcgatgactccaaaacaacgcattgagttctacatcaattccccgaacagcggacatgaaattttccgtgatgcgactaagttcttccaggatatggggcttgcgatcgatgggtataacccagaaaccaatcagcatattctccgtattgcgatgaatgaggatcgcagtaacctcgaatcagttctgaaatcgcttcaacgcgtgaagccatatgtgaagccgatcggcggtaaattactgttcgatatcttcgaacatacatgttcacagttcaatacgtactggttagcatttgacgttgcagaagaacgctggatgtgtttcactggctggagcctgaaacgcaatcaaaagccagaatttgaaagcgatagtttgcgatcagtgcttgcgtatgtctgtgaaacccattattatacccctatcgaaaacgattcatactaaggtaaaacgatgaaaaaacttgcgctgttactcactctgtttgctggctttgctcatgctgatgatcgactggctgaactctgcaataatcgtgacattaaagacgttgcggtatgtgaacaggtgattgccgaacaactggacgcggcttatgtgtggggcgaagaaaacgcgcacctcttcaagcgtcagaagttggttaaactgcatgagtttttacagtctgaaccaatgatgaacctctgtaccaatgcgccaaataaggaacgttgtgaaaaactccgtacttacctggttgatgaatatgttgctggcataggattatactgatgatgggattagtgatcttttacgggtgtgtgattgctgctgcaatcattatatggtattacgttaaaaagccaaacgaaagctcgttccctgtatatgatgacgagttggaagcctggcaaagatgggacgacgaatttaaatgaacacaggttatatcttaatgtgtgttgtggttgtgatcgcggggctggctgtgctggcttaccgccactatacaggtgatgaaaatgattattaaagaaatcaaagggaacgctgtagagttgttcctgaaacgaaaagtacacttgattcatgggtgtaactgttattgcaacatgggcgcgggtattgctaaagaagtgaagcaaaaaatccctggtgcgttcaaaattgatgcactgactatgaaaggcgatcagcggaagttaggcactaactccatctacatgacggaagaaggtcagattgtcttcaatgcctacactcagtttaaattctggggtactggcccacaagtggattatgatgcaatccggtcatgctttgtgagcgccgtagaacgcgccagtgcgtttcccgaaaaattgcctatcattacccctcttatcggtgcggggcttgctgggggcgattggttgcgtattagcgctattattgacgagtgtacgggagattacccgatcatcgttgttcacttcgatccatcggttgatccacgtaaggcggacttatcatgattgaagcaaataaagaaaagctctatagcaaaatagagaagtttgcgagcgctcgtgaccgtttccttgatggtgacgcgaaagcatcacaggaagcgctggattggtgggatgatatcgttagctttgtggatgatctggttgatgccggacgtaaagaggcgagagaatgagaccgcaagaacaaaagctgttaaaacataaactgaaacaactgggcgaagcgtatcaggattatgccgaagatgacgatcctgattcacgcaactacaatcaatcctgtattgacgacattacggcggatattctggatttcgttgaaaatgaaatcaatgatgcggttcgtgatgcggtagcagtggagcgagctaatcatgattgatcctatcaaagcaggtcgggcgatcaagaaagctaacaaacggatcgccgcaatcaaaggacaacgcgccgcactggtgaaaacctgtgaagcgctggcgcagtccatgaaagcgaacaaaatcaacatcacacagcgtaaaacggtggttgacattctttgtcttgttgatgaaggactggataaagaaatgggcgaactgaaaagcaaaatcaacatgtggtatcttgatatccataaagcacaagatagcgaaatgggcggttataatcatgactgacaaaatcaaagctaaagcaatgaaggtgattgcgacatacggaacactccgttggtgtaacgcgcaggtgtgcgggtgtatgggttgtgcaaatcatactatgacgaaagaagagtatgatattgctatccagatgccggaaatcaaagagcatcttgcgcgacgtaacaaaaaactcatgggtaacggatggtttacaattggctaaactgtattatcactatgcatcaatgaacgctggaaagagtgcgcgactgttgacggacgcgcacaattacaaagaacgcggtatgcgtgttgtaatctataagccagcaatcgacacccgcacatcaaacacagtgagttcgcgtatcgggctgaacgaaaagtgtgaattgattgcgcctgatatggatctgttctgggacattcagcgccggaataaaattgcttgcatcttcgttgacgaggcgcaattcctttcgaagaaaaatgttttcgatctatgtcgcgttgttgatgaactcgaaatccctgtaatggcttacggtctgcgtactgatttccagttgaatctgttcgagggttcttactggttgttggcctgggcagacgagatccgagaactgcggggaatgtgtcactgtgggcgtaaagcaactacggttgcacgtatcgacgcacaaggcaacttcgtaaccgaaggggcgcaggttgagatcggagccgaagacaaatacgtttcgctctgtcgcaaacattatcacgaaaaacttcttgataatgttggtctgaactgttaaggtgtattcagacaaacaaaggagaacactatgagccgtacttaccgtaagaaatatgttccagtccgtgataagtcctccatcgaacagatcgaagagacaaaagcattttcagagtattatgcacagcacggggaaagtcctgatggtttacgttggtatacaaccaactggaaacacaaatcaggttgcgcatatatccggttcgataaaaacctgaatcgcgacggtaacaaagctcatcgtgatatctccgcgatgctttcaatcgctgtgaaaaagattgattcgaaagtacgcgctaaaatgcgtcaggaattacgccggatgaaagctggcgtaattggatgggatgaaaatatcgagaacgcaaataagatccgcgcttttgagcgtagcttatgctggtatgagataacttgatgtatttttagactaattttacataaggggcgattcgccccttttttgctataaatatatacaggaacggatctattgttgatccgtaagtacgtagagaattgcttatgaacattaaacgcatatctaaagcgctgatgtttggtttgttaatcttgtctccgtcatcacatgctgatgataggtcagtagtagccaaagagttcgattactatatcaatgcggcgctacaggtatatcttgacaccatccctcccagcgtaaataccagtgaactattctataattacatggaacgaaaatggcagcagaagcaatgtaaatccgaacccgaatgtaaacgtttagggctacgggttgcaagtgaattcgccgctattcatcgttcataagggatgaagatgcagacgtttaacgaagtaacagaacgcgataccgcgagtaaaattgatgcctttattggcacttgcttaatgtctgtaacctatatgcacagcgcacattttgcgactggttcatattcacagcataaagcatttgaagggttttacgaagatatgcaggatttggttgataaattcaccgaaatccatataggcattactggtcgatacaaacccgtattaaaaacagaaaatgtgcttgacacggtcgcgtatctccgtaaaatagccgatgaagccaacgaaatctatgattcagtagatagttcattgaagaacgtcctggacgagatcaaaggcttgtgctatcaaacgatttacaagctgacaaaactttcttaaaaagagtttgacaagcgaaaaagtgatgatagaataactatcgaattgaaacataaacccaatggaaataatgatgaacttaaacactatcgtaaacaacccgaagaaaaccactctgatcgctctgggcgtaatcgccgctctgtggctggttccgaactcgtacactatcgttcaggatggtacggtaaaaactcaaaccttcatgggtaaagtttcaccgaagcctgttctgcctggcttccacctggtaaacccactggctgatttcgaggtgttcaacaccaaagacatcgcaatgaagtttgacaaattgcaggttccgtcccaggataaattcaaatccactgtggatatgaccgtgatgttgcagttcgatggtaacaaagccccgatcaaccgtatcaacgcgggtaatcaggatcaggcgcttgataagtacgtgaccgaaaaacttctgtctaccgtccgtgagttcggtaaatctgtaccgaaagcacaggatctgtataacgcagaagttcaaagccagctacagatcgcaattcagcaggaagttgaagagtatgcccgtccttacggctacaccgtgaaacaggtattcttgcaggacatcgacctgccggaagcgattaagaaacaggttgaaaacacaaaaattcgtgaagaacaggtgaacgcagaaaaagcagaactggcacgtaaagagcaaatcgctcaacaggcagttgttcaggcaattgccgataaagaagcccgtagcaatgctgcacaggctaacgagcgtgatgctgatgcccgtctgtatgcggctaagaaagaagccgaagcgaacgccgtgttgcagcgtaccattacaccagaaatgattcgctggaaagaacttgacgttcagatgaaacgcgcagagaaataccagggcggtgttccacataccgtaatgggtgcgggttacgatggacaagtgattttcgattctcgtaaataaggttttaaagcccccactctgggggcttgactcctaaaacgagaatactataatgaacataaaacagatcatccttactatcttcatttcgctattcttcggctttattggcggttttcttggtgtattggtgattgcgtctgttttatgattaacctttaaacgtggagcacgttatgaaacaatttgataaagctgtcgtaattggcagattccaacccttccataatggtcatgcagcaatggtgcgtaaagcactcgaagaagcaaaaaccgtttacatccttttgggttcagcttacgcttaccctaacgttttaaaccctctgacagcgcgtgagcgtcaaacgatgatcttctcatggttaaacgctaacttcccgatcgaagatgttgttcgtgttcagtttgaacacattccagattatctttacaacgaagagaaatggaaaacctctgttcgtactgctatcagggaaaccaaaggcgacaaaatcgctatctacggttacgaaaaagatgcgggttcatactggcttaaagcgttcggatggacacacgtacctgttgatcctgttcgggttgacggcaaggatctatcagcaaccgatctgcgtccgattattttcaaccacaaaaacggatgggataagaaactgctgcgctttgttcctcaaacaaccgtcgattatatcgacaaatggatgatggaagacacgttctggcgtttattctacgaatacgagaaatgggaaagcgaattggagaaattcaaaaactacccataccccgacgcgctgaactgctgcacgggtgatagtgtggttgtgtgtaacaatcacctgctggtaattcgtcgtaagttcgccccaggtaaagacgcgttagcccttcctggcggacacaaaaactcaaatgaaacgttcctggattgtgcgatccgtgaactgctcgaagaggtgcggatcaaagttcctgaaaaggttatccgtggttcaatccgtaattcgatgctgttcgatcatccgaaacgttccgtatacttctcaaaaccgactgtggcgcagtacatcaagttagaacctaacaatgatggaagtctgccccgtattatgggcggttctgacgatgcgttagacgcgttctggatgcctatgcacgaagtcaaacaaaatcgtggtgagttcttcgatgaccactatcagattatcgtagcctttacgggactctgataaaaagattaaaaagcccttgcgttcgcgtgagggcttttgttatattaggggcatcgaaacgaaggaggtaattatgagcaagaaatcagaagtagccgaaatcaaaaaacttgatgatggtaaaatcgcggtacgttggaaaggcaatcgcaagttcaatgtgattgaagatcccgaagtcgctgctttcctggtgttcatgattacccagaaagatacattcgttcctgatccaaacaatataaggctggcggattaatgaaacatccttactgtttagtaacccgtcctatctgcgcgggtggtttacctgtcaactgctggcagttgattcaaacaggtgacgcgttcctgaataagcgcggtgataaagtgtttgtctatggcgtggattccatcgaaaatgaaacgatggtgatcaccgacgagaaaacaaaagaaaaatatacgttgacttctgatcacgattgccgtaactttaacgtgtactggaaatctaatgaagactttgaaggaattaaatcatgaaagtagcaacccttagcggtatctctgatgtaaaatgtcgcatggcgctggaacctggacatcgtgtaggaattaaacacacgggttctgtaggtacaaagaattacaccttgcaatcagttgcgcgtgataaaaatgatatggtttatgtgtttgttactgaacctatgtcaagtagcattcgtcaaacgctggtgatgaaactgggaaccaaagaacccgcaatgctgatcggtggaactgtagagcctgttactgttgcgagcatcgcgcataaaggtattgaatgcgccgtagacggtaacggtaaactgtccttcgaagggactaaacgccaacccgtcgatcgtccggttgttgttggagacatcttcacgtcagaacgccgtgaataccatgttgaatacatcgcacaagatggttctctggtttgtcgcatgtactcccgtaagagcgcagacgataacaaatacatgggattaaccgtcattgatggacgtgacgcgatcctgctggattccctgaatgttaaaattaagtttgcatactcatgattcacacaattagcgttattatgggtgatgtcgtaaacatcaacgggcacgattactacgtagcggaaatcaatacaaagggtaatcgtgagatcctggaactggacattgtaaggccgtccgaagggcaatcccttacgatcgaagtggttcataacacgaacacaggggaagacgtagtgaagccagttctggcacgtcttccggtgttctactgtgaaaagtcaaaacgttggaaaatgaaatgatagatttaactgatgtgaaagtgggtgataccctgtttgatcctggtattcgtcgatacagtcatcacaaaaccccacgacctcgcaccttgtatgtgatcaaggttgcccgtcaatacctgtatgcgtcggaagatccaaatatcaccgatattaaagatttccgtgttgagcgacttgatcgaaaaacaggtagcgctaatgactggaataatcatacacagggttatcatagcgaagacgaatacaaagaacatttgtaccgtatcgaacttactgataaaatcaaagacgcgttcggtcgtggacatgtaacgcgtgtaccaaatatcactaccgctgaactgcgcggtatcgcaaaaaccctgggggttgaattttgaaaactgtaatggaaaccgtgttcggttctcacctgtacggactgaacacaccgacaagcgacaaagactataaagggatctttctcccgcacccgcgcgatattctcctggggaaagccccgaagactattgacaccagcacaggcgataaaagctctaaaaacaccgtagacgacgttgaccgtcagttgtatagtctgactaagttcattagtcttgcgtgtgatggtgataccgtagcgctcgatatgcttcacgcttcggatgacaagctgatcgttaactctcaaatctggcagtatatccgcgctaaccgctggcgtttttacaccactgaactaactggcttgttcggttatgttcgtaagcaagccgcgaaatatggtgtgaagggttcccgactggctgcattgcgcgaagttgttgatgtactgaaagaaaccgaaacgatcggtggtattcaggaattcacgccagatatgaaacgctatacgcgtgaagtgaaagtgtctgacatcaaggatcgtttccctacaaacgagttctgccgattcgttaccgacacgacaatgaaatctggttgtcaggacttctatgaagtgctggggcgtaaattccagttcacgatcaaagccgatgaaatgcgcaagtcagtgtataaactctgggatgaatacggagaacgcgcacgacaagcagaagccaacaacgggatcgactggaaagcattaagtcacgcgttgcgcggtggtatgcagttgatccagatttacaaagatggtgatatcgtttatcctctgcctgatagcgcattcctgaaactggttaaagctggcggcgtaccgttcgcaaccgtacaggaaaaactggaagaagtcatgggtgaagtcgaacgccttgcagcgatttcaacatatccgaaagaagttgatcgcgaattctggaacgatttcatcgaacgcgtatacagcgatcatgttgtggggtattacaaatgatgtatcctaaattgtccggcgctgaaattgatgttctgtataaactttacggatacgcaactaaagtgctagacttagatttcgatgacgtacccagcaaatcagggcgtgatgccctgattcaaaaaggttacgctcgaagggtaacgggttatcacgataattcgaaagcatggttgctgattaccccactggggattgacgcataccgacacggtattaaaacggagtggcactaatgactgatgttattttgaacgttaaagatgttgtactgggcgataccaaaaacccagacgcagttacactggaacaggctgttgttcagatcatgcgcgatagcctccgactggaagttactgaacgcaccgaaagcaattacacgggcgggattgatggtcgccagttgtacgaagatagcaaacacgttaatgtaaccctatgggcggacattgacgaaaactcatacaaaatcgacgagattgattttgacgtatgaaaataattgacctctgcgctggtgtgggcggggttcgattaggatttgataaggcgttcggcggtgtcgaatgccttttaacgtctgaaatcgacaagttcgcacagcaaacatatatcgaaaactggggcgatgataacctacagggtgatctattcgccattgatgaaaacaaagtgccggatcatgatatcctgctggcggggttcccgtgtcaggcgttcagtaaagccggattgaaactgggcttcgatgatgtacgcggtacggtgttctttgaaatcctccgcattatacgcgctaaaaagccccgtgtgttgttctttgagaacgtgcctgaactgctaacccatgacaaggggaagacgttcagaacgatttacgggcttctggaggccgaaggatacaacgtattctatcaacgcctgaacacaaaggatttcggactaccacaaagacgggaacgcgtgtttattgtctgcttcctggatgatgtattcttttcatttcctgttcccccgcgtacacctacacgcgtaggcgacatcctcgaagatgctgatgattcattcaccctctcagataacgcatggaaaggctttagagagcgtaaggaacgaaataaggcaaacggtaagggtttcggttatcaggccgtcacaagcgattctgcgcacactgggacgataacagcgcagtattacaaagacggtgttcaatgtctggtattgcaggacgggaagaaccccagacgattaaccccgcgtgaatgtttccgcttgcagggcttcccagattcgtttattattccatcgagtaagaaacaggcatacaaacaagcgggtaactccgtttccgtgccagttatcgaggcaatagcaaaacagataaggaaagtattatgagaaatcaacctgaaatcccgatcgataccgttgttgaatggcattacaaccactgggaaaatgatgaatggtctgccagccagggcgtattgaagtaccagaaaggcaacttcatcctgattgaactcgaaggtaagccaaccgtgctggacggtaaagatttggtaatgcgtccgtacaaagaaagaccggaaacaaaattctttaaaaaagtgtttgcatccggtagttgatagtgataccttagctttaccgaaacaaaggagacacaaaatggctaacatgactaaagcgttattccagaagaaagtaaaagcggttaaagaacttgggttcactccggctttgatgactaatggcaaaactctgatcattcgcttcgtgaatgcttacgatgaagttgtgtgggaaaccgtttgtgtcgcctcttgttatgacgttttgaacagacaagagaagaaatatcttgcatggtttaacgaagtgtaatatattggccttgttgaaacgaaactgaaaaggaacataccatgacttttaatgacctgtttaacggatgtactggcgctggtgcgaaattcaatctcctgaaagattacccgctgggttctaatccaggttacgtgatggttgaagtgcgtaacggtgaatactacaacgtgttcatgtgggatcgttctttctcttactgctggttcggtgcgaaatacaaaccagattacatcctggaacaaatcgaaacagtgaaagcgaaaaaccctgaactgtacgctttcgcagagtctatccgtggtgtgttcggacactgattaatcaagccccgaaaggggcttttttcgtgaggaagttattatgatctatactgttgaatgtcttgttgattgtgagcctggtaatctgatttgcgcatcggatactattctggactgtatcgacgcagtgaacaatcacgaaaccttcccgtatgttgccgatgatctcgaattcatcgcatggaaagacggtaagaaagttgcggttgctgtattggtggggaacagagtaggcgatacaataggcgctaacggttatgaaccgaaccctgtgacctacgaagaagttattggtaaaatggtgatcgaatgaaaaataaaaacgccgaacgcggggagaataccaacgaaatgttcttcattcgttgcaatcgtaagcccctcaaacgcgggtatgacgacatcgacgaagccctgagcaagtttaacgaaatcatccgttcatccgtctaccgtagcggggaacatcctggcgacctgtgggaactggtagcaaaagatccttacagtaacatcgtcctgaaatccgaaacaaagggtaaagtatcatgaaaatttatactgttgaaagtttaagcgaagattactatacatttagtgatttggtcggttctaccgtatcgctggaacgtgcgattgaaatggctaaaccttttgactgggtgagtatcactgaatgcgacggctttactggcgaacgtctgcgcatagtaacactgagcaacgaaaaagccattgcgaacgcaaccaaagaaaacttacaatttgaggatgtaaaatgaaaatccgttctggttttgtgagcaatagttcatcaagtagtttcatcgtccggttcccgaaagatccgactaatatcgacaacctgcgcgaaatgatgggcgattgcgtccctgattgtggttactacgatccgccattgacagcggaagaagtggtcaatcacgttcatcgtgacttaggcggtcatctgggtaatagctttgaatcgttctacgacgataagcgctatgactgggaaaccgaagaaagcgcggaaaaccgttaccgttcaaatcctcaaattgcgcttgcgtatgacgggcgagactggtacgatctggacacagaagagaaagacgctctgatcaaaatgtggttgtatgaagaatacaacacgaagttcggcaatcaggacggcgtgtttatctttgaattcacgtactccgatgaatgcggcccgatcggaactcaactggaacatggaaacatcttccgtaaccttgaacacacatcaaagagtcatcactgatggataataaactgaaaacagaagtttgtgttgttatgcctcgctatgcattaggggagtcgatcccctttagccaggatcgccccgcaccgtttgatgtattttctttgcgaaaatatcttgaacgatttgaactgaacgagtatactctccaaatcgttcgggtatggaatccggtaatgtatgcgcttgcgtttgacgttgctgaatccaaactcactacgatggatgaatacgttgaactcctggcgcgtaagttcgggtgtgatcgtacagtcgaagcagtaagcaataaagttaacgaaattttagaaaaattcaaatacgagaaaatttaaatgtcaatcacaaatatcgaattcaaaaacgctgtatcgaagccaaccccgacaaaccacgttttcgtgtgtgacgtatccggttcaatgtacaacgaactgcctaagatccgtaaacacctgaaagcaaacctggcgagtctggttaaacaggatgacaccgtttcgatcctgtacttctccagcaaaggcgattacggcacggtgttccgtggtgagaaggttagcaatgtctctgacctgtctaacatctgcgcggctatcgaccgttacctgaaacctacgggttgtactggctttgttgagccgttgaatctggctgcggaaatcgctaccgatctgcaatctgaaaacggcaacctgaacagcctgatcttcctgacagacggttatgataactgctggcgtaccgatgatattctgaaagcgtgtgcggttctgccactgactttcaacagtatcgcgttcctggaatacggttattatgtaaaccgtcctctgctggaaaaaatggcagaagcaaccaacgcattgcacaaattcgttgaaggtttcgacgcatacgaaccagcatttaacgaaatcatcaccgcgcagacttccgcgcgtatcgaagtcaaagttgctgatgctacccatgcgatctacctggacgaagggcgcgtgtatgtcctgaacgctgcaaacggtgttgtgctggttccagaacacatcaaaaacatctgggcgctgggtgaaaacgcgattaatgatgttgacggattcgatccgaacatcgccagcgaacagcaagttctgtatgtcgtgctttatcatgcactgcacacaatgaaccctgatctggcatggaaagtgcttcaaaagctgggtgatgtccgtctgatcaaagcgtatgacaactgctttaccaaacaggactactccaacgcgaaagacctgattgcacaggctgttgtagatccatcacagcgtttcgttgatggtattgattacaacatggttccagacgaaaacgcgttcactctggttgatgcgctcgaactgctggcacaaactgacacagtgatcgacctgtcttctgagcactgggcgtataaccgcacaggccgtcagactgtacagaaagaagatgatacactggatcaactgaccgaacagatcgcaaacgctgcaaccccagaagaacgtaaagcactggcggcgcaaatggtagcgcatgaagtctggacaccgaaatttacccaaaccacaaccaaagtatcggttaaacatctggtgggtaacagttcccgtccgaacatttccatcaacacggatctggaagggtatgtgactatcccagaaagcaaacagaaagaattcggtctgccggaaaaagtcgaaactaagcaggtgcgtaacttcaccatcgttaaagatggtatcgtgaacgttaaagttctgccgctggaaaccgatattccgacactgaaaaaccttcgtgcttctggcctgactatcaagccgctggaaaaaatcggtgatgatcgtatgtcggttctggtagactttacctctctgcctctggttaaccgtggcatgactcgcgggttaagcggtaaagagttcgtgactgataacgtgcgtctggaaatcctgaaaggccgtcagaaggttatgaagttcttccgtgacaacgcgatcggactgcgcaacgcagaagggctgaaacagcgctttggtgaggctgcgggtgaatggctgtctgaacagggtattcgtgattacgggttctctccgaaggttgagcgcacagaatcgactgatgtttacatgtcgaaagaactgaacgtgaaaatcaagggtgtttcctcccttcctgctgtagcggctaccgtcgcgaaacgtgacgaaggtaagaagaaactgaacaacggcgacctgattatcctgtgggcttacgatcaggtgaaatctgaactggatgcgcttgacaaagatcaggtagtcgagtatcttgataagcagacaaaggcaacgattcaggaagtccgtaaactgaatgcccgtttaagtcgcgtaatgtacggtgttgtagtagcccatgcatggttcgcggatctggacttcgaagaaaccaaagtttctatcgctgcaaaagatattcttccgaaagaagataatattccatccgatttctggaaagtctgggaaaccacatcattcgaatgtgaaatcgtcctggaagaaaaagaagtcaaaatctaacaatgaccgcccccgaaagggggcatattgaggaaaataatatgtcacgtaacgtattctggggtgaagttgtaaaaggcgatatcctgtacctgtccgaaccacaagcctatcgtgaaaacaacgaaaagaaccacgcatacgcgcctatgctgccggatttcgtggttgttgatgatgtatttgtcggtgaaaatggctggcagattgatttagtcggattcccttacaaaaagggtgcaatccttctcgaactggaagatcatcatttcttcgcccatgttggcaacatcgaagatcatggtgatttcgatatcgaagatatccgcgaaaagccgtatgtgttcagcaactactacaaggtcggtggacacctgcgcagtgataacaaaactgttctgtatctggatggtattctgtctgggatgcataatttcagcattgagaagccaggcaacagcgcagaactctaccgcttgtttggaaagtacgatcgccagaatggtaaactgttaccgtcagaaatggcttatatcatcaatcgtctgatcatgggacttcacaaaacattcctgattcactatgatggtgatgtagaacaggcgatgactactgtgattgacatcctgaaagcaaaatctcgtgaaatggataccctgccaaaatgacattattcttcatcattgcattaggtgtgtttattctgggagccacgatcgcatttatggcgttcgataaacgcgaatatcaactggcggtcatcgggcttatagtagcttgtatcccgctggtgttgtcatacaacctgtatcatgagaaaatcgcggagaacgcgaaatatgaggcaagacgatgaagattcgttctgggttcgtgagcaatagctcaagcagtagtttcattatcgggatcggacttgtccgccctggtaaagaacaggaagttgcaaagatttacggtgagtcaaacgttgaatctctgatggatatgtttgatgatactcgtcctcgctggggttcgcctcaaatacacgatgacggtacaatcacactggaagcgttcggatgtaatagcgtcgaaataacccgcatttgggacaagctgaaagaactgaatctggatgatgttaaaatcgttcacttcaatgagcgcggcgacgaaccggaatacgacgatgaaaccggaagttataactatgactggtatgacgacgcggacgcattcgggccggaactcgaaaagaaatacaatctcctgagagataaccgcgaactgttcattgaaggtgatgttcgttgcggtggtggttatgacggctaaacgattggtgatctgttaccgctgtttgcatgtgtatgatcacaacacagcgaagcgaacagcaacaaagcgcttgcgcgttaaagaggcggaatgtcctctctgtaaatgtaaaatctgtttggggtaatccatgataacgatagtatactgggaagaactggaaagcgaattcagtgatgaagctggggaaatggctgctgtagcgggtgaatctgaaatgcttacagctaccgaaagcatggatgatgcatttgatcgcatcaagaaacaccagaaagaaaacgaaggtcgggatattcagtacatgctatcgttctggctggatggtgaaatcttctgtcatgctgctattgctgaggatactccggtcgatatgtgtcgtgaagaaatcgtgaagtacgtcaaatcttttatgcattaactcaaaaagcccttgcgttcgcgtgagggctttgttatattacacatatcgaaacggaacagccaaaaggaacgagaacatgaaagctaaaatggtgaagttcgtaaaagactggagaaaaggcgcagtaatcggtgagagctacgtaatcgtagacatcgaaagcaacctgctcgaaggtgcgaacgttttagaagttcctcgttacggtatggttgaagccgctgataaagcaaaagaactgaacggttacgttctccacatcatcgaagcaattgagaaggaattagcatgaacagcgtttatctgattgaagaaaccattatccagccaaacggcggagtgtatgaaaagaatatcgtgtgtgctgccctgaatgaacaagaggcagatcacaaagtgaaatatttaaatgaaaatgctgttgtatgtcagacgtattccggttatagtgttgcatatgcttggaaagcggttagtttagaaacccaaccatcttggttaatcaacctgaaaaaataaggggcttatcatgaaaatgaattacgttcgcggcggtatcatggcactgttactgaaaggtgtttctcgtagtgagaatcgtatgggtatggggccgatgggtaaagtctggtctgtctatattggcggtgactgtatcggttacatcggcaatgatggattgagccgcgtttacctggctatctcaagcgggggtcgtgaagtcgaatgtggtaatttcatgcaagcacttgcgcagttcattgatactgcgatcactcagattgaaaaacagggctgcatcgaacgccgttacgcaaacaagatcggaatgattgaatattccaacttctgcttcgaagtcgaagaagtgcgttatgatacgatggacgaagtatacgaatatgtgcttcgtggtgaggaagtgattaagtcctataacgggacgaaggttatcaataaccgctctttcatcaccccgttcgaattgcgatatcaacagctaatgggctggatcgtgatggaataagaaaagcccctttcggggctttttgttatgaggatgatagctggagtttgattctttctacttcttccggttcatcaatgatgctgtagtaaatcgtcacggtgattgcgttttcgtcatactgcggaatcacttcaacatccagattgtaaacacggggttcgtatgcgcggatcgcggagacaatcgaagtccttactgcttccgctgttagcgggttcatgttctcgaaaatctgttccccgatctcacaaccaaagttgctatcgaaaggccgtgtgcctttttgtgttgttacgataccgatcagactattctttaccgctgccgcccctttcgaggcggttacgtcattgttccagtcttttgttaagttgggatcgatatcgctatacagtaagcgaaggttaacacccattttatccaaccacctttagaaacgcctctaagcctctcagtgcaacgatatgctcgtagccacacgaacaccttaccggaatgtttgcaacgattgctggcttatccagagcgctatttattgatttaaagaccggatagtcgatactatccagaacggcttctttctctgactctttacagtcatcccataagatttgttcaccgtcgatgactacaaacttaatcagttcgggtaactcttcctttccggtgcggtgtggttcgactgaaatcttgatctcattgccgtacagcttttcttcgtattcatccaccatgatatgatgacgattgagcacaaacttaatcagttccccgcattcagggcatttgatttggagatctacagtctctttgttgatactgtcgaacagagccataatgtaaacataatcgcgctgatgcttgaacacatcaccttcaataatgaagttatccgtgtcatcaagatcgccaatggttaacgggcgataagtcacattatattttgggatatgtcggggtgtatgtttacgcatttgcattctcttttcgtttcaagtcttccgccagcaatgcaacgtaaattgaacgttccatcgggcttccattcattataggttcaatctgtacggtattcttatttaacaaatagttggttttgaagaactcattcagttctgatttgttgaacaggattttgtacagtgtcaataagtcgctgaactcaatatcacgcacggtaacatgacaggacttgcgtaacagtttaacgatattttccatatcttcaatagacaccagatccaggatcgcgttctttgtgtcctcgtctaatgcattccattcgtatctttcgccgtcctgcttgacatactggatacattcaaggaataattgttcactgttgttacgatgtttcgggaatttgaatcccagagtaagcgaatcatcaagggcatattcattttgcaaaacgtaatcagttacatgcatgaatgcttctgattgtccgttgcttcctttgattcggatcttgattgcgttcttaccgaacgatacacaatacaccttagtgaaaatgttttcctgttcggtgcgggaataacccggatacataatatctaaaatttcatccagcatttcttgctgttctgtgagcgtcttcccttccatgtccgcgcttgtgagtaagaaactcaactgatcgcgcacggtaaacatagggaatcgcttcactccaccagggagttttacgcggattatgtcaatcattttaacctcaaaaggggctttcgccccttattgtccagtaaccacaccacgaacggcaattgctgccccttcgataagtgattgtttgaatccgtcccaaccttctttatctgcttcaacaagccagcctgttttataggcaaagtcaacagtgaatgtccagatttcgttattgctttcataactcagttctgggttgctgactttaacaggcaaacacttctggaatacatacgtgctgtgcgggacaccatcgcgattgtgtaagtttacctggatcgcgcttgatacttcatcaatgaatgcgaactggcctgagacatcatcacgaatagctgacaaccattcgttgaatactttcaggttacgcgcttctgaatccacacggaacgttagcgataattcgccattctccggtcgggtgaatcggatctggggtacaccgccattatacacgtattcataacccagtgttttaccaggcaactgaacaccaacgatgctcaaccccatattatacatcattttgtcacggaattctgttagcatctgtccgtaaacactatcaccaaacagggaagtaattaaacgagggcttaacgcccccatgattttactgaaacctgttttgttcagggacataatagctttatcaaccgtatagctgaatagcttgcttacgccccctgtaatagcgttcatgaactcgttcgggttattcgcgttaatggaactcatagtaccatcaattaaagtatcgcggatactcccgatcgtgctgtcgagaatgcgtgatgctggactggttgcgaatacaacactaaacaggttgcttcgctggaagtctctatttgccattcctgacaaaaattcatctacgctatagaacattgttcccccttaatactgcgtatcaaaaatcgaatcctgacgcatatcgatcagttccataaactgaatttcgatttcaactgcgatcggggtgttcggtgattctctcaacgtatttacaatgttgtccattgtacgcccgaaacgaacgctggtaatacctgctggcccgaacgtggaatgagggaaccgcaaactgtcacctgtctggaagtcacgaataaaccacacaggaggcgatttaataacttcaacgttcgatacgaagtcaacaatctgatccccgatgctgccgttgaaatcgcttgctgtcgtctggtttgttgatggtgcaaaaacgtttgcaaccttcgaagcactggaattatacgcttgtttaaccagtccggctaattctgctggagtaccgcccgaagtagtaccataacccagcaccgtgaacaggtaatagattttaatcagttccagcaggtcataacggctttcgataacgaatgtattgtaatacatctttgtgcgcttatcagagccttgaaacgctgctttcgtaccgatgtcgattgcttccctacggtctgccagaataccaccagaaacggattctacagcgccccagataacgtttgataccgcacgggataaacctttagcaacaatactatcggttgcatcctgataacggtgtgagttcacttcgttatcgttcaggcttcgcggtaaaagtatttgacaaatggggttaagtgtacccatagtacgggtattcaaaacctgtttgtatcgaacgttcccagtgttagcactaaggatctgttgcgcgttctgtgctgcctgacgtaatgagcggtagttgtctttactgcctggtgcaagtccacccgtgaaatcatatgctgtgaacagcaagccgttattatacaggcttgatgcattataagcgttatcaatacctgctgcacgttgggaaggaaattccgctgttacgatcggttgagtcaacgcgtttttagttgttgcagcacccccagaggggatgccagcatttttgatttcagcaaatgattgtacagtgtcttgcaatactgtaattttcatttaaatttcctttaagctaatgcaatcaatggtttacggtcagttcgttgtactgaatgctgaaccgtgttgtttactgttttgttgttgacctgaacgctgttaggcgttgtaggctgaacaggggctttcactgcttccggttgcttgtcaatacttgcactcgtttccggtactgtggtgatcttttcctgccagcgggagatcatatcacgatagcggtctttgtcgtcctcattcagcttgttcgaattgtttttctcttcaagcgattctatgagtttttccattacctttttatcgttgcccgtcagattgtctttgttcaggatttcatcaccctgatcgaattcattatccgctttaggtttcgctttcgcttgcgcggcttcgatctgtttggtttcgtccacgcgcttacggttagcggtattctctttatcaacctcagcctgtaacagtgcggggttttcctgcaatgctttcagttctttcttcttctcttcggtgatcttttcttcaatagccacacgatcgcgcatctgttccaattgcttagacaatgctttctgtgcgtctgtttgctgtccgaaactatatgagaatgcgccctgggtagccttaacctgttcgacaaccttagaacgtgcctcaaccactttatcattctgatcctggatctcctgctgtttcagcagaatcagatcatcgggatcaatttcaagaccgtatttttgtttgtcgcgcagtgctgatactttcattccgcgtccggcgttggtaatcgtttcagatccggtatattcacccagagcgtaaatcagattaccgataccttccgtgattgcggttttgatggtatcgcccagaaccttaaacggttcaaggaacaagtttttcagcgattcgcccaaattactcatatcgaagttttgcagaccttcgttgattttctcagcaagggttttgatattcccgaagtatgaaccaaacaaatctttcgaggcttcaccctctgcaagaatatcctggaaccacttctgaacaaccttactcagtacgtcgatcgcaaatacgatactaccgataatcagagtccattttgcaaacttcgccagcgcttcgagagaataaccgataaagcgagccagaagaccggatgtattatccttgattgcacccagcaaagacaatactttcttgctgaatttcttctcgtctttatccttatcgcggatcttcttcttgtcccgatcgacctccggttcctcttccggtactggttcaggttccggcgcgggggctggtttcttttcagcgagttcgataaacttggtgattgcttctgcaatcgttccggtgtatgtttcgattttcgcaaatgggttatgctggttcgatacactgacggagttatcaacactggttgtgctgttgtctgttaatgatggtggacgcgctggcccaacaaaatcgggcaactgttcagcaagtggttgctgatcctgttcgtattgttcctggaagccagcgaatttctctttgaaacgatcctcaaaggatttcacgctgtctttgatgtccagtgtattcagcgcggtttcaagggtattatcattgatatcctttaactcacgcatcgaatctttatctaacgttgcctggatcttacgaacagtcggttgcgcctgtggttttggtggattctgcatccggcgacgttgttcttcgttaaaatatggattgctagccattatcattcaccgatgatgttaagccctttaatggttttcccctcatgcacaatatagacttcctggagtacgccacgttttacatcgtcatattcataacgatacaggcagttaattaattgaatacggttttcgtccgtcagttcgatcggcttcccgttgtcatacgcttctttaagcagtaatgccagatcatccagcattagggtcggtttgttgaagaccaatcgaaggttatcaaaagtatgttcatacttagcttcgctgattttcatatcatccagattaataccgatctctttcagtatcgccattgccttatcgtcattatgataatgcaggtgaatcaaaaggaattcggtttctgctgcggttaattcgcgcggttgaatctctttgatgatatactcaagcaactgcattgggtctttcattgctttaatctgggtgaaatgacgataacccagacgggggatcgtaacctgttcaccagtaggcaacgtgactactttatttttgctgttcttgatgtttaaacgcgtaaccataaatttatcaagtgtgtttttcttctctttcatgatcgcctcaagtatcccgatatttactatttagtaaatagaatataaagggaggatgtctaatgtccagtaaagttataaaccgcgtcgtgtcggttaaattatatccaacatatgaaaagttcgctgataacgtctatcttgaattgttacctgcccttgtctcaatgagtgagaaaaccatcattaacggtacttctgaaacattgatgcagatctatgataaccagttaatctatcagttgacagaaaaaccgattattcaggtatccttccagtataacgaaacgttagaacagcattactacggtgttctgtattcaaacgtcgaaaccgatgatatgaaccgctctatactgcgcctaaacctttctccggtgcatacggtgtttcgtcgtaagttttcccgttcgttcagtaacaacgccgtacagacgattacagagtgcatgacggcactgtataacgatatgaagttgatcacgccgcatatcgacgcatcaaacgtgcgtattcctccggcttgcctgagcgggacgtatgaaaccgtgtttgattacatccgtgacaacgggcagagcgtagattcgtctgacttctgttatttgtgggaagatggttccggtatctttatgaaaagcaatacggagatcctcgcacaaaccccgttaaaggcttacaagttcaacgtaagtaacccgtttttaggtgacgctttggtattcacgaaaggtgaatacattacccataaggataacactaccctgttaggggatgcaagtttctttagtttctcgatgacggataaaaaactgtatagtgatatccttgcgagtaccgatattgaaaacgcatggatcaccatgaacaggaacgcggtatatgagaacaacttccagaacccagacaaacagggtcaaccgttccaggctgttaagtgtcagacgttatccagttatgaaaaacgtattcggtttgatatcaatcagggtcgaatggatgttaaagtgggggcattgattgaggtgttaggggatgaatattcagggaagtatctgatcgttgaatgtatccgcgatgtatcaaaagatttccacctgcaaacattggaatgtgtacaggtggcagcggctacgaacgacaccagtaaaaccagtgaggcttaggccgtagtttcttcatgatagcccatgaacaggtcgaacacgttgttcttgttctgtttacgggctttcttgatattctcgtagttctcgcgaggcatatcgatcatgaagcacttctgacgcgctgtagcgttctctgtgagcgcaaacagttcatcttcggtgtattccttgtttttgtccagatcgagaatgacgcattgccaggtgtcttcatcgctggtttgttgcatcatcaccagtgcggcgtttttgaatcccagattatgcgcaagcatttcatggacgaattcgcggtcgccgtcttcataacggagttcgttgccttcccaacggataaggcgcacagtcttacttggttcatttttcataacgtggtttcctgctcataagttcgcgtaaacgtttcgtcggttcaggtgggtttttgatgatctcttgaatccgatcccacacttccggtgaaacttctttcctgtccatgataacgatattctgattatcacagcactttccaaccattacggatcgcccacaattaaggcaaatcgtatcagggcattttccaagtttatcagggtcgatagattcaaggaatcttcttgctaccgataaccgctctttaacttctattgggtcatattctttatttttcatgctaacaattgactcccctcataattggtaggaacccgacaggcaaaaaacaattgttggtgttcccagtttttacgcgcctgttctggagtatcaccccatgcagcatcaaaaccagttttcgcacagcaccagcgatgattagggtcttcgctgatagtttcgaatatttcgagtttcttactcatttcaggtcaccgataatttccatcgctgcttcgatgttttcaacaccataaaaggtattcccacttacttcaaggagtttgataccatgaagataaaccccaaccagcgcaccgatagcatcgtggatagcgtagttgccgttttgaagttgatttgcagtgtgcataattttcatgatgtttctcctttcgtttcgatatgggtaatgtaccactacattacccagtaagcaagcattatttttcgatttcgtagcactcttcaacttcgatgtttaccagaggtacttcgatatcccatgaatccgcttgtgcatcgtatacggctttgtcttcgtcgttcagaggcagacaagtaacccaaccgtcagtaacacgcatcacgcgcattttagaaaggctttcgagtgcgtccgctggcagtttttcaccaccgttacccagttgtgccaaacggtcttcatttaccagaacgattactttgccttcgagttctttagtgatttgcatgggatgttccttttgtctgtttcgtttcgatgtttgtaatataacaaaagccccttactcatgcaaggggctttttagcaaaaagtgctatttaaaacagatcagcgaagataacgtgaatatcatccggttcggtcttatcgcgtcggatcttcttgatgattggcaagaagaaactgaactcaggttcgcccttcttacgcgttttagacttctggagtccgtcaacttccatttcgacgatagcgccgatatagtcatctttgttcgccatgatgtattcgcgatccagttcaccacgttcttctaacgggatgtacacgcggttaataccgtcttcatcgtatcggtagtccgtatcagtcagaccggaacctgtgtttgttctggcttctcctgataagtcctcaaccacgaaccctccgaccttatgagcttctttggtgtgttcgtacacgtcgatgattcgcagttcaatcggggttttgttcttcaacttcacctgatccgcaacgcgtgaatccttccatttgaaatcaacgtttttcaggattgaaccctctttaccgtcattgcggtaattgttgtaatcctttttcgcttccgcgtagttctgcaccaggatagaagggatcaacttaaccgatgttacaccagagccagccagcgcaccttccaggatagagaaacgatcgcaatatggttgaacactcggagcatcgccatagtatacttcatacggtacgatatcccagacaacataaacgatattgcgctgttcttcgtcgctgatagtacctttcagggatttgtttacaatcccgttgccctcttcgcgtttcgcttccgcttgtgtctcgttctcggtagcttcccgcctaacatctgccacaaggtcagaaacagaatcgtcgtcatcgcccataaacccagcaagactaaatggaacgctgttcgaaggaacgacagcagttttttcagcagggacataaatcagttctccatcaagtacaacatcataacccagataatcacgaatctttttcagatccttgtccagattcaccaaaccttcatactcatttcccgcgcgggttgctttgcggatctgattctctaacagttcggacatacaacgcgcaccatcggctttaagctgcgagaaagcagggaagcgaatacgttttaaggctttctcgctaaacggcgtagcgaggcattgaggctgttctggaatgagtttcttccatacgcggttcggtaacgttgtacccgcaccacattccagatcgcggttaatgatacggcgaagaacttcgcgatcattctcgttcaccgatgatacgatatccagcagacgatcacgggctgcattgcccgtatattttcgcgttgccaaatcagacatcaaatccgcgatagcattcgatagcggggttgtgcctggcttaccgtccacctgcggaaacttcttaatgtgaaacataatctgtttcgtgtacgtaatgcggaaaatctcttttagcagatcattacctgcattacgtttcaggatcgcttccttctctgagattttcagagtcgaagcgagttcatttagaatctgtaagatcatgtaatttctcttcgatttcaaaccatgatttaactgactggtgaggcgaccacggggtttcacgttcaccacgcaacatatggaataacggcaactgactgatgacgttatgacattcgtttaagtttaccgcaagatcatcaacgaagcaaaccagacgattaccatatttggctttcgcttccaggtagcggtgtactttggtttcaccatgcccgacaaccatcacttctttgaatgcggaagggaacagcgtgttcaggtttgcaatacggttaaggcttgctgtaggagtggttcccagcgccgtgacagccacgaaatcatatttggctttcagacggttgatcacaatcaacgcatcgtcatacgcgcttagatagcgaataaacgaactgttattgtattcttccatgaggattttagccagttggtgatcacacccaaagatttcggtcatatcacggaacttttcatccgtaaccatatccagcgcgatatcggtcggcatgttgtgtttagacaaaaagaacgggaggccgctttgccattttacggcgatcccgtcaatgtcggtaagaataactggtttcaagatttaacctcataacgatcaaagaaaagggtactcttaaacgcttcaatatccgcaaggaatttgtcacgctcgaatgtacgataataatcaaattcgatacacagcatatcatcgttcgtaacactgataccagtgatatcttgatgatatttctttgcctgttgtagaacgaaaggatcgagatccgaacagtcgaaataaattacgtaactcattatcaacccttgtacatataaacagcgtcgaagcctggaacatccatttcgactttatcgaacacaatatctttcagcttgcatttttcaacgtagctgttgatcacgttaatgttgttcgcgccgatggtaacgtaatacacacccgctttgtagataacacccataatcagggtagaactcaaagcaccctgtgcgtggagtaatgccagcgggttaatcgcgcctttgaacaggaacgcgcattctactctttcatcataatctttcatagtaactctcagtcaaaaaatagtgcgaatattaaccatataccgaagaaaggccagaataacacgatcagcgggaaaatggtatgttttaaaagcaaagtttttggtgtgtgatatccgttatgacttacaccaaagcaccaggaaaaacgtgcggcgcagtatacaccaacaacgaggtatagaatgataccgatgacaatcaaggctatcatagtagatcccgtaatcgggttaaatttcggacaaactcacgttcagtgagtaccgtttcattcatcttattctttcccattgaatgagtcaaggtactttttccggttgcagccagcgcacggcggaacccgtcattcaggaaaagagcattgtacgcgttttcaatcaggatttgatatgcttctgattcacggtgaattggcatacccttccagtatagggtctgatcgcgataccatttctttttcttgcctttgaacttggcggctttaccaaccagcgtacacacatgcgcttgcatatctggattgctgaatttcagactttgtaaaaagccctccattgatgcacattctaccccgtcaaacgtgaacggatgcggggcgaagttgctcaatgcgcatgatggatactgactacctgatccgatgtccatcatcaccccacgaagttaacgagtaatgcagaaaccatacaacccagagcaaaaccaaaagcaatcaaagccagttcactattctgtttcattttcggcttccttcttcccttcctggcgagcgcgtttgcgtccagcacgtaccagagaatcatagtatggacgtttacgatcgatgttgtcagtgcggtatgctttaccgaaatgactcgttttgaatccgtaatacttcacgctttaacctcgtaaggcttatggagtccacgcgccggatcataacggtcatatgttgtcccgttggttgatgccatgatagagacatcctggcgacggttccagttcaacagagcaagaacgatacgatctgccgcttcaataaaatactttttcattagaaacctaccttccatactttttcgaatttgtcgaatattgcaccgatacttttcagatacgcggttgcgtcgtcttcggaatttgtgtacatcgcgaaggagtatcccccaaattcacgacacactgatagcggtttgatgctggtaatgttttggttatatacccgcatcttatcgatcattgcttcggtaatttgatgctcatgatattcgagaatatatttcatttgattgtatacccgtatttgttggtttctgcattcaatgcaatagccagcttattcagatccccaatatcaccctcaaggtctaaatcaatgctgtcaatcttcgcatcattataaagatcagtacccgcgtatgcatcaatttctacgattttcacgttgtgttctcgaatgagattcattgatgcttctgggatacgacgcatttcgaactgaaacgttcttacttcgataccttcacgcatcacgctctctccagacgggttgttacttcacggttatagatccgcgcatactggcgaatgtcttcgttatcgctggtgttcttcgcgatatatgcatcatcttcggtttcgaatgatgcggggttgcgatcgtcgtttgacagatacagtttaccgaagatatctttctttacagtctgtaccccaacaaacatcacaaaatctttttctgtgttaatggaactcatgattatttcccgaaaaggtggcggtcttgggggtttgcatcccattctttttcccagctactacgctcgcgatctttatagacaacctgaaccgatgcatttttaagttcttcgatctctttgtcgcggcgacgtaacgcggtgatcagttcgacaatgaggtgttttgcatagcgatcttcgctgttactcatgaaccccattactttctgttctaattctttggtactcatgttaagccctcaaaccaaagctacgttttttgatgacggtgacattatgaacacctctgttattgcaagtgctggttttcagagtttcggctttacgcgcacccagaaccagagttttaacaggagtcacaggagcagcgataaccacaacagcagcccaacgtgcgccaacagctttatcagtacccaggtcgattacagcagaggtatttttaccagcagccagaacatacgcacgggcttcacgacgagtgttgaagcaaaccagttctttcatgttgtaagttttcataatgtcatcctcagtttcgtttcgatggggctatattctcacagcccccagattaggtcaacaactttttagaatttcgcctgaacgtcagagatatcgtcggcgtattctacttcaccgtttttgtgctcgatccggtaagagtagcccattcttttcatttccgcgtctgggtcagagaaagcgatttccttaacttctgcaaccacaacaccattatcaactactacgaaatgttttgctgcgtcgattgggtttaatttaatcattttctcgttccttttctctgtttcgtttcgatgtgtgtactttaccacactcacgattcagtgcaagcattattttgcataaaaacgaaaaaagccgccacctttcggcaacggcttgatttttaatacttttcttctggctggaacaccgcacgacacgcccacatagaggcttctttcagtcggtctttcgccttttggatttgatggatacgttcaagcatcgcatcgagttcttcggtagtgaatgaatcggtatctgataccgcgtaatcacttgaatactcttcatccagttctttgaagatttcgcccagggcaacttctgcggccttgatgcggtttactttgtcgatcttttctttcgagtggggcttatagccctgtacgtcttcaatcgccattatatactctctgtaaaggttcgggcgataacgtcgcgctgttgttcaggagtcagtgaattgaaacgcactgcatagccggacacacggatcgttaactgcgggtatttttctggatgcttcacagcatcttccagagtttcgcggcgcaacacgtttacgtttaagtgttgtccaccttccactttaacagtgggttgaaattcaatatcgacttcacgttttgcgaatggatcaacgcgagctttaccgatcactgaatccatttcgagggttttggataccaccacacgaacatcattaccttcttccaggtagattgtgccagtgtgtaaaccttctaaaatctgatatgctttcattgtattacctttctacgacataataacgcaacgggttgatatggaacgccagcattgcacgatccagcccgttagggtcagttacttcctgtttcagtttccacccgcaatacacgcgtaagcagaactgaacctttccgactttaagccacggtttgaagacataaagcccccatgccgaatcattccacatcaacagataaccgtgacgtgatggatcggaaccaccttctgttttcgggttgcccttccaggcgaagtctgactgtgcttcacgccctaagacgtgataagcgaagttgtacgctttgttacgccacaaccagcctacacgttgcgcatacacacccagatcgcctaagtgataccggatgttagcccaacgccggatatgtccaccatcaccatcgatcgggttatcgaatgtttccatccaacggaaccctttaggtaagtgtccggtttcttcactgtagaacggaaccacgaaaggagccagcagaatagccagaacaccagaaagaatatcaaggggaaccagtacaagccagcttgcgtattttaaaaagcgcatgtgcttctccagaaaaaaggctatccgaagatagcctgttgattaacgaactgctttgatatacttatacgcttctgcgaattcttcttccagagcttcgttgcagaacggaataccttctgctttaaatccaccagtgataaggtactggataaagaatacagaagaatccatagagatcaactgatggttcgtaggttcgatatcagttcgacgaacgatattgacgatcgaccagtcaaagaatcgtcgatgatattcgtgtttgctattcacctgcggtgatgcaaagaaaccatcaacagaatacgcatcgaacgctttacggtattcgttatcgaaatctgggatttcttcggtaaacagtttcatcaatttaccgttgatttctttttcagttgatgcagcgacgatttcgcgaatttttggggttaattcaaacagcttttgaagacctttcatatttttctcttttaaatttcatatgctgcgtctatacaagattgtattagtgcgtcgggcgaattctcgataattggtactgtttcaccacatacatctgctgcataaggatcgtcatcaacataacattcacggaattttaatttatatcggtagtcatttttacataaccccgctttccattcgttgaatgtcatgccgtaccgctctttgaattgcgctggcgtaatctctttgaacgtatggattgttttgcctaacttagagtcatacaccgtcttttcacgaattctcatatagatctcacattgtttagtgggctggaagtttctttacttcaccccgcattccggggaacctattaccggataccaacagagcctatcccgtgggatatggttgcatattccgaaccatttaacggcattgcgctacgcacccgaattggagcaggtgaagggactcgaaccctcaacaatctggatggaaaccagatattctaccaattgaactacacctgcaaattttttagaactgtttgcgatagatttcgcgaaccagcggatcaacatctttcgcgtacttacatacgtcttcgaactggacgatgtacgccatgacttcatcggcacgggatttaagtttaccctgatgcgcatcaatgatcattgctgtcattacgtcaatacgcgctggggcttccagaatttcgcctttgtcgaacagctttttggatttgctgacggtatcagcgataattgcttgaattgatttagccatttttagatctcgtagattgcctggattgctttgtaatgtgcggaaacgtattttgtttccttctcttttgcttctttttcggaaatgtaacccgcaaccagatcagggtcaggaacattcgccatgtgagcgcttggcagtgggatatatttacccaggattcgttctgccgcttctgctggaacgtctacgcctacagaaacaactttaccataaaaaggttgttccccgtgctggcgtacaccaaccacgataccagattcagatttgatttcggaaccctgcggacgcgcagtagcttcgatgatcacatattcgccggatgcttttactttcagttcagacatttctttactcattgttgttaaacactactttggaaaagtcgataaacgattctaactcttcccgtttaatttgttccacgacacagccatatttctgcaagcgtgaaatccattcatcattaccacgatcgtatttatcgagataatacaccgatgtaatcgccccgctagcaacataccattcgatatgtttcgcgcagttagggcaaggcgatgcagttgtgtaaagtgctgcgtctttgagtataacacctcttgtgtgcgcactcaatagcgctttcatttctgcatgaatttcgttatcgtttgaccatgctgaatgttcaggacgatcaaccgctttcagtttaccgtcatcattcaccatatgattgttgcatgagttgcaacgacaatcaaggtcaaccgtattattttcgccccacgcgacggcacgaccacctatcgcgataatagcacctacacgattcgaaatacattgagaacgttgactccgatcgattgctctcaacatattcattactttgaatttcattaacaatcatccatatatttcagaatgtctttgatgaaatcgttatcagggttaacgatgtgatacgtagtacctgaacgtgtcaccacttcaacaaacgatttgttcgccggaatcgcatattcaacaaccggacttgttgcaatgtcctgttgaggatcattatcaaccaacccaaacacacaaccataacgaagcatcgttggttcagtacataaccatgcctgatgaatctttctgattttgtcgctcataatactcccgcccatgctacgaatttagttaccggattccactgaatcccgaactgctgttcaacgatgttacgttgactcaaaatacccagaaggaaggagaactgaccatcgcggacaatcttcactgtataaccagcaggaattttatcagcaatgcgctggcctaactggttgagtttcagttgaagttcaacaggattctcaactttaacacgatcacccagttcaaccatcacattttcattttcacgaataaccataatattctcctttgtttgtgcgggtatcttatcacacccgcactcactgtcaactgttttttagaagtcgccgtaatcaacctggaaacatgggataccgttcattcgccacatcccgactggtgtatccctgtcgtccactgcaagaacaggataatacttatcgagaatcttttcaacaagtatttgctcttttacgtggaaatcgtgacgatgatcaccttcttcgcgcatgtagataccatcgctcaggtcaacatcgtatccgatcaggcttgcagcggtatcatgtgcgcactgtgcagtaccctcacgcccagacacaacaacacaggcataaccagcggccttatacatcctgaacagttcttgaacaggagggttaggcggatcgttgataaccttcgtgaagtcatacgggctacgttgtccaactttggttaatgtcccgtcaacgtcgaagataacgcatttcggtttgctcagatctgcatagctcatagccggaacccagccacggagtttacggtactgttcgaacatcgcccagacacgggaaacaggtagagcattcacaccgcgtttatggttgcgtttcaggagttctacgatatcggcatcaatccattcgatatggaaatcagcattgaactctttcgcgatctctcgccacacatcatgatctttttggtgtaaatgggtattgtgaacgataacgttcttcccactcgccagggcattacgaactgtatcttcttgcacacggcaaacaaacagttctttctcttcggtgaagcgatagccagtgagatcaccgccagcacagtaaagggttttgcggatatcgtcacgggaaacagtcagcgtgttccccagttgacgcgctttttctttcgcccatgtagttttcccgctacctggtacgcctacagtaataaacagattcatttcacaatctcatattcaatcagttctttgttatgctcattcgttagattgagccacatatcacggttccagtcattttcgatccagagaccttctttgtccttcttcgcatcataaacctttccttcggttatgtcacggaaaaatgacttgattattttgacttgcatttctcagggtatcccacggtacacagaatgttatccgtctggtctttctgacgcttaacgtcattcatccagctacggaagattaacgaatcgggatatgaaagggcaacgtatggattgccgtcataaggcatgacaaggtattttttaccgtcaatctctcggacttctgcaaccactttccatttcacattcaccggattcaccttagcggggagcgtaggcaaaatcttttctgggggcttctcagcacacccgaccaacagaacgcccagaacaagggctaatgttgaaattttcatttgtcgtactccgccatatactcttcgaaggacttgttgatcttgatttcgatcagtcctggtttcttgaacaacaggtctttacgtccggcatccttgaccaactgctgatccttacctttttgttcgacatagatcaccgtattggtgttgtttgtctctttgacttttttgatatcagcctgtaactctttgatatctttagccaattggtcattttcacttttcagcgtgattgtcatgtacaaaagccctgctaacgaaccagcaactattacaggccatatccacgaacttatattaaacgtacccaatacgtttttgatattcatataacgcttcctcgtaagctattgatgcttgttcctcggtatcatagtaaccgatgtgtttttgcttcccgtctatctttatctgtgctcgatattttccacgcgaagccctgtaatcaacacctttggatttaaccgttttaggtgttgatttagcttttcttttcagcatattatgaagcggatctgattcctgtagattttctataccatccccagcttccaacccatgcttatgatcaataagcaaaggcagataaccattacagtaatagaaaattatgcgatgtcttaaatattttctatcgccgtgccgaattctcacgtaaggttttgatttgctcataatagaaccagcttcttttccctgattctgttttgctgcattgctattccaaaaaatttttccggtttctgggaaaacgtcaacgtaaagaagcagggaatcgatccctgctttctcttcttctaacgttgtgcttccagcgccaaagcactttgtcatttatattcttccggtataaactgttcgtagttcttcgccattaatgcaacgatgttatcaaccagcttttgcttatcggtatcatcgaaataacgcatcataggcccgaagatgatacgaccgtcaggggttaagtcagcgctcagggcgatcgcgtagtctttgcgtgattttcctttcgtgtcttcgattgcctggaatgcttttgcagtcagacgattgagactatcaaggaataacgtttcgaatgcgtcaattttcttgagtgcgtacatatcatcgaggaacatttgtttcaggtcatcgacggtattttcaacaatatttaagaacagatctttgttattgttgatgctatccttcgtgcggtgaaggtttacataccagttggttttcgctttcacaaaacctttatcagttttgattacgtaaccctcgaaaccttctttcgtgtaggcttcggtaatgaatgcatccagatcggtgatttcgattttctcgcgctcaaccaggaacggacgtaatacaccatctgcgaagatatcctgataatcaacatattcgcccgtgtcgttattacggatgttcaggatcaccactgctggttcctgatagccaattacaatacggtttgtcggtgcgacgtattccatgttgacggtgaaaccatcgttaaccagttcggtcaggcggtcgaacaatgcgcggttagtctggatcacgctcatagcgtccatagcctgttcagattgaacggatgctttagacttaacgcccagatagccggaatcacagaaggtggagatcagggaaccatcttccttaatcatcacatccactacggtttcaccaatcgtcacaggagaggctttcagctcttcccatgcctttacctcggcatagttgaaaaacttctccatagggcgactggcgagttttacgggggtttccccatccatcgcaaacatgataccgcgacattccagcgcaccgggttttaaccagtcggaatagctcgccatgcgatagttaaagatgcgcacgttggtttgcatcacagttttttgatcaatgaagtagaagcattcgctttcgttacacagtttcatcaactggtcaaagagggttttctgatttttggttagctttgtcatagtgctgtttgttccattcaggattgatttttcggatcatgtttatttcaaaatcatgatatgtgtcttcatcgtgtgttgtcacgataagatttacacgcttacgttttttgattgccatttccagacgtgcggttttcaaaatattactggggtttgcttccctccagtatttcgaattgcggtatgtgtctaaccgcttccacaaatcacgacattttccaacatacactatccgaccgtcgatttcaataaaatacacacaatgccggaattcgccacatttaacgaaactccggtctatcctcttgtctgaacccagacgcaaaggaaatattacaccaaatgttacatcgtccattatatatccaacttattcacctttccggtcaacacattgacgcagtgagcaatataatcaccgtggcacggtagaggtttgcatgtacatcctaaccgcttcccgtccaatgctttcagttcgtcgattgtgatcacgccagttcgaatcaagttttggaaatacgggatgaacttcattatgttttcagcccgtgttcccttgtagaagggattgccgaatttcgtacctctctgaatatcgacatcccagctacctttatacttgtttacgacgcgacaatcaagcgtatttttgtcgccattttgcataggcttcgtcgctgatctcggtgttgaggttgccaaccaggtaagaactcacttctacttcctgtggggctacctgtacgttgtcagacttcaaccatttgttcatccacggatacgggttcggcgttggtttaaatggagactgcaagccaaccgcgcgcatacgctgatctgtcaggtgttcgatataagcgatcgtacttttcagggatacgccgtctacatcaccgatagagaacaggtgttcagcccattctttttcctgttcgtacacttccaggaaaatctttgtcgcttcttcttcatactggtaagcgatttccgccatttctgggtcatctttacccatctgccagagtcggatcttgctttgagtgcctttctggtgaagtgcttcatcacgggcaatcagacgcatgatcttcgcgttaccttccatcttgccttgttcggcaaagttgaacgtgaaggtaaacgacacgtagaagcggatcgcttccagagcgttgacagcgtgcatacacaggtatagagcaaccttacatttacgcatttgctctttgcgtttcttctcgtactctgcgatcgattcgtctgggtatccgtgggacgttaacatttcgattttgagcacgatgtttttcagttcatgacattctgcgatcaggtcatcgtagtattttgtcatggaagccgaacgtttcataatcgcttcgttgcgcagaattttatcgaactctttcgacgggtcgatgtgtaggttgcgctgaatgtgcgtataactgcggctatggattgtttcgctgaacgcccatgtttcgatccacgtttccattgagacatcggaagcgatagggaggaacgccaggttcgggccgcgtccctgaatggtatccagcagggtttgatattgcaggtttgaatcgaaaataaccttttcgtgttccggcattttcgcgtactgcatacggtcgatagacagatccacttcttccggtcgccagaagaatgacagttgtttttcagtcagggtttcgaatacacggtgtttctgttcttcgtatcgtgctacgcccgtatcctcaccaaagaacataggctgttctaagtgtttgtgatctgggtttgtgttcattacagttaacatggatttaccttataaaaagcccccgaaggggcattgaatcaaattttgcaaccttcgcaatcttccgcttcttcctcacctgcaccgtcgcgggtgttgtggtagtaaagcgttttgatgccgaaatagtttgcatacagcagatcttcaaggatgatttcagatttcactttaccatctgggaagttagccggatcatagttggtgtttgcagagatagcctgatcaacaaacttctgcataaccgctacgtgcgacagataacctttgtttccacgttttgccattgtccagagataatcatagaagtcaatctgattattctggtttggtactacctgattgaatgaaccttctttcgaagatttcacactcacagggccgcgcggaggttcaatcccgttggttgagttactcacctgcgagctactttcacaaggcattaaagcagaaagcgttgagttacgcaagccatgttttttgatttcaccgcgtaaccattcccaatcgcagttatacacaggtgatgccagttcatcaacgtttttgcagtaccagtcaataggcaacagcccttgtgcatatttcgtttcatggaacagtccacatgcaccgcgttcctgtgcgagttccatcgaggcaaccagcaggttaaattgaaacgcttccatcaactcatgaacgtttccggcgtatgcttcggagtagtcgcaatagttgcttgccagccaggatgcatagttggtgataccaacgcccagagaacgacgctgtttggctttcagagccgctgcaacagggtagttctggtaatcaagcaagttatccagtgcgcgtactgcgatgcgtgtaagggctgggaattcgcttatatcggcattatcgagaacgatcgccataagcgtacacagtccaatttcgccagccagtttatcatcgtcatccagtggtgaagttgggatcgcgatttcacaacacaggttcgacatacgaaccggaacagagaaactaccctgctggtttacgtgatgactgttgaaaatgtatttgcgtccggtctgtgcgcgttcctgaacaagcaactggaacagatctaccgctttaatacgtttcttgcgtaccgttgggtctttttccagactggtatacagttcttcgaactcactctgatccgcttgatagaatgcgtcatagaggcgatcattcgcaacgtcagggctgaacagggtgatgtaatcgttattgattaaacgcttatacatcaaatcgttaagctgtacgccatagtccaggtgacgaatacggttttcttcaacgccacggttatttttcagaaccagcaggttttcaacttcaagatgccagatcggataatacagggttgctgcaccaccacgaacaccaccctgtgaacaggatttaaccgccgtctgaatgtgtttccagaacgggataacgcctgtatggactgcttcaccaccacggatttttgaacccatagcgcgaatgtgtcctgcgttgacaccgatacccgcacgttgagagatatacttcacgatcgcggacgtaacagcgttcagagaacccagagaatcaccggattcgattacaacacaactggagaactgacgcgtaggagtacgcacacccgccataataggcgtaggtaatgacagtttacgatccgaaatcgcgttatagaagtcaacaacatgactgattttatcagcgtgtttttcgtcctgatgcagacacatcgcgatcagcatgaatgcatactgtggtgtttcgtagatgtcgccggacgtgcgatcctgcaacagatatttcccgatcaactgctgaacgccagcgtaagagaattcaaaatctttatcgtgattgatttttgattccagataatcaatctcagcaggagtccattttgtcaggatttctttatcgtattttccagcctcaaccagcttagtgatgtgttcgtagaacggaatcgggtcaaactgcccgtaaacggttttacgaagggcgaacatttcgaggttagccgctacatactgccagtcaggttcttttgcggagattcgatccgctgcatacttgatcgctacagcctggatctgtttggtagtcataccatcacgaagcaggtcaacgacactttcaaggaatgcgttaacatcaatatttcttccaatactcgcccaattaaggactttgaacagtttttctttttcgaacgtttgacttacgccagaagacttcactactgttttaatatcactcattatcttaccttgttaagaaaggggctttcgccccctttgtttatactgccatagctgcttttagcgagccgtggtgattatagtctttcaaatggatggagtcaaagaattcttgatccaaatcaagtaagctatttaccttcggcatataaagggtcggaagtggaagcggtgcgcgttccggcttcaacaactctttcgcttgttctactgcgtttttgtagatatggacatcaccaccagtccaaaccagatcgcccacttcatacccgcaaatatcagcgataatatgcgtcaggagagcgtaggaggcgatattgaacggcaaccctaagaagacatcaactgaacgctgataccattgtagagacagtttaccgttgattacgacgaactggaagaaacagtgacacggacgcaaagccatatcatccagatccatcgggttccaggcagaaacgatgatcccgcgatcgtctggtgtggttttcagttgttcgatgattttcttaatctggtcaacaccataataagaaccttccgcaccaaatgagcgccattgatgcccgtagatcggtcccagataaccatgcgtataacccagcgctttagcctgattttcgtagttatcgtcccagatcgtccgcttatcgctatcttcaccccacgtcattttacgcagtgtttccacgttggtagaaccttcgaggaaccattgtaattcatgcttacacggtttgaagaatagctgtttgctggtagtagctgggaaaccttctgcgaggttccaacgtgcttgcatcccgaagatgcgcagtgtaccaacaccagtacgatcggttgattcagtaccgtgtgttagaacggtgttgacgatatcaagatattgtttcattttatgcctttttcgtatgtcgatcgacgataatttttctgacgcgttcgtttgattcgatctgctgaattttgaaatcagtcagttcatatttcagaaccgcttcacagaattcaggaaccgtgaacgaaacatcacgtttaaaagctggtgcattatatacatgatgtccgtaaatgtgcgtcacaaccacttcatcaaccattgtattattgattgcttgcagaagcaaccacttaccaccaatgagacacacatcacgatctggatgcgtttctttcattacgtcgattgcagcagacaacccgccaccgtggatgacataatcagcggtattcccgttctttgttaccagacgttgaccggatgcagacagaacgcaatgaactcgccctggcaatttaccaggcagagaagtaaaagtgttcgcacccatgatcaggacgctatttgcggtttcttctttgaagttctgcaaatcctctttgcagtggccccacggtaaaccctgttcataaccaaacgcatagtccacttcgtacatatcatgaccaacggcgaaaactgcttttactttgctcatagcgcgatccacattttgttgtcttcaatagtcacgatgtagcccatagcttcaaccatgacgcgcaatttgtctttacaggcttcattgtacccgcgaatcttttcaaattcaacagaaaagatactcaaaccgttaacatgagcgttgatgattttggattccagatcgaacaccatcacatctaacggactccattcaacagaatgaagtttttcgcgggttaacagggttgtgtgttttggtagtttcattggggtacagtttgccatagccattgttccattttacgtaaatcttcctctaacggagtgaaaccaaatgattcttcgatcacaccgtcttcccatacatcaatttccagaatttccgttaccggagggtttgacatcacatgatcacgacatgcagccatagcggtcataatggaatttgttactgtcagggtattgccctgaaccgatacctgaataatcatactttcacccattctttatctttagtccatgcggttttcaaggtaaaacgctggcggtaatgcatacccaaacttgggggatgcagcgaattgataccttcgacggcgatccgcattgcttcgaacttctcgcgatcaataaactgccctggtagaactggcattctcacacagtcccattcgtaagtatcgctgatctctttactggcattaaccagaatttcagcaatgtcaaaatctgtaggtgcgaaccatcccagattgataaacacgcgtttttgcgtaccttctttcaggttttcaaagtgcgcccatgttggacaactcatagtattttcctcataaaaaagggaactgcttttcaacagttcccattatagcataatcagttagtgtttcaagcgccaaagagcgattgcttcatcaactgcttttttaatttcttccggcgtgtctttgcgtccggctttaaccagggcagagagcatagaacgaatggttgcattcatctgtgacttctcacgatccatctgtgcctgatgcgccttatcaaccgctggggcttctttcttcgctgcctgtggtttcgtaggctgtgcgcctaactcgtccttagcttgcgtttcagtgcgtttctgttcggcttctttcttcacatgaggtgcggagaatttaccagccttgaagttatcacgcataccttccaggatcttacgggctgtgtaccagtcagcaacaccacgaagttgtttcagggtatcaaccagcaaaccgatacttgcgcctttgctatcctcgtcaatgtcgatatctttcaaccattcaacatgtttctgaccggagtgcataaagttaaagctgctgaaactccagaaacctttacggttgctgatctcgcgtttgaagtggaaagtcaaacccgcgccgttatcaaactcaccgtagttactgcggaatgttgcccccgcttgtttcagtgcgttgaaatagtcatctttattgatgcggttaacggtgcgtttcggtttctgttctggttccggcgctgctgcttgctgtgcggtacgtttaacaaaagatgctgaacgatgccccgctgcaaactctgcgttcatcctgtcgattactgctgcgattccgcttgcgtctggtttcactttctgcatttctttgaaagtgtcgatgatcatatccagacatgcaccgtcttcgtcttccagcatagtacctttcagacgttcagcaggtttgaatttgttcacagttgggtcaacaacatactggaacacatacgcgcctttacgcatgaatacgtgacggtagaagtgaactttatagtgtccaacatcaacaataacatcgttaccgctaaccttcgcacccaggatacgggcaaaggatgtcatgtagtccgcgcgtttgaacttgagatccttcttagtcgggctaaagatggattccagtttcttagtagggaacaggctttccggcgtgattttgtctgggttcttgccccattggtaatcgcggcttgccattttgtgtttcttcgtaccaaccagaaccagagtattaactgatacgctacccagtgcggacgcgtccggcgctgctaaaccttgaccgttaggcggttgacaagagaaagagaagtcaaagaacgcatcaccagaagtgaaacgataggttgcgtgaacagtgtgaccgcgaacttcgctgattgtctgggtataggttgttggttgtccggtgaatttcgtgaaatattccgcaaattcttgcgcgttgaatttagtgctgaaatagtttttcgccagcacgaaatacgctgcaaatttttcttcccacgctttcttgtttgctgcgtgttctgcgcgaacatcactgaaagttttaccagcgctgtttgttttggttacaacgtcatacgcctggttgattttctgcatgagttcagtgctaccaccacggtcggggtgattgcgcagagaagcacgtttaaagagctttgacagttcagctttagattcgtcgccagtagcgcccaaaatcttcaatgcttcgctgtgtgacatttgttcgttaatcattttccgttcctcaaaataaaaacccgtgcaactcagtacacgggcgactttaaggtatttatgttttactgtcaatagattttttcgaggaaccacaccgaagatttattattcttgatgcgggtcaattcaatggggttatctttgaatgcttcctcaacatctgccattgtaactacatgtttttcttccaatagttcattatggagataaaacctctccacttcgggagaggtctttaaatcaaattcacgttctaacatgagatcgccatatctttgattgatggttttgtgaaccgcccaaccttagacatgatgatgtgtcggtcgaagtcctgcggatcaagatcctggtgactgattacaataacgttaccatctacagaatccagcaaggatttaatcgcgaatgaaccctctttatcaagtggcccatcaaacacttcatcaagtaccagcagagacagatccacgcctgatactttacttgtcacgtcacgccatgtgaacagaatagacaagttgatgcgagcgcgttcgccttgactgaatgacgcataactgaaatcatcgcgccccagtgatttgatcgattcgttgaactcgtcatctaaagtgaactgataatcagcacccaacagatccagataatatgctatctgtttgttgaagtacggaatataacgcttaacgatgctcgctttaacgccggaatctttcaacatatccgtaacaataccacgaatatatttttccttgacgtagccttgtcgtttttcgttcagttctgcttcctgctgttgcaactgcttcacgggttcttcatcaatgactacttccgcgcttgcctgttccatgatcgcctgtgcgcgtttagcgttggcaacttcgttttgcagtgtacctttcagggcttcatatttggttttcagggcattgagtgcgcgttgctgttgcagcaagtcattcatgatcccttgtaactcgtcctgtttggttttgatcagggttaaacgttgtgtacccgctttgatgttctctgcgatctccgccatacgctcaggagtgggtttaatcgcttgcttacatgccggacactcaccgcctttctgatacatcacctccagctttttaaactgttctacagtcattgagagccgcgaataaccgtcacggagtttgttgatatcttccgtccggtcttctccagtgatcaccgattccgcaatctccgcttgcaactgcataagctgtgctttgatgttctttgcggtttctacgtggctatcgtagatctctttgtatcgggcgttgttctggtttgctttcgctcgctgttcgtcaatgaagcgctggtgtgttgcgatctgctgctggatgtgattaccctgcattgagagtgtatccaactgctgattaacaccgcgaatgtatgacttgtttaacttgtccatttcactgatgacggacagagacagcaaatcttcaaccagtttccggcgttcgggggttttcagttccatgaatggagtgtaacccgctgtacccagaacgataacctgtttgaagcccacaaggttgatgttcagcatagattcaagctgtgcctgataatcacctgctgcggagtcttccggcaacttctcgccgttcttccagatctcgaacaccttcggcttttgtccgcgcacaactttgtacgagtctttcccgtattcgatttccagttcaaccaggcatttctttttgttgacgctgttcaccaactgcccgacttttagatcgcggaatgacttaccgaacagggcataggttaacgcctcgatcagtgtcgatttaccgccaccgtttttccccgtgatcagggttttttttgccgtatcaaattccagttcgatcggggtgttcccaaccgacagaatattttgatacttaatttttttgaagtttagtttcatttaaaatccgttcacataattcagtgatcatttgaacaactgatgaatcaatactatatgatagagtatcgtcgtccagtgtatcaagcatgaatattgaccatgttcgtgatgaatgccatgcacccttcatgatggtcaaacaaactgcgctggtttcccctgcttcgtcggatgtggaaatgatgtgtttcattcccaacatacgcaacaggtgagaatatcggggattttccccgaaatattcatcataacggctatgcacttgacacctccgcgtatagttcgctgatcagcttattcacttcctctttttcatcgtcggtgatctgcatgttggcgatatactcagtgataaggccacgaacggttttgatttcaaagtcggtatcgacatccgaatctgtttgaactttgtctatgatattgatttcataggcaatttcttcaattttggtttggaactttgcaagcccctgatcaatttcactgacaatcagacgcaccgcgcagttgcggaactgttcgagatcaacatctttctgtgctggatacatgatccggcgatggtgacacacagggttagcgatgaaagtcaattcaggcttgcccgtgaacacatagaatccgcgtgtttcgtcttcgtcgtttgcgctcatagtcagaggcgtaccgatataaaacacgttatcaccctcgttagcgtggtgatagtgtccagagtaaacacgatcgtacttcttcaagaaatcaggttccagcccatgatcggctttgctgttcttgtagaaatagtaaccagacagttcgaagtgtcccaaacaaaagttagctttcgattgtttgatgtagtcaaaaatacgctggctgttttcctgacaaatccacgggatcaggtcaatcgaatttccgccacctaaatcaaccgtggtcggttcgtcaatgacattaaagcattcgtattgacttagtatctcgcgtggcgcgttggggcgtattttgtccttaaattggcaatcgtggttgccgacaagaacatccagagtgatccccgcctcaatcagaagaggaaccagcttttcacgaacaaaattcattgtcgtttgtgtggttgcttttcgaacgtcgaagaagtcgccagcatggaagccgcgcgtgatcccgtgttctttgcaatactctacgatctgtttgaataccgcatacaggttttcttcgttccaggggttatcctggcgaagtccggcatgggtatccccaattaaaacatagttcatataaacctcaaaacccccgaaggggtttatttgccgtatttttcagaagccatgatgaacaggtctttcaactgctggttcgaagtgatccacatcgtttcaatcagttcatcgttgtatggttgcttgagcatatcacgcatctttttgatcgcgtatacgtactgctctttgttaccttcgaagagtgcgttctctgcgtgtttatgcagtcgcttccattccgctttgttcttccgcatgaacttttgcgctttgcgtagggcttcctgttcaatgcgtgtacccttgatggagtccagttcttcttcacgaagatccagcgctgatttttggtgtacttcgtcgattacttcatgctgcacgttcatagtaagtgatctccatgatcattgtttcggcgtttattacatagtccagacgaccttctgttatctggaagtctggatctcgtacatctgtagggtcgatgataatcggaatccctaagctctgcaactctaatttcacaaggtaaggaagcagatcaatttcgtcgttagcatctgctaaaattttgttcaggtcaattttaattttcatagaaacatttccaatgttggcgattcgtccacaacctcgattttatctttgggttttttcgcggactcttcatactgattaagtttgtcatggatatcctgaatgaaagtttcatcggctatcgtggtcatatcagtatcatcgctgtcatagacatgttccaggaagtatttgtatttcttcgcgttctctttcttctcgtagagaatacgagttacaaacgcttgccagcaagccttgttgatgtaaccgtagacgtttgtatatttggtttcgtcaaagttatgaaggccggaaatcgttgccgaaattccatcatcgatcatatccattttccagtcttcggaataacggttgaagttgtatcgacgtgccaaaccgtgagcaatgttcataatcgcaataccgagttcatccggcatcttacgatcaccagtttcacggatttgctgtttccacttacacataactggatacagcttatcattatctgcataaatctttgtagtcattatattctccaaattgaatacattcattatagccgattgaatcaggtgtttcaaacctacttccaatctatattatttaataaaatcagcgcgaagcgcttccgtgagcgaagcgaaacggatagttagatctggttaaaaagtatacggaaatgtactgttttctctatatataaaatataaaaatattaaaacgtacattcagtacatagacactcactacgttcgtgtccttcgcttcgctcagatttttgaaatgatctattgactttgaaaaagtgatcactataatcagtttcattcaacaacaacgaggtattgaaatgtcttcatttgcaagtatgttcaacctgaacagcttaatgagcaatgacgatgatcctgttgatgtgatgtgtatagatatttcaaacctttcggtagcaacgttgatgaacaacttcaagccgaaagaccagaatgacatcaaccaacaaattgttcgtcacatagtgcttgacaccattcgtcacaatgtggttaaattcaaaggcgagtaccctgaaattgttctagcctttgatgataacaagtattggcgcagaagtaaagcctggtactacaaaaagaaacgaaaaatggaacaagaagcatcggattgggactgggatcgcctgaatggtttccttcacccgacatacgatgaaatccgtgctaatctaccgtacaaaggtatccgtgttgacttcgcagaagccgatgacgtgatcggtgtggtgacgcgtaaagcggtatccgaaggtaaacgtgtcctgatcgtttctgctgatggtgactttgcagcccttcaaaaatatcagggtgtgcgtcagtggtcgccaacccaaaagaaatgggttacaccgaaatatggttcgcctcgtaacgatttgcgcatgaagatcatcaagggcgataaaaaagatagtatcgcttgcattaaaatgcgaaatgactatattgttacgaaggttgaaggagaacgcgccccacaaatcagggctgctgaactcgaagcctggctggaagcggacgatccgaccgtgggtatgcccgaagagtgggcgatccgctacagagaaaacgaagaacttcgcgactttgattttattccgaaagatgttgcaacggcaatcgaagaagcgtacaatgctccaaaaatcgggaacaaagcaaaaatggagaaatacttcatggaatgcaaacttacccgtatgtatgaaaaactaagtgacttttgaggtaacaaaatgagtgtagaattactgcaagaaaacccagacatcgctaaagcggttaaagaactgatcaaagaagcgtcgaacgtgaaaacccagatcgaacacttccagggttctttcaaagacatcaaatccaaagcgaaaacggattatggtatcgacggtaaaaccttcggcaagctgttcaaactgtatcacgaacaggcacgtaccgcgttcgaagaacagaacaacgaacttatcgaactgtacgatgtgatcgataaggcgtaatatgagcgaaatcggaaacaaaaccgaagtcggcttgtatatcgaaaatctggttgcctctgagggggcaacctacatggaagctacgttacaatggatggacgaaaacagcattgattatgctatgctgtccaaaacagtaccgaaagcgatcatcgacaagattagcgacgaagccattaaaaacaatctgctgcgtccttctgtggctaaagaccacgcgacgacgcaaacactggatgatttcatgtgaaatttaaaaccccgtttgacagttcagacgctaattcccgtttgaaaccgattgcggtatacaaactgtatctggtgatgaaaaatcactttgcgggacggtatgacgcgatcaagtacaaatgggaaataaagatcactgaaaaagcgttcgaaaagagaagagataagtattttttcaaaaagttagccgaaaggtttacatttaaagaaatatatcttatacttctctccaacatggtagctaaccccgacttctgggtcggggatgtagacgaagatacgatcgtgttttatcgtcaatacataggcaagttgaggcgaattgataatattttcgtggacgatgtaaaaaacctgtatgaattttcccgcatgaaaggcattcccctctcaacggtgtttcagtatagcgtcaaatcatcaacctcgtatatcagcaaactcgtacagtctggggtgatttcttatgaatcattcttgatcctcgactcgtttttagacatcataaataaacacgatgaaatcgcaacggatttcgtctggaatgaatttagtaaaaaactaaacgcatacagaaaattagttgaaatcagtaacgaagaaatcgtaaaataccgaaacttaatgaaacaaactttaattaacttaaacgagaaataacatatgtcattctttaaacgtcaagatccaaccaaactgcaagaacaagtcgccgctctgaaaggttcatccggcttccagaaagatgaaaaagagtggaaactcggtgtcgatgcacagaaaaacggttctgcggtgatccgcttcctgcctaaccgatctgatgatgaactggcgttcgtgcgtatcgtcaaccattcattcaaaaagaataaccagtggttcatcgaaaactgcccgtctacccacggcgattacgatgcttgccctgtgtgtcagtatatctctgaaaacgatctgttcgaaaaagcgaaagtgaaaggcagcgaagccgaaaaaacactgggtatgatcggacgtaaacaatcgttctgggcgaacattctggtggttaaagatccaatgcacccagaaaacgaaggtaaggtgtttaagttccgcttcggtaaaaagatcatggataaaatcactgcggctatcgcggggaacccagatctggatgaaccaggtgttgctgtgacctgtccgtttggtggcgctaacttcaccctgaccgcgaagaaagtaggcgactggcctaactacgacgacagcaaatttggtgttcctggtccaatcaaaggtatcgaagacgaagcgcgtcagaaagaaatcttcgaaggtatgagcgatctgcgtccaatcactgcaccagaccagttcaaaccaacggcggaactgaccgcgaagttcaccaaagtattcggtggtgctgcaatgggtgctggcgcaagcgctggtgcggatctggattccgaactgaattcgtttgacaacgaactgaaaaacttcgataatggcaaccagtccaaaggtgctaaagaatctggtggcgtaagtcaactgaacgtaggcggaagcgtaccggaagatgataatacacctccgtttgacctggaaggtggttccggtgatgacgacctggataaactgctggatctgtaatgcttacgggggcgaaagcccccaatttgaaagtttgaggtagatatgaatttagaacaaaacgtatatgtagcgcatctgaacaacgttcgcaaatcctgggtaggtaaagtgccggaaaacatcaaagagattttccgtgcgatgcctcaagctgaacgctttgagcattacaaacggatcgacgaagcagtaagcgcagtacataccggactgattcacgacgctcgcgaagcgggtacgaaaatcacagaatccaaaagcaaagaattccttgacaatgcggcggatcgcgttgtagaatccctgattaacggcacttttgcctaattgaaaactataggttgaatatgaaattctctaaacaaacgatcgatatcctgaaaaacttttcccagatcaacccgtctgtaatgctgaaaaagggttcgttcattatgacgaaatccatcaacagcgtagtttacgcagaagcaacgatttctgacgtaattgacgaagatgtaggtatctacgatctgaactcattcctgaacatgctgaacgttgtaggcactgatgccgaagtaactcacgatctgtccactggcgaaatcgtcattcgtggtgagaaaatgaaaatcgttgagcgttcaagcgatccaaccacaatcgtacagcctaagaagcgtctggaaatgccagttgcggatctgattttccagattagcgcgaacgatttcgaaaaacttatcaaagcgtcacgcatgatgaaactgaccgacctgtctgttgagccaatcaacggcaagctggtaatcaccgcgaaaagtaaagaaagccagtcaaccttctctgtggaagtgggcgattacgaaggtgataacatgttcaacttcgatatgaagattgacaacatgcagttcatcaacagcgattacaaagttgaaatctcttctcgcggcgctgcgaaattctcgtccgaaaacggcgttgcgtatgtagtggtacttgaagcaaccagccagttcaagtaagataaacaaagtagtacacaaggggcgttaagcccctttttgataatcaattgaaggtaatattatggaacttagtgaaaacgtacagttaatcgaaaccaaatacggcaaaatctcccagtctcccgaagaattcgcatgggatcagcgctatcgcccgacgacgatcgatgaatgcattctccctgctgctgataaagcgacgatgcgcggcttcatcaagtctggacgcatcgacaacatgactctggtttctgattccccaggtacgggtaaaacaacgctggcgctggttctggctaacgaagttgatgcggaagtgatgtttgtcaacggttccgattgtggtgtgaacttcatccgtaacgaactggatcgttacgcgtcctctatgacgcagaagaaaggcggtaaaatcattctgattgacgaattcgatcgccctggtatggcagaagcacagaagcacatgcgtagctttatcgaagcgtacagcaagaacgttactgttatcatcaccgcgaacaacatcaacgggattcaccctgcgctgatctcccgctgtccggtagtcaagttcggttctccgtcgaaggaagaacgcgttgaactgatgaagcaaatgatcaaacgctgtttcggtatcctcgaaatcgagaaaatcgaatatgaccagcaggtgatcgccggattcgttaagaagcactacccagacgcgcgatccatcgttaaagctcttgggttctattctaagcgtggcaaaattgatgctggtattctgtctgagattgttggttcggacatcacaccagtgattgaggggcttaaagcgaagaacttcaaagcactgcgagccgaagcaatcaagtacgcgcctgagtatgaaactttcctggctaaacttctggatgcggtatacccgatcgtcaccaacgaatctaaggttgcactcattcaggcagtaggcgaaaacaacgcacagtacgggctggcagtgaacaaagagattcacctgcaatacctgttcatgggcttaatgcttaccctcgcgtgggaggcttaaaatgtcactggctgcttttctcgatgaagatgaactgaacgaacatgaagcggcctggcgttctaaagactgggacaagatcgaagaacttgtgaaagagtacaccaaagacaaggaaaacaccttgtttatggtgctcgaagaactgaacaacgggaagacaccattacggatctctgcccttgattcatacgataagtttttcatcgacaatgcaatgagccagcatatcgaaacgctgatacctgcatacacgatgaatatgatcggttccggtttaccagaccaggcgcactttgattattacctgcatacggtgcgcaaaggtaagcggttcggggcgtgggctaaactcaccgaagataacgaaatgaaagttatccttcatgttctccaaaaacgatacggtgtaaatacacgtatagcaatggaatattacgaagaactcaaacagcttgaaaaactggacgagtggaagcggaaaaatatgaaagttgctttatctgtgttggctgatgttgtgaaaaataaaaccgaccagaaaaaggttgaacaactaataaagaaatggtgatgtatgaacatgctcgaaattaaactgtccagcgatgacagtttcctgaaaattcgcgaaacgctgacccgtatcgggatcgcaaataacaaaaagaaaatgctgtggcagtcttgtcacatcctacagaaacaagggcgttattttatcgtacacttcaaagaactgttgaagctggacggtcgccaggttgacatgaccgaagatgacgaactgcgccgcaataacattgcgcgacttctggaagagtggggtatggtttccatccttacgccggatctgaaattctccgaagagaacaacttccgcgtattgactcacgcacaaaaagctgaatggactttgaaatacaagtaccggatcggtcattaatcaaaagcccttgcagaaatgcaggggctttgttatattggttgtacaccacttgtgaggactaaattatgaaaattcgtattgaagaaatcatcaaagctattgaatccggtgatcacttgatcaaccgtctgtatagcgaagacatcaaactgtctcttacttgcaatctctctgatctgcgcacctacgcatacgcgcgggatcacttccctaagttttatacccgcatcatggaagaatacactgtgctggttgaacaactaaatcggcctgacacccaacgctatcacaaattagcgcaacgctcgcttgatctgatcaagctggctggggtatcattcctgtcacgattaaacacggagaaagaaaaccgtaatgaatgaattttatctatccgttgagcaaatgggcgatcacatctacgagcgcttcattgactctgagggacgcgaacaggttcgcaaaacaaaatatgcgcctacaatgtttcaacacgctatggcgggtgtagactcgccatatcgcgacatttacggcaagacctgcatcaaaaagaacttcgaaagcatcaaagaagcaaaaaactggatgcagcgaatgaaagatgtaggcatggaagcgctaggcatggatgatttcaggctggcgtatatctccgatgcctacagaaaggaaattgaatacgatcgagacaagatccgcattgcttcacttgatatcgaagttaccgcgcctgaattccctgatccacgcgaagcaaaatacgctatcgacgcaatcacacactatgacagcgttgaagataaattctttgtgtacgatctggtcgagggcgggttagatgaatgggtagcgtcgaaagttgataccgaaaacgagatcagcgaagaagacttgaagaaaattgtttaccgttcattccagaccgaaaagtcgctgatgtctgcttatatcaaagactggaaagagcggacacctgttattgttacgggatggaactcaaacaagttcgatatcgcgtatatcattacccgttacttgaatatcttcgggcaaaacgttgttcgtcatttcagcccgttcgggaaagtgactgcgaagacaacgaccgaccatttcggtaacgaacaactgggctatgagatttacggcgttgctcaaatggacggaatggatctctataagaaattcagtttcaccccgcaaccgtcttacgctctgggcgcgatcgctgagttcgaaacaggtaaaaacaaagttgattacgaaggttcgctgtctgaacttcgtcaagcggatcaccagaaatacatcacgtataacatcgttgacgttatccgcgtgttggatatcgacgggaaacgcaactttatcgaactggttctgtctgtagcgtactacgcgaagatcaacttccctggggttatgtcaccgcttaaaacgtgggacgcaatcatttacaactctctgcgtgaagagaagaaagtaatcccagaaaacaaacgccatactaaaacgccgtatgatggtgcatacgttaaagatccggttgtcgctccataccgttacattgtatcgttcgacttaaccagtctgtatccatctatcatccgacaggtgaatataagccctgagacaatcgctaacagctttgcagtgcgtccgatgcatgaatacatcaataagactgcgccgcgtcctagcgacgaatttagctgctctcctaacgggtggatgttccgacgcgatgttaaaggcgtgattccggtcgagatcaagaaagtatttgatcagcgtaaggcgtggaaaaaacgaatgatggcgggtgagcgaaatctcgaactgattaagcacgaactcgaacacctgacagacgcacacaaccaaatgatcaaccctgatttcgagttctacgaagatttcggtgatgaatcaaaagctgtactgaaaacgctgtctaagcaaatgcttaaagccgtgaagaaagtgtgtgagaagaaaatcgcacaggcgaacaccgcacagcttaaccgtaaaatcagtatcaactccctttatggtgcgttgggtaacgaacatttccgttacttcgatattcgaaacgccagtgcgatcaccatgttcgggcagttggctattcagtggattgagcgtaaggttaacgaataccttaacgaactgtgcaacaccacggattacgcatacgtgcgttactgtgacaccgactccatttatgtttgtatggacaacgtgatcgcgaaagtcggcggtgaaagtaagttcagggataacaaccattgggttgacttcctggataagttcagtaaagaacgcatggaacctatcattgataagggctaccgcgaactgtgcgagtacatgaataacgtcgaacacctgatgtttatggatcgtgaaatcatttctgggccacctctgggatcgaaaggtctgggtagtttctggacggcgaaaaaacgatatgcggctaacgtatgggactccgaaggaacccgttatgagaagcctaaattaaagatcatgggaatggaaacccagcgaagcagtacaccgacagcggttaaaaagttcttgaaagaagcgatccgtcgcatcctgcaagaaggtgaagaatccttacacgaacacttcaaagtatttgaagaagagtataaggcgcttgactaccgcgaaatagctggtgtatcatctgctaataatatctcaaaatataatgatggtgctggcttcccaatcaaagggacaccaaaccacatcaaaggcgttctgttctttaaccgccatacgaagggtattcaaggaatcaccccgatcatggaaggtgaaaaggtgatggttctgccgttgcgagataaaaacccgtggcaagctgattgcatcgcatggcaatccggtacgcgtttaccaactgagatcgaagaagatattttgaagtgggtagactacggcggattatttgaaaaacatgtgattagcccgttgcaaaacatcacggaagcatgtaaaattgattacgaaaaacgcgcatccctgaacactctgttcggtgatgactggtaagacctgacggggcagaaatgccccatttatataaatttgtgaggaaaatattatgcgtgtatataaaccggaaaaataaatgtctaataaagcactcctgaaaaaactgatcaaaaactcgaatagtcaatctgcgtcaattctgtctgaaagcgatgttttcaataacatcaccaaaactcgaacccgtgtaccgatcctgaacctggcgctgtccggcgctttcgatggtggtctgacttccggcttaactctgtttgctggtccgtcaaaacactttaaatcgaatctggggctggtgacggttgcggcgtacctcaaagcgaatgaggatgctgtgtgtctgttctacgattcagagaaaggcgtaactaagtcttacctgaaatcaatgggcgttgaccccgatcgtgtggtgtatactcgtatcacgacagttgagcaacttcgaaatgacgttgtgagccagcttaacgcgctggaacgtggcgacaaagtgatcattttcgtggactctgtaggcaacaccgcgagtaaaaaagaactggctgatgccctgtctgacaacgacaaacaggacatgacccgcgctaaagcacttaaaggtatgttccgtatggttacgccttacctggcggatctggatattccgatggtgtgtatctgtcacacatacgacacacaagaaatgtacagtaagaaagtcatttccggtggtactggtctgatgtattccgcagataccgcgatcatcctgggcaaacagcaggtgaaagaaggtacggaagttgtcggttatgacttcatcatgaacatcgagaaatctcgcttcgtgaaagagaaatccaaattcccgcttcatgttacctatgagggcggtatcagtatgttctctggtcttctggatctggctatggaaatgaacttcgttcagactccaacgaaaggctggcgcggtcgtgcgttcctgaacacggaaacgggcgaacttgaactggaagaaaagaaatggcgtgaatcggaaaccaactctattgagttctggaaacctctgttcactcaccagccattccttgatgccattcaggataagtaccgtattcctgacaaagagatcactgacggggcagcactcgaagatctttattctgacgatgaagtagaaccgtcaaataaatttgatctcgatgacgatatccctgatgatgtggatatgtcagaagagtaataaacaactgggggctttgcccccttttaataggtgaatcatggacattgaacaaaaaacaaaaaacattcttgacgaagcaatgcaggacgttattcaagaactgttgatcaacgatgaaaacgatgttgcacacttagtgtacatccataaggtgtattgggataacggcctgaaagtcgaatttagtacgccggacgaagacaaagaaaaactgattccgctggttcacgatgcaatctacgcgcagatcaagcctaatctcccaaagcctgaaaagaccttatgggcggcgttgaaagtaaagctgtataatttctttcagatgttcgctaatctggtttaagaggtaataatgatcgtcgaaacaatattttcaaatctggtttttaatggtacgtattttgttcaggcgtggccccatttacgccgtgaatatttcgaagggaacgcgcagattctctttgatttgatggataagcacgtacaggaattcaacagcattccttcacaaactgctttagaagtagctctggacaaaaagagcctgagtgatgtagtctacgaagataccaaaaagatgatccgcagcatgaaaaatgcgccggaagatctggaatggttgatgaaagaaacggaaacctattgtcgtgacaaggcaatgtatcgcgctctgtcccgtgcaattgagatccaggcgaatgctgaaaaacctgctggcgaacgcaacaacaaaattcctggcgttggggcaatccctgacatcatgacggaagcgttagcgattagcttcgatagttcggtcggtcatgattacttcgaagactatgaaaaacgctggatgctttaccagtccaaagcgatgaagattgctttcaatatcccgatcctgaacgccattaccaaaggcggggcggaacgtggtacactgaacatcttaatggctggtgttaacgttggtaaatctctggggctttgttctctcgctgctgattacctgcaatcaggtaaaaacgtcctgtatatcagtatggaaatggctgaacacgtttgttctaaacgtattgacgctaacctgcttgatgtgccactggacgatatcgacaacgggaacatcacctatgcggactataagaaccgtatggaacgcctcaaacagtcgaaggtcgggcgtttaatcgttaagcaatacccaacagcaggggcgaacgctaaccactttaaagcgctgattaaagagcttaaattgaagaagggtttcgtacctgatgtgattattgttgactacctggggatctgtgcttctacccgtgtacgcggggcggaaaatacatacatcctggttaaagcgattgccgaagaacttcgtggtttggctgttgaaacaaataccgtaatgtggactggtgcgcagactacccgcgccgcgtgggatgcttctgatatcagcatgggcgacgttgccgaatctgctggtcttccggctaccgctgactttatgttagctgtgatcgagactgacgagttagctgatcagggcttgcagttgttcaagcagatcaaatcccgttacggcgataagaaccactttaaccacttcaaactcgaagtgcgtaagggtaatcaacgctggatggataccgacaacagcgatatcgggttcaaatctgattataaaggtcgtcagatgccgaaaactgttgaagaagcacaaggtgctatggtaaaacaagctgagactaaccgaagcaataagttagccgaaattgcaaatagtacagacattcaattttaacggggcttcggcccctccaaaggtatagtgaaatgaaaaagattctcgttattgtattcctgatcctcctgtctctgaaactggcagcaatcggggttatggcaaatgcttcatggtggcttgtgtttgcacctctgatcgtgatcggtgtgattaagctggctttctgggtgctgtttgtggtggcaatggcaaatgtattccctaaactgactctctggattgcaaaaaacgcaaaataatcctgattaggggttgacgggagttatgattgtgataatatgactcccgtagacaacgaaacggattaggagataccaaatgaacttactgaacaacccatacgacaaagtgatgaacccagaactggatttcagcgcgggttatttcgatgcagtagtgaacagcgtagtaaacagaggtttgctggttgaaatgctgaaaagtgggaaagcagatgttgaaggtagcgttgatttcctctggggcttcctcccaatcgacccagaattcaaactctgctgtaacgaagttcaggccaaaaacgttcttcggtatctaatcaacaaagcataaaaattaagccccgaaaggggcttttttgtatctgtaggtattgcaatccttctcgaaaggtgataccttattctaaacaaacaaaggaggacatcatgaaacttgcaatcgcttttatcttactggttctaaacgcacttatgggctttccgttcccgtggttagtgcttctggctatcccgtttgcatggaacctgttcagaatcggtttagcgggttgtgttggtgtcctgatgcttatcatcggcgctatcggtggcaaagacgcttttatcggtgttctgaaagccatgaaagagggcgttaaagaaggtttagtgaaatgagtgatttattagatatgatacttccagacgaagaagaaccgaagttcgatagtccgtatcgttccgaatggatcgtatcggttgacgataaaggctatgtcgatatcatgcgctggcctaatattcatcctggctatctggacgaaggtatcaatgcggaaattctgggtatgcctgaacaggttgaagatcctgctggggtgtataagtggatttgtagcccgtgggaaacccgcgactgggaaagcaatattgttgatgactggggctttgatgtggtagaatctacccctctgttcttattaccggaaaaggtcaatggcgaagttaacgaaagcggaaaccaaacaacacaacaagataatggatctggtggagtctgacaaggcgctaacctacgacgaaaaattattcattatcgaaaacttccatgaaggtgcatttacgaataactctgaactgggcgcgttctttaccccgatcggacttgctcgcgatttcactattgatgcttgtaccagtggaagcgttgttgacctgtgtgcgggtattggtgggctatcgttcgcgatgcttcacatgatgatgtacgccaaaccgcgtgaaatcgtctgtgttgagttaaaccatacatactataagttgggtaagcgtatcgtaccggaagcgacctggattaacgcagacgcattaacgacggagtttgatactctgtttgatatggcgatcagcaatccacctttcgggaagataaagacatccaattttaagggtaagtatacgggcgcggaatttgaatacaaagtgattgaacgtgcttcacagattgcccgtgcgggtacgttcattctcccgcagatgtccgcgaatttccgttactctggacggcgttatttccaacaggacgaatcaacgacaacatcgaaatgcaaaaagtttcttgatgaaactggccttgaaatgcaaccaggttgcggcattgataccggatactatctggaggaatggaaaggcgtgaaaccgatgtgtgaagttgtctgtatggaattccctgaaccggagccagaacccgcgcaaaaccttttcactttcacaatagagtaaagactatgagcgatcaattaatcaaaaacatggatttaacctacagtgtgcgaatgattcgcctactgaaaaagccctggactgaatggacggcttacaagctgggtatcatcgacggtcaaggggaagtaatcaagaacccgaagacgaaggaagaactggaagcatattccccgttccatcgctctgtaagacacatcaaacgccgtttaaacgcggttccttatatgtctgggttcatgaaccttacaagcgcgtatgactcgctacggaaccgctggaacctgaccgagcaagaacatgaagagatcatgatgaacctcccagaacttcgcgaaagactcaacgaagaaatggttgcaggtgattcaggcggaagtgtggataatattgcttcgggtgtgactacaggcgcgatcacgaacaaagggccgaaggttctgggttctacacgtccgcataaacgcaaacgtaaaatcatgaagagtgaagaatgaaaccattaccgccattgaattatcggatctgggttactgcgaacaattacacctggtttcctatccgtatcaagtacatgagcgacacagcgatcgtgtacacgaacgaaagaaaaacatcatcgggtgtcgatattcctagaccttatccgttttataagatattctatgaatggaaaatcactttagacggcacagagaaagaagttagccgatagaggtaaacatgtatcttgatatagagttcgcaactcgtatcatgggatcattaccacaaagcgaaatcgttcgacggggtggggaattcagtatccattcccgttgtccgatttgtggcgactccatgaaggataagcacaaaaaacgtttctggatattcccgtcaaaacgaggcacacacatgatgtgtggttgttttaactgcaactacagcaagccgttttctgtgtttctgaaagactattacccggatgattacacggcgtatttgatggaatctttcaaggatcgtaaagatttaaaacagacgcacgaagaaccgccgaaggaagaaaagaaatatattcctgaattgcagttctgcgaacgtctggacacgttgccagaaaatcaccctatcgttaagtatgttgcaggtcgtcacatacctaaagacaaatatgatcgcctctggtttacgcgtcaatggcaacacctggttaactctgtgaatgcggacgcataccctttaccgaaggatgaaccgcgtttggtgatccctatctttgatgaaaagggtaaaatcgagtcattccagggacgtgccttacgtgacaatgccaacgcaaaatacatgacaatcaaagcatgtgaacactcaacgaaagtgtatggtcaagataccatcgatccgttgaaacctgtctacctgcttgaagggccgctggatagcctgtttgtagataatgctggtgcgattacgggcggacaaatggcgctgtccgatgttccgtataaaaatatgcgtgtctgggttcttgacaatgaagcgagacaccctgatactactcaccgccttttaaaattgattgaggctggcgaaaaggttgtgttgtgggacaaatgcccgtggccgtcaaaagatatcaacgaaatgataaaaacggacggcgcaactaaacttgaaatcatgcagtatttgaaagagaatactgtttctggactcacggcgaaacttcggtttaagtcgtggaacaaatcaccgaaaaaatgagattgatatgactgataaaactcctgtgtttaatagctgtgcgcacctggttaaagccgatgatctggaaatggtagaaggtttctaccgcaatgcattacagaacggaattgacccgctgcaaaagatgctggacttgcaaaaccatgcacaacaaagcctgtctgataccctgaattgggttccacgtccgaacgaactgaaaacgtgcggtgagatcctggactggctgaaactgcaagatgatgcgatcgcagacgaaacccgcgaactttacaccgctctgggtggtatgtcacgcggtgcaaaagcggcttccggtgtctggaaaccgtggaaagcaaatcaccaggaactgcgtagccaggtattcgcagaaatgaaagaagaagacaaactggaaattctgttcgaactgattgaccagtggcacttcttcatgtgtaagttcctcgcactgggactggatgcggaaaccatctacaagctgtatgctctgaaacaggcggaaaacctgcgtcgttgggctaacaactactaatggaactcaccgcgctacatgccgtatttgctttgtcttatatcgtttgcgcggtgataacgtatctcttcggatggtgcgttttccacgttaacggtgttgacagaaaagccgctttgatagtattatcattgctatgggttataggttttttctacgtcatctatgaggggcgaaaatgattgacaaatactatatcattgttacgaaagacaaagacggctttactattccacacgttgaaaacgggaaaacgccggaactgtttgcaactccagcagaagcaaaggataagttagactttatccgcaagtgctacgaaagcaaactcaactacgtaccggacgaaccgcgtttcagtttcttccgcaaaaccgagcaactaccagcaaccgaagaacagaaaaaagagatgcgttggtttattgagaattcgaaaattcaaggggtattactcaaattatgagcgagttaacatttgatgatctgagtgacgatcagaagtccgcgcatgatcgcgtgatccacaacatccagaacgccattcatacaactattacgggtggccctggtgttggtaaaacaacactggttaagtttgtctttaacactctgaaagggttggggattagcggtatttggttaactgccccaacacaccaggctaaaaacgtgttagcagcggctaccggaatggacgcaacaacgattcattctgcattgaagattagccctgtgactaacgaagaactgcgtgtgttcgaacagcagaaaggcaagaaagcgcctgatctgtctacctgtcgcgtgttcgttgttgaagaagtctcgatggttgatatggatctgttccgaatcatccggcgcagtattccaagcaacgctgttattctgggactgggtgataaagatcagatccgtccggtaaacgccgatggacgtgttgaactctccccgttctttgatgaagaaatctttgatgttatccgtatggataaaatcatgcgtcaggcagaagggaacccgattattcaggtttcacgggctgtacgtgatggtaagatgctgaaaccgatgtctgtcggtgatctgggtgtgttccaacatgctaacgctgttgacttcctccgtcagtatttccgccgtgtcaaaacgccggatgacttgatagagaaccgcatgttcgcttacactaacgacaacgtggacaagctgaacgcaacgatccgtaaacacctgtacaaaacaacagaacctttcattctcgatgaagtgatcgtgatgcaggaaccgttagttcaggaaatgcggttgaacgggcaaatcttcaccgagattgtttataacaacaacgaaaaaatccgagtcttagaaatcatcccgcgtcgggaagttatcaaggcggagaagtgcgacgagaagatcgaacttgaattctatcttctgaaaacggtatcgctcgaagaggaaaccgaagcacagattcaggttgttgttgatccggtgatgaaagaccgtctgggtaactatctggcctacgttgcgagcacttataagcgcatcaagcagcaaacaggctataaagccccgtggcattcgttctgggcgattaaaaacaagttccaggatgttaagcctcttccggtttgcacgtaccacaaatcgcaggggagcacgtatgaccatgcgtacatgtacacgcgcgatgcgtatgcgttcgcagattacgatctgtgtaagcagttaatctatgtgggcgtaacccgcgcacgttacaccgttgattatgtataaggggctttgccccttttgaggttattatgaaattgactatccttgtaaaagacattccccgaattcttgaagcactcgataaaattcgagaaaaagatccacatgcggtcaatgtgttcgggatgtatagcgcagcagatccgcaagaagttattcaccgtttgcgcttcattgaaaaatctaacgatattctgtattctccgaacggaccaagttattcatggagtcctattgcaaaagaagtcgaactgacttatgatgaatatggcgttatcgtgctgatccttcgaatggcacgaaacattcgtgaagataaagacatatggacattaatatcatgaaaaaagatatatctatccagatcccacgcctccacgcggaagcgattgcagatctaattttcaaaacccctgttcaagaacttccgcatttcatcgatcgcgatgtgttggacgaattcacagaagctgttgaaaacgcgaaccgtctggaaaaggcaatttatcattccggtctgcgtcagttcggtatgatgactttgcaaagcaaagagtttgaaacttttgatatcaacccagaagttgcgcttacgctggcgtacttcatggaagagtataagcggagaacttcatgagtcatttacccgtagattacgtatgggattatgaaacggttggtccttccccgaatgggaaggtgatcgaactctcatacgttccatttgttgacgatccccacaacccgccaacgttcgcggaactggttgcacgggggcgcaagtacaaatttgatttgcgcaaccagcctgatcgtattgctgatcagggaacaattgcctggtggaaacaacaaagcgaagaagcccgtcaaatcctgaaaccgtcaccggaagacctggaactgtatgcaggacacagacaattctttgaagacctgaaagcggacggtgtgagccgttggcaatcactcgattatgttcgtggccctgaattcgatcgcggtatcctggttgatatcgtgcgtaagatggttggtaagatcgacatcttcgaagatatgccgaccgtgttctggaatagtcgcgatgtgcgtacatgtatcgaaaaccgcctgttaacgcgtgatgcttcgacctgtcctcttcggaaagggttgcttgatggttttgtgatgcataattcaattcacgattgcgcgaaagatgttttgatgatagtctattcattgagatatgcgctggggctggaagaacccccaagtgaagaagaaaccgatccattgagtctgccgaggaaaagatgattaaattatcatttgtaggtaaaactgtacatgcaaaaacactgaacgaagcaaaagcgcagatgtttgacattctcatgaaccccgcgttcgttaaagtcgaatacgatgaatatgttgttcagcctggcgatagcatgtattcaatcgctgaaaaattatacggttgtggtgagcgctggcagtctatcgctaagttgaaccgcaaaaccgttagcaatgcaagctatatccttccgggtatggttctgaaattgcctcaattagtagaattgtgataaaaagcccttgcattcgtgcaggggctttgttattttgtagggactgaaacaaaagaggatgaaacatgtttggtgatttgaaagaaggtttgaacattttaatcggattcgcgataattggtgtgattgcgtgtgtatccggcgcggtgtggttgtcttatcaggcgatcgtgtggttgggtgaatggcttcacattctggcacagtaaggggatattatgcgtttatgtttagttggtgtaggtttcggtcgtgcgttaactcaagggttaatcgactcaatccgctggattcaaccaagcgttgaactgtacgcaatgccgaaccggatcgaatactctgatccgacaccgtacaaaatgaaaccgtatcaagcgccacgcgttaaccgtgtgctacaccgtcaatctgtaaacaggggtaagtgatgaaagagcttacgatcgtcgcagcagttctgattttcatcatagtttcaatgattatcgtcagactgtaccagcacggggaagcgtttgaatggttcctggatcacgacaaagcgtttcgaaagcatttcgctggtgagttcatctttactcatgtaagcgtagcaagcggtacggtaacgtttgattttgacgggaaagggaaatcataccatgttgaactctcccttatggatgctaaacgcgtgtatgatgccacacaaaacggcggtatgcgaaagatgcttatacctctttcaaaataattttaatagcctcttgcaatgcaaggggcttttttgtatattgcgcacataccaaacggaggcaactatgacacgtattaacacaatcgatccttctcttcttctgaacgaacacctgattgcagaactgcgcgaactcccccgcattcccaatgccgttttatccggtaaggcaaaaatcaacctgtcaaaaatccctgctgtgtatacgctgggaaccggacacgtaaccttcttttacaataagctgggataccttcgcgatcgtcatgctgcattacgtgctgaataccttgcgcgtaacggtaaagaatacatggacggtgcatacgaagatttcgatcttagtccgttgtcaaactccctgtttcatcgtcatttgtgcgcggactggcaaccaacgccggaatcagtgaaaatcaatgttgagcgtatccgtgaacgtttcgaactgcgcaaacgtgcttatcggttcggtactgagatcatcaacgacgaagccgcatgggatacgtattacgaaaaattaaaagaaaaatacgattttctttgatttgggtattgacccaaatttcgatatgcagtatattacacacatcgaaacgaaacagacaaaaggaacgcatcatgaaaaacttagaagccaaagtagttaaagccctggttaagaacggtttcaacgaaaacgacgcagtagcgatggttgaaaagaatctgaatgatgcgttgaaagttagaccagaagcaaaacctgctaaactcgcagaggtgattgtatgcatcatgtaaaagtaagcatcaaggatatcacggtgggtgacaccgtgatccacgaagggaaaatgaagactgtcgggaaaaacgacatcaagcgcgaccctttgtttggtgtcctcctgtttggtgatagtttcaatctggggagaacttttatcgagcgggttattttcccgaaatggtatcaagggaaacgggtttaacaaatagcactttttgctaaagacttcacgggatagctttgatatagttatcccatcgaaacaaaacggaaggagagttatcatgatgcagaacggttctttaatcaaaggtcacggcaaattcctgattcagcagatcaacgacaacaaaggcatcatcgcctattgcgacgagaagatgaacagcgatatcgcagcatgggaaaagaaagagtatgcagcagtgaaaaaagccgcagaaaaatcccttgctaaagcagaagaaaatctggctaacctggagaactacgcatgaactacaaaactttcgtgattaccgtcaaaactaaaaatggtgaagactgcttcttgtatcaggcaaaagacgagaaagaagctaaagcaggtgtattgaagttcattaaacgcgatgcattgagcaatatttgcgaacaaccaaaataatgcttgcaatcctgaacgcataatagtatattacacacatcgaaacgaaacacacttaggagattttaccatgtatacttttgacgaactgaaagccgcagcacagcctttactggacgcgatgcacaaaggtcgtaacactggcatgtggttcagcgattacactgaaactgtgttcgttctggaaaaaggccgtaagtatcaccgtatcgtgcaggatacccgcaacaaagaaacgggtgaaatgttcaatcagcgttcagttgctggcttcatcgacaatgacggaaatatcttgaaagccgctggctggaaagcacctgctaagggtattcgtggtaacatcttcaacaacccagagaacgcgatcgaccggagtggatacgttcgctatcttcgctaaaatcggggcttcgtcccctttggaaattaaaatgaaactatcagcaaccgccagttggtcaatcttcggactgatagccgcaggggttttattcttcgcatggcaatcaagagatccgaacaaagcggcgtatgaagccgcacaacgagtagtagaacaggatgcagaagcacaacacgaagcaatgctacaacagcgtcgtgatatgggctttgtggagactgtgagttacacaaacgcttttggtgatgtcactacgcgctctgtaaacgtcttagggcgcacgaaagggacaatgctcaccatcagacgggaaggaaccggaaagctcgtagacgtgtgtttcagtgcgattacggacgattccaaacgcgaactattcgccccgtatttttctacgcctgtatatgctaaatttgacggcggagaaacaaaagagtttagcgcaagcagaggaagtaccgaagatttcctgtgtattacttccccgcaacgcttccttttcaatatggatcgtgctagtgttatgcaagtccagttagtattcctggatcattactccaaagtgccagaagtgcatgaatggaacctgaaaacatataatgaggttgtgaataaatgagcagacgcccaaagaacagcaaaaccgaaatgtttgcaacgtttgatgtaaacggaaagagcattgagggtaaaccatgcacgaactcaaagtttatgcatatcgccggattgcctggtatgagtgttaaaacttcttactgttgtcactacaacgaagaaaccacctctgtttatttgggcgaagaactcatggctgaacgcgtcatgcaatgtgtgcatttccctggcgaacgtccagaagtgaactgttttattgttggttatcataaaggtattgtaaatgagcaagtataaaattggtgatatgtacgccccgaaatctattttaatggctgtgtgtcaaatggcatcagaagccgatccgattcgtcgtatgtatgatgcgttgcgtaagaacccgatggacttcaattcaccacgccggatcagtatggtgtatgaagaaacagggattctttatcttgaaggtattcccgttcctatcaagttcaacgatatgaaagggcttttcaatccggtatgggttgcaccagaaccggaaactgaaatcaaccacgtcaataaaggtgaggaagtaccgcgcgaaaattccgctgtagttctggataagtttttcaagaccgctcatagcgtcaaaaaacgaaccgttagcgacgtggttcaccacctgtccgcagaggttggggagatctccgaatgtctcgttcagcctcaacgcggcggtgatatcgtcgaagaaagcgttgatgcgatcgtgtgtgcgttggatgtgatttacctgaaactgggtactacccacgggacaacagaaatcgcgcaagtgatcaataaactgcttgataagaaattagataagtggtactctacttgtagttaatcaattacgaggatcggatcatgttggtttatcgcgttgaattgaaagcgtctatattatccaaatatgatggatggtgtaagcaattaggcccgtacacgggttgtgttggtgatgaagacgatctctatgagtatcttgatattcatggaatcgagttcggtttaaacttcggtatctccgagactcgtcaccccgcaccatgcgaagaccttcgtttaatgcgtaacctcaaaaaacatggtaaaaattatcgtagctatattttcggcttctcttcattgcagaagttgtctaaatggttcgatagctgggagcggcaaattttggagaatcagggatatatctgtatggtgtacgaaactgatctcatgtttgcagggaacaaacaatgtgttttcagcaaagccgcaaccccgatccgttttattccattgtcagagatttattaatgccaacatatacctataaatgcaccaagtgcgaaaaagaattcccgaagatgtccagcatcgcgagccgtgacgaaccgaaagattgtgattgcgggggcgaggcgaaacgaacggttgataagccgcagatggtgaaagacggtttcccgtacaacaagtaaaccccgaaaggggttttctttttcatagaaccctatataatgcctgagaactaataaagaggtgaatatgagtttagatttcttaatggacgataacgagccgcagaaagcaccagaagccccgacaaagggcgctaaggtggatgaatcattctgcttgagcgatcgcgatcacattcgcaaacgtccgaacatgtacgtgggttcagtgaacaaagaagcccatgaacgttttatcatgggtaaattccgcaaagtggaatacgttgaagggttggtgaaaatcatcaacgaaatcctggataactccatcgacgaagcgatccgaactgatttcaaatttgcgaacaaaatcgaagtcaagattgatcacaatctggttactatttcggacaacgggcgcggtattccacaagatgacgtgagaacgccagaagggaagattgttcctaaacctgttgcagcctggacaatggctaaatccggttctaacttcgatgacgaaaaccgtgtaacaatggggatgaacggtgttggttctttcctgacaaactgttacagcgcaatctttatcggtgagacatccaacggtaaacgcaaagtcacgatcaactgtacggacggagcgcagaacatggattaccgcaccagcccgacgaaggagcaagggacaaccgttaagtttacccctgacttctctattttcggtgtggacggtatcgacgaagagacaaaggaagtcatcaaagatcgccttatggcgcttgcagtggctttccctgccgttaaattcacatataacggtgatatcctcccgaacaaattcgcgatgtatggcgcgatgtacggtgataaaacgattacccagacaaacaacaaaatcagtttcatcctggcgagcacagaagacggtttcaaacagaaatccttcgttaacggattggatacgaaaaacggcggtgttcatgttgacaccatgatcgacggtatctattccgaactcgaaccgatgatcaagaaaacacacgctatcgagatcccgaaagcccgtgtaaaagaatgcttgactttggttgtgtttttgcataacttcaatgcaccagcttttgatagtcagacgaaagaaaaactgactaacaccgctggggagttcaacaaccacgccggactgaactacaaaaagatcgcgaaacagattatggatacttctgaaataatcactccgatcattgagtccgctctgattcgcaaacaggcagcagaagccgcagccattaccaaagcgaagaagaaagcgaaaaaggcgaaggttgcaaaacatgttccggcatcagggatcgacactgacggggtagaaaccactttgtttctgaccgagggcgattccgctgtagggcagtttatcgagtgcagaaacgaagagacacaaggcgcatttccgctacgtggcaaaccgttgaacacctggggaatgagtaacttagaagtgctcaaaaacaaagaattgtctgaactcatggcgatcctgaatctccatccaggcgactcttccgaaatgacttacgacaacatcgggatcatggtcgatgcggacgttgatgggggcgatattctcaccctactgattgcgttctttagtcgctggcctgagttgttcgagaagaaaaagatccgttatatccgcacaccgattatcattgcgaaagtcggtaaagatgaaaaatggttctactcccttgaagatttcgcaccgttccgcgataaagcgaaagaggtacgatatatcaaagggctgggttctttacgcaaagaagattacgatcgggtgttgggcgaccagttaaaatacgatacaatcgtactgggcgacgaatacaaagacgttctggaactgtgtttcggtgatgaatccgatccgcgtaaagactgggtgaacggaaaacataaattttcggtgaaatgatggaaagaagtattaaagacgttgtacaggtagaagggcttacgtttgccctttacacaatttattctcgtgcgatcccgcacctggtagacgggttcaaacccgttcaccgtttcttcgtgcattccgcagcgaaaggcggtacaggcttccagaaagtagcctctatcgctggcggtgttgcaatgtatggttatcaccacggggaaacatccgttgaagaggcattgtctcttatggcggcgcactggtgcaataacatcccgctttttgaccgcgatgggttctttggttcccgtctggttaaaaagccaggcgcaccgcgttacattaaatgtaagctgtctccgctgttcaaggctatctacatggatgaagatttgacaatcccgcatgaagatcctgaacacgtaccgccagcctattacctgccaatcattccgatggtactggttaacgggttcagcgggatcgcgaaagcatacgctaccaacattccaccacacgatccgatttcggttctgaatggatgtgttagttacctgaacgggaaagatttcacgctggatctgaaatacccgcatttcaaaggcgacattgaaaacggtacgatgtacggcaagtacgaactccagggtaaaaccaaactggtgatcacagagattccggtcaagtatgatcgcgtgaaatatatctctattctggataagctggaagaaaaagggtatatcgtaagctataaggatctatcgaaagaagatttccgctacgagatcaccctcaaacgcgagtatgcaaacgggcttacccctgagaagatcctgaaagatttcggattgattgagaactcaaacccaaacatcaacgttatctttaacgggaaactgcattcatacgagcgtcctgaaacgttgctgaaagacttcgttgatatccgtattggtgtttaccaacagcgtattgataaacgcatccaggagactaaggaagcgttagataaagcgctggcgaaggttgacttcatcgaccagatgatcgcacagcctgacgcattgaaggggcttagtcgcagcgaagcggttaaacttgtctctacgtggacgggttgcgagaaccacgccgaaatcctggttgcgatgaacatctatcatctaaccacggatgaacgtcaaaagctggaagacgaagcgaacgaactgcgtaagcaactgaaatactgggaagaaacgaccccgaaaactgaatatctcaatgatttgaaagaactttcgaagaaattgaaataatttacaaaaagcctcttgcattgcgggaggcttttttgttatagtgtcctcactgattggggaggatataaaatgttcaaaactcgtagcgatatggaaataaccatctgggccaaaagcatcatggcgaagcatggcttatctcattggtctttcaaaattaacggacgtttcaagcgtactctgggacaatgcaattacagtcgcaagtcaattgaattaagccgttctcacgttaaggaagatatctacgagaacgttttagatactctcatgcacgaaattgcacatgctctgaccgaaggggctggacacgggatcgtatggcagcgtaaagctatcgagttgggcgcacagcctacaccatgtaaaagccgtatccgtgagaaatcagtgattcgggaaagcaaaaaggatatgtatgctttgttcctgaaaactccgaacggcgaagtttatcagtgcaatatgcctgaaaagatgtacaatgagatccaggaaggtaaacgcaaccttgcgaacatctacatttcaggaaacaaaagagcaaccaaagggcgcttagtagcgcgtaaattgacaccagaacaatatgcagaggcgattcaatgaaaccatatgatgcaccaaaaacgggaaaatatattacaatagctgtgctgtgtactattgcaatatgttttgtaactgctatcgtggtcggtatcatggatatgaaagaccgcgaacgtcagaagcaacaggtttacgaataccttgaccggatgtgtacacctgttgaatatgggcttgatcaaaagcctgtgaaatattcatgcgataacatcatctttaacaccaagtgagatataaacaatgaaattgcgtcagttagcaccacaaaccattcacactacgggcttcgataaaggcgaacgcacgaagtttaaaatggctaccagtgcgaaaacatacaaaatcatgtcatcaaccatttacaaatacaagatccgcgcaatcattcgcgaaatctccagtaacgccattgatggtcatatggtagcgggtaacatgaacccgttcgatgttcagttaccaactgttctcgatccgcgtttcatcgtccgtgattacggcacagggttaagtgactggatggttaaagaggtgtttgcaacctatttcgaatccaccaaaaccgacaccgacgaactgatcggggcgctgggactgggtagtaaatccccgttctgctacaccgaaacattcactatcgaatccatccaggacggcgttaaacgtgcgtacacggcttatatggataatggtgaacctttcgttgaccaaatctacgaaaccgaaacagacgaacctaacggcgttcaaatcaccgttccggttaaagtcgaagatatcgcagaatgggaacgtgaagcggcgcgtgtttatgaaccgtttacgggtatccgtccgcgctttatcggtgttcaggttgatgtaaactggcaaccgaaagaagcagacgatcgcgggatcatccgttataagtccatcaactattcaggcgtatacgcgcgtatgggtaacatttgttatccaatcgatctggatatgttcgaaaactcgctgttctactgctaccgtaacagcaattacgcatatattctggatttccctctgggatcgctggacttcatgccgtcgcgtgaagagttgagccttgataaagtcacgaagaaagtgattacggatcgactggataaaatcaacaaacgctttgatgaagagttgatggaacagtataaaaagcagaagacaacccgcgataaactcgtatggttcaataatctgcctagcttgttacagacattcgtaacccgtgataaccgtttccgtgtgggtaaagaatcgctggctgaaattctgacgcgtatcaaaagccctgatacagcaaccggaaaatatgtgtggggcttctgggctaacccatatgacgggaaagattgcgtattcgaacgtgtgggttctggtcgccgttatgagaagtataaagcggaaaccaccaaacgccaggacgttatgcgcatgatccaaccgtggcgacagaagaaactgttcatcgttgaaaatgataacgaagcgcgttcactccgcccgtatctgatcggttactgcatgatgaacggttcggatcgtatcagtttcgtaactgccgatcgtaaaagtgactctgtgcgtcagttgattgaaactggctatttcgatgaatctgagatcgttacactgaaaaccagtgaattgaccaaagaattcgaaacgtacaccgaagatcgcaatcgctggaaagcaacgcgtgaatcatcttctggtgattctgaaccacgtccgaaaacgcctacggcatatcattacttccttgatgatcagggtaacttacagaaaaacgatctgttcctgacaaaagcacagttcgtgaaactggatgaaatgtacgctatgcgcctctacgggattgatgaatatagccgactggacggagaagcaccgaactatacactgggtagcatcgccagcagtatgatgaccctgttgaaagttaccggactgaaaggcgtgatggttctgcgaaactccctgtggagccgcattcctgatagcaacatgaaatgtcttgatgactatctggtacagcgttttgccgacgcggtgaaaaagatgaagcctaactggtatccagcctggatttcgtctaaacatggtagcgaggttcgaacccttcgcgattatctggaggtgactcttgatcgcatggtgaaaaaccgctataatccagaattgtatttgttgcttgattatcttgatggtaagtttacctacgatactatcgagaacaaaaacaaatcgaaaaatgtggtgcgcaatccgttacttcgtgaaatgtcggtgaagcattacaaaatgctgaaagatatgaaagaacgtgttgataccgcctttgatttgtttgaagaacgcaaccctgcattggtgtatgtgttgcgcaattcgtcttactctttaggccgtaccatgattacggacgataagatcaagacgaacctgattaaccttatacggtggaaataatgagaaacgttaagatccttgatgatgtacaaaagaaagctgtctatgagggctttctgaccagcgcgaacaaaaccgcactggctaaacaatttggtgtaagcgtccgaaccatcgggcgcgttattaccgaacaacattctaagtataatacggaagcatcgaaaccacttccacaaacagatgtcaaatctaaaatgattggttctgaatcgttcattactctggtactggacggcaagatcatcacagcggattcgtcacaccctaacttcgaaaaagcacatgctttaatggttaagggcgacatcgagggagttgctaccctgttggacacaacgcaagcgttgaagatttacagcaaaggcaacattaaaatcatcgggcataaagtcctgtacaaagatatcgtgtttgacagcggtatcacacaacgtatcgttcgcgaaatgtacaacgatcgcccttacgagcacctggtgaacttcttcgagaagttgatggaaaacccttcacgcgatgctgtgtatcagctttacgggttcatggtgcataacgatatcgaactggcagatgatggagatttctacgcgtggaaacgtgttcgtgaagacttccgcgatctggcttccggtaagttcgataattcccctggtgttgtggttgaaatgccacgtaaccaggtagacgagaataaaaaccgaacctgttcatgcggtttgcatgttgccgcaaaatcgtacctgcctcactatggcggaggacgcgggaaagttattcaggtcaaggttaatcctcgcgatgttgtagcaatcccgacagattacgacaacgctaagatgcgtgtatgccgttatcaggtgatgcgtgatgtaactgtgggattcagtcactactaaccccaaaacagcgcctggagcgattcaggcgcggaggattcgattatgaaattcctacagagcattcctgactactggcagaacttgagcggggcagaaacagccattaaaaccgccaaagaactctggaacggaggcaacgttaccgctggacgtacagaagacggagaacagacatacttcaaaaaaccttacggtattatcgcaacagcccttgcatttaatctgggttatgttatgctggtactcgcaacggttcagaagtgggtagagataccgatgaaatggatcgggacgttgttgattcgcttagttcgcttagtgttcggcgcaacgatcttgattttgtcatgccctatcttcttgctggtactgacaatgaatatgaaaactggtgtaaacaccaaattaggaaataaactggtgaagaaaaatgaaaagaattctgacaaggcttgacatccacaaatatgctgttaagataggtgacatgaagcgcggtgacttcaccaagttcgaaggggttgacctgaaagaacacggcttctacctggtagttgatgataaaacgggtaaggtagtatttcgattctacgtagccccaaatcaacgccgtaagactggcgcaaaccgtactctgttacgcatcaaacgccgcgaacatgaaccatcagcgatggtggccttgctggatagtgcttctctgtacttcgttgcacacgataagattaaaaacctctttggtttctcgaatcttactggtacaatagcggaaagcgcgattcagatgcggttcggggatggtgagaactatactgaatacaaccgcgcactaaatgatctgtttgactttgaattccaaccatactaattgagataatgaatatgaaactgttttccaaaatccgttctgtagacgaaatcgtagcaacttttgacaaaaccctgaccgaactcgaagcgcgtattgcgcatgatcagaagcaggtcgaacaggtagcagcagaccgcaaagcagcggaagaagaacatcagcgtaagctggctgaactggctaccaaagaaagcgatcacaccgcaagcgcaacccgcgccggacgtatcgcggataagatccgcaaactgctggattaattcgaggggcgaaagccccttaaatatttctttttgaggggctttaaatgaacaatctggtagcaaaacatgatttcaaccgcgcttctactcaccgcgatcgcaagcgagcacttaaagaagcaaaacgtaagcagaaacataaaggtaagtgtgatgaaaaccgctttgattattcttgaggaaatcccagaaaacacggggctgtatctcgttgaagccgacgaagatatcattgaaatcctcaaaaccgctcacgggcattatgtgaacggatgcaacaacaccccagaacaggatcacgctgtcaatatcgttaacctcatgttagggccgcgtacagacgacaacctgaaatgggcgagcgaatccaacgttcctcatgagtatgtcgggatgtattatcagtgcaacgttgacgataaagcgccactgataccggaaaaacagattgatttagtagttcgaacaggtttcttcttatgagttcacaaattctgttcagcaaagaagatccattaggcacagattcatcggtgcaacgcttattctggcacatggattatgcaaaaaatcgttgtcgtaacccaaacaatacatggggaagcaacgaagacattgataaagcaaaaatttatcctcgcggaaaagcatactggaaaatttttgatatccatcttcataaagttatgaaagattcgaacgcatgataaaaaagcccttgacttcggttgagggcttttgctatattggccttgtcgaaacgaaaccactaaggagattcaccatgactaacctgactaaagttaccgcgacatacttcatttcttctggcgctaaaaacgctatgtacactctgcgtgtagagcgtcgtggaggtggattcacttctgataactatatctgcaacctgtctactgacccagataaagcggaagcgaaagcgcgtgaatacttcgatcgcatggtggatcgtctgaaccagaccgatactttccagatggtgttccagggcttcgcagatttcgatctgttcgaacgtcgcggcaaactgtctgtacaagataccgaaaatctggaactgctggaacaaggcatcatgccgatcggtaagcgtaaaggtgaagtgattgctgatatgccgatgtatacgattctgtggtgggctgatcagtgcaaagaaaacggcaacgatagcccagtatttcaggctatttgctcttactgcatgggcgtagcgctggagaaggattacatcgctaaacgtgaagagatccgcgcagaatgggaagcagagcgccaggcgaagatcgcagcagcgcagcacatcggggaaatcggtaagcgtatggaaatgagcggggttgttgagaaagtgatttctctcggatatacccaagtttcttattacaccgaagtggaacgtttcatgaccaaaatcaacgtagatggtaacgtggttatctactacggaaacaaaattgttgaagagggtgatgtgattcgcttcaaagcgacacctaaacttcacaacgaatacaaagaagttaaacaaacaatcgttcagcgagtaaaggtattataatgacatacgaagaaatgcttaatgaagtgtgcgcgggtaaaaccgcgtaccgcccgattaacccagatatgatcgtgttccgcgaaggggatacgatcattcgccgttctcaccgtaaggttgagattaaccaggtattcattgccagtgttgaagaacagaaagcgaccgactgggatatagttgcagaagatgataaccacgacgaacttgacctgatcttagtcatagataatcacccactgggtgttcgtccatacatctatcacaatcaatacagaggcgaagtgattctatcatgacacacgacgaagccatgaaagccgctacacgcggttttaaagtcgcccctgtgggtaaggctgggttctttgtatatcacagcgtagaggctggtttccggcgcattacgataggtaatgttggatactggaacgatgaatatgttccgacaccttacgaactcatgcgcgtatgggacatatacgataaaagcccgatgacgaaagtaaaagatttcatcaatcgggctttgagtagtttgaaactgaaattatcatcgaatcctgcctaaaattctagcggcctgattgcacacgatcattaacttcgtatcggcgacttcgggcttctgtatataccattccattagaattgatcctgaatagtagttttcgagattgaagtaaggacaactaaaggtatatgctaccggaacaaggtcttttgttggaagatacgggctggcaatatctgagatatagtacagcccgtttatatgtctattatactcttccgatgtcttgtctataggatagccacccagatttttcgggttaatctgttgcggtaacttcccttcatacgcaattatatcaacaaaataattgacattcttaggtctgaacccaaagattgccgaaaaatccgcacccgtagttaaatgcactatgtttaactgttcgatggatgcggattcaaacttttttgccttttcaatctccatcgtcggcacgtctataacgcttgaagatgttttccagactgaaaataagtcatcccacttataccatgttacgaacataatgaaaatagtgacgataagaaccaatttaatgaataactgtttccatgttttgaccgccatgatgaacgatattacccgttcaagcaccgccaatttatcttgtaatagcgccatatttaatcctcaagttcggggatgccgaccccgaacatatttaggaatttacttaacgttgagtgaccagaccggatcgtgtttggcctacacgggcgttcaaatagtcataccacgcgttatgttgggcagaagcaatctgatattggcgatatccatcctgtatacgaccgttattgtcaaagtcaaacacaccgccgtcatccatcgtaagtcttaggttaacagcaggaccgttttgaatggtaattacgctaatctcattgctgaattgtgcagaaacacaagtaccgaatgcgttgccgttaaaactaccaccaactgcgccgtgaccggaaggtttcgaatatggtgaataccaaccaaccccccactgaccacgataacgggcgttgttatagtaacgctcatacaccgtaaagttgatgttatatacggattgtcccgccattcgagacatataaaacggtgttccgattcgaaccgcgttacccgcagcagacatccaccgttgccctgtttctgtgaccgcagacgaaccgatccagccaggaactcctacaatagccataaaaatacctcatgaaagaggggcaattaagcccctaatttgttttcgattgcttccagacgttcacgcagttcgttgattgcgttaaccagaagcgcgttaattcccgaaggtgaaatggttaacataccagtgtcgatgtcttcgcgcactgcttccggcaataccttctcaacgtcctgagcgatcagaccggattcgcgatggtatacgatatcatcagcatcttttgattgcttatcgtagatataacctttaagctgttcaatcttgcttaatgaatctttcaattcaaccaaattagatttcagtcgaatatcggaacgaatatacacatcgttggcgtttacgttaccttcaacatacagaccacggttcatatacagatccgaagtacgcaactgtaaggtcgtattcagtcggtagttgtgtaccgatacgttatcatcagcaccaccaaacccgaagtatgcgccgctgttacctgccaaagtaatcagcaaataacacgattggttagtcgctgtgttattcagaagtaatgctggcccgttaacaccctgaacctgtaactgtttatagttagcagttgcaccagtagtccatcgcataatacgctggctatttgcataggcgttgagaataccgtcaccttcctgtttgaaacctgtatcgttatcacccagagaaataccagtcgtacccaatccgtttggcgtaccacaaccaataccgtttgtttcgaccgttccgttgaagtttaccgcgttgccaaagttaacagaaccgttaatgttcgcgccgtttcctatagaaacaataccagtagtcaagctgatagtaatcgggcgtaaactgttccatgttccataaggatcgccggagttggtgatcaaggtatagtagttaccaccatcatttcggtgtattaccccgtagtttccttgtaccgcgcggaactgtccaccagaaccagacgtagcgctttgaacttcgttacggaatcgagcataacccgcagtagaaatctgcaattcttcctgtccgtctgtagaacctgttgccagtctccacacaccaccctgaacagtttcatgccagattgtgtccgcgttaccgcctcggaactgacgcaaatagtttttcccgccctgtccaacagtaggcaagaaatattgcgctggcgtaccctggggaacatcattataatatgatggaacgtttacgttaaaacctaatttggtgttaatatacgttacaccagtaccacggaaataatggttatatcgtccgttgctgtctttatagcctaagtgggtaacaccatcaccaaccccgtttccatcaccgtttgtagttactcgaagtattgcagtgtttgctccttgagtagcataatcagtttcaacggaagcacggttattgaatatacccataccgttaaacgtagcctgtccaggaacggttagatggttagcgagaactaaagttccatcagaagcaaaacgagttgcatacgcaccaccaccagtacgaacataaacgttcttccctgtatcaacgtagaccaaacccagttcattacctccagcatcctggaaatataagtttctgtttccatcgcctttgatagacatttgcgtaccaaagatcgtaccgcttacaacagtttgcatcccgatgttgaattgcgtccctgttaaactaacaagaccattatcacccagcatttgcaattcagcgcgaatggtcccagcagcaccagttgtcgtgtttggtgcgccaaaagcacggatataataagcaccacccacccgcagggcgttgggtacaaatcagatcaacaaggtttgcccccaagtttggatctgacgttggtgacgcggtttttgaatgtataacaaatgtgcgtgtttctgcgctaggaaacccgtttgttactgggttattgtctgtgcgagttgcaacgagataaggttctgttgccctaaccattgcgatcctgtatggtaatttcaattcagttgcagaaccttgtaattccaaagttccttgcattgtatcaccagctttcttcacctgtgcatcgtttgttacgttgcctaatccgatttctgcctttgttggcttatcgttttcggtgtagactttaaagcctttatatgtgattgtgtttccagaagggagtaaaggcaaattagcctgactccagatagtattaccgccaacggtagtacccgcttttaaatctgccattattaagatcctcaaatgcttttatgatatttataaaaagaaaaagccccgaagggcttttaattagcgggatttgagttccctgacttcctcgcggagttctttaatcgcgttgacaagcaaggcaataacagcagaagacgaaacagttaagatctcgttctgttcaccatcaacgcctttcttaacagcttccggtaatacttcttgcagttgttgtgcgactaaaccagcctcacgggtagtttcttcacccccgatatgatttgctttgtcgtacaccataccatcaagtaaatcaactttatccaatgcattttcaatcttactgaaattacttttcagtctttcatcagaacgaatatacacatcgttaaagctaccattaccgttcattatcatttgaatgccggatgaagggttgcgttcaaaataaaccagatatgacgatgaatccgacagttctatacggtttccgcgagtagcatcaccagcatggaagatatacatatcgcgagggtttgcaccactgcgaataaattcaacgcgtccgttgccgctaccgtttaatgttaaatttccattgtcaatataactgcttgactggctgatacgtccgttgactgataacgtatgtcccatcgagacattaccagtatcattatttatatacaaaggacgtaggttattataacttccccatgcatcacctgagtttgttaacatgaaataggtgttaccaccgtcatttcggataaagaatccacggttattgtatgcaatacgcaatccgttggctgagttggaaataatatcaccataagatacaaactcaccagagttatcaaaataccattgacgatctaccgatccagtacggtaatggactgtaaacctgttggtgtttaccaacgtacccatagaccacgcaccgccagcctgagaataatattgcttaataataggccagtattcagatgtcgatgtagtgttaatattctggaaaatcggagcttttgcagtgctttgagaagcccaagaacctctaccttcccccgatgcatcaaaataaccgcctgtttggttgatggttcctgttaccgtgcctcctgtatttttcaagaacagtgcatcgatccatcctgaaaacccgcttttgttgatatacacgttcc

SEQ ID NO: 32 - skipped

SEQ ID NO: 33 - DNA, 178888 bp, Unknown
  source: /note="Description of Unknown: M16-4a Bacteriophage Sequence"
aatacccatctgctttgtcggtgcaacatagatattcagtgtccctttagactgcttgatgatatcgaaagccgctttggttttacccgacatccgacccatatccagcgcagtttcgaagatagacaccccgccgcattcttgcccccagcgcccatcaatgattcgcgccaggtgcaggttacgtgactgctttacagcgtcaacatagaattgtgaaatcatgttgtcgccttatgcaagttcaacgtgtggtgcgtcgataaatttcgtttcaatcggaaggtttggatcgttcttccagttgataccgtaacgcagttttacgccctgttcatcagcggcttgtttcactgcattcaggacaggcaaccacactttcgggttagtctgccagccagcagggagaacgctaggatacagatccacagcatcaccagtgatgtgttttgagttcatggtctgggaaacacccttgcggacgttttcgcgctgttgctctacggtgcgcagaccttcgcggacaccgaaatcaacaggcgagagttccagagcacgttttaccaccttaaccagttccggcttcacgccttgcaggttgttcaggcttttctgactaaatttaaacatacatacctctttatgaaaataccctatgggctacacagggtatttacggtttaagaggcgcaacgattaataatcatcgtaatagagataaccgaaacattcgtcaaattcacgtttacgtttcatctgttcttcttttcgctctttcatatcaggaggaagacggtcttcattgacttcatcaatgtaagcctgtgcatcctctttggtcaggaagaacgcatggaagttatatccgttgcgcccattcatactacgatcgtcaagagagaattctgtgtgacagtcccagtctttgtacagggtgatgcattttgcaaacagcccaataccgcgatgcatacgagggaagccagtaacaatcatcttgctacccatttccgctttttcgccgttcacgcagaacacttcatacatgatcgcaccaggtttcacatctttcttgagagcacgtttttcaaaagcacttttcataatgtattcctcacaattagttttcatatacagattaccacaatctgttttgatgtcaacaaggtctatcgtttttatttgggaaagttaacgtgaacaggcgatcgtgtaatccctcgatccgctcatacgcttgtttcaggatcgtcttatcttctgggttcgttgtctcgatgcagatcagttcgtccgagtcgatagcgatcacatcatccatcagtgaagcgaatacgttcacgtcagggtgagtcaattcctttatctccgcttccatcccgtcatgctgggataacagttcgatgatatcgcgctgtaaatctccctggtacgggaatccggtttgaagatggttgataattctttctgctttggtcatatttcacctacaaaaaagcccctttcggggctgggattaaatgtctttgcactggcaaacaccgtatttggtgaaaggcttgtcaccgctcaggtaagaccagaaatcgcaagcctgttcagcggtttcgaagattgcagcatcatagaagccgtgttcttcgttaccatctttattgaggaacacaggaagccagctttgcggtttgtagcagtcagtaacaactacccaaccttctttcgctttcattgcttctttgttcgcttcaaccatttccagcatttcgttcagtaagttcattttaatccccttgtttatctgttttgttgtctacgagagagatattatcacaacggggattagtgtcaacagttattcgaaacgaattgtgctatttttgaaaaatattccagagcacacagatcctttgatctgcttgccgttcacaccagttgcttcgaatccggttgagtatgtgtctttttcagaacatgcaaaccacttgtaacccgtgaactggatgttcgtataaccctgtgcttccagggtacgctgtgcctctttctcgtcagtacagcttgactgcaagaacacaacaacgacaaccatcaaaatacacacaacaattttccacataatttatactcttttaaggttagttttgctggcttcgatccagcctgaatagaacggggagaagtcctccgctacacccaaacaaacggtagtatgtccgaatgggttcggtgtcgttactttactatcgggattgatcggaagttcactagccccaacactggtcgcaaacaccataccaccagttacgtaaatggtttgaatatgcccgtaagcatcgccaggccacttgaaacggtattcagtgttccataccttgacgttgtacacatcatattcatcgaacagaggatcgttgccctttgtcgcttcgtaaagcgcaccacgccattcaactaaatccgcttcgatatcgcttacacaaaactcttcttccgcactcagtttatcaagtatcatttcaatagtacggatagccatacttaattcacgatcgagtttcataatcaatttccttaacaacggttaaattcttttcggttcttagcctgaataattccagcgcttcttctggggttcttccatcgtattggatagtatgaataccagatttaaaagtcaatggaacccagaaaaacccaaatactcgtttctctaacttgtatgttctttcaggaacccatccaggcgtatgaacttcaactacccgaattttcatacaataccctcttcttcgagcacttcccagatcaaacgatccaggtgcatcaggttccacataaccgagtcatacgaacccagcgagcgggagtaaatcactccccatgaacgataagccttttggaatgattcagcactgttttcatcgtgcggcatatcgtcacccgaagcgatcagcagtttcagaaccatcaggctattgagcgcctttggcgtgaattcctgttcgcttaacttcatcgcgtaccgttcgatgatcgcgattgacttcggatctttaatacgcccatctgtacgacgcgttttaaacgcgctcattaattcatcgactacggcggtacacttcatatgcttcatccttttcctgtgcagacatccgattataacggatctcttcgcgcagttcaacttctctcacggcttcggctttcttttcagcggtgagtatgtgatgtactacagcgtttcggatttcccagagatattcaatcatctgcatatcttcaacggtgtgatagcctttcgcatcacattcaaatacaatttcatcgcgttctgccattgccacctgtgcggtagaaggacaaataaccattccagagtatttttcaatcaacgattccagtgtacgcggttttgttggaatgtcaatagataccggaaccattcgcatcgttgaatcattatgggattgataaatcatcagaatgtgatctccgcaaactgcattctacgctcaatcgcatggatagcgttatcacgctgttctttgttttcatatccagcccaggtaatcggggttgaacagatcaggtgaaaagtgattgctgggtgtctcttcccttcaacaacgattgttgcatcatcttcgatccaggttacgtgatccagattcactggatagtttcttacggtaacagtttcaccaaccaaaggcgacacgtccagaatatcacgatcacgaacgtatgatttaatacgagatacgattaacattatttcaactccactgcatatacatcggtttcaggggctttgtgtacgcgcatatctttaccacataccgcataagccggacagttacggcaaccgttatgatccttgttgcccgtcagttctttacggaactgttttgttttcgggtgttcccagatatccttcacaaaatcttcggcttccagaacatccagaccttcttcccagccaccttcaacccaacgttcggtaaacgagcaagggaagaactgaccacgttcgttgatgtaagagctaaacatcgttgcttcacagtcttcggcgtattgcttgtactgttcgaagttcgggtgtccctccatcgcttcaacgaaagcgggggctgaacagctatcgaatccaaatcctacaccagaatcgaggcaatattcaacaagttttttatattgttcgcgggtaacggtgtcccagttcttaccgcgtcccttttgtttcagtcccaggaacacgatcgcgtttacttgtttcaggcgcggatcattcttcacggcatcaaccacgttaaacgcgtcatcataggttttcgagctaaccatgaaatgcaggttgatttgctgttgtccggcttctgtcaggttcgctaccgagtcgaaagcgacatcaaagccagcgtgtttataaaccgataccgcaacagccccagcaaccgccgctaaacgcgctgcaacgtcttttgatacatcagcaatggtaaggttcggcacaatgcctttagaacgcgcatacgccatcatatcgaacatatcagggtttgtttgcccctgtgcatcagcaccgagtgcgcattgagtcagccagggcattttgtcgatgatttttttgaagttggcaagatccatgttgaacccgttcgggttattggacttgtagcagaacccgcagagtttacccgctggcccgttgcatttggtagtgatctcgatatcgagaatttcggggaatggtgcgtattctggatcgtgggaatatgttgcaccccagcgagcgaattcaccagtatcaacgttgaaattatagttgtagaacttcgagcgagcgaagcgcatattgccgtgttgatagatgaacagggacggcgctttgatgctggtaacgatatcgacagatttcataatataattctcaaaatttaacgtgggattggaagacagcgcgagcaaggctttcattgtcgaacggtatcgactggtgtttctctttgctgtcaatgttaacgcgccagaactcactcgaaccgtttttggtggagtaatgcatcagcgttaccgttttattcttttccaggaaagtacgtttgtcaatctctgttttgagttcgtgttgcatcattttacactccgtttcagtttacgttcgtcagccagttcttttttgtaggttttgatgtacttcccgttaaggatgcgaagctgttggaaaactttgttacacaaagcacgtttcgctttgtattccggcgtattacggattgattcgatcgtcatacccatttcatttttagggtaagcgctcaattccctgccgatctctctgtgccagttgcttaactgatcacgctgtgctttgtactcttcaaaagttaacattataactgatctccgtaatctttcgctgcatcttcgggggttgcatccagtcggtaaagctcaacagctaacggactgggtttgatttcgcggttcaggatctcactgataccgcgaaggaactcgatataaggacggaatctcatttgatacgtaccgcgttaaaagcctggttgcgcagttcataagcctgttcaagctgttcagtagtgaacagagggctatcggtattagtggtgaaactgcaaatggttttgttgtcggcgttgacttcttcaacaacgatttcataaccccatgccccactgtactcacatttcacgttccggtacttgatgtaaactgctgcaacatcttcttttttgtagttccggcttttgtagatgatttccataatttcctccttcgtttcgatgtgtgtacaataacagatcagggttatggagttttagcaattcgtgctaattatgccattttcttagcgattttccatgcggctttgaacgctggaacatcttcaacatcaacccagaaaccagaaccgaaaccatcgttgtagcaagggcaaccgtcgcagtagttttcccaggtcatcactttaccaccaacagaagcaccagtttccatcgcacgtaatgcatcttcaactttttccagtttttctgcattgtcgtcataaatgatgaagtaccatttgccgttgtattcgttacccagtttgattgcttcgcgaacaagtttcatgatgatttcctttttgtctgtttcgtttcgatgtgtgtaatataacaaaagcccctggcggttgcaaggggctttttaaacaaaaagtgctattttgtttcttcgaggattcgaaggatttcggcgcgggtgattggatgttttgccagctcacggatcgcgtggtcaacgtgtatcttacacatcaaaaacttctccccgcacttgtcgcatgttgcatacatatcgccatgtatacgcccgatcccatcggttacggaatgatgcatccaggcgtaaggagttccccgcatccatccggtagcaacatgtttacattctcgttttcgtccgaacatattaccacccgttaggattgcggaaatgtgtttgccagtagcgcagttgttcgcggttcatgttttgggtatcaatcaccataccctgaatcatctgcaacatcatgcgggtttgattgacatcctccaggctcgctatacgctgttttaaggctttgttttcctcttctaactcaaccatacggttgtatgcgttgacgcgctccagaggcatatcagggcgctctttgaggacacgggcgcgggatacttcgcattcgtgatttgctttccagtgcgcggcttctgattctgctttttgcttgtctcgaagcgcgagtgacagatcgctaaccagatccagaaccgtttgcggatctacggtttccagatattttccgagaccctcttcccagcttttaatctgtgtagggctgtcgccatatggaacaccatatgagaacgcgcgtttatactctttgcccctgaaaccatattcctgatttccctggatgctcatattttcaacgagagtccacttactacccatcatagaagaaatcgaacgggctgatttttcaatttcttcaagtttttcacttgttactttcattttgtactccacaaatcatattgtgcgcgaaggatagcgtaaaggctaccgatattgattgaatcgaccggacactggaacaaatcagagcgcatcatattgaactcaatattgttctgttcaacgaagttgccaatcattgatgtccagcccatcaccaggttatatccgtcttcggataacccgtaagccaggttaaccctgatacaacgcttatcagccagttctacgctgatacagttacttgaatgcatagaattgcatgggaatttgctaggaaacttacggaacatctgggtaaggagtttagccgtttcaatgttgatcgcgcgttcctgatccctttgcgcctggttgtcatgacggcgattcagatacttttccatttttgggttgagattcacatgttgcataatatattcctcacaggtttaaagcgttcttttccggttccattacatgaactgcatttcggagatcggtcgctatcatatcgccccgatccgttacatgcaacacatttccgtaatttccagccatacacgaaccgcatgtaataatcggttcgtgcggccttgcgttcgtggaagttcatactttgttgtaaacctgaaccagccacatttcgatgttcggcgcgtaagtaacgtttaccatcggcatagtgcggtatttgtaagcggctttgtacgcatcgagttcagtcggaacacagaaagagaaaccgttgtcataacgttctgcgttagaaacttcacaaccaactacagcggcaatgtttttgttcatgttcatgatgttttcctttctctgtttcgtttcgatgtgtgtaatataacaaagcccctgcattactgcaagggcttttttcactttaatcgaatttttctggcaactgatctacaattacctgagtttgatggatttcttcactcaatttatcgcggtaatgaaccagttcacgggttctggatgctgaatagctaatgattttatcagcggtagcggtgtaaccgtaaccagcacacgcgatttccagttttgcgttatcgccattcggtacgcggatatgagcatacgtcagcaagtttttaaccgcttgtaacagttcatgatcttctttaccgatgataaactgatttggttctactgaatcaatgttcagttcttcgtctttgttcattttgcagccttatacatttcaaggacgcggttcatatgctcttgtgattgaggcacacccgcgaagttcagtttgatgaagaattccagacgatcctttttggtgcattcatccagccccagtgcaggtaatgacatattttcaaaggttcgctgttcgtgtcggggtagttcatgccagaataaacgggaaccgtccggcataggaagaccaatttcaccttcgtaaaatttgataatcgtcgtcaggcgttgtttaccgtcgatgacttctacccagtgagtttcattgaactggctatcaaccgcgatcgcgatgacaccacaagggaaccccgtcattaaggtagtcagaaacgcatcttgttctttctgcgtccacacgtaggggcgctgataagatggattcagatccagatcattatgcttccaccagttgagataacttccaaccatgatcgcatgatcgcgactacgaaaagttcggagttcccgaagtcggttatgaaccggaatatcatctttagacatgattcaccacccaacccagcaaaccagtattgatagccgcaacggtaaggcaaatcaccgcatacacccgcgcgttgtgaactttggttttcagttctgcgatctcctgatccttttcactttcgaactcttcgcgggttccatagtaaccaggatcagcagcggttgcgggacgaactgcatctttttcaacgatggttgcataaccactcgttactttcgttgcaccgtaccagtcaccgcgatcggtgttgatgatcaagtgatcacccttcgcgttagctttatgcttcgacttgccaatgacaattacacgttcaccattcataatataatcactctttcacgttttgttgtaagaactctaacagctttccttcggcctgtaaagcataaagtttattcagctttgctatgttctcaaagtctgatttttcgctgaacgaccagacaccatcatcggaaaccagcgcaccaaccgatacgccagtttcaggatcacgcgtcaacgccagccccaggggatgtaggatatctttattgattttccagatcaaccccaattgagataaggtgttgaaatcaacgtgactcattaggcagtgctccgaacgaaagcagccccatacgatgatcgttatctgattcaccagcgcggaattcgaatttcttgccgctgatactgatagcgctgaaaccgtctttcaggtatggcaacagatacagagggatcagcatcatctttgaatcgtcttcccacttacggaagcccagatttttcatttcttccagcgtcaaatcattcggatcgacgggttcgaaatcaggggaagcgtaaaggcgtccaggcagatcgcgaatatttttcacggtgaatgaatcaccccatgactgatacgcgataggttcagcggcgcgggttgcggtagccagaaggatcatttgacagatttgaaaagttgttgctttcatgatgtatatcccacaagtttagatagaagttgtcccatagtcttacgcgcatgatcgcggatctggctatacggaacatatttgaaaccgtccatttctgtgatggttcgcccgttcttcacgaacgttgacgcacagaagcatttatcggcttcggggtaattattgcctttatacacgaataagtaaagctcttttttactggtataatccagtcttccgaggctttccagttcgtgcggttcaacaagaactccggtttcttcgaagcactcacggatcgcagcgtgaataggttcttcgcctttttcgatatgcccctttgggatgtcccaatgaggcgtttcggtcgcgtggcccattaaaacgctgccgttattcaggaagagaataccagcagaccgttccattactgtgctccgaacttacgatcgtatgctgccagcgctttatctgctgcatcaactgcctgagtgtgtttgttagcggatttctcgctgaacacttcgcggtaaatggcaacccagagggatcggcgggtctgttcgctttcttcattgacgcgagaagccgcaaaagcgttatgttctttgatcagttgtgcgaattcagcatcatgatcaatggtttgttgttgaatagctgtagaagtcataattcacctatttctttcagttcagttttgagtttttcgagagtcgattggtactgaatgccgttttctggatttggcagacgggcataatacagcgtaccagttttgttgatgtctgacaacacctcttgatcgagggtagccggatcgatgccaaaagccattttaaacatggtttccgcgtctggggcgaatccgtgagagaatgcaaaccccagctttttatcaaactgcatcagggatactttgttacccattgatatcttattccccataatgttcttcgtagtcatcgcattcagggagataagtttcgcagaacatacacagcgtgaagaaagtaggctggcgaattccgacattatcgggtaagtacatccagaacgtgttcgcaaacacgatgaacgttttcaggttttcaacggttacggtactgataccgtcataaccggattgagtaattgcgcgttccaggggaacagggtattgctcgcagtagttggcgtaatgttcgcttgtcaccagcgcattagccgcttttacgagatcggtaattttcattcaatatatccccaacgaatttttacgttatcttctgacgccggacttgtaggagttgggtatggataactttgcgcttcccacagataaacaatggcgtgttttgtcaattcttcgataacttcatcgaaagtaccgacactggtttgtaaaggcaacgagaaaggtttatcgttggtttctacttgagcgattggcccatctaccaagataacacgaaccgttgtgtgctcagacatatgagcatagattttgtttttcatgcgggtacatattccactttgacaggttttgcgataaggcgttctttggtgaagccttgcccgttacagatatcacaggtaacgttgaaatcttccatctgatcaacccagccagaatccggcaagccagaaggatacgtgttgacacgcacaacttcgaaccctttaccctcgcatttcgggcatttgtgcgggtactgggatttaaccatactcagcagttgccccagcgtcgttgaacgatcgaagcgttcgactagtgccattacatcagcaatacgaatcgaaccagcgtcaataacggtatacaggtttttcggtacatttgagcgcatagtatatttctcacttaaaaaattttttgatgaaagagaggaacaatccaccaccgaacatgatccagtatcccgcgccgtcaccgttaaacaggacatacacagcgacaccatagcaaaagatttccgcgatattcagtaagtttctcataactccctcctttgtctacaccaggtattttaccagaaagtagattactgtcaacaacaaagttttatcaacccacttatcaccagtcattagtaatcccctacaggttgagaagatgcaacgctcaggatacggaaagagcattcattccatttgcaataagttttcgcacagtgaacagtgcctttcattacaaacccgtttgagaacaccagccagtaaagtttcatgattgtctcctttgtttcgacacccctaatataacaaaagcccctgcacgaatgcaagggcttttttcaaatatttttcaacatatgcagttgaggaggacaatcttttgaagcaatcaggcgatccaggcgtgacataacgcgtctgtagccgtcatactcgaacttgattttgggtgcgatgtagttcacatggatcgcgtttcgcgtgttcaggctcaacgtgtactcagggataacggttcggaatcgtacagcaatcactggtttttcgtgagcaaccgaatcatccatgttttcgaacatctggacggtgaacgcacaggcaaacactttgccattgatccggcgatatgcaatgacttcctgcataccttcgtttttcgctttcaccgcgtaatacagaacgttacacgaataatgtttagcgagactattaagaatttcactgtagaccgcaaagtcttttttgactgacgcggaacgatccaggaatcggtctgcgatgtgatctgtagtcattgaaacctttgtcacataccaatcacttaacgctttactgaaattttggttaacttctctgcgtaagttattgataacatacatcaatcgtgctctgttcataaatcacccattatgtttaaagtattcgatttgacgcagacgtttttccgctgcctctttcgaatcatattcaccaagttctttcgtgcgatcatggttcagtataacccacttatcgccgcgatgttcgatgtgctccgtgatgtcttcgactttcttatccagatccagcggttcagcatcttcctggatgatagtcaaatctacgggcaatgtcaacagtcttttaactccgctgatatcttcgatgcgggaatcatacgcgagggttacatgtggtttgtaatcgtcataatcgtatgttgctccagcatccattgcatctttgaagcggctatggagataatcagactccagaacgcccacgatcgtattaccgtatttcgtttcccacttctccacgtcaaccagtcggacaggttcagagataccggatgcagggaacagatcaaccgtcttacggctatacacaatcgttgtatgcagctttgcagcggaaacaggattctctacacccagaagtttttgcaccttcgcgagcgcttcacaggaagcctgatcgaacttcgcacacatatagatccccggatcaactacgggtttcgctacttcaataaaacttttcatgtgtactccaaatgaaaagggggctttcgccccccagtggttaaacgcctaagcgttaattatgcttttgatgcatcaatcgcttcatcgtcgccagcggtttctgctgttgctggcagaagtgctttgatcgcgccgaccagggcatcaggggatacaccctgcgaaccgtcgatttccagaagactgcaaatttggcctacgagttgacggtgatttgccagttcttgttctttaccctgaatgatttcgttcaggtcgaatacacgggctttcaggatcaggacatcgttttgaagctgttgggtttggttttgttcagtcattgtttacactcttaaaagattgaatacattaagcacgttacgtttcaaatcgtctaacgtaccattatttaggattgtataatcactcaagccaggtgtcaacccttgctccgttgaatgattatcttcaataccagtttcacgttcaaggaacacaaagcgagtcccgaacttgctcaggtatttatattcgtgcggttgacgcacatcggtaatgataaagtgatccgcgtaggatttcaacattttttgaatagcaattgaagtccatatagacggatctattttacaaacaatatcagtcccgaacacctgcatcaaacggcgaatcgtccagggctggctgttttcttcgcaaattttatgagcgataacatctgcgttactcatgaagaacccgcgagaacttaattttttgataccgctagaaaacagcgcgtatgcatcgttattggacatcaccagcggggcttcacgatcaccctcatagaatgggttcttcgctgccagcgctcgcaattgcgtgttatcgtgatgttccatagaacgtttcaggatagctttgatttcgtcggctaacgcgataacttcaacattacggaagttatgcacaaccatttgagcaacggtatctttacccgttcgctttttaccacaaataccataaatcatttttgcgttttccgtggagtaggcacgatcacccgtccgtcgatctcaatttccatgtgagcgaagttgaacatcgtcatacaggatacggcttcatccgaatcattggtatacataagctcaagctctccgaggttggagggccaagcgccatagaagcgaaatgtcgctacagtttttgactgcgagttatccaggatatgcaaagccattgcctgttgtggttcactccaacgcacggaatcgaaggtgttaaaatcgacagtaccgagcatccaaaggtaaaccccaagatacgatcgcagttcttcatcaacagcaaaacgaatagtcagtggatcgaactccattgcagatcctgggatcttccctcgaatcattgggttcagtgggacatccgtaattggaatgttgatagcaggtagtgtaacaccctgaacctgtagtttcaacccttttacataatcattgtcaggaatatctaacatgaagttagtaggtgaaatctggttcaggatcatagcagttgtattcatgatgatctccattttatagatatttagatcaagaccgtgagcgaagcgaacacacgaacgaagtgagtgttatgtacgatgtactgtttataatatttatattttatatatagagaaaacagtacatttccgtatactttttatacaatcgttaactatccgtcttcgcttcgcttgacggaactcgcttcgctcgcgatctaatttttagttgatctattcaataaataggtatactatacctatactttcaaaagagattgaaaacatgaaatcattcaaagaactactttctgaatctgttcagaacaaaaaatttgctaagaccgttgatctggttgaccgtggtaacgctgcaaaaggtcagattggtttcctgcattttgcacatggtgctgattacgatgtgtatgcgccggactcccacgatctcgcttacttcggtaaaggtgttgtccgcctgaaaggtaaaaccactggcaagactcaggcagcgtatattgactgggcgaaaggtactgtttcattctacagcggtgatcctgctgatgacctgaaattcgacaagccactgaaattcaaaggcgcttctctgtacaaagaagcagaagaaaacctggatctgtataatcagttggcggaagatttcgaaattgatctgcctctggatgaagcattggtgaaaggaaaggtgtacaagctcccaagtaacgatatgtgcttgctgtataccggacgtaccaaaaccaaagaaacaggtgaatacgccgtgtttacggttgtagatgcctctggtaaacctcgtctggtatcgggtaaacgctttacccaggaatacaaaggtgatgttctgtctaaactggttctagctgaatcagaagatttgaacgaagccgctaaagatattcgcgaaaaagttattgcggtgttggtgaaacgtgggtttaacgaaaaagacgcagaaaagatggttgataaaaacctgaaagatgcgatgaaggttcgacctggcgcaacccctggaaaactcgcggaaatcgtgagtaccctgtaaaaataaagccccttcctttcggttggggctttttgttaatatctgttccaaactttcttcgcgctgtatggttttcctttggactggaaagcctgtgtaggcaaccaaactgctttcgcccaatcttttggggcgatctctgcaagtggtgaacgtagatgggctggcaggtaggctttgatcatttgatcagccccgcgcattcccttcacgttgttccaattgattttcagtctggttttgttagaaagtcgatctgttgatccgtagccacgtttcaggagttcttctaaaaactcttgacgtgctcgcggtggcgcatagtgcaagttcagcccgtacagaaccaagttacccgctttcgaacgtcctgaacccaggaaaatgatcagcgggaaccgatcccagtatggaagggtgtctttgtatttcgcatcgtagatgaacgtatacaagcgacccgttgctggtttcgcaaccctgtgcgtcttaatgctggttttgatgaaatcaccaaaccaatcggtcgaatctttctgacgtttcgcagcggttacaccaacagtcattttcttcaaactgttgcggaaatcgtttacgatatcaaccgcgtgttttttacgatagtcattacgtttgcgtcgggcttcggtttctgctttacggcgttcgatttcatcatcaatctgctgcttatagcggtgcatagactttgtgaacgttgcgtatgcaatcccgttttcgtccgcgaactttttggctgtcatgccttttaattttgcgcgtcggaatttgataccaagttcaacccattcacccagctttcgcttcggtggtggttttggcttgtcttcttctgcgatgatctcgaactcaaaaataaaactcataattccctccgtttagggtatttattgccctttccatccgaacacacgtttcaacgtgtcctctgtgatgatcttgaactcccagcccttttgttttgctgctgcattcgcggctttccatttgtcaatgtttaccgcataagtatacagcgcatcaacaaatttctttttgttgtgaacgttgttgttcgctggcttcggtgggggcaacgtttctttcatcggcttgacttcccaaaggtaggtcacaccgttatccatttcaacatagaaatccatgaaatagcgccgtcgctttccgtctgcgttgctgaaataagggatcacaacctcttcactgttccagcgtttcacatgcgggtttctatcaagccagttcataatatatttttcccagcttgaacgatacgttatctttcgcggatctcccttatatttctgtatgttctggggcataaaagaccccttgtatgtctgtcttccagccattttagatcctaaatatagtaaacattagataggggaaattacaatgttattttcgttctttccaccagttgattacaaaggcacaccaactactgatatctaccgcgattatcgtttttactttaaccgcgtgatcaggaattataagccgcgtacatatcaactgacaggttcattaagacccgaacaattagcggaaacgctatacggaaaccagcaatactactgggttatcctgatgcttaacgataattacgatccgttttacggatggattaccgatcaggaaacggcttatcaatgcgctatccagcgttattcaaaagcaggtggtgaacaggttctttatcatatggatggtaagggcaaccgttattacaatttggttgaagacccgaacaatcccggtcattggtatgacaaaggcgataagaacatgcgttatttgcagtaccagggaacattagtccctgtagatatttatgaagatgcggtgcttcaaaatgaagcaaaacgaaccatcaagattattaacccctctgatattcaatcgtttgtaagtgattatatcaaggaaatggaaaaggcaaacctatgaaatacggtggaaataaatactcccctttctttgagggggtggtcgaagaagtcgatgatcctcgtctattggggcgtgttcaggtgcgtgtattcggtgagcatccggcacagaaacaaaaatctgaaactatcggtattccggttgaggaattgccgtggatgatgcctattcaggatattcgcagcgccgctatttctggtgttggtttttccccgactggtatcacgcgcggtagttttgttatcggttactggcgcgataaatggcaccaggacggcgttatactgggaacctttgcgggtgagtaccgagagaagccggacacccagaaaggcttctgtgacccgtttggcgagtatcctcgttatgtaggtaacgatgtcaacgtactggctcgtggtggcgcagaggggcgcggttcttcgagcgtgattattcgtgatgctaacagttcgttagctgtcaatccagatgatcgcccacttgacgagatcccagaagataaccgtcctgatactggcgggttcactatcgaaaccatgcttaaacaggatgaaggtatccgcacaaaatggtatattgatagtgaaggttatccgactatcgggatcgggcatttgcttatcatggaaaaaacccgtgatactgcgaagattaacgccgcgatcagtaaagcagttggtcgagaagtaaccaatggaacgatcacagcagaagaagtttcaacgctgtttgctcaggatttggcaaaagtccggcaggggatcagcaacacttcaaacgttcgagaagtatacgtgacgttaaaccgtcctcgtcaaatggcaatcgaaaacatgtgcttccagatgggtgttggtggtgttgccaaatttactaatgctctggctgctatgaagcgtcaggactggcaaaccgcttacaacgaactgcgaaactcaacatgggctaaccagacaccaggacgttcttcacgagtatctaaaatcgtgctgacgggcaacctcgaatcatacggtgttcaggttccagatccagaagggcgttcattgagtgctgcatacaatgctgttgtgttggctgcatcaaatccagaagatccttttgttcctggtgatactcgcgtaatgttcgaggaacctaaatccgcatacgctgctgaatatccatacaacatggtattcgaatcccgttctggacacattcaggaattcgacgatacaccaggctttgaacgttacaaccgtgttcacccagcaggatcatacgaagaaattcgccctgatggaacccgtgttgttaaaatcgttggtgatgattatcaaatcgtcatgcaaggccgtaaattaaacgttaagggtaatttacaggttgttatcgagggtgatgcgttcatttacaatatgggtaacgttcaacagaccgttgatggtaacgtgaccgagttcgttcgcggtaatgtaaatcaaaccgttgaaggtgaatatttggggctgattaaaggcaacgcagaattaaccgttgaaaaagatgcaaccgtaaacgttaatcagaatttaatggctaacgttaaacagaatgcaactgttgccgtaacagaagatgcaacaattaccgcaaaaaatgctctgattgatattgagcaagatttggatattggcgcacgtaatatcaacatgcgagcatcgaataatactttcattgattccggcgcactgactaagatcactggcggtactgtacaggtaggctaaacatgatcatggattatgaaaccatcattgatgggattatgcaaaattttcagcatccttgcgatgctgagatccccgctggatattacagacgcgttatctggcagggacacacagaaaattaccctgctgttggggtagaatgggcgaccgaaatcatcccgatcggaactcacctgtatacgagttcccctttcggacagaaaagcgatccgcttccggtggtgaactctccaaacgtacccacgaatccagacggaaccccaggggtttctactgacattctggttacgaagattggttattatttcgccagtcaagcggatattgatgcctatatcgcatctatcggggctactaagctcgcgggtaatgactggtacggggcggatctatcaaaagcgaatctgttcaagaaccctggcgaactcgcgatgtacaaggtggaaaactccggtggttacttgctgacttccggtccccgttgcgatccgcgaatccgacaggtatacaaccagactacaggcgcgtttaccagcattgattactactggaatggtaatcgtattgcgtacatgaaacacgacgaatcccccgcgcaccagtgcaaatatacagggatgtcagtaaacacgaacgcagataccagcattcctccggttccccctgctctcccgtcaacgtatggggcgctaccgagtgaagccagattgttttctgctcgctctggattgggctgtattccggcgaccgtagggttcccgtatacgaatatcagcgatgctatgctttccgcgtggaacgagactcgtaaaacgttcaagctggctttcgatatgctgacgggtacgattaaaaacggctctggtatcgcgacgatgtttgacgggctttcgatcgggatggaagaaatcacagcgggtgctctggcattgtcacagcaagcatggcaaaccgcaatgaaggtgttccggcagatcattagctctgcgtttaacatcgtgggtggggcatggagtctgatcaataacttcctcccgactgttgcgatcctgggtgttgcaatcaacatttacgatctggtgtttggtgatagttcggttcaatccctgaaagattctttccaggctctgattgactccggcgcacagacgtatgaaagcgtcataaacgcaatctacggggctataggcagttcttacaactacaccgttgaatatgtcaaggctggcgctcgcgaccttgtagacgcttgtagcgcgttatttgactggtgtttgactatgttccaaaacggttgcgttgctctggtggatttgtacgggcgtatgatgcagatctggtcaatgcctcccgaaacaccaaacccgctttggtctgctgtgctggctatccgtaacatcatgcgacagattaaacctcttgatgtgattctgggcggtaacttcccagggtttacagcaatggatctgtatcagcaagcacaagcgaaagtgaaagcgttcattgatgcatcctatgcgcagatctccgcactgtatgatcaggggcaagaactattcaacaccctgaaagcacagacacaggaaagggattcgattaaacgcaagttcgatcagtacctaaactggatgtgggaacctgtaacggaagcaacaaccgctgcttatcaggctgcacttgatgccgctaacgctgctgtgaatgcgactaaggccgcatatgagggaatcaaagcacagattgctactctgcaagatgggatgaaagacacctacagcatggcaatggctgaactcaaaaaactgcctgtaatggctcagattaaccagttcttaggttactgtggggttgcattcgatgacctgttaaaaacgtatgagaacgcgctgacgggcgcacaatcgctatataaaaactttgttgacagttcccgctcgtttaaggacacatgcaaggtgatttataaccagatttgtacgcttgctctaagtaaggtaactcaatacgtaaacaaattactgtcattaatcggactcgcgatcacattcggttcaattagtgtttgcgtccctatggttcaatactaaatacccgataacgaggggtaataatggctactacaaagaaacaaattaatcagatccccgatatctttgtcggggctacttttgacgaaatcaaatctgacttaataaactggctccgaggtcaggacgaattcaaggattatgatttctccggctcgcgcatgaacgtacttgtggatctgttatcatactgtacactgtacattcagcaaatgagtaacaccgcactgttcgaatcgtttattcgtaccgctgcattgcgtagttctgttgttcaacaggctcaggatttgggctatatgccggactcccgcaccgctgcaaatacttcgatcctgatcactgcgaaaaacccactgaacccaacatcgatccgtattccacgcggtacgaaattcatcggtacagtgaaagaaacaaacagtttcccgttcgtcgtatccgatgacgtggtgatcgttcgtgacaaaaacaataactatgtttcgatgttgaacatcgttcaggggcgtttagtacgtaccgaagtcatctttgatggttcgactatcctgatccgcgatccaaacatcgaccgtagccaggttcgcgttaccgtcaacggcgcacaatgggatgactggacaaacgaaagtatcgtaaacgcaacgggtgcatcaactgttttttatatgcgtgaaactgttgatggacataccgaagtttactttggtgaaggtgaaaccagccaacaggtcgcgggtggtgctctgactgctgattacatcgggggcttgaaacctgcaaacggttcaaccgttgttattgaatatatttcaaccaacggcgaagaagcaaacggtgctgaaaactttgtttacgtggatacgttgacaaacattagcattacgagtattgttgagaacccgactaattcagcggactatgtaggcgctgatggtggtggtgaaccggaagatatcgaacgtattcgcgaactcgcgcctatcatgcgtgagacacaacgccgttgtgttactgcatcggattatgaatcgttcttgtctcaccgtttcggttctgttattcaggcggttcagtgctttactgataaagaaaaacctggctatgcgttcatcgcggttaaaccgaaatcagggttgcgtttgacctctgttcaaaaagaggatatgcaaaactatctggcgaagtataaccttgcgacgattacgccgtcgatccttgacccgaactatctgtacatcgtacaaagtatcaaagtaacgtatgatatcagtaagttggttgaatcagaggaatggttgcgtggtcaagtaatcaatgaggttgacagatattatactgataacgttgaaattttcaacaaatcattcagtaagtccaaaatgttaacctatgttgataacgcggacgtgtcgatcattggttcttctgcgactattcagctattgcgtgaacttgataactattacagcgctccgatgtctggtattcacttcttaaaccaggtgaaatcacgttctgttgtttcgaacgggttcaaatacacaaacgctgctggtgattcgtatgatgtgcgttatgcatcaaccgatatgaacaccacaaccggacgtgcaaaaattgttatcgggccattcaaaaacggtgatatcagtatcgcagcctatacaggaaccgattttgataaatatcctggagtgaccgatcgtaataaatattacgaagtcggctatgtggaacactacactgatttcattagtttcgatctgggtgtcctgaacgttccatccgagcgattcagcgctgcttatatcgaactgactggtacaccattggaagagaacattttcacccgtgatggttctctgattgtgtttgaaaacgatctccgtcctcaatatacaacattgacaatgaatccaatcagtcaataattttaacccctgtcatccggcaggggttttttgtttgctaaatatgggatataagtaacgcaaatttggagaaacataatgattaaagcgccgtcaattaccagtttgcgcgttgataaactggctgctaacttcgtttatttgaagtgggatagcgtcggcatggatttttactatgtcgtggaaatggcagaaactcgcggggcaggtggtgttactattccagatgaagatttaacctggttccagttgggttacgcttttttgaatgaatggttttcttccgatgtccaaccaaacaatttttataaattccgcgtcatggttacgcacaagggctttgaaccgtctgattgggtttatacagatgaattatggacgttcagccttaacgcctacgcatattcaacaatgcgtgaatttacgccaagtgatgcattcataaacgaaaaattcgcaaagaacaatcagaactacgttaacttcaatacagatgtggtaatggcagcgttgatgaaagaagactttgtgttttctccactttacactgacgtatcccagatcagcgataaaattcttacacaagaaaactatcacgaaatccaggatcatattgaacacgtttgtaatgacattaacagaactttcctggtagcgtcaaacggtttattgtacctgtttgaacgttttcagaacatggcgaaggtgtcaaacgacaaagggcagacatggcattactacaaagcatttaacgaccgcgtaggaaaccctgtatcgcgctctattgcgtaccaaagccgaaacacaacctatgtactgggttacgatcgtatcttctacgggcgcacctcaacggatattcgctggtctgcggacgatgtgcgattctctgctgatgatgttacgtttgccaaactggggaaccagactggccttgatttcgacgtagactcatacaacacgtttgctaaactgcctggtaacgtgtcgaaatatgcagaagcaatggcatgttccgatgactggctttatgtggttgcgaaaaacgttgtgcgtcgtatcgcgctgaaacagacaccgatcgacaccgatccgagttctccaacgttcggagaaaagattttcgatacagcaagctatacagttgtccctggaaatgataagatcgttgtcaagaaaatggatgtgatgaacgggattctttatgcactcgttacgggtgaagtgaaaaccgctctgcaagatcctacaaaacccgctaacgtggttccgtccgctgctgctggtgtgtatcaatggcaagaagacacgaaaacctttgtgcgcctgtacgggaacaccgaggaagaacgtttttatatccagcatgaatacaccaatatgtcaacgaacggcacggagatttttatttccgtagcgaactacaaatatccaggcacacttcccgatcctgaattgttgatcgagaaccctgcactggttggtgctgtaaaatatgatttgcgtcctggctatactgccagccttgcgattaactttgcgacgattcgcgctcatatcgacgacccgactgtttggaaatttggtgcgcaggaatattacaacgaggcgaattatagctggttcttccgcgactctgtgcgcacatggatcactaatgataaccgtcctctggtggtgtatccgaaaatcacctacagccttgtaaccgatagtgctggtccttcgtcatcgcttcgtgtgaacaaagaggtatgggatcgcggacatgttacgatttacattaacaacattaagtttaccggattcacaaagtatacgaacggcgtgttgctgtataagagttcaggcgaaatcatcgggttctttgaactgagttaccgcgctcgcgataacttaacgattttctggaaaccagacaatacgttattgattgccgatcttattcagcaggaacgcgaaaaaccgtatcaaccggatctgtcacctggtttgattgacccagatttaagccatatgattacgcgctttgcgcctcaaagctatctggaacagcagtatttcgagaagttcggggaatactatttgcagttcgtttcgctgggtgaaaacacctactataacaagctgctgaacctgatcaggaacaaatatccgcgtgagaagaacagcgtagaatatctgtggtcggaagtaaaccgccgtaatatctacctggataaaacgaagcgtgatcaggtggttcgtttctttgaatctcgttgtagtgatttctattcaacgaaaggcatcgaagcaagctataaattcctgttcaaactgttgtataacgaagatgtaagtgtagaaatcgaaagttcgaacactctggaatatgatattctggttcattcaacaaatatcaaccaggacattgtaggccggacgatttacacaccaacagcgagagcaaacgtgacgtatatcgaacgccagtatgatgacggtcaattacgttggtcggtaacgctgcacaacgtgatcggtaacttccttgaagggcaggttgtcaagtctgaaaagactaacttcacaggtactattctgcgtggtgtgcgtggtaagcaaatggcgaacaactcgatcgactacttcaaccgtgggcgttcttactacgtgatgaaaattcgttcgaatctgccagcgtcccgttataaggatgacgttttacgattcgtgcatccggtaggctttggctttatcgggatcaccatgctaacggtgttcatcaactccggtttgtctatgacgcatagtgaaacgatcattgacattcttcgaaattatcgcttcgatagcggttatccgaagtattggcctgatcgcgtagcacgtctggacggtaacggaaaccagacatttgaccttgtaactggtgaagcattgtacgacccgcacccgaaagcgggacaaccgtttgatgttccgccacaatatgacattgatgaaaaaccgctgaatggtgtactgccgtccgcgcgtcgatttgatcaaagtcctctgttcgatagttcagcggttaaatactctcagttccgtaacttagtggaaaaacgattgaaagacgacgcgggtaatcctcgcgatccgaatccaccgactcagagaaaggtagcataatggctcaacaaaacatctaccgtgcggtcgtaactggtaagttccgcacggaaaacatgatgaactttcgcgaaatgatcggggacacccccgatcataactcgatttatatgtcaatcgggcgtaccgaacaatgggcggataacgaatccgaccctgaattcgctcccccttatccgaacgatgatacagatggtatcgttgatatgtggacgcatatgatcgggatgacgaaagtaccaggcgaaatgattgatgcaatcgttccgcgtaaagactggggcgatactcgatatccaaacccaaaaatcttttacattaatgacatcgtggttgtaaactccgcgccttataaccgtactgactacggtaaaggatggatggtataccgcgttgtagacgttcctgatattggatcttgttcaatctccagtatcacgggtaaagttgaatgtgtgcgcattggtggcatttggacaccgacccacgaatcgatcgaacctccgcgcggggaagcgaacggtatcgacatgggcgacggctatatctgggaatatctgtatacaattccaccagatgttgttatcaaccgctgtacaaatgaacatatcgttgttccgttccctgatgaacttgaagaagatccggttcgttggggttatgataacgtgatcaaatggtatcctgatatgtacgatttggtgtaccgaatgaaggttcactcaatgcgattccgcgcgtatatggattccctgttcttcccgcaagcctctttacctggcaaccgtgggttccgtcaaatcagcgttattgtaaatccgctgttgaaaaaggcgcaaccatccgacccagaagtaaaagcaacggggcagtattacacgaaaggacagcttgaacttgactcaggacaaatgatctacatggaaaaccgtcaaccgattattcgttctcctgatcagaccgaagaagtcagtattattttcgaattctaaggaaaccataatggcatatcaaactggtaaaaaattaattgacgtggggcaaatcggcaacccgtcaactggtgacccgctgtatgacggcggtgttaaacttaacgaaatcatcaccaacgtatacaacgcgtttggtgatgtgcgtttactgactgcgaatgatggtgtgggtacaatgttactccacgcgaccggatatttccagaaattaccgcgaacttattattcaggcaacccgatcgaactgggttcattgcatgatatggatacttcaacagggccaattactgttgttcttccatcgggtaaacccggcgaagggttctatttcataaatagtaacggtagtatttctgttgatcgtcctgttgtattccgtccgcaagttggtgatggtatcaaaggggttcaggatcaactttacgtgacctctccatatactcagattaaaatctggtgtgtgaagaaagaaggttccgttactacatgggattattctgttgaatcaatgtttggttcaaaaacaatgcctgtagatactactaaactcattctgaaagcatcaccgaccgcaattcctttatttggttatagtgaattcagtggggcgaaaattctcgtgtacgcggagaatatgacaggcacagtcaataaaatggctgaaattcttttgtctgttgaccgtgtcgctaagggcgtgtattcaactgaatacgcagttctcaaaaatagcgaagatgaaatgtacacgcttacgttcactgttggtgcgagtgatattgtttacgcaaacgtacaatccaaaaccgaggatcgcattaaattctcgattaaagcggttgacaccattaaatcagggatcgcagcatgaaacaagaaattcttatcggtaacgtggttgatgacggcgcaggtgattatctgcgtcgtggtggtcaaaagactaacgccaactttaccgagttatataataaactgggtgacgggagtatcccgcacccagcgggtgcgtggaaaacgcacacagcgcctacgctgacccctattttcggtgaatcatgggcgctgaataccagcaacaaccgtattacggtaaacctccctaaaggcagtgtaagcgattataacaaggttattcgcttacgtgacgtatggggtaagtgggcggtaaacaacgtccgtatcgtccctgcaagcggtgataccatcaaaggctcaccgacttacaaagaactgtacaaagacctgatggacgttgaacttgtttattgttctcctggacgttgggaatatgttgaaaacaaacaggttgacaaaatcacaacttcggatctggcaaccgttgcgaaagaaacgtatatcgcgactcagggacaaactgacttcctgaacgtgttcggccctggtaactcgtacaacgtccgcgcactggaagtttactatcgcggtaacttgctgtacatcgacgacaagaacgggtttaattcatcaaacagcgattacggttcacctggtgcgagcgccggacaactggtagatctggatggtgtaaatatccgtcttaaaaacccgtgtaacgctggtgacacgcttcaattcgttacctatctggatggtattgccgcatggcgagcgacgtatgaagcgcataccatgcgcgtatataacacgggagacacagaacaggttagtatccctggtgaaatctgggttggtgatctaccaaacaaacgcacgttcactaatgctgaatttggtatcagtccgcgaattttgattaacccgaactcgttcgaactgctgctgaacggtcgccagcttgttaaagcaggcgatgcggatctcccgacatttgtttgtgagggcgcagaaggttatgatgaagatagctgtattgcgaactccggcgcgtgggttccttctggacaggattacagtctgatttttgttgactccgtggttactggcattaaatttgctcaacctctggaatcccgtgatgtggtaactattcgctggttcaacaatgatatcggtactgtaatggaatgggacggtgtaggcggtattaaagaacacaccgataagatttacctgaacaacgaagaagaagtgacgctggttaatcagatcgaatataccgattataacaacccaacgcagaaaacctcgcgtaaagtagcggatacatttagcggtcgtcttctggatctgcaagcgttctttgatgttattcacccaatcgggacaatctacgaaaacgcgcataatgatgctaacccaggcgattatatgggctttggtatctggacacgttacgcggaaggtatgttccttgcaggttggacaaccgatgcatcggatagcgattttggtctgaacaataacgatctggatggttccggtcaaccaactcacacttctggtggtactggtggcgaacgtggttatgaaattaaaccgatcaacgttccacaaattcagtcaaccgataaggtgttgattaaagatgacaacgggatcattattattggtggctgtcaggttgacccagatgcaacagggccaggttacactaaataccgcgaggatgtattaaaagtaaatcgggggaacactactccagataaactaaaaacgctcccgccttatattactgttcaccgctggataagggtagcataaatgactcagtttatttccaaaacaagggagggggcgaaagtcccttcccgtgaagcagactttttgcaatatgaaatgggtacgaaagaaccgctgattggtggtaaacgtactattggtggtgcaaacgtcgatcagcttcgaaaaggggtagattaccctaacgtacaatcagcaattgatgacctgtattctttgtctcaacagatcccgatcaatggggtaatcatgatgacggaagatagccccccttctgcggtgcaacaggtagaatcaattacgtttgatgggacggtttcaaacccagatccagatcaaacacaggcgactattcacgtttatggtttcccgttcgttttcgacaatacaacgaacgcctctaccgtatgtgagacagtctataacaaattcgttgaattcgtcaacgatgaaaaatatttcgatttggttactcgtaaaggtctcaacggggaaattctggaagttcgttttattgattcagttccgcatccggttactaataaaactgaatacggaatttcgatggtaggaacaatcgacgtacaggctaaatctggttacggtacatggacaaagttaggtgaaattgaccttgctgttactccagcagttccgatttattatttcaagcgtattgcatgaggataacaaatgaacaatacaattaaccacgtaagcgataaatccgtttacgtgacatttgatcctgctggtacgcaatggcctagcacgtttaagaacgtacaacaggcattagccgctattgggccgtgggcgcgtactgatgttggtttgcctaatgccgcgcctggtgtgcgcggtattgctgctattgcgacacaggcaatgattgatgcgggtactgatacccagacgatcgtaactcctgctttgctggaataccgtctgcaaaaccctcatgcatcacaaaccgtatggggttacactcgttacgcaactgatgcagaatcagtaacagtaacaaacgatctggtttctcttactccgcgctcgttgaactatgtgtttaacacccgccatgcaaaagaaaacgtttggggttctgtgaaactgtcaacaactgctcaggcaacatccggtactgatgacactaccgcaatgactccgcttaaagtgaagcaagcgatctctgctctggttccggtacaggcaaacgcaacagaaagttcgtttggtcttgttcagttagcaactgttgcagaagttcgcgcgggtactattcgcgatgggtttgcgatttcaccatacacgtttattcgtctgactgcaagcgaaagtgatttaggtttactccgtatcgctacccaggcagaagtaaacgcgggtactgataacaccaaagcgatcaccccgcaaaaactcgctgctgtgaagggttccggctctactttcggtatggttaaattaacaacagatatcaataccggattagcgaatactgctttgtctgctggtgctaacgtagtaccgagcaacaaaaacagtgcaattactggtggtgcattgtatcagggttcgattagtgctgacaataaataccagacaaagacagatgttgacgcaaatatcccgatcggatgtatgatgcttgcagcgtttaacgccgatgttggtaacttgtttatctgtaacgggcgagcaatgaaccgcaattcaaacccagaactgtttgcccgaattggttatacatacggcggttctggtgatattttcaacttgcctgatatgcgcggtcttgtagctcgcggctttgatggtgggcgtggtgtggatgcaggtcgcggttttggtacatatcaggctgatatgtttgcgtatcacgaacatgatctccagatgatttaccagaacggcggtaatcttcctaagagtcaagcagtttatgaactgaaaggcgcggaaaaaaatgaccaacgtgttatgcacctgaataacgattacagcaaagcattaggtactggcggaaatgaaacgcgaatgaaaaaccttgcggtcaactacgtaattcgagtacgataaaggggttaatccatgatttcaaaacttaacccgttaccaaagatcccgtttgttgatggtgtccctgcggacaccacacaaacccagatcaattggattgttaacggcgaaactctcgatggtgcaaaaaccaaaaccactaacgagggttctttaaacagatgcggtgttctggttcaaaagaacgcggtacaattagaagcaaatacaactacccagacatcaaaaatcaacgaagttatcgatcaggttaacctcattactgaaaacctcgcggcgatctctgatgatagtgtgatcgacaaactggataaagttgtcgctgatgttgacgtgctgaaagtagatatgtctgctgtacaggcaactacagcaagcaacaccctgaaaattcaggatatcgaaaaggaaattggtgtatgggatgcgtcaaccgatcctaaacatcgtaccattcgaaaagatattattttcctgaaagatgaactgggtgcatatcctggctttaacgaagatggtgatgttgatccgtcctctactggctccggcgtgaaatacaaggtaatggctaacgctcaggcggtatctatccatgaagcacgtattactaagctggaagatgactgggtaaactcagatgtaggtaatttaaccgatgaagttaccgatctgcgtaacgaaatggggccgaagcatttagccactttcgaatctgtgtatgttcgtctgaatggtatcggtggcgatatcactggtattaataccgaactgtcaaacatcaacacttatatcgggcgtacaggctcaggtggttctggtagtattgattcccgcatggaaactgcggaaacgaacattactactctgcaaacccagatgaatgatccggttgttggtgttctgcctcgcgtaatccttctggaaagcgctgttggtaactcacaggttccaggtagtatccgttacgatatcagcacaatgaaacgtagcattagcgatctgaatatgatcgttggtgaaacaagtgatgatggtctgcgcggtgaaatggcgcaggttatgaccgatatcggtactgactcccagccaacaagcatcaaaggccgtctgctgaatgtggaaaacacacagcgcgacgatcaccaggcactggttgatgttaccgcaattgtgggtaatacgtcaactggactcgttgcggctaatatcgcgatgggtaaagctgtttatggtgatgcaaccagttctgatccattcctcaaagatggtattcagaaaacggctcgcgataacaaaactgcgatcggcgttaatactacaggatcagaaacagggatttataaactgatttccgatctgactgcgcgtgttgctgctctcgaagctggcggtggtggtaacgttgaacaacgtctggacgatctggaacagaataaagcctctcgccaggatgttgctgatgctctggttccgtatatcacagaagttgaagcggataacaaatacgaagcgaagaaagttccactgtcatttactcaaaatctggtcggtcgtaacgattatatcgagggtgatgatatttctttatctgttaccgttacaggtggtaaactgccttatgtgtaccagtggaagaaaggaaccgcaaatatcgggactgattcaccgagtgtaatgatccagaacatcacaacgagtgattccggcgtatataaagttgtcgtaaccgacgctgaaaataccgtgattacttctgatgaacttgacattgcggtacatacggttcctcagttcgatacaaacttgagcgatatttctgttgttgatggtgatccattgactctggaagtagtgtttagcggtggtaaaactccgtacacttacgtatggcataaagacggatctgtattgagtggtgaaactggttcttctatcgtcaagtctgctgcaaccagcgcagatgcgggtgattactatgtaaccgtaactgacgcgatgaacagtaccaacgattcagcaaccgcgactgtgactgtaactactcgtccggctctggcgtttacaacggatcttccggcaacgaagagttatacaacaggcgataatatggatttagccgttgttgttactggtggcaaaacaccatatacatacaaatggtttaaagatacggttgaagttactggggaaactggcgcaagcctggctacagtagcagaagcgggtgtgtacaaagttgaagttacggattccgcgacttctccggcgaccatcacctccgctgaatgtactgtgacggtagcataattttaacaaggggcgcaagccccttttgaggatcatatgattacgaataatccagaacagttaaaggatgaaattcttcgtcgtctgggcgcaccaatcatcaaaatcgaaatcacacaagatcagatttatgactgcattcaacgcgctttagacctgtatgcagaatatcattataacggcacaaacaaaacgtatctgattttgacactgggtgatgataacccgcgcaacgtgttcgacttgagcaaagaacacatcttcgcgatcacgaaggtgttgcgtacaaacatgggttcattgaccacaatggacggtacagcggtttatccgtggtttaccgatttcctgatggggttgactggtggctctctgggtgggcgctgtgcatcgagtgtgtacggtatgaacgcatacggcgcggatatgggctactttacccagatgatgtcctatcaacgctcaatgcaagacctgctggctccactgcctgattactggttcaacgatgatactggtcagttctgcgcatgggggcaggtgaacaaaggcgacattatcgttattgaagcgatggttcgttccttcgttgatgtccctagctccgtaggaagcgtcgcaggatacgctacagcgggttctaacgcagtggaagaccaatccatagccgacatctacgaaaacccgtataacagcgttgtaggcggtgtacgagcgggacagggttcaactgttacgggcggaacgtctgcatataacaaccgctgggtaaaagactactctaccgcactggtgaaagagatcaacggacaaattctggctaaattccaggggatgcaattgcctggcggtgttgctcctgatggtacgcgactgatccaggaagcggaaaccaaactgcaaagtctgcgcgatgaactgatttctatgtctgacgcagtaccgatcattatggtgtagggggaataatgcaaaactgggatgaaagtttattcgctcagttgtctacgggggaaggggttgatcgcaacttaaaggatcaggtcactaacccgtatgtaaactggtacaaatacaacccgacacaacagctacacgattcactgacagcagaatcaatccagatgaaatcgcctgatatgtattacgtccggcgtgacttcgtgaatattgataagatcctgggcgaagaccgagaatccaaatttacgaagtcatggaaaattgctgcatatattgaatcgtatgccaactatgaaggacaacgagatttctttagtaaatttggtctgagttcaaacgatgaaatgacgctggtaattaaccctcgtttgttcgcacatcaaactgatggtggtattcctgttctgggggatctggtttattttcctatggacaatagcctgtttgaaattacgtgggtagaagccgatccgttctatcagttcggtgatcgtcctcagcgtaaaatcaacctggcgaaattcatctacactggtgaagaactggctcctgaattgcagcgaaatgaaggaatccatatcgaacctgatgcagaactggatctcgaacctatccgaaatcttgacgggctggctgatatcaacatcgaacagtacgaagaagacaaagaatttgaaagagaaggtgatgaattcatcgaatcttttgatgttgtcaacggacgcggttcaccgtttgcaagtctgccataaatacgttatatgggtataggcggaagtctataccctcttcgaagaggattttatgatatggttgcaaaaatctctatagaacaaagagaacatcaattaaaagaacgttgtgcggaattagaactatcttttgatggatgggtagaccaatcagcgatcacaaaatattcaaagttttatgttgtttgcagtaaaggacatagaacagaaaaacagatcaaaccatttgtcaacaaaagtcgtccaaacggatgttatttgtgttcccctaagatgaaaatatcaaaggaaaacagaatcgaggaaatcaaaactcttgcagattcaattggatatacattcgtagatttcgttggggtgtataaagatgcgcacacaaaaatatcaatggtttgcgataaaggccataattgggatgtaagtatagttgcttttctcaatcaaggtcatcgctgtaaaaaatgcgcaacgtctgggttcaatccgaacaaaccagcatacgtatacgtacaatcactatctggaaaatttctgaaatttgggataaccaacagaacaccaaaaaaaagaatgtgtgcgcaatcaaataaatccgtttataaacacgaactggtttatcaaaaattattcgataaaggtattgatgcaatgagtattgaacagaagatcaaacaatctcttgtttgtggcgtagtcgataaatcagatatgatggatggatatacagaaacaacagatatatccaattacgataaactgttgaatattatagaaggagtataaaattgtttggctactggtataatagctcactgcgtaactatattgttcttatgggacaattgtttaaccatgttcaggttaaaagagtacgcggcgatcaagaaaaatacatcaaggttccgatcacctatgcatcgaaagagaagtttctcgcttccatgaacaaacttaactacacgttgagtcaggaaaacgttgctaaaacggaaacgattttaccgcgcatgaacttatcactggtggatctgcaatataacgcaatccgtaaaaccagtatcgcggtcaaccaaaaaatgacacagttagcaaccccacgaaaaacgatcacacagtttaaccctgtgccatatcgtctgattttcgaactgggtgtttacacgcgatatgaagatgatatgttccaaatcgcagaacagattttgccatattttcaaccgcatttcaactgtaagattaccgaactgcataagaacgatatcacagttgaccgagacatcaaaatcagtctccaatcggttgcgccggataccacattcgagggcgatgcaaatcaacgccgtcatgttgagtggtcatttatgtttgaattacagggttatctgtacccgcctgtaactgatgttaaaggcgaaatcagaaccgtttacacggatttcttcgctaacatgaacccgttagataaagataactttgaatccgtggatagtcaagccgatccggtagatttgcctatgcaggactacacgggcgaagaatatattcagacgtactcgcacgataagccgatcccgtctggtgatgaacctcctaagccgagggaatgaaaatggatgaaaaattagatttacagcaattgctgaatattgattccctccctggcggcgttgagtctggggaggatgtggttgtttacgagaaacttgaactggttgacgttcaatcacatccagcagaccggaaaccggatctggaagaggattatacgctcgcgcgtaagactgcgcaccatatgaatcagatgatcatggatatggcgcagatcgcattacacaacgcgaagaactccgaatcgcctcgccacgtcgaggtattcacaagcctgatgaatcagttaaacgtttcaaacattggcctgatgaagattcacaaagaaatgcgtgagattacggaagagactacaaaaccaggtgctgaaaaaggcggtggtggtagtgaaatgaatatcgagaatgcaaccgtatttgttggttcccctacggaactgatgcagaaatacggcagtgcatatgaacccaaagagggcttcattaatggtgaagctgtagaggtaaaccctgatggaaatggaaccgacgatcgatccgagtaaggaatcagatcaccctatcggattaatgcatcccaaatatctgaaaaagaaaattgatgaattggggatggagtggacacaaagcgaacacgataaaaaatggtatccgacaacgttcagtgactacctgaaaattaacggcattcaaaaggtcgatattcagtctaaggacagttcgaactttgccacgtacaaaaataaaggcaacaagaaaacccgatataacggcaacccaaacctgaaacgtgcgtatatccagactaaatggacgcaacaaatgttgatggagtgggtgaaatgtcgtgatgatatcgtttattttgctgaaacatattgtgcgatcacccacattgactatggtacaatcaaggttcagttgcgtgactatcagcgcgaaatgctgatcgaaatgcacaaaaaccgtatggttgcctgtaacctgtcgcgtcagttgggtaaaacaaccgttgttgcaatcttcctggctcacttcgtgtgtttcaacgaagataaatatgttggtgtgctggctcacaaagcctcgatgtctgcggaagttctggatcgtaccaaacaggcgatcgaactactgcccgacttcttgcagcctggtattgttgaatggaacaaaggttctattgaacttgacaacaaatgtaaaattggtgcgtttgcatcttctcccgatgcggtgcgtggtaactccttcgcgatgatctacatcgacgaatgcgcgtttatcccgaactttgttgatgcgtggttagcgattcagccagtaatttcttctggtcgtaaatcgaaaatccttatcacaacgacacctaacgggcttaaccacttctatgatatctggaacgctgctatagaaggaaaatccggcttcgtgccttacacggcgatctggacatcggttaaagagcgattgtatacagacggcgacaacggtacatttgatgacggttattcgtggtctgcgaagatgatcgctggctccagcaaagaggcattcttgcaggaacactgcgcggaattcatgggaaccagtggaaccctgatcgctggttggaagttgtcaaaactcacatggattgatattgatgaaacggaaacgaacttctatcagtataaacgtccagtagaggggcataaatatgttgcggtacttgatccagcggaaggtcgcggacaggattaccatgcaatgcatatcatcgacattacgacgatgccatttgaacaggttgcggtgtatcactcaaacaaaacgtcgcatcttattttgccggatatcctgttacgttatctgaatatgtataacgaggcatggatttacattgagctaaatagcacagggcattcagttgccaaatctctgttttccgaactggaatatgagaatgttatttgtgacagctacaacgatctgggtatgaaacagactaagcgatcaaaagctatgggatgttcgacgctgaaagacctgatcgagaaagataaattgatcataaataacaaaaagacaatactcgaatttcgtactttctcagaaaaaggcgtttcgtgggctgcggaagaaggatatcacgatgacctcgttatgtcgcttgcttgtttcggttggcttacaactcaaatgaaatttgccgaattctgcgagaaagacgatttaagactagccaatgaagtttttgcacgggaacgcgaacagctatacgaagacgcattatgtccggttatcgttacaagcggtgatgaaacgatttcggttggttctcacggtatttcgtttatataaattagaggaaattctataatggctttacaatctccaggtattgaaaccaaagaaacatcggtacaatctaccgttgttcgaaattcaactggtcgcgctgccattgtcggtaaattttcatgggggccagcttatcagatccgtcagatttctaacgaagtcgaaatggtaaactattttggttccccagacaacttgaccgctgactatttcatgagtgctgttaacttcttgcagtacggtaatgatctccgtgtggttcgcgttgtcgataaagatgccgctaaaaacgcaagcgcaattttcaaccagatcaaaacaactatcgcatcacagggttctaactacactgtaaacgatgtgattaaagtaaaatacaacaacgttgttgtagaagaaaacggtaaagtgtccaaagttgacagtaacggcaagatcctcgcggtaatcatcccaagcgaaaaaatcgttgcccgtgctaaacagattggtacttacccagatatttctactggctggactaccgaaattgtttctcagtcttccggtgtttccgcgtctattacgattgacggcatcgaaagcgattcagggatcactctgttgaacctggatattgcaaaagaaacaattcagggaaccgcattccagactcttacccagaaatatcagatcccgtctgtcgtggctctgtatcctggtgaactgggttcaactgttcaggtggagattatctccaaagctgcttacgattctggcgctatgatttcaggctacccttctggggtttccgttaagaacagcggtcgttctgtaatgacctacgggccacagaccgataaccagtacgcttttgttgtgcgtcgtggtggtattgtacaggaatccttcatcgtgtcaactgagaagaccgataaagatatctacggcgtaaacatcttcatggatgactttttcgctaacggtggctctcagtacgtttacggtacttccctgaactggcctaaaggcttctccggtatccttgagttcggcggtggtttgtcctcaaacgacactgtaggcgctgatgaactgatgactggttgggatatgttcgctgatcgtgaagcgctgcatgtacctctgctgattgctggtgcgtgtgctggtgaaactgtagagatcatgtctaccgtccagaaacacgttatctctatcggtgatgaacgtcaggattgtactgtgtttgtgtcgcctccgcgctctctgatggtgaatattccactggcaacagcggttgataacatcattgaatggcgtactggatataaactcagtggtggtactccggttgacaataacctgaacgtaagttcaagctatggcttcctggatggtaactataaatatcagtatgataaatacaatgacgtgaaccgttgggttccgctggcaggtgatatcgctggcctgtgtgtttacactgatagcgttgctcaaccgtggatgtctccagcaggttacaaccgtggtcagatccgcaactgtatcaaactggctatcgaaccgcgcacagcacatcgtgacgcaatgtatcaggttcagattaacccggtaactggtttcgcgggtggttccggcttcgttctgttcggtgataaaacactgactaacgtaccgagtccatttgaccgtatcaacgttcgtcgcttgttcaacatgatcaagaaagacatcggtgataacgcgaaatacaaactgtttgaaaacaacgacgatttcacccgttcttcgttccgtatggatacaggtcagtacatgactaatattcgtgcgctgggtggctgctacgattaccgtgtaatctgcgacaccacgaacaacacaccggacgtaatcgaccgtaacgagtttgtagcaacgatctacgtgaaaccgcctcgttctatcaactacatcactctgaacttcgtagcaacgtctacgggcgcagatttcgatgaactggtagggccgcaagccgtataacgtcaagggggctgaaaagcccccataaataatccgaggttaaaaatgcttactgacattttacgcgcctttgaatccggtgatttcgcacgtccgaacctgttcgaagtagagatcccgtatctgggcaaaaactttaaattcaagtgtaaagcggcaaccatgccagcggctacagttgaaaaagttccggtaggataccaaaaccgcaaaatcaacgttgctggtgaccgtacctatgatgactggacaatcacgatctataacgatgacgcgcataatacgcgtgacgctctggtagcatggtcaaacatgatgcacggaatgggcgatcagattagtggtgatattccagcgaactacaaaaaaaccgctacggtgaaacagaaaaaccgtaacgatgaaattaccgccgaacataccattcacggtcttttccctactaacgtaggcgaagttaccctggactgggacagcaacaacgaagtgtcaacctttgaggttactttcgcgctggactggtgggaataaaggctataaatacaggggtagcaatacccctatcattatttttcggagttactatgaactttttgggctttggcaatgtacttagctttttcaagaatttcgcccgtgaggacgaattagatcttgaacagcaattaaaaaatgatacaggttcggtcgcgcctcctaaaaataatgatggtgcttatgaaatcgaaactgatctgactaatcagaaatacgcaagcgtattccagcagttttattctggacaagatccggcgattcagaacaaagaacaattaatcaatacatatcgcggcatcatgtcttacccagaagtagaaaacgctgtttctgaaattattgacgatgcgatcgtgaatgaacagggcaaagatatcattactttggatcttgccaaaacagattttagtaaggcaatccaggacaaaatcgtagaagaatttgataacgttctaaatatctatgattttgataacatgggtgcgcgtctgttccgtgattggtatgtggattcccgtatatacttccataaaatcatgcataaagacgaaagcaaaggtatccgcgaactgcgtcaacttgatccgcgttcgatggaactgatccgcgaatctatcactgaaaccctcgatggtggcgtgaaagtattccgtggttatcgcgaatttttcgtgtatagcgctcctaaaaatggctatacatacaacgggcagatctaccagcataaccagaaggttaaaatcccgcgctccgctatcgtgtatgcgcattctggtctggaagattgcagtaacaacattatcggatatctgcaccgcgcagtcaagccagcaaaccaattgcgtttactggaagatgcgatggtcatctaccgtatcacccgcgcacctgaacgccgtgtgttctacatcgatgtaggtcagatgggtggcaacaaagcgacacagtacgtaaataacatcgcacaggggcttaaaaaccgcgttgtgtacgatgctaaaacgggtactgttaagaaccagcaaaacaacctgtcaatgacagaagattactggttaatgcgtcgtgacggtaaagctatcaccgaagtagacacgcttccaggcggtgcgaacttctctgatatggatgatatcaaatggtttaaccgtaagctctatgaagcactgcgtgtgccattaagccgtatgcctcgcgatgatgggggtatgcaaattggtggtggtggcgaaatcacccgtgatgaactgaaattcagtaagtttatccgcacactgcaaattcagttcagccctgtgctttccgatccgttaaaaactaacctgatcgcgaaaaaaatcatcacagaggaagaatgggaagaaaacgttagcaaaatttccttcattttccagcaagattcatattatgcggaagtgaaagatattgagattatggaacgtcgcctaacgttaatgtcacaggttgaaggtgtagtagggaaatatgtctcccataaatacatcatgaaagagattcttcgaatgtctgatgaagacattgacgaacaagcgaagctgatcgaagaagaatccaaagaagaacggttcaaaaatcccgaagaggaagaggaaaacttttgatgaaagaatttatcgaagcaatcaaaagcggtgatctggtggaagcgaagaagcaattctattccatcatggaagaccgtaccgaagcccttcgccaagaaatgcgcgttgaactcgcggaagctgtacgcatcgaaggtgaaaccgacgatgacgacaacgatgacgatgacgacgacaaaggcggcgatgataaaggcgacgacaaagacaaaaagccgtctgataaaaaagacgacgataaagacgaataagaggtgtaaataatgcaactcgaactcgaagaaatcagcgtcgaagatctcgaaccccatttaaccgaagcgaaagcccgtgttgatgttctggggatcgatgacggcactgtgaagatcatcgaaaatttggcggtcaatgaacctcatttagccctggctatgatgtccattgtcgagggtttgagtttagatgaagtcattgttaaacacgtagattcgcgcggtaatgtggaacgtaaaaaagaccgtaaaacccgtgaacgtaatgcgtatcaaacaactggtttaactaaatctcaacgtcgccaaattgcgcgtcgtgcgctaaaaacaaaacgtgcaaacccttctattacaacccgcgcacagcgtaagcgtaaaaaagcgctccgtaaacgcgccgcattagggctataaatatgaatgaatcccaactcaatgaaaacggcgatatgctgctaatcgaggaatggggtttaccttgtgcggatatttccgattcaattttagaatcggtcggtgagtcgaaaaaagacggtaaacttcggattgaaggtattttcctccaggccgaaaaagttaaccgcaataagcgactgtatccgaaaaaagtattagaagaagcagtaaacgattatatcagaactcaggttaatacccgtcaagctctgggtgaaatgaatcatccgccgcgaccgaatgtcgatccgcgtaatgcttgcatcctaattgaaaaattatggtggaaaggtaatgacgtttggggtcgcgctgttgttgtcgaaggtgataacggtgatggggataaactcgcggcgttaattcgcgcaggttgggttccaggtgtttcttctcgcggactgggtaaactttccgattctggaaaaggttacggtatcgtacaagaagggtttaaattggcagtaggcgttgatgttgtttgggggccaagcgctccagatgcttacgttaagccgattaccgaatctcagtcaagcaaaacgcttgttgagaataatagtgctgatgatgacgctttcagaaaactctctgaacgtttgaaaagtctatataaataatatcatatcaaacaggaaacttagaaatgcttaaagaacaactgttggcagaagcccagaacctggataccccagttgagttagacagcattttcgaatcagttgaactttctgatgatgcgaaagcaaacttcaccactgtattcgaacaagctgtaaaagcaggtgctgcgaaactcgctgaaacccacatcgcccagatcgcggaacgctccgatgaactggttgaagcccaggttgccgaaaaagctggcgaaatcgaaaataaactgtacgaagatgcgaataaatacttcgaccacatcgcgcaggaatggctctctgaaaacaaagaagctgtatcccgtgatatcaaggccgatctgttcgaatctctggtaatgggaatgaaagaactgttcgttgaacacaacgtagttatcccagaagcacaggttgatgttgttgcagaactcgaagatgaactgaccgagaatcagcaggaagttaaacgcctgttcgaagctaatcaggctcaggctaaagagatcgccaacatgaaacgcgataccatcgtttcagaaaaaacaaaagatctgactgaatcacaaattgaaaaggttcagaacctgatcgaaggtttggaatattccgacaagttcgaatccaaactgaccgcaatcgttgaaatggtagcgactaaagcggaaaaacaggttgaagagagtaccactactcagacaaccactaaagatgactttgttccggtgaatgaaaatacacctccagcagagaaatcgaagatcaataaatatgtacaagcggctaaagccctttcctaatcttataaggtaagaaacaatgtctaagaaaaacgaattgatggaaaaatggaacgatcttctggaatctcaggaaggtttaccggatatcgctaccaaatccaaaaaacaactggttgcagcaattctggaaactcaggaaaaggatgctgatactgatccagtatatcgcgacgaaaaaatcattgaatccttcggcggtttcctggcggaagcagagatcgcgggtgaccacggttacgacgcaaccaacattgcctctggtaaatccagcggtgcaatcaccaacatcggccctgctgtaatcggtatggttcgccgtgcgattcctaacctgatcgcattcgacatttgcggtgttcagcctatgactggccctactggtcaggtgttcgcactccgtgctgtatacggtaaagatcctctggctggcggtactcctgcaaacgttcgtgaagcattccatccgatgttcgctccagacaccatgtattctggtgaaggtgcaaacaccgcgtttgctgctatcgcttccggtactgctatcgcttccggcgctatcgttaagcacgtattccaggaaactggtatcgcgtacttccagaacgtaacctccggcaacgtaaccgtaactggtgctgatgctgctgctctggatgctgctgtaatcgcagaaaacgagaaaggcactctggctgaaatttccgaaggtatggctaccagcgtagcagaactccaggaaaacttcaacggttccagcgctaacccgtggaacgaaatggctttccgtatcgacaaacaggttatcgaagctcgtagccgtcaactgaaagcacagtattccgttgaactggcacaggatcttcgtgctgtacacggtatggacgctgacgccgaactgtctgcaatcctggcaactgaaatcatgctggaaatcaaccgcgaaatcgttgacctgatcaactacaccgcgcagattggtaagactggtttcactcagaccgttggctctaaagctggtgcgtttgacttccaagatccagtagatattcgcggcgctcgttgggctggtgaaagctataaagctctgctgattcagatcgacaaagaagcgaacgaaatcgcgcgtcaaactggtcgtggtgctggtaacttcatcatcgcttcccgtaacgtggtttccgctctggctcgtatcgacagcggcatcactccggcaggtcagggtctccagaaaactctgaacgtagacaccactaaagcggtattcgctggtgtactgggtggcacttacaaagtgtacatcgaccagtacgctcgccaggattacttcaccgtgggctacaagggtgataacgaaatggatgctggtatctactacgctccatacgttgcgctgactccgctgcgtggttctgatcctaagaacttccagccagtaatgggcttcaaaactcgttacggtatcggcatcaacccgtttgcgaactctcgctctcaggctccggcagatcgtatcacctctggtatgatcagcaaagaaatgtgcggtaaaaacgcatacttccgtaaggtctgggttaaaggtctgtaatcgactttacactaaaaggcaacctacgggttgccttttttgttggtgtaaatagatacaggtaaaaagccctctaattcaggaaccaaagaaatgagtgataaacactacacaattcacaagttgatgcgtcagtcttcgcttccgtctggtaaacgagaaaaagttatcaacgaagcaacaggtacgaccgacatcaacgtacagaacacgcgcccagaactggtttctttgactcgcgcggttaacaacctgatctatcatgaactggttgctgtacaagaaacagaactccctgttgcaacactgttcggtgttcgctatcgcaaccctaacggtgatatgactttctccagtgctgcaacctattcaggccgaatctctggacgtacagacatcgacgaaatcgatctgactaaagcctacgttaaaggtgatttgttcaagcatgacggtactgacgttgtttatgaggtgattgcacctattaccctgaacactctggatactgacaaagacaccgcgatcatgaaagctgtgttccaaagcaagattcgtctggttagcgaagccgctgatacttctaagtatgaaaccagtgaagatatcgcgtcaacctccttccagatggatcgctggaatattccggtacgttcgcgtaagtttaaaaccgaaatgacggttgaactgatgcaggatttggaagcaaaccagtttgaagctgatggggtgatcgaagacattctgggaaccgtggcaagtgaagaagtcaacaaagacattattcaaactctgatcaccgtttccaaacgttacaacgtggatggactcgttacggatggtatttttgacggcacaaccgcatacaccgcgaaggatgccccagcattgggtcgtatcctgtatcaattagcgtgtgaaatggggcaggaaatgaatagaacgacttcatttgatgctacctacgtcctcgcaacagcgcgtgttgtaggcattctggctgcgtctggttggatgcacgaaaccgacgaacaacacccactggcaacaggtaagctgaacaacggttattatgtctatacagacaccaacagcccgttcgattatatgctgactggttgcaaatatgatctgggtgatatggatcacgtaggctctctgttcttcgctccgtataccgaagctgacgaagcaggttcaatcaaagtatccgtagatccggcatccctgcaaccaaaagttgctattctgatgcgttacggtctttccgtgaacccgtatactgctgaaagtgattctgatcgcctgatcaaaggtgatgattggtctgctcttgcaggtaaatctaagctgagtcagatcgtaggtattaaattacctaaactgggttaacaagttttgttttgagaagaccattatagtaataaagatctataaggtcaaacgagcgaagcgagttttcacgaacgaagtgagtgatgggtaagtacgatgtactgtttataatatttatattttatatatagagaaaacagtacatttccgtatactttttaaccaacattcactcactacgttcgttcatgtactcgcttcgctcgtagatttgacttcttgatctaactggttataatgttactttgttttgaggtgatacatggctgaactaaaacttgaagatctacaggctgaacttgaagaggatatgcgtattgatccgttgaagttacaaagcgaatcagcagacattccgaagatttggtcaaaatggcttcgataccattcgaatgctaagaaaaaacttattcaactccaggcgaagaaagaagcgattgtaaaagatcggttactgttctacactggtagacacgaaagcgaaatgaccgatgtcatttacactggttcgggtgaaatcaaaattgctatctccggtgatcctaagaccgttgaagttaacaagctgatccaatacttcgaactgattgcagagtttaccggaaaagcgctggatatcgttaagaacaaaggctactccatcaaaaacatgttggagatccgtaaacttgagagtggtgcataaaatggcagaagaatttgattgcaaatgcgttgtgtgcaaacaaccgatgaactcccgtaatacggcgtttgtcaatgaagctggcccgatctgcggtgtcgtatgtttgcaatatctcaacgaaaggaatgatcgcggtatcaatgaagccgacgatctgaacgaagttcaaatgttgctgtaggtgtgaatatgaaagactattcaaaaatcgactttaacgaagtatttcgtttgctgggattgatggaagaatgtgtgaccagggttcatgcacttcgaatttcgtttgaaagcggttgtatcgaagacgaacgcccagatttatagcagtaaatagatgtgtaccccttgtggggcttgggcttaccgtgtggcgtacccatttgcgccgtccgatagaatttactttcggtggggtgattggtaagataccttcgagtaaaggccagttaattgtaattcagaatagtacagcactgaaataaaataaatgtacgtgtcggaacaaacggtttccgaaattaaaaagccccttcctttcggttggggctttctttttaaaacttctcttcttctccggtttcaagttcggctttcagttcttctcgccgtcccttgatcgcgtcacgcattgaaatgtcatcggatgctgcaacctcgacttctttcacgcgggtgttgtaatacttttcaagttctttcaaaccttctagtgtccggcacgaagcaaccttattcatgaaatcatcaatcgctgcttcgtttacgaatgtagtaaaacttttcattttggcctcttaaatttctacctgtttgatcgcgtagtcgaatcgttcttcattgtagatccgcacacgttccatagcatgtttcataccgtagtttgtcgcactgtatttatttttggctgtcttagactttgacagcgtagccaggttatcaacgatatcccatacagtagcgagcgctttcgatccgtgcttacgaagtacacgaccgatagactgtttcaccacaacagcagatttgcaagggtgcgcaaaaatgatgtggtgtaggttcttgattgagatacccgtactcagtaccccgatcgaaccgatgacgattaaacctttcgtcgattccgcgattttcttcatttcgttacgatcgtcaatatctgtatcaccattgaccaacaccacgttatcgtaaaccttgctcaactgctcgtacagccattttccgtgctctttgtaccggaacatcacaaaggcgttttcgttcttctcacgggctaatttgagcgctaattttagaatccacgcgttgcgccgtgtgtggctggttacgtacttgatttccgtctggtagtccgcacccttcaattttttgacctcttcttctttgtatcgaaggaagatcgtgttaattttcaggttggtgacttgtccatcatccatcaaacgacgcgtatcaactggtttaaagactttgccgaacgcaccgatgtattgcatcatgttcgttttcccttctttcagggaaccggataagcccagtttgaagatacattgatccatcgtgtcgataatctttttgatgctcatgcctgttgagaggtggcattcatcaaccatcaaacacatgaactgttggaaccattcggcaggcattttaaccgctgattgccaggtagaaacgtaaatcagtgcattactgtttttcgctgtaccggaacggatacccagcattgccgatttcgggaacaaacgatagtttgcgatgtcctcgatcatttggtcaacaagtgcggtagtcggaacgatgatcaacactttcccgctgtaatgttccagacaccaacgagagataagcccctgaatcagagatttacctgctgatgttggcaggttcagaacaccgcgacggtttttgataccgtggaacactgattcgcgttgataccagtacgggtcgatctgtttgtcgccgtcataaaccggatgttcgctaacccacttatcaaaatcttcttgcgtgatatcctcagtttcgtggatctttggatcaacccagattgaatacccgcgtgattctgcgaatttggataccagataggctaacccatacgggagtttcccgttgtagtccatcaagtaaatgtaaccgttccatccaccatatttgtatttggcctgatactgatagcctgggggctggaagctgaaatagtcacgcagttcatagacaatgtttggttctgcctgaatctgtacgtggcttgtgtttaaaaatttgacttcaatatccactatgattaccctatgtacaaagtatatacgtatttatgtcataaatattggataaacacttggagataccaatgaacattgattacgaaaaagttgatgggttccgtaccctcgacgcaaaagaacagaaaggcgctttagccgattacgctatgactgtgtttgcggttaagctgaacaaacaaaaatccttcgataacatgctggcggatctggttgctgctttaccggaagatgaagaaaagccggaactgctgatcgattcaccagaaccggaaatcgtcgcatataaaggtgaggtgactatgggtgaacctgtcatcgaagccccgaacgttcccgatgtggttattgatgcttctgcggattttatggagtacgttaaagaggtcgcgccggaagtagccgatcaaatccaattagtacctgatgtcgtagaagctcctgtaagcgcttctgacgagtccaaaggcgaactggtatggttggaagggtttagcccgacaatcttcatgatggggcgctctgcgagttctaacgggtattatacctgtccgtggtggatctatgactggattaaacaaaccccagactggtacaaagatcctgatagctgtccacatgcaagcgcaatcgacacaatcaaatcacttgcgttctatatcgtgcgcgatggcgaagttcgtgttcgcgaaaccagaaatagccgattcgaaacatttaagttttagcactttttgctaaaaaacttgttgacgcataccctcgtttaaagtatatttgtactcgaaggcgggggaatggctctcgcagtgaagaaggaaagcaaaatgaaaaacgaaatgatgaaaaatgcttactacccagttctgtttgtttgggctgatggtaaagtgaagaaagtagtcaattcaaatgctccttactatactgttgaagaagcactgcgccacgcttacgaagctgattatcctgtccctgctgaacctggttatgctcgttggaacggttcaaaatgggttgctgatacctgggacaactacgaagaagcaaaaatggaatgcgatcctgattatgtttctcgccaaatggaagcgcacatgattgcagaccgtcgcctggataacgaagctcgcggtttctattaaaattcaaagggggctacgcccccttttttgtaggtaaaatatgactgaattaaatcacgaatgcctgaaagacttatcagaaggtaaagagatcggaaacgtcatcttccttgatatcgacggcgttctaaataatatgcggtgcatgaaatttggtgagcatatggacattgaatgtgctcgacacctgcgccggatcgtaaatcatgcgaactgtgatattgtcatttcctctacatggaggatcggcaacacaacccatactctacgggaaatcttctacccgtggggattgtatcgcatcattgggaaaacctgtacgaatctaacagaccgacaagcaggacgcggtgatgaaatcaaagcatggatcgacaccttcggatgtaagaattaccttatccttgatgacgataccgatatgctaccggaacagagtgaacatttcatcaataccgatgggttcgtagggctgacagaagaacaatccacttacgcgatccgtaatgtgttcggtgtaacaaacccgttctgtcctgaatgcaacggctatgggcgcgtgaaccaatatgataaatgtccgtcttgtgacggcaaaattttacttctctaaatagagaaaaactaagaggttttgaaaatggctacagaaaaatggactacggtacacccgatcccgtggcgtaacaccagctttacctatttgccgtggtggatctttgatatcatcgtggctgcgaatgctgcaagcgaagactggcgtgattatgccgaagaaaaatacgcgaaagaattcgacacactgaaacaggcgtatattgattacaccgatgttgatttcatcgaatcccgcaacggttatctgtataagctgagtgattttactcctgctgatcctgtcgtaacaattacaccaaaaaccgctcctgctgatttcaaagtaggtgatgcggatctggctgcaactgatctgtttaccatcgatccttctggtacagaaatgactctgagtgttgactcttccggtcatggttctatcgttggtggtaaacttcatgcggttagtgaaggtgatgttgtcgtaacagcaacctctggatctgttactgcaactctgacggtaaacgttaaacctgcaccataataacaactaagaaggtaaaaatgctactatttgaattcaatgatgtattcgcaaaattcagcgacgcaatcgaagccaaatttggcaaacgcccacaaaacatgacagatgcagaatatgaagctgctgtatcgtccctggttcgtacagatttctatgaaaaactggcgatcgaggtgttgggttgggatatgatgaaatggggcatgacctatcgcgatcgcgaagtcggttttattctcgtcaacgaagcaaaaagcccgtcctgggtgaatagtcaaaaaatcgcgtacatggataaagtatgcgcacagatgggtattgtacgtttagacttctggacttgtcgggatctgaacgaactgaaagcccacgcttaccgttgccctctgatctcccgcaatgataagcatcgtcaagcatgggatagcgcagggaaatatcgtagtgttttcctgaacgacgatatgaacatcactattcatgatgtgaaccgctcctttgcggattacacaccataaacaaaaaagggaaccgcaatggttccctttcttttatgcaatttttctgatttctttcaatgcttcttctttgctaccaacgaagagaatcgctttacctccggcttttctgaatggcaacacagcttttgccctgtcatcaatcagtatacctttgtccgcatatgctgctttctctccgctgcttttggtgtagtggaattcaggcagataaccgaacaccttcatcaacgcttttcttttttgttctgctaccgcatcggaattgtatttccctacgctggttaagatcgcaacctgacctaaagttctcaaatgacagaacaggtcgatgccctcttgtaatggttccagattttcgtagaagtcagtttgtgatatagcctgtttcgcttttttcaattcttcttccggcattctcgccgggtctccgtacatcggaacaaaagaaccttcccagttgaacagtacaccatccatatcgaacaaaaactttttcatatcaattcctcggtttgtgtgtgcatcatattcatatatgttcctattgtcaaccccatgtatcagttttcggtgcgtatgctgcaactttagccactaactctttatcaagctggtcaatggatttctgcggctttccttttgccttaactttgatgtagttagacttaacgacaaacataccgcctttgtcagatttcttgatttcgctgtcaatgcctactttgttgaagctgatccagatatcgccgtccatgtactgtttcagagagtcgcccatattcaggatcttcgccatagtgagcgctgccccttcgtgggtatccatgaggatttctttaggcactacacgatcgcgtttaaggttctgctgcatagcaatatgaacatcgttcataacccaaacgatatggatgttttctttctgataacccagcgcttcaacatcacgggcgatacttgccagcttgctcatgcttttcagggttacgtcaaagatcaggtttggtttacggtcttccggtgctgctgtgataccagcgtacacacgcgcctggtttttgttggatacgttgaacacgtctgcgatcacatgatgcagtgttgctacgttgtccgggtttttcaggttcattgttttgacatcgtgaccagttttcgctttgatctctgctgccagtttggtactacccatgaccaattttttgagtgcgtcaacgtccagggtgatcccttcgatgcctaacagcttttcgagggtgaaccctttaccagaacccgcgccgccagccaggatgactacctgaccaaatttaggataagccttaccgccgaaggtgatcagcgcttcatcaaggctcgtaaagtctttgaatgatttcatcttagaactccaggtgtttatttaaaagtatttattgacacggtttatgagtgtgtttatagtgcaattgttcgacggataggccggaagaactttaaccataaggtaacaattatgaaaaatgaactgcatgaattcatcaacgccgctgctcttggcgaccagtcaaaatataaatcccgtcgcgataccctgattgacgatttctgtaatctcttggggttcaagcgctggcataccccgtctatgcgtccagattgtgatccaaaatgggattacttcaaatggagtgctcgcgatcgtggttacgtcgataacgtccgcgtaatgtctttcaaccacttatacgcaaattcaacaattgctgttgctaaacgcaacgattcgacttatccgaacgggtggagtgttgctaaagtcatagaaacacttcttcaactgcgtcgcgaatataaatcagcataccgtgtcaatcccaatcctatctataatgaatggcaaatcgtcgcgaaatacctgctgaacatcacctattctattttctgtcgcttcgggacaaaagagattggatttggctctcatgatataattgcagaagcacgtcaccgcatggtctacgcgatcctaaaaattcaaaactctggtggtttgattctcgctgcgttctgtgatgaaattgtgtactatggtgaacaggtcgaagttgatgatgttcatcatgaaaaattcaaaagatttgtattcgggcaatataacagctattcatatggaaacgatattcgtgtgatgatgcacccgcgcattatgttggatatggaagggtgggaaccaggtcacggaattggtgatgccgaaagccaacgtgaacgccgtgttcgttcagttgctaaaactcgcgaattgatgacgggtcgccttactgattacctgttcagaacaaaagaagacgttgaaaaagaatttgttgacttgtcgggcgaatagcgataagctgtaatctctgaaaacaaggagataaccatgaataccattcactgccgcaaagagttcgttgagttctatcacggatcatgtactgctgccggaatcgaaagcatgttgttgcctccttgtgattctgatactctgtctgaaaaaggcagaaagaaaaatctggatcgtgttttcttcactgctgatatcgggctggctcgtatctatgctggaagggctgcacgttcaataggtggtgatccggtactgtatcgggttgtgtgtccggtagatgtggtatgcatgaacgatgacaaaggcgcaagcgtttatcatgctgcatgggctttctgtgaggaattatgaaagataaggtgttggcgtatctcgttttcttgctgggatatcgcgttgaagtgatgggtggttattcttctttgtatggggatttaaccgcgatctggatggttgcgttgggggttatgtttacctttatggcgatctgtattgcgaatgaggctgatcaaaatgcttgaattttatcctgctggttgcaaatcaaatccgcctgatgcgtcgttccaatcgtggatttattttcacagggaactaaacgacatcatcgaaagtcagtggaaagaccatcctgaacgaagtgcccccgatttagtcgatagcgtaacagatgtacgcaccctggaaaaagggctgtatgattgtctggttcagggaatggtgtgtaaattgattttgtggtatgctccgatcggttcagatctaactcgcaaaatcgcccgtggctatatcatgacgaaacgtgagtttgaccagatctggaacgaacccgactgtttcgaacgcgaaaaatatgaaaatgaggttagttgcatatgaaactatttcatgttgtgtatggtgggatgaaaaatatcgacatcgccgcgttatctgctggtatgctggacgaactcgaagcacagatcgggaaacgcttcaaagccagtatcaccgaaacacaaactttgtttgtcgatcaccctgcggatatggaaaaccttgtcaacactctggatgatctgatgatcccgtgtgctgatggttggaacgaagcatccggtgttcatgtagttgtaacttttgttctaaaaaatgttgacagcagaaatgccgaagtgttagagtttattcgtaaaattgattctactaaaggaaagtaactatgaaaatcgttcagcgtaatatcagcgaagttagccagcaggaaaaagtacagattcattttaaattcaatgatctgaaactgggctatgcacagatcgcccgtgagcacatgctcgataacggcgacatttacgtgattgttcaggaaatcgagcgaattcgtgctttccgcgcagaaaatccaaaagtgaaacatgttctgcgtcgtgtgtatatcaacaaacatcgtgaagaacagcgtaagcctaagaccaaagctaaacgcgatccgcgtccagataacaaacgtaaagcaatcaacggcgctatggcgctggcgttccaggaagcgggtttggtgtaaggggtttatatgtcttcaatgatgaatcgctggtcgggcgtgataacttcgactatcaaaaaggatttggtgaaggttgaagcaaaaccaaagccagtagaaccggaaaaagttcaaactatggtatcactcgatcctgctgagttagaacaccgccgccgtgcaaagcaaattgaattcgatctgcgtgtcgctcgttcatacaacagtaaaaacgatgatgcgcgtaaccgcaaccttcaatttgctctgacgttaagcgactgggcgaagctaatgagtgaacccgtatgttcttactccggcagaccgtttagcaacaaaggcggttgctctgactcccgaacaatggaacgaatcaacgcttctctgggatacacggttgaaaacacgatcgcagtaaccagcgccgcgaatagcgagaaatcaaatctcgatgcgtttatgaagggttctgtgatccttccagaagtaaaactgaaactgttacgcaaagctgcgtatcaaattgaaaaacaactgaaaatcaagggttaattatgtttgtgaaatattcttctctgactaaccattatgaaggtaaattcatcaatggtgtgatcatgaatggtttgactggtggcgtatgggttgcgcgtgaaaagatccacggggctaactttagcctgatcacttcggacggtatcaaagtcattccggcaaaacgtagcggtgaaattctccctgctgaacagttctacggttgcgaacccgtagttgcgaaatactccgaacctgttcgtaagatgtgggaaatgatctctactgcgcgtcagttaagcggtgagtatagcgatgaactggtgatccaggtatacggcgaattcgcggggcgtggtgtacagaaagatgttgactacggagaaaaagatttctacgtatttgatatccgcgtcaatggtcagttcctccctgataacgttgttgcgaattacgctgttgctgttggcttgaaaatggctccactgctggcatacggtacgtttgacgagatccgcacactgcctatcacctttgattcggtggttaacctggcgaactccggtgcgatccctgcaaagaacggcgttgaacctgagttcaaaaacttcatgacgctgaaagatggtgaaggtgagaacatcgcagaaggtttcgtgatgaagcctgttcaacccgctttcatgccgaacggtgaacgcgttgcaatcaaatgcaaaacgacgaagttcacagagaagaagaacaagcaagcgaaccgcttcaatgctccttctgaactgtcagaaacagacaaagtgaagctgaacgaattcacctgctacctgactgaaaaccgtgtgaaaaatgttctgtcaaaaattgacagcgcgaatctcaccgcgaaagatttcggtcgcgtgatggggctgacggtacaggacgcgctggaagaaatcgaacgtaactacgggcctttcctggaacagttcgaaaatccaacgctggcgaagaaaaccttcactaacgaagcgtcaaatctggttcgtgagaactggggcgcaatcctgaacaatgaattttaaaactgttctcgaaaacgcaaaaacggctaccctgatcggtagccgtgaaccccctgaacgtatcgcgagtatagccataaagattggacgtgctttaagtgatcgggggatcttcgcttactctggtggtgctcctggaatggatagccatttcatgtttgactactcaccagaaagacggcgtataatcctccctgagaacggttttaacgggttgtattcgaatggtaaggatatcatcgactatacagaatacgacacgtacaaagccgctgacgaagcgagaaaggtagctggacacttcgacaaccaaagcgaatggacacaacgccgatacgctcgcaattcaatgcaggtattaaccgaaaacctggacaaacctacagattttgttctattctgggcggtagagaaagatttttgtgttaaaggtggtactgcgatcgctgcaaggcttgccagattgtataaagttccaacgttcaacctttggaatcaaaacgttctggatgaagtctgcgatactttagggattaacactaaacctcctactctggattttctctggtgataactcccgaacaatcacgtaattacgaacgcctcgcagttgaagaggcattaaaaaaggcgaaacataatggtagaaatcaatggaatcggtgtgaacgcacaggcgggaagcgggacatcgtgggtcaaacgcgaaacgcaagatgatccccgctgcggacgtagcccgacactggcagaacgtgcgcgtaaactggttgacgaaatcaacgcgaaaatggtcgaagcatcccgcaaagacatttccgagtatgtcctgaaatatccgactaaacaatcatatacctttgatatgaaacgttttatcggtaagactatggatcaggaatgtaccgaaaaagcatatgcggatctgggtgaatggttggcggaagaagggtttactttcgatacacagcgcaaccgacaagctgcgttactcaataccttcgcgggttcgcgtcgtatccagaccaattttagcgatcctaagcgtgacggatatagcgatctgacttattacatcacctggtgaaaataattcgaaaaacttgttgacgggagttatgagtgtggtaatatagctcccgtagacaagacactaacccaaaaggaaaacatcatggaaatcaaattagtacctacttgcgctggctactgcttggcactgaatggtgtagcacacaacggtaaaggcttacgggctaacgttgaagcaatgctgaacgaactgggtgcggtttatgaatatgatgacgttgcaaccagcgttaaaatcataagccttgaaaaagatggtgttaactgtgcgggttggtgggattgctacatcgactatagcgacaaccgggtcttcttactgaccagcaactaaggatcgagcatgagtgaagcagaatatattgatagctggggtggctacgacgatgacgatgatgatttttgtggtcataatttacgtcgagaaactctaaggcttttgcaacaagcaaatgcgccgaagcaagtcaaaactcctgttaaatattccgatggttcgattcgaactgaaacggttgtcaaagaagtaaacgggcgtgtcattacgtccgagcggcagaaggacatcaaacaattgtacgatgttgcaaaagccgctaaagtaggaaccatgatcacctgtcctacgtgcaaagagttgcacaagaagacgacatatcataaggtgttctgctctaatggtaaaaaatccaggaaagactgtaagagtaaatactggaacacgatccatccagaacgtttggatcgtatcttttaaatcaaaacgtggagtacgtttaaatgaaaacttttaatgaactgaatagcctgatcacctcaactgattcctacaaagtgtcccactggttgcagtatccacaaggcactgatgcagcgatgttctatattgaatctcgcggtggtaagtttgatgaagtagtaaccgctggcgttaacttcgttgcgcgggttcttgctgaaccaattaccatgaaacaagttgagttggcacgggtactttaccgtaagcactttgggaaagagattttcaactacgaagggtggaagaagatcgcagaactgggttatgtccctgttactttccgtgcgatcccagaaggtacggttgttccggttaaaaatgccgttgcgactgtgtacgccgaacatgaattctcatggttggctgggtggctggagacaatgacgattcgcggtatctggtatccgtcatctgtagcaacgctatcgcgtgagtgtaaaaaggttctggctcattaccttgatatgacttctgacctgactggtgaagcatataacatcacactgggtacacgtctgcatgatttcggggcgcgtggcgcgacctctgctgaatctgcgggtattggtgggctggcacacctctataacttcatcgggactgataccgttgaaggtatgattatggcaatcagtctgtttgcggactatcaaactctgtttgatgaagttgaaaacgtcgaagcaatcggtgtttcaattccggctcgcgaacattcgactacgatttcctacggtaaagagaacgaagacgaagcatacaaaaacagcatcgaaatgttcggtacagggttctacgcttgtgtgtacgattcctgggactacaaaggcgctgtagatcgcatcgctgaatataaagagcaaatcattgctgctggtggtactctggttgttcgtcctgattccggtgatatgattgataacatcatgtacaccctgcgtaaactgggcgaaatcttcggttacaccgtaaacagcaaaggttacaaagttctgcataattcagttcgaatcatccagggcgacgagatccacgggcctgaaacaatcaaccgtgtgttaagttggatggaagcgaacaagtgggcgagtgagaacatcgcgttcggtatgggcggcggtttgctgcaagaagttacccgcgacactcaaaagtatgctgaaaaactgtgcgctatcctcgtgaatggtgtgtggaaaggcgtttacaaatgcccgaaaggttccgaatggaaacagagtaagaaaggtttgctgatgaccatcactaacggtgtggaattcaaaacaatcgacactctggaaactgagattcctgacgggtggcgtgatgcgatgattacgtattacgacaacggtgtattaaacacctccgatacagtaggggttatccgtgagcgagcaaggatttaatatccgcgccaacgataacggatcggtagtcttctacaacaatcagccccttgtcgctcgcaaggggcttttttgtaagttggtgggctacgggttcaagttggaacaggtggacaacgcgacactaaaagaggttgttcgaattgcttatctgttgaaagataaaaaagatgaacaccgtgctattgcaatgcttgagaaattaggcgaaaattattgcttcgtggtgaatcgtgggtataagtacgaaacgatcgccttatttgagaaaggacttggtgaattatgattaccacaatcaaagaaggggttgacctccatttaggcgactccgtaaagctgattaaacagcttgaatctggttctgttgacttgaccataacttcgcctccgtatgacaacttgcgccattataacggctctggtgatgtctggggtgaacacgtatggaaagagttgatatcggaactgtaccgcgttaccgcgcccggtggtgtggttgtgtgggttgtgggtgacgcgactatcaacggtagtgaaacgggtacatctttccgtcaagccttgtacgcgctcgaacaaggttttcggttgcatgatacgatgatctatcacaaaaccgctctaccgaagaaccataaccgatacgaacaggactttgaatacatgttcgtgtggacaaaaggcgcaccaaaaacattcaacccgatccgcattccgtgtaagttccctgaaaaggaaaccgcacgacaaaacagctacttttccgaaaccaacgaaaagaaccgttcagcccgttccggtaagaaacgtaaacctgttggcaaggataaaattaagggtaatatctggtattacgctgtagggcgaaatcactcaacgaaggacgagattgcattcaaacacccagcaatatttcctgaacaactggcagaagatcacattaaaacgtggacggttgaaggggacttggttcttgatatattctctggctctggtacagtgatgaaaatgtcgatactaaccaacagacggttcaaaggcttcgaactgatggagaattattatcacgattctattcttcgtgttcagccatacgttaacaatctggaatcttttctatgagttatttgggtgttatcccctatacaggcaacaaacagtcgctattacctgaactcttcaagctgttccccgaaagaagttcatacatgcgtttcattgattgtttttgcggtggccttagtgtgtcgttaaacgtccctaaacccgttctaagcaacgattacgataagacgctgattgatatgtatgagcgtcttaaaacgcttcctgacctgtctccggtgcgagaattgattgcatcgaagggtctggggaaagacaagaaagaagagtatttgaaattccgtgatgaatacaaccagaacaaagatccgttatggctctatgtcctgatcctgcattcattcagcaacgttaaccggacaaacgacaaaggcgacttcaacgctaatttcggatgccggacgctcaacgatgcaacagtaaaacgctttgaacatttcaaaaagaatgtgaaaggtattgagttttccagtggttcattccgtgacattgatatctgtgaaaatgatttcgtgtactgtgatccgccgtacctgatcaccgatgcagtgtataacaagttctggaacgaagatcgcgaacgcgagttatatgctttcctggatgaactacacagcgaaggaatcatgttcggactgtccaacgtgactcaccatgccggaaaacaaaatgatatcctgattgaatggatgcagaaataccgcgttcataatctggataaaaagtatctgttaggccagcataccgactcttacgagcaaaacaaaacgcaagaagtctacgtgtgcaactaccagaaacgcgacgtaaatacattccctttaacactgaacgatttaatgtaggttaacatgtttaaaatttatggctatatcccttctgtgtataactgcgctccatgcctgaactcaaagcgcttgctggacgcgaaaaaacatccgtatgagttcgtgtctgttgcggattccgtggaagacggtaaacctgtgctgaatgaagcggtgatcgacgaactcgaagccctggttggtacgcgccggatgactatgcctcagattttccatgacgggaaacacgtaggcggattcgaccaacttcgcgagtacgtccgcaccctgtaataaataatgacaccttactgaatggtgttattatgctgacgaaacgaattaccaaaaaagactacccgactatcaagcaagccctctttgaaaaacaaggtgggcgttgtgctctctgcaaacgtcctcttgagggagagatcgagaaacatcaccttgaccatgaccatgctttagacggcgaaaacgccggacgtgtgcgcggcctactgtgtaacctatgcaacggtacagaaggtattgtgaagcacaaattcaacagatccggtctggtgtcccgtgatgttgattacatccagtggttagagaacttgcttgcatatctgaaacaagactattccgaaaaccgtattcatgacaaattcataccagataaggtaaaatggttttcaagacttaccaaacctgatatgattgccgaaatggtttctatgggctttgaatacgcagacaaagacgaacgcaaagccttaaccgcaaaatatagaaagcaattaatgaaggcaacgaaatgaaagtagaaaaacgagacggcaaagccgttgattttgacaaagaaaaaatccgtattgctgtagaaaaagctggcgggactatgacggatgctgatgccgcaatcatgctggttcagtacaatcagatccgcgatggtagcgcaatgaagatcgcccgtatccaggaactcgttgaagaatccctgatgaaaacgaacccagcggtcgcccgtgcatacatcgaatatcgccacgatcgcgatattgcccgtgaacagaaaagtaagctgttcaaagatatctccggtatggtgaatctgtccaacaaagagatcaccaacgagaacgcgaacaaagacgcaagggtattcccgacacagcgcgatttgctggcgggtattgtagcgaagcatttcgcccgtaatcatatccttccgaaacatatcgtagaagcgcatgactccggcgacatccattatcacgatctggactatagcccgttcaccccttacactaactgctgtctggttgacctgaaaggtatgctggagaacggtttcaagatgggtaacgcggacattgaaccgcctaaatcgatcggtgttgctaccgctctcatggcgcagatcaccgcacagattgcttctcaccagtacggcgggacaacctttgcgaatgttgataaagtgctggctccatacgctcgtatgacgtatgaaaaacacgaaaaaaccgcaaggaaatacggtatttctggcgatcgtacatacgcgatggaaaagactgaaaaagatgtttttgatgcgttccagtcttacgaatatgaagttaacaccctacatactgccaatggtcaaaccccattcgttaccatcactttcggtactggtacgggtatgtttgaacgaatgatccagaaagcgattctgaaaaaccgtattcgcggcctgggtaaagagggtatcactccggtattccctaaactggttatgttcatggaaaaaggaatcaaccttgatccagaggatcgcaactatgacatcaaacaactggctctggaatgtgcttctaaacgcatgtacccagatatcattagttcggctaataaccgcgctattactggttctagcgttcctgtatctcctatgggttgtcgcagtttccttagcgtgtggcatgatgataacggtaatgaagttctggatggacgtaataacctgggtgtggtgacaatcaacctcccacgcatcgctattgaagcggaagcacaggaaaacgaagacgcacacgacgcattctggcgcatccttgatgaacgtctggaactgtgttttgaagccctgatgactcgtatcgaaagcctacgcggtgttaaagccagtgttgcgccgatcctatacacagaaggtgcttttggtgtccgactgaaaccggatgatgaaattctggaactgttcaaaaatgggcgtagctctatcagtctgggttatatcggactgcatgaaacgctgttgatgtttggttcaggccaacacccatttgatcgtatcggctcccagaaattaggccgattgatcattgaatatctccgcgctgcaaccgaagcatggaagaagaaaacaggatatggattcagtctgtattcaacccctgcggaatctctttgccatcgcttctgtaagctggactttgagaagttcggaagcgtcaaaggtgtcacggataaaggctggtacacaaacagtttccatctggacgttgaccgcaaggtaacaccgttcgagaaaatcgactatgaagccgattatcattacatcgctactgctggtcatatcagttatgttgaattccctgatatgaaaaacaacctgcaagccctggaaaaagtctgggattatgcgatggaaaaactggactacttcggaactaaccttccggtcgataagtgctttgtatgtggctctgatgacgagttcacgcctacagaagaaggtttccactgtaagcactgcggtaatcacgatccggctaaaatgagcgtcacgcgccgtacatgcggttatttgggtgctcctgctgtccgtggattcaacgaaggtaagaacaaagaaatgatgcaccgaactaagcatcaaaattaatcaaaaagccccttgcgaaagtgaggggcttttgttatattgcacataccgaaactatgaggtattgaaaaatgatgtactggacaaaagactattttgaatttcgcgatgaagaaagttttgggactgtataccgcaatttagctttgcgtggtagtcctctgtcgcctaatcaactttcatctgtcgtgtttcctatcaaggtaacgcactgcgatcggaaaggtgtcaatgggattgttgatgccaatggcacaacatggtattccgaagattcttatctgtttgataacgaggatcgcggattctttaaaaagtttgtcgcgcttaaacctgctgttgaaaaagccgacgcgcaacaactgctggattgttctcacctgctggggcgaatttacgtagatggtaagctggtgacgaaacctggcgatctggaaaaattcttgcgtaaggcgcgggaaactaccctgaaagacaccgaaaaacgttatgatactgcaaccgccaatctacatcgtttgtctggtgaactgaaagttctacggggtgaatgatgtttccattaaaggcgcgggttcgcaacaaaaccggaacacaagaatggatggagtgtttacgcgaaactaagaactactacatttcacaggctgtaggctatgacggaaagaacatccgttataacaaagtaggcggtaaacgtgtggggatggaacaatatctccaattagaaaccgtccggcctgtgaatgttcctttcgatcttaaacgaccaaacggaaagccaacgatatgatcgggaaaatccttgatactttgtttcccttccgtgtacgcgcacgggtagaacgggaaaaccgactcgaagaaatccggttcaataagttccttgaggacaaaaagaagcgcgaagacgagaaacacccaaacgcggtaatggctgagggtgtatcgaaatgttctgttgggcggttctgggttgaaaaggattatcttgatctgataggtgcaattgcccctggcgttacgctggaggacttctcccgcgctactgggcgttcgtatactggttgtatcaaccgcttgcgtatgctctctatagtggtgcgtagtgcgcatttcggctatcgtgacgttatccgtccggtgatcccagtaagcagattaaaattttacatggcgggtggaaaaagacttgacttaaccaacgaactatgtaaaatcggttatatcagagaggggaaagttgttaaagcccctgaatggttcaccaatcaattcgaaatcaaataaggcaaaattatgttcaagaaactcgtatcgttcgtgactggtaaagttgaaactgcaatcgaacaaaacacttccccagaagaagcatggcgcagtgctgcacgtatcctgatcaaagagatcgaccgtctgcaacatactcgcgtttctgctgttcaggaaatcgcgaagctgaaaaagaaagttaccgaacacaaaaaccttcacactggtaaagaatcagagatcaaaaaactgctggcggcggggcaggaagtgtccaacagtcattacgtgctggcgctgcaacaccgtaacatctggcagggcttacagacgaagatcgaagaactggaagggatgaacaaagagattgatctctctgtcgtcgaactggatcgcaaactggctgatgtcaaaatcaacctggagatcatcgaactgaacaagcaaaccgaaagtctgggtctgactgtaccggaagacgtgatcgccgctgtaggccacacttccgtaagcgtcgataccatcgtgacgaagattgatgtgttgctgggtggcaaaaatgccgcttccgtaacctccgctgacgttagcgcttacatcgactccctgaacgcgaaataagaggaaggggcgaaagccccttttttgctatgtacgattacactattgaacgtgatcgcggtgaagaatggttgatttctcgtgcgagaaacttctatgttaaacttcctaaaaactttcatactttaccgaatgatgatactgatcgcttattgaggattcttgtagatgggaatgttccacagcgcgtttttcaggaaatggttgaacatgcgtgttctgaatgggataaaaagtattgcgaagaactgacgcatgatagtatagtaaacagcaacctaaaagacgcttacgaacgaagaagtgtgtacgacatttacgaaaaagagaggaaaagtgaaatgatgttcgaagacggcaacagtgcattcaaaccagcacgtaaaacttatccagactggcgcaaacagtacgcagaacagctatggcacattgacattcccgaagcgctcatgaaagcgattagccctgcggttgactactattcaggctggaaagatgaatatgagttagaagtcggttcgtttaaggcgcacgtcatcaaagcgaccagaattcttgatttcgttgaagctgttgcgtcatgtgatatcgttgaagatattcgtattccttcaatcaacgtttcgcggtatagttctccgggtaacattcgcggggatcgttatgcgaacctggcaagcactacggataagctgaacttccataaaatcaatgaaaaaggatttgatggttgtgttctgatctcaatggtggttgtcacgacacaaggcgagtacaaactgatcattgattgtgacaaagcggctcgtgcaattcccacaatcaaacaatgctttggtgaagatttcaaagtattgatgaaagcccgtgcgatggaaaagttcatccattcgtgcaaaaagaacgtgctggagaagtatgatccggcgctcacatacaccaaaattgataaagatctggtaggtgatttatgctgattaacaaagcgcagtgcaaagcgataaactttcttctgcacgaactgattgaaaacggtatcaaatttgaattcgttgatccgattaacggtgatgatcgtcatctgctccgctgggtgtctggtagcaatccgctggattcagtatcccaggttgtagagtctgcgcataacaatatgccttgtcgtgttctgttgggtagcgttaacgcctccacatggaatggatctgatgcttattatgtcggattcaaaaaagagttgacggacgacgaatgatgttataatatgcccctgtagacaacaaactataggggctaaatcatgaaaatcaaaaatactgctactgaaaatctttgtaacgaaatcgcggtgacttactggaaagaaggtcacgtaaaagcaatgaaggattttcaacagtggtgtgatacccagaagttagccaactgggaatacgccgtaatcgtggaacggatcaaagaactgatccttgagaagaaaggcactataaaatgattcaactgaaattagacacacaggcgctgaacaacctgttcccagaaggaacacaagcgcgaatggatctgcaagccgctgtcatcaagaacgttgttgacagcgttatcggtaagcgcgtaaccgaagaaatcgaaaacatggtgatcaagcacgtcaatttgatgatgccagccaatcacgaaatcgaaaagattgtgcataaagagtttgctgattacattcagaaacgttacgcatacagcaatgttttcgatatcaattcaggcggtatccgccagatcaaagaactgatcacgacaaacgttaaaaaacagtgcgccgacctgctggattcaatcaagctggaagcaatcaacgatgcaaccggaaacctcaaagcggacgaagaagcgtttattgctcgcgtaaccaaaaacctcgaagtaacggttcgtcaggaaatcgttaagcgcgtgaataatgaattcccgcaaattatcgacgaagcgatcaaagcccgtctgttcccagaggcgaaaggctgatgaactttgaccgcatctataacatggatgtggttaacggtaaaggaatccgtgtagtgttgttcgtgactggctgcaatcataaatgcgaaggttgctacaacaaatcaacatggaatccccgcaacggtacaccatacaccgaagagactgaaaacgagttgattaaactcctttcaaatccccatgtggacgggttgacgcttacaggcggcgatccgttttaccgcaccaatcatccgacgctcttaaaactgctccagcgcgtccgtgcgacgttccctgataaagatgtgtgggtttggacgggttacaccctcgaagccttacagggcgatacagaacgctctaagctgttaccattcattgatgttctgatcgatggacggtacgaaaaggatctaccgactaagaaaccgtttcgcggttcggataatcagcgaatgattgagttcaaaaagaattccatcgaaattaaaaatatcgcttgacctggttggtagttctgttaagatatccacatcgaaacaaacttgaggacgagaaaatgaaaaacgcaatcatcaaagaaatctgtgaactggttgatgtgtatggttggagtttgggcgctgcaaaagcagaagccaaatctcgtctggaagttgtaatcaaagcccgtagcaaagatgaatttgttactaaattgcaagccctctatgagagataatatcatgatcctgaatttcaaaacccgtaaagaagcccgtgactattgctggaagtggtcgatcccgctgaaaaacatcaccaaaggaagcggttcacatccgtggacggtgagaacaaaagaaacccgcttcgaaactggtaaagattacaagctggttgatgtcgaaggtttcactgacaacggcaaaaacattgcgaacagtgttcaatcaaaacagatccaccaattgctgaacggtgttgtaaacatcgcaagccgtaacggtgatcgctataccttcgatgctccggcaggtgttgctatgaacacccttcgtgcatgggaagcgaaatacttcacagaagttgctccggctaaagccccagcgccaaaacgcgctaaaaagccaaaaccagtaggcaaaccgtccgtttctcctgcaccagctaaaccagatctggattcagaactcgacggtggcgttaacctcgctccgacaatcgaaccagttgcgaaacctgttgcaccacagccagcaacggttgaagcgatgcctggtaactttgttgcaaaccgtccgtatgttctggtagatgtagatggtttcctgcgctctcataccgcgaataaacgcattgtgcaacacatcaaaaataacaacggagttctggtgtttgaatccgttgatggtgacggcgacgcggtgatttataaagatcgtagcctcccgtttgtaatgcatcgtgagcgtaagttcttccgtgaactcggtactggcacagttcaggcagataccccagcggttcagactgttgacattgccaaacagcaacgcgataaagagatcatcgaagctgcacaggcagtagaagacgcgctggcagaacaccagaaagcgatcgaagttgttgcgcagaaagctcgcgcagttcgtgaagccgccgcaaaacttgcattgctggaaagtaagtaatataattcgggggtgcttacggcatccccttttttatttgaggtaatcatggaattattcgctggaaaaacttacggtttaaccgtatcccctgaaatctttgcagagaaaacctggaaaacaggtatcgcaaacatcattcgtgaaaaaggttatgtgacgattgatcgtacctcaatcggtgagtttgaagatcgcgcgtttatcatggacggcggctacgaatatgaactccctgcatcattatggaaatggttcaaggaagtaacgccggaagatggtgaattcaccccagaagaacccgaagaggttaatctcggtaaaggggttgaggctgaaaacggtatgcgtatcgcaacgccggaagaggtttccgctggtgttaccggatcggatctgtgcctgatggatatccctaaattcacgtatcgccctgtacaggaaaaccctctgcgtgatctccgcatcgatccatcattcggggctaacctggaaacgttgagcatcgcaccgatgccagtacgtaaatctgatgcaatgctgcgtttcgccttgcaacatgttttcagtggtggtagcatctatcaaatcaacatggaatcagaactgaaaatgcaggaagaccagattgcaaacctgttcgatctgcacacccagttaaccgctgttgagaatatcgaaaaactgttaggcaaagagaaaaagcgcattcagcaagatctcaaaccatacgggaagaagaatgaaagtcgaaatatacggaatccccgaaagtcttcataactgttacgggtgtatacaagcacaaaaactgttgacagaaaaagggatagaatatacattttatcccgttctgaaagaagcgaaaaacgatctgggctttgaatacgatcgcccacgtatcgaagagttagcaaaacgggtaaggcaacgcagtttagcgtttcaatacccgcgtatttttgtcgataacaaacttatcggcggttatctgcaactgaaacaacttattggtgattaaatgagccgtgaaattttactccctgctgcaaatgctgttcatgctgaaacaatggaatacatggagaaattcgttgaacgcgataacaccgcgatcatcactcctactcacctggacgcgctcgaagatcgtcttcataagcagattaaagatcaatttcctgaaaaggttagccgcaacttcattcgtcaggaaatcgttgcaatgatgctgaaacattacggcgttgaaatcttcggtgtcgaaccactgaaaccgaagaaaccgcgtcaaatgcctaaacagatcaccgacgaagcaatcaagaaataccagaagaaatacgctaagaataaatgatctttaatacgattgaatgtgttccgtcaagtggtaaaacaaaggcgattctgaaccatatcaatcaaacgggcgaaaaagcaatcatcgcttcgatttccatgatgttatcaaaacagtcttatgactactacatcaaccaggtaaaagggaaacgagcggtgattgtggacacggatcaccgaaccaaaagaaccaacaatgacgcgctgcgtgaggttgtcaaagattatgatgtgatctttatcactcatgcagcactgaaaaacattgatgactttgatttgtataaagatttttctctgtacattgacgaagttcctgatttggttgcgttcgaaagtctgcgatttaatagcaatatcaagcacatacgcgagatttgcttgccgtttagttgcaatgccgatgatatcgttgatttaaaacttgacgaagaaaaacgagaactggttacacgattagcctatgatgggcttcgtaaacgtgatgatatcgcaatgaagatgttcccgctttaccgtgctctgttaggggctattccggtgaagatgcaatgtagcgattcgggatatgtctgttacttcgtagaggatcatgacgtaagccagtggaagttcaaaaatgtaaccattgcttcatccaacatcaaagacacgattacagggaagatcctgcaaacgtttcatgatgtggagttcaaagattcaccgcttcaaaagctggttgactttaagcaatacaaaaacactgggcgcatacatatacatgtgctcgcagagggggattattcgcgttatactggcgatctctctcaatctgggacgacagtatacacccagattaaaaaacgcgtggaggcgcttttagggggcgaacagttcatctactgcaccaacacgtatcgatcgaagtttagcgaggggcaagaaatcccgtacaactcgcacggattgaacttctattcaagttatactaacgtggtggcattattcagttacaacccgttaccctggcttcgtcaaatgttgcgagcggttgcggtgtcctctggactcgaagaggaagaattagttgatgcttatgttgtcagtaaatattacgaaccagcctttcagttatgcgctcgttctgatatccgacacaacaacagcaaacgaaagattaatttatttgtgcctgatatgcggttagcgaaatacatgaaggaaaaatattttcctgatgccattatcgaaaccacagaagcagttcaaacgaaaaggcaacgcaaatcatttcaaacccttttccaaatgacggacaaagagaaaaacgcttttacgccatacaagaaaagaaacaaattagattatgcgaatcctcttcatcacgcgattgttaaagattggctgaacaattaccgtgagaaaaaggcgacttgatggtcgccttttttgtttataaatatcagtattgaataagataaaggaaaacgataatggtagctaaatcattccgcgccacaagtggccttgatgctgctggcgaaaaagttatcaacgttggtaaagcatcacgctctgtgttgagcgacggcgtgaacgttgacttttttaacgaatttaacacgatccaacaatacgattctacccgtggttatgctgcgtttatggctatcatgtacgcgcgtcgtatttggtacgctcgcgcagatattccatcaccagcgggtgctttcgatgaaacaaaatggatctcaacccgtaacgatccaaaatgggtatataacaacgtaacgagcaatgacggtctccctgttgaatccggtacgtacttaatggctgacggtcgtttctctgaactgacctatattctgccagatgcccctgttgagggtgatattatcactattaaagatggtggtggtcttgcaggggttaacaacctgttagtgcgttcaaacacccgtcagatccgtttacgtgatattcagtcaagctcttatcgactgactcacccatatatgaccgttgcgtttatttttaacggcaacttatggcgtgttgctgaaatgcgtgataaccgtgattcgcagtttgttaatgcgactggtttaaccgctttccaaatgcaagcgggtatggtaacattccgtaacagtgggacgggtaaaattacgttgcagttgcctcgttacgcaaacgatggtgactcaatcacaacttacgatctggatcgccttgcttcggtgaacgttgcgactctgcaagtttatcctggtagcggacacacgatcagctatgacggtatcaataacgtaacctctgtgacttcacagcgttccggttatggtatcttcatgttcgatcaggctaataaccgttgggttgtttatgacggtgatcagcgcgttcgtctgcgtcgtatcagtgatgacctgaacatgttgcctaacgattacgtgttcatcactccgattgctggcaacccaccaactgtacgtaatgtaacgctgactcttccgcaagatgttgcagaaggtgatcgcgtatatatcagtatgtacatgatggggaaaacgcagaactgcacgatcaaagttaaagatggttccggtgaaaagatccgcaccaacaaaaacatgatgcagttcccacagcgtaaggattatccgcctaatgattggttcagtgttgacactctgactttcaatgccgatactgactatcttccatacatggaattgtcgtatctgaaagctacgaaagaatgggtagttgcacagtatcgcccgatcattgaacgtgtcgatccaacaaaccgttctcgtctgggtgtgattgcgctggctacacaggcagaagtaaacaagaaccatgaagatacgccgtctgatgaactggcagtaaccccgcgtacactggcgaataaaaccgctactgaaacgcgtcgtggtatcgctcgcctggcaacaactgcggaagttaaccagaacacgacagcaaccttccttgatgacgtgatcgtgacgcctaaaaagctgaacgaacgatcagcaacagaagatcgtcgtggggtgctggaaatcgcaactcaggcagaaacaaacgcgggtactgatgacactaccgcaatcacgcctaaaaagctcgatacgcgtcgtgcgagcgaaaccttagcaggtatcggaaaactcgttacaacgggcgctacgacagcggagggggctttacgtggggatgctggtacgaacgtctacaacttcaataacggtgttgaccttgtcaccccgaaatcattgaacgagaagacggcgaccgaaaagtcaaaaggtctggttgttctggcgactgaaaacgaagtggtaactggtgctgctgctggatctgcttcaatgccgatcgtagtaactcctgaaatgctgcatcgtaaaacgtctactgaatcgcgtatcggattgattgagatcgcaacccagacagaaacaaacacgggaactgatgatctccgtgctgtaacgcctaagaaactgaacgatcgcaaggctactgaatcgcttgatggtattattgccctcgctaccactgcggaagtttcagcaggtacggtaacgaataaggcagttgttccggttaagctgaaagagttcttcgacgttacgagtcatgttgcggttgcaactgctgatggtttaactcagtccggcactatctggacaacggttaacctggggattgcgtctgcgactgaaacacagcgtggtactttacgcgttgcgactcagggcgaaactgatgcaggtcttctggataccgtgttcattacgcctaaaaaactgcaagcgaagaaagcgacggataccgccgaaggtattattcgttgtgcgactaacgcggaagcgggtgcgggtactgctactaacctggcaattactccggctaccatgcagtttttgaacggtactgatccggcgtggggtgcaacaacaactcgacgtggtgcggtgtttatcactaccaaagcaaacactttcatcggtgataatctggttggttctactcaggccgttgacgattatctcgaagatttctatgctgtatcgcctcgcggtctgaactttgctctgcaaaacttcttaccgaaaatggcaacggcgcagaatagtttgagtctgggcggtgtggttgctgcaagctggatgcgtcgtgatgcaaaccagacggtaactggaaacaacacgtttaacggtacgagcaacttcgttggtaacgtaaccactaacggaacactgacggctaacgctgcggtaacggttaacaacaccgtaaccacgaacaataacattaaccagtctgcgaaagcaaacacggtgtatgctaatactgttctgagtggtgaggctgcgggaaccaaaaacctgcttcgtacattccgtggtggtgtgacggatacaatctggcatgaaactgttcaggcaagcacgtatcgcctggcgacgggcacaacggatctggttgacgttctgacagtaggtgatgtcggtaacggcacaatggcgtattccggtacgaacattcgtctgaatggtaaagctctggctaacatcaacacggcgggtgatttgtttgttgcgagtacagcaacgcctacggtacaattacgaaccgctgcaactaatggttggaacggtgtaacaatcagtaatgacggcggcacaaccactgcaaccgtgatcaacacccgaaactttacccagcatcttgacagtacctatgtcaacgtagcgggtgatactatgactggtgcgctgtcagttagcgtaaacggcacgggtggacgctttaccagtgtgagcggtacggcacatgttcaggcgggtgatttctctgggaacgtccagaaaatgcgcttaactggcattgacgataaggtattgactgagtttaacatcaatatcaccgattacaacaaagcgatgatcaacggaaacctgatctatcatgcaggtcgtaaaccaactccggcagaaatcggggcggtagcggtagcgggttcaaccgtcgatactctggttgtgcgtgactatatcaaaatcggtaacgtgaaaatcttcgcaaatccaacaactaagacttgtgaatttgtgtgggaggaataatttaaatggcgaataacgaatttatggcgttattcggccctgatagtttcacggcgaatgtgttttcagaagcaaacgccgtgaaatatcgccttgttgtccgtggaacgaataacgattctgcggtcaactcggttgaggtatctattaacggggctgatattataaacagacgaacacaagttgctcgcggaattaacctggctgtcattgatggaacaactttagcattattggattacaaagcattcgatatgtatggtgatcctgctacgaacgggaatgcgattaaagactacctgaattcacttccagcgaacagaattgtgtgtttttatactttcgatgctatcaaaagtgatgacaactttttagcaacaatgaggaaaattggttctgttgcatggcctgaaacacgattctttagtattccgacgacaacaaacagcaattcccaacgttcatcttattcagctatctattcatctacgatgaaaaagatctgtatggaaaactttgtgggtggttctggtacggggttgaaagacaatacaacgagttttgttgaagttgtgtttgatgaatttagtgatatcggggtaactggtattcctgaaagaatggttgatgatgtccagacataccagaacagcggggatatgtacggcttccatttatacggattgtggtcaatcggtaatgatgtttatctgggtgacaccttcaaatttactggggatctgtattgttcaaaagaacttcgtgatgctgggggagaagttcacctgtatatgtggacagaaaacggtagcggacaatggatcaaatcaaccattctcagaacaaccggattagcccctgatacatggcattcgttaacaggatatttcactattcctactgatgcggtaaatgctcgaatgggttcacaggtgtatcattatccgtcaactgtaaaagtcgggcttgctcagtgtcgaaatgtccaaattgctaaagtaccgcgcgaagaagtagatcgtaacggtgctgcgatcggtgtgaacggtatacgaatgcaaacactttccgaagtgactgcaacaggaacagaaaacccgattgaacaattgctttctctgcctgtttcgcctactggggttatcagtgacaagaagatcagttcgcataactttgctgaacttgattatattgtttctgatccggttgaatacacttcgacaaatacagcggagtaccagttcaaagaatggactgttacccagcaatcggcggtaacgaaagcatcactaagcagttatggcttaaaagctggtgatactatccgtatgcaatgccaaatgaaacgcgatgcgaatgcgattgctaacaataaaggcgcatatattgtaatgcagttctgggacgcgaataatacgtatatttcagggatcaacatgcgtgatgttggtacgatcccgaacgtatattcattctacaaaaacgaaggggttattcctgctggtgctgttacgtttgatttcggtttatatcgttatccaaacaacacaaacatcggtacggtatccgctaaagacgttaaactgtcaatcgtgagataaaggggcgaaagcccctttttcataaatacagtcattacaggagaaattttatggctgatttgaaattaggtacaacgctgggtggtgcgggtatctggagtgcttctaaccttcctctattgccctctggtggacaattaacgtataaaggctggagagtatacaccgaaaacgatcgtccgacagcggaggatataaacgccctctcgacgattaacggcggcacggttgcaaagaatactacattcagtcagaacgtgaatgtagggcaggtgttgacagcaaatgatattctttctaatactcgcgtacaaattgcaagaacaggcggtgcgggtgcaaacttaacatttcgtcgttatgacgttaccggaaccccttcttcggaaattggtatcatggatatcaacgtacacaacggttcaggtcagtttgttggtgcatttaacgttaacgcacgtccagacggcggtaataaaatatacttccgtgcatacaaagacggaacacagaatacattattaactctggattcacaaacccaacaggtaacagttgagcaaggttctttccgtgtaatcgggacttctaacctcggcttaacgaatgctacatcaatggcagttagcggtgcgattactgcgaatacagtaaccccgacaaactgggctaaccatgatgaacgatatatgacgggcattcctcgcggtatgtctggaacaagtttcggtgctgctgttgtaactgaaaagaacgatgttctgtcagtaggcggtaacatcaccgatggcccatatggtaacactacgtattacggacaggttgttaactatcgtcgtacactgaatagtggggtttcattagttcaaacatacttcgggaacgaaatgtggtttcgtcttggaacaggttctccgggcgcgtggtcgtggaaccagggcgatgctaatggttggcggcgtgtttatgatacggtcagtccaccaactccggcagaagtgggggcagtaaacaaagctggtgatacaatgactggtggtttagcgttacttggggatttgaccttccgaaatttggtaaatcgtcatattcgtttcgaatacaccaaaaacgacggttctaccgctgttgacgcttatatctataaagatggtgtagatagccctactcgtcgtgctggacttcgcattaactgtgccacaccgaacaaagcgagcgggaatacttcaaactcaggtgattttatattcggggagaatggtaactttacactacctggtggcggtatgattgttcaggacggattgaaccagggtgtttattgtatgagtgcattaagcacaaccgcaagtggatctaagaactacttacgtaaattccgtggtggtaatagcgacacgatctggcatgaaactgttcagggcggtacgttgcgttgggctactggcaacactgatgcacaggaatgtatgcgccttgatggaacaagtttagtagttcaaggaaacatcacgtcaggaaacaatttcttggctggtggtatcatgcaaacgaacggcggttctttgtatatccgaagctctggcggtactcatacgtggtatcaagaaccagacggttctgaacgtgctgttacatggtctgatagttctggtatctatcgaatccgttcaaacaatagcaaggctgctacatgggaatttaagaatggtatgatctattattctaccccagtaaacggaagtgaccacggtttgattcgaggtgttgttgatgctggcggttgggatcaatggactgctcgatctgctggtattctgctggatgtgccaaatatccataccagtgcttataatatctggaaagtgacgaagtggggaacctctcatgttgctgcgatggatattcaccgtcctagcgatagtgattcacagacgcgagttcgtattattacaaactccggtgcgtacttctactttaacggttctggtgaatttactgcatctggtaacggtagctttaacgatgtttatattcgttctgatgaaaaactgaaaagtaatttcaataagattgaaaatgcattagataaagttgaactgttgaatggtatgatctacgataaagcggatcatatcggtggtgaacctacttcccgtgaagctggtttgattgcgcaacaattacaatcagtattaccggaagctgttaaaactggcgaagatacagaaggaaatgaaatcttaactgtttctccgaccgctgcgatcgctttgttggttaacgcgattaaagaactccgtgaggaagtcagggaacttaaatcccgctaattaaaagcccttcggggctttttctttttataaatatcataaaagcatttgaggatctaataatggcagatttaaaagcgggtactaccgttggcggtaatactatctggagtcaggcgaacttgcctttgctcccttctggaaacacaatcacatataaaggctttaaaatctacaccgaaaacgataagccaacaaaggccgaaatcggattaggcaacgtaacgaacgatgcacaggtgaagaaagctggtgatacaatgcaaggaactttggaattacaaggttctgcaactgaattgaaattaccattcaggatcgcaatggttagggcaacagaaccgtatctcgttgcaactcgcacagacaataacccagtaacaaacgggtttcctagcgcagaaacacgcacatttgttatacattcaaaaaccacgtcaccaacgtcagatccaaacttgggggcaaaccttgttgatctgatttgtacccaacgccctgcgggtggtggtgcttattatatccgtgcttttggcgcaccaaacacgacaactggtgctgctggggctgtccgtgctgaattacaaatgttgggtgataatggtcttgttagtttaacggggacacaattcaacatcgggatgcaaaccgttgtcagtggcacgatctttggtgcgcaaatggctatcaaaggcgacggaaacaaaaacctgttcttccaggatgctggcggtaatgagcttagtttgatctatgctgatacaggaaagaacttatatgttcgtactggtggtggtgcatatgcaaccagatttgcatctgatggaactttagttctcgctaaccatctaaccgttcctggacaggctacgtttaacggtatgggtatattcaataaccgtgcttccgttgaaactgattatgctactcaaggagcaaacactgcaatacttcgagtaactacaaacggtgatggaaacggggttggtgatggtgttacccacttaggctataaagacagcaacggacgatataaccattatttccgtggtactggtgtaacgtatattaacaccaaattaggttttaacgtaaacgttccatcatattataatgatgttccccagggtacgccagcgcaatatttcttgcctactgttggacagggcgggaaaaactatttgcgtcagttccgaggcggtaacgcggacacaatctggcatgaaactgttcagggtggtgtgtggagactggcaacaggttctacagacggacaggaagaattgcagatttctactgcgggttatgctcgattccgtaacgaagttcaaagcgctacgtctggttctggtggacagttccgcgcggtacaaggaaactacggggtaatacaccgaaatgatggtggtaactactataccttgatcaccaactccggcgatccttatggaacatggaacagtttacgcccgattactatcagcttgactactggtattgtttctataggaaacggcgcgaacattaacggttctgttaactttggcaacgcggtaaacttcaacggaacggtcgaaacaaacggtattggttgtggtacgccaaacggattgggtacgactggtatttctctgggtgataacgatacaggtttcaaacaggaaggtgacggtattctcaacgcctatgcaaatagccagcgtattatgcgatggactactggtgcaactgctaactataaacagttacaggttcagggtgttaacgggccagcattacttctgaataacacagcgactaaccaatcgtgttatttgctgattactttggcaggtaacagcggcgcatacttcgggtttggtggtgctgatgataacgtatcggtacacaactaccgactgaatacgaccttacagttgcgtacttcggatctgtatatgaaccgtggtctgtatgttgaaggtaacgtaaacgccaacgatgtgtatattcgttccgatattcgactgaaatctaatttggttgaattgaaagattcattaagcaagattgaacagcttaaaggttatatctacgataagcaatcaaaagatgctgatgatatcgtataccatcgcgaatccggtctgatcgctcaggacgttgagaaggtattgccggaagcagtgcgcgaagacatcgacactggtatgttaaccatttcaccttcgggaattaacgcgcttctggttaacgcaatcaacgaactgcgtgaacgtctggaagcaatcgaaaacaaattaggggcttaattgcccctctttcatgaggtatttttatggctattgtaggagttcctggctggatcggttcgtctgcggtcacagaaacagggcaacggtggatgtctgctgcgggtaacgcggttcgaatcggaacaccgttttatatgtctcgaatggcgggacaatccgtatataacatcaactttacggtgtatgagcgttactataacaacgcccgttatcgtggtcagtggggggttggttggtattcaccatattcgaaaccttccggtcacggcgcagttggtggtagttttaacggcaacgcattcggtacttgtgtttctgcacaattcagcaatgagattagcgtaattaccattcaaaacggtcctgctgttaacctaagacttacgatggatgacggcggtgtgtttgactttgacaataacggtcgtatacaggatggatatcgccaatatcagattgcttctgcccaacataacgcgtggtatgactatttgaacgcccgtgtaggccaaacacgatccggtctggtcactcaacgttaagtaaattcctaaatatgttcggggtcggcatccccgaacttgaggattaaatatggcgctattacaagataaattggcggtgcttgaacgggtaatatcgttcatcatggcggtcaaaacatggaaacagttattcattaaattggttcttatcgtcactattttcattatgttcgtaacatggtataagtgggatgacttattttcagtctggaaaacatcttcaagcgttatagacgtgccgacgatggagattgaaaaggcaaaaaagtttgaatccgcatccatcgaacagttaaacatagtgcatttaactacgggtgcggatttttcggcaatctttgggttcagacctaagaatgtcaattattttgttgatataattgcgtatgaagggaagttaccgcaacagattaacccgaaaaatctgggtggctatcctatagacaagacatcggaagagtataatagacatataaacgggctgtactatatctcagatattgccagcccgtatcttccaacaaaagaccttgttccggtagcatatacctttagttgtccttacttcaatctcgaaaactactattcaggatcaattctaatggaatggtatatacagaagcccgaagtcgccgatacgaagttaatgatcgtgtgcaatcaggccgctagaattttaggcaggattcgatgataatttcagtttcaaactactcaaagcccgattgatgaaatcttttactttcgtcatcgggcttttatcgtatatgtcccatacgcgcatgagttcgtaaggtgtcggaacatattcatcgttccagtatccaacattacctatcgtaatgcgccggaaaccagcctctacgctgtgatatacaaagaacccagccttacccacaggggcgactttaaaaccgcgtgtagcggctttcatggcttcgtcgtgtgtcatgatagaatcacttcgcctctgtattgattgtgatagatgtatggacgaacacccagtgggtgattatctatgactaagatcaggtcaagttcgtcgtggttatcatcttctgcaactatatcccagtcggtcgctttctgttcttcaacactggcaatgaatacctggttaatctcaaccttacggtgagaacggcgaatgatcgtatccccttcgcggaacacgatcatatctgggttaatcgggcggtacgcggttttacccgcgcacacttcattaagcatttcttcgtatgtcattataatacctttactcgctgaacgattgtttgtttaacttctttgtattcgttgtgaagtttaggtgtcgctttgaagcgaatcacatcaccctcttcaacaattttgtttccgtagtagataaccacgttaccatctacgttgattttggtcatgaaacgttccacttcggtgtaataagaaacttgggtatatccgagagaaatcactttctcaacaaccccgctcatttccatacgcttaccgatttccccgatgtgctgcgctgctgcgatcttcgcctggcgctctgcttcccattctgcgcggatctcttcacgtttagcgatgtaatccttctccagcgctacgcccatgcagtaagagcaaatagcctgaaatactgggctatcgttgccgttttctttgcactgatcagcccaccacagaatcgtatacatcggcatatcagcaatcacttcacctttacgcttaccgatcggcatgatgccttgttccagcagttccagattttcggtatcttgtacagacagtttgccgcgacgttcgaacagatcgaaatctgcgaagccctggaacaccatctggaaagtatcggtctggttcagacgatccaccatgcgatcgaagtattcacgcgctttcgcttccgctttatctgggtcagtagacaggttgcagatatagttatcagaagtgaatccacctccacgacgctctacacgcagagtgtacatagcgtttttagcgccagaagaaatgaagtatgtcgcggtaactttagtcaggttagtcatggtgaatctccttagtggtttcgtttcgacaaggccaatatagcaaaagccctcaaccgaagtcaagggcttttttatcatgcgttcgaatctttcataactttatgaagatggatatcaaaaattttccagtatgcttttccgcgaggataaatttttgctttatcaatgtcttcgttgcttccccatgtattgtttgggttacgacaacgattttttgcataatccatgtgccagaataagcgttgcaccgatgaatctgtgcctaatggatcttctttgctgaacagaatttgtgaactcataagaagaaacctgttcgaactactaaatcaatctgtttttccggtatcagtggcgctttatcgtcaacgttgcactgataatacatcccgacatactcatgaggaacgttggattcgctcgcccatttcaggttgtcgtctgtacgcggccctaacatgaggttaacgatattgacagcgtgatcctgttctggggtgttgttgcatccgttcacataatgcccgtgagcggttttgaggatttcaatgatatcttcgtcggcttcaacgagatacagccccgtgttttctgggatttcctcaagaataatcaaagcggttttcatcacacttacctttatgtttctgcttacgttttgcttctttaagtgctcgcttgcgatcgcggtgagtagaagcgcggttgaaatcatgttttgctaccagattgttcatttaaagcccctcaaaaagaaatatttaaggggctttcgcccctcgaattaatccagcagtttgcggatcttatccgcgatacgtccggcgcgggttgcgcttgcggtgtgatcgctttctttggtagccagttcagccagcttacgctgatgttcttcttccgctgctttgcggtctgctgctacctgttcgacctgcttctgatcatgcgcaatacgcgcttcgagttcggtcagggttttgtcaaaagttgctacgatttcgtctacagaacggattttggaaaacagtttcatattcattatctcaattagtatggttggaattcaaagtcaaacagatcatttagtgcgcggttgtattcagtatagttctcaccatccccgaaccgcatctgaatcgcgctttccgctattgtaccagtaagattcgagaaaccaaagaggtttttaatcttatcgtgtgcaacgaagtacagagaagcactatccagcaaggccaccatcgctgatggttcatgttcgcggcgtttgatgcgtaacagagtacggtttgcgccagtcttacggcgttgatttggggctacgtagaatcgaaatactaccttacccgttttatcatcaactaccaggtagaagccgtgttctttcaggtcaaccccttcgaacttggtgaagtcaccgcgcttcatgtcacctatcttaacagcatatttgtggatgtcaagccttgtcagaattcttttcatttttcttcaccagtttatttcctaatttggtgtttacaccagttttcatattcattgtcagtaccagcaagaagatagggcatgacaaaatcaagatcgttgcgccgaacactaagcgaactaagcgaatcaacaacgtcccgatccatttcatcggtatctctacccacttctgaaccgttgcgagtaccagcataacataacccagattaaatgcaagggctgttgcgataataccgtaaggttttttgaagtatgtctgttctccgtcttctgtacgtccagcggtaacgttgcctccgttccagagttctttggcggttttaatggctgtttctgccccgctcaagttctgccagtagtcaggaatgctctgtaggaatttcataatcgaatcctccgcgcctgaatcgctccaggcgctgttttggggttagtagtgactgaatcccacagttacatcacgcatcacctgataacggcatacacgcatcttagcgttgtcgtaatctgtcgggattgctacaacatcgcgaggattaaccttgacctgaataactttcccgcgtcctccgccatagtgaggcaggtacgattttgcggcaacatgcaaaccgcatgaacaggttcggtttttattctcgtctacctggttacgtggcatttcaaccacaacaccaggggaattatcgaacttaccggaagccagatcgcggaagtcttcacgaacacgtttccacgcgtagaaatctccatcatctgccagttcgatatcgttatgcaccatgaacccgtaaagctgatacacagcatcgcgtgaagggttttccatcaacttctcgaagaagttcaccaggtgctcgtaagggcgatcgttgtacatttcgcgaacgatacgttgtgtgataccgctgtcaaacacgatatctttgtacaggactttatgcccgatgattttaatgttgcctttgctgtaaatcttcaacgcttgcgttgtgtccaacagggtagcaactccctcgatgtcgcccttaaccattaaagcatgtgctttttcgaagttagggtgtgacgaatccgctgtgatgatcttgccgtccagtaccagagtaatgaacgattcagaaccaatcattttagatttgacatctgtttgtggaagtggtttcgatgcttccgtattatacttagaatgttgttcggtaataacgcgcccgatggttcggacgcttacaccaaattgtttagccagtgcggttttgttcgcgctggtcagaaagccctcatagacagctttcttttgtacatcatcaaggatcttaacgtttctcattatttccaccgtataaggttaatcaggttcgtcttgatcttatcgtccgtaatcatggtacggcctaaagagtaagacgaattgcgcaacacatacaccaatgcagggttgcgttcttcaaacaaatcaaaggcggtatcaacacgttctttcatatctttcagcattttgtaatgcttcaccgacatttcacgaagtaacggattgcgcaccacatttttcgatttgtttttgttctcgatagtatcgtaggtaaacttaccatcaagataatcaagcaacaaatacaattctggattatagcggtttttcaccatgcgatcaagagtcacctccagataatcgcgaagggttcgaacctcgctaccatgtttagacgaaatccaggctggataccagttaggcttcatctttttcaccgcgtcggcaaaacgctgtaccagatagtcatcaagacatttcatgttgctatcaggaatgcggctccacagggagtttcgcagaaccatcacgcctttcagtccggtaactttcaacagggtcatcatactgctggcgatgctacccagtgtatagttcggtgcttctccgtccagtcggctatattcatcaatcccgtagaggcgcatagcgtacatttcatccagtttcacgaactgtgcttttgtcaggaacagatcgtttttctgtaagttaccctgatcatcaaggaagtaatgatatgccgtaggcgttttcggacgtggttcagaatcaccagaagatgattcacgcgttgctttccagcgattgcgatcttcggtgtacgtttcgaattctttggtcaattcactggttttcagtgtaacgatctcagattcatcgaaatagccagtttcaatcaactgacgcacagagtcacttttacgatcggcagttacgaaactgatacgatccgaaccgttcatcatgcagtaaccgatcagatacgggcggagtgaacgcgcttcgttatcattttcaacgatgaacagtttcttctgtcgccacggttggatcatgcgcataacgtcctggcgtttggtggtttccgctttatacttctcataacggcgaccagaacccacacgttcgaatacgcaatctttcccgtcatatgggttagcccagaagccccacacatattttccggttgctgtatcagggcttttgatacgcgtcagaatttcagccagcgattctttacccacacggaaacggttatcacgggttacgaatgtctgtaacaagctaggcagattattgaaccatacgagtttatcgcgggttgtcttctgctttttatactgttccatcaactcttcatcaaagcgtttgttgattttatccagtcgatccgtaatcactttcttcgtgactttatcaaggctcaactcttcacgcgacggcatgaagtccagcgatcccagagggaaatccagaatatatgcgtaattgctgttacggtagcagtagaacagcgagttttcgaacatatccagatcgattggataacaaatgttacccatacgcgcgtatacgcctgaatagttgatggacttataacggatgatcccgcgatcgtctgcttctttcggttgccagtttacatcaacctgaacaccgataaagcgcggacggatacccgtaaacggttcataaacacgcgccgcttcacgttcccattctgcgatatcttcgactttaaccggaacggtgatttgaacgccgttaggttcgtctgtttcggtttcgtagatttggtcaacgaaaggttcaccattatccatataagccgtgtacgcacgtttaacgccgtcctggatggattcgatagtgaatgtttcggtgtagcagaacggggatttactacccagtcccagcgccccgatcagttcgtcggtgtcggttttggtggattcgaaataggttgcaaacacctctttaaccatccagtcacttaaccctgtgccgtaatcacggacgatgaaacgcggatcgagaacagttggtaactgaacatcgaacgggttcatgttacccgctaccatatgaccatcaatggcgttactggagatttcgcgaatgattgcgcggatcttgtatttgtaaatggttgatgacatgattttgtatgttttcgcactggtagccattttaaacttcgtgcgttcgcctttatcgaagcccgtagtgtgaatggtttgtggtgctaactgacgcaatttcattgtttatatctcacttggtgttaaagatgatgttatcgcatgaatatttcacaggcttttgatcaagcccatattcaacaggtgtacacatccggtcaaggtattcgtaaacctgttgcttctgacgttcgcggtctttcatatccatgataccgaccacgatagcagttacaaaacatattgcaatagtacacagcacagctattgtaatatattttcccgtttttggtgcatcatatggtttcattgaatcgcctctgcatattgttctggtgtcaatttacgcgctactaagcgccctttggttgctcttttgtttcctgaaatgtagatgttcgcaaggttgcgtttaccttcctggatctcattgtacatcttttcaggcatattgcactgataaacttcgccgttcggagttttcaggaacaaagcatacatatcctttttgctttcccgaatcactgatttctcacggatacggcttttacatggtgtaggctgtgcgcccaactcgatagctttacgctgccatacgatcccgtgtccagccccttcggtcagagcatgtgcaatttcgtgcatgagagtatctaaaacgttctcgtagatatcttccttaacgtgagaacggcttaattcaattgacttgcgactgtaattgcattgtcccagagtacgcttgaaacgtccgttaattttgaaagaccaatgagataagccatgcttcgccatgatgcttttggcccagatggttatttccatatcgctacgagttttgaacattttatatcctccccaatcagtgaggacactatagcaaaaaagcctcccgcgatgcaagaggctttttgtaaattatttcaatttcttcgaaagttctttcaaatcattgagatattcagttttcggggttgtttcttcccagtatttcagttgcttacgcagttcgttcgcttcgtcttccagcttttgacgttcatccgtggttagatgatagatgttcatcgcaaccaggatttcggcgtggttctcgcaacccgtccacgtagagacaagtttaaccgcttcgctgcgactaagccccttcaatgcgtcaggctgtgcgatcatctggtcaatgaagtccaccttcgccagcgccttatctaacgcttccttagtctcctggatgcgcttatcaatacgctgttggtaaacaccaatacggatatcaacgaagtctttcagcaacgtttcaggacgctcgtatgaatgcagtttcccgttaaagataacgttgatgttcgggtttgagttctcaatcaatccgaaatctttcaggatcttctcacgggtaagcccgtttgcgtactcacgtttaagggtgatttcgtagcggaaatcttctttcgatagatccttatagcttacgatataccctttttcttccagcttatccagaatagagatatatttcacgcgatcatacttgaccggaatctctgtgatcaccagtttggttttaccctggagttcgtacttgccgtacatcgtaccgttttcaatgtcgcctttgaaatgcgggtatttcagatccagcgtgaaatctttcccgttcaggtaactaacacatccattcagaaccgaaatcggatcgtgtggtggaatgttggtagcgtatgctttcgcgatcccgctgaacccgttaaccagtaccatcggaatgattggcaggtaataggctggcggtacgtgttcaggatcttcatgcgggattgtcaaatcttcatccatgtagatagccttgaacagcggagacagcttacatttaatgtaacgcggtgcgcctggctttttaaccagacgggaaccaaagaacccatcgcggtcaaaaagcgggatgttattgcaccagtgcgccgccataagagacaatgcctcttcaacggatgtttccccgtggtgataaccatacattgcaacaccgccagcgatagaggctactttctggaagcctgtaccgcctttcgctgcggaatgcacgaagaaacggtgaacgggtttgaacccgtctaccaggtgcgggatcgcacgagaataaattgtgtaaagggcaaacgtaagcccttctacctgtacaacgtctttaatacttctttccatcatttcaccgaaaatttatgttttccgttcacccagtctttacgcggatcggattcatcaccgaaacacagttccagaacgtctttgtattcgtcgcccagtacgattgtatcgtattttaactggtcgcccaacacccgatcgtaatcttctttgcgtaaagaacccagccctttgatatatcgtacctctttcgctttatcgcggaacggtgcgaaatcttcaagggagtagaaccatttttcatctttaccgactttcgcaatgataatcggtgtgcggatataacggatctttttcttctcgaacaactcaggccagcgactaaagaacgcaatcagtagggtgagaatatcgcccccatcaacgtccgcatcgaccatgatcccgatgttgtcgtaagtcatttcggaagagtcgcctggatggagattcaggatcgccatgagttcagacaattctttgtttttgagcacttctaagttactcattccccaggtgttcaacggtttgccacgtagcggaaatgcgccttgtgtctcttcgtttctgcactcgataaactgccctacagcggaatcgccctcggtcagaaacaaagtggtttctaccccgtcagtgtcgatccctgatgccggaacatgttttgcaaccttcgcctttttcgctttcttcttcgctttggtaatggctgcggcttctgctgcctgtttgcgaatcagagcggactcaatgatcggagtgattatttcagaagtatccataatctgtttcgcgatctttttgtagttcagtccggcgtggttgttgaactccccagcggtgttagtcagtttttctttcgtctgactatcaaaagctggtgcattgaagttatgcaaaaacacaaccaaagtcaagcattcttttacacgggctttcgggatctcgatagcgtgtgttttcttgatcatcggttcgagttcggaatagataccgtcgatcatggtgtcaacatgaacaccgccgtttttcgtatccaatccgttaacgaaggatttctgtttgaaaccgtcttctgtgctcgccaggatgaaactgattttgttgtttgtctgggtaatcgttttatcaccgtacatcgcgccatacatcgcgaatttgttcgggaggatatcaccgttatatgtgaatttaacggcagggaaagccactgcaagcgccataaggcgatctttgatgacttcctttgtctcttcgtcgataccgtccacaccgaaaatagagaagtcaggggtaaacttaacggttgtcccttgctccttcgtcgggctggtgcggtaatccatgttctgcgctccgtccgtacagttgatcgtgactttgcgtttaccgttggatgtctcaccgataaagattgcgctgtaacagtttgtcaggaaagaaccaacaccgttcatccccattgttacacggttttcgtcatcgaagttagaaccggatttagccattgtccaggctgcaacaggtttaggaacaatcttcccttctggcgttctcacgtcatcttgtggaataccgcgcccgttgtccgaaatagtaaccagattgtgatcaatcttgacttcgattttgttcgcaaatttgaaatcagttcggatcgcttcgtcgatggagttatccaggatttcgttgatgattttcaccaacccttcaacgtattccactttgcggaatttacccatgataaaacgttcatgggcttctttgttcactgaacccacgtacatgttcggacgtttgcgaatgtgatcgcgatcgctcaagcagaatgattcatccaccttagcgccctttgtcggggcttctggtgctttctgcggctcgttatcgtccattaagaaatctaaactcatattcacctctttattagttctcaggcattatatagggttctatgaaaaagaaaacccctttcggggtttacttgttgtacgggaaaccgtctttcaccatctgcggcttatcaaccgttcgtttcgcctcgcccccgcaatcacaatctttcggttcgtcacggctcgcgatgctggacatcttcgggaattctttttcgcacttggtgcatttataggtatatgttggcattaataaatctctgacaatggaataaaacggatcggggttgcggctttgctgaaaacacattgtttgttccctgcaaacatgagatcagtttcgtacaccatacagatatatccctgattctccaaaatttgccgctcccagctatcgaaccatttagacaacttctgcaatgaagagaagccgaaaatatagctacgataatttttaccatgttttttgaggttacgcattaaacgaaggtcttcgcatggtgcggggtgacgagtctcggagataccgaagtttaaaccgaactcgattccatgaatatcaagatactcatagagatcgtcttcatcaccaacacaacccgtgtacgggcctaattgcttacaccatccatcatatttggataatatagacgctttcaattcaacgcgataaaccaacatgatccgatcctcgtaattgattaactacaagtagagtaccacttatctaatttcttatcaagcagtttattgatcacttgcgcgatttctgttgtcccgtgggtagtacccagtttcaggtaaatcacatccaacgcacacacgatcgcatcaacgctttcttcgacgatatcaccgccgcgttgaggctgaacgagacattcggagatctccccaacctctgcggacaggtggtgaaccacgtcgctaacggttcgttttttgacgctatgagcggtcttgaaaaacttatccagaactacagcggaattttcgcgcggtacttcctcacctttattgacgtggttgatttcagtttccggttctggtgcaacccataccggattgaaaagccctttcatatcgttgaacttgataggaacgggaataccttcaagataaagaatccctgtttcttcatacaccatactgatccggcgtggtgaattgaagtccatcgggttcttacgcaacgcatcatacatacgacgaatcggatcggcttctgatgccatttgacacacagccattaaaatagatttcggggcgtacatatcaccaattttatacttgctcatttacaatacctttatgataaccaacaataaaacagttcacttctggacgttcgccagggaaatgcacacattgcatgacgcgttcagccatgagttcttcgcccaaataaacagaggtggtttcttcgttgtagtgacaacagtaagaagttttaacactcataccaggcaatccggcgatatgcataaactttgagttcgtgcatggtttaccctcaatgctctttccgtttacatcaaacgttgcaaacatttcggttttgctgttctttgggcgtctgctcatttattcacaacctcattatatgttttcaggttccattcatgcacttctggcactttggagtaatgatccaggaatactaactggacttgcataacactagcacgatccatattgaaaaggaagcgttgcggggaagtaatacacaggaaatcttcggtacttcctctgcttgcgctaaactcttttgtttctccgccgtcaaatttagcatatacaggcgtagaaaaatacggggcgaatagttcgcgtttggaatcgtccgtaatcgcactgaaacacacgtctacgagctttccggttccttcccgtctgatggtgagcattgtccctttcgtgcgccctaagacgtttacagagcgcgtagtgacatcaccaaaagcgtttgtgtaactcacagtctccacaaagcccatatcacgacgctgttgtagcattgcttcgtgttgtgcttctgcatcctgttctactactcgttgtgcggcttcatacgccgctttgttcggatctcttgattgccatgcgaagaataaaacccctgcggctatcagtccgaagattgaccaactggcggttgctgatagtttcattttaatttccaaaggggacgaagccccgattttagcgaagatagcgaacgtatccactccggtcgatcgcgttctctgggttgttgaagatgttaccacgaatacccttagcaggtgctttccagccagcggctttcaagatatttccgtcattgtcgatgaagccagcaactgaacgctgattgaacatttcacccgtttctttgttgcgggtatcctgcacgatacggtgatacttacggcctttttccagaacgaacacagtttcagtgtaatcgctgaaccacatgccagtgttacgacctttgtgcatcgcgtccagtaaaggctgtgctgcggctttcagttcgtcaaaagtatacatggtaaaatctcctaagtgtgtttcgtttcgatgtgtgtaatatactattatgcgttcaggattgcaagcattattttggttgttcgcaaatattgctcaatgcatcgcgtttaatgaacttcaatacacctgctttagcttctttctcgtcttttgcctgatacaagaagcagtcttcaccatttttagttttgacggtaatcacgaaagttttgtagttcatgcgtagttctccaggttagccagattttcttctgctttagcaagggatttttctgcggcttttttcactgctgcatactctttcttttcccatgctgcgatatcgctgttcatcttctcttcgcaataggcgatgatgcctttgttgtcgttgatctgctgaatcaggaatttgccgtgacctttgattaaagaaccgttctgcatcatgataactctccttccgtttcgtttcgatgggataactatatcaaagctatcccgtgaagtctttagcaaaaagtgctatttgttaaacccgtttcccttgataccatttcgggaaaataacccgctcgataaaagttctccccagattgaaactatcaccaaacaggaggacaccaaacaaagggtcgcgcttgatgtcgtttttcccgacagtcttcattttcccttcgtggatcacggtgtcacccaccgtgatatccttgatgcttacttttacatgatgcatacaatcacctctgcgagtttagcaggttttgcttctggtctaactttcaacgcatcattcagattcttttcaaccatcgctactgcgtcgttttcgttgaaaccgttcttaaccagggctttaactactttggcttctaagtttttcatgatgcgttccttttgtctgtttcgtttcgatgtgtgtaatatacaaaaaagcctcctgtattgcaagaggctagtttaacaaaaagtgctattttaatgatttaagtgttctacggattcccccgttttgggtgatatcgtaaagctcttttgctttggaaagagataccgtgatgtcataatcggttcccttctgtgagaatgagaatctaacctggtttagctccgtgtatacgtgggtacacactgcttccattcgaaaatgttttataaacgctttcttcgtgtagtagtcgctaaaccattctcttgctatggattggtcgattgctttgaagatgacaaacagcacaaccaacacaaaaattactataagtggaattgctgtgctcattattttcccctgttcacagattgacggtgtaacgcacggttaacgcgtggcgcttgataaggtttcattttgtacggtgttggatcagagtattcgatccggttaggtaatgaatacagttcaacgcttggttgaatccagcggattgagtcgattaacccttgagttaacgcacgaccgaaacctacaccaactaaacataaacgcataatatccccttactgtgccagaatgtgaagccattcgcccaaccacacgatcgcctgataagacaaccacaccgcaccggacacacaagcaatcacaccaatgatcgcgaatccgattaaaatgttcaaaccttctttcaaatcaccaaacatgttttatcctcttttgtttcagtccctacaaaataacaaagcccttgcacgaatgcaagggctttttatcataattcgactaactgaggcaatttcagaaccatccccggaaggatatagcttgcattgctaacggttttgcggttcaacttagcgatagactgccagcgctcaccacaaccgtataatttttcagcgattgaatacatgctatcgccaggctgaacaacatattcatcgtattcgactttaacgaacgcggggttcatgagaatgtcaaacatctgcgctttcgcttcgttcagtgtttttgcatgtacagttttacctacaaatgataatttaatcatcttttcctcggcagactcaatggatcggtttcttcttcacttgggggttcttccagccccagcgcatatctcaatgaatagactatcatcaaaacatctttcgcgcaatcgtgaattgaattatgcatcacaaaaccatcaagcaaccctttccgaagaggacaggtcgaagcatcacgcgttaacaggcggttttcgatacatgtacgcacatcgcgactattccagaacacggtcggcatatcttcgaagatgtcgatcttaccaaccatcttacgcacgatatcaaccaggataccgcgatcgaattcaggaccacgaacataatcgagtgattgccaacggctcacaccgtccgctttcaggtcttcaaagaattgtctgtgtcctgcatacagttccagatcttccggcgacggtttcaggatttgacgggcttcttcgctttgttgtttccaccaggcgattgttccctgatcagcaatacgatcaggctggttgcgcaaatcaaatttgtacttgcgcccccgtgcaaccagttccgcgaacgttggcgggttgtgaggatcgtcaacaaatggaacgtatgagagttcgatcaccttcccattcggggaagggccaaccgtttcataatcccatacgtaatctacgggtaaatgactcatgaagttctccgcttataatcttccatgaagtacgccagcgtaagcgcaacttctgggttgatatcaaaagtttcaaactctttgctttgcaaagtcatcataccgaactgacgcagaccggaatgataaattgccttttccagacggttcgcgttttcaacagcttctgtgaattcgtccaacacatcgcgatcgatgaaatgcggaagttcttgaacaggggttttgaaaattagatctgcaatcgcttccgcgtggaggcgtgggatctggatagatatatcttttttcatgatattaatgtccatatgtctttatcttcacgaatgtttcgtgccattcgaaggatcagcacgataacgccatattcatcataagtcagttcaatttcttttgcaataggagaccatgaataacttggcccgttcggagaatacagaacatcgttagatttttcaatgaagcgcaaacggtgaataacttcttgcggatctgctgcgctatacatcccgaacacattgaccgcatgtggatctttttctcgaattttatcgagtgcttcaagaattcggggaatgtcttttacaaggatagtcaatttcataataacctcaaaaggggcaaagccccttatacataatcaacggtgtaacgtgcgcgggttacgcccacatagattaactgcttacacagatcgtaatctgcgaacgcatacgcatcgcgcgtgtacatgtacgcatggtcatacgtgctcccctgtgatttgtggtacgtgcaaaccggaagaggcttaacatcctggaacttgtttttaatcgcccagaacgaatgccacggggctttatagcctgtttgttgcttgatgcgcttataagtgctcgcaacgtaggccagatagttacccagacggtctttcatcaccggatcaacaacaacctgaatctgtgcttcggtttcctcttcgagcgataccgttttcagaagatagaattcaagttcgatcttctcgtcgcacttctccgccttgataacttcccgacgcgggatgatttctaagactcggattttttcgttgttgttataaacaatctcggtgaagatttgcccgttcaaccgcatttcctgaactaacggttcctgcatcacgatcacttcatcgagaatgaaaggttctgttgttttgtacaggtgtttacggatcgttgcgttcagcttgtccacgttgtcgttagtgtaagcgaacatgcggttctcgatcaagtcatccggcgttttgacacggcggaaatactgacggaggaagtcaacagcgttagcatgttggaacacacccagatcaccgacagacatcggtttcagcatcttaccatcacgtacagcccttgaaacctgaataatcgggttcccttctgcctgacgcatgattttatccatacggataacatcaaagatttcttcatcaaagaacggggagagttcaacacgtccatcggcgtttaccggacggatctgatctttatcacccagtcccagaataacagcgttgcttggaatactgcgccggatgattcggaacagatccatatcaaccatcgagacttcttcaacaacgaacacgcgacaggtagacagatcaggcgctttcttgcctttctgctgttcgaacacacgcagttcttcgttagtcacagggctaatcttcaatgcagaatgaatcgttgttgcgtccattccggtagccgctgctaacacgtttttcgcctggtgtgttggggcagttaaccaaataccgctaatccccaaccctttcagagtgttaaagacaaacttaaccagtgttgttttaccaacaccagggccacccgtaatagttgtatgaatggcgttctggatgttgtggatcacgcgatcatgcgcggacttctgatcgtcgctcagatcatcaaatgttaactcgctcataatttgagtaataccccttgaattttcgaattctcaataaaccaacgcatctcttttttctgttcttcggttgctggtagttgctcggttttgcggaagaaactgaaacgcggttcgtccggcgtgtagttcagtttggtttcgtagcacttgcggataaaatctaatttatcttttgcaagttgcggtgatgcaaacagttccggcgttttcccgttttcaacgtgtggaatagtaaagccgtctttgtctttcgtaacaatgatatagtatttgtcaatcattttcgcccctcatagatgacgtagaaaaaacctataacccatagcaatgataatactatcaaagcggcttttctgtcaacaccgttaacgtggaaaacgcaccatccgaagagatacgttatcaccgcgcaaacgatataagacaaagcaaatacggcatgtagcgcggtgagttccattagtagttgttagcccaacgacgcaggttttccgcctgtttcagagcatacagcttgtagatggtttccgcatcaagtcccagcgcgaggaacttacacatgaagaagtgccactggtcaatcagttcaaacaggatttccagtttgtcttcttctttcatttctgcgaatacctggctacgcagttcctggtgatttgctttccacggtttccagacaccggaagccgcttttgcaccgcgagacataccgcccagagcggtgtaaagttcgcgggtttcgtctgcgatcgcatcatcttgcagtttcagccagtccaggatctcaccgcacgttttcagttcgttcggacgtggaacccaattcagggtatcagacaggctttgttgtgcatggttttgcaagtccagcatcttttgcagtgggtcaattccgttctgcaatgcattgcggtagaaaccttctaccatttccagatcatcggctttaaccaggtgcgcacagctattaaacacaggagttttatcagtcatatcaatctcattttttcggtgatttgttccacgacttaaaccgaagttttgccgtgagtccagaaacagtattatctttcaaatactgcatgatttcaagtttagttgcgccgtcagtttttatcatttcgttgatatcttttgacggccacgggcatttgtcccacaacacaaccttttcgccagcctcaatcaattttaaaaggcggtgagtagtatcagggtgtctcgcttcattgtcaagaacccagacacgcatatttttatacggaacatcggacagcgccatttgtccgcccgtaatcgcaccagcattatctacaaacaggctatccagcggcccttcaagcaggtagacaggtttcaacggatcgatggtatcttgaccatacactttcgttgagtgttcacatgctttgattgtcatgtattttgcgttggcattgtcacgcaaggcgcgtccctggaatgactcgattttacccttttcatcaaagatagggatcaccaaacgcggttcatccttcggtaaagggtatgcgtccgcattcacagagttaaccaggtgttgccattgacgcgtaaaccagaggcgatcatatttgtctttaggtatgtgacgacctgcaacatacttaacgatagggtgattttctggcaacgtgtccagacgttcacagaactgcaattcaggaatatatttcttttcttccttcggcggttcttcgtgcgtctgttttaaatctttacgatccttgaaagattccatcaaatacgccgtgtaatcatccgggtaataatctttcagaaacacagaaaacggcttgctgtagttgcagttaaaacaaccacacatcatgtgtgtgcctcgttttgatggaaagatccaaaaacgttttttgtgcttatccttcatggagtcgccacaaatcggacaacgggaatggatactgaattccccaccccgtcgaacgatttcgctttgtggtaatgatcccatgatacgagttgcgaactctatatcaagatacatgtttacctctatcggctaacttctttctctgtgccgtctaaagtgattttccattcatagaatatcttataaaacggataaggtctaggaatatcgacacccgatgatgtttttctttcgttcgtgtacacgatcgctgtgtcgctcatgtacttgatacggataggaaaccaggtgtaattgttcgcagtaacccagatccgataattcaatggcggtaatggtttcattcttcactcttcatgattttacgtttgcgtttatgcggacgtgtagaacccagaaccttcggccctttgttcgtgatcgcgcctgtagtcacacccgaagcaatattatccacacttccgcctgaatcacctgcaaccatttcttcgttgagtctttcgcgaagttctgggaggttcatcatgatttcttcgtgatcttgctcggtcaggttccagcggctccgtaacgagtcataagcacttgtaaggttcatgaacccagacatataaggaaccgcgtttaaacggcgcttgatgtgtctcacagagcgatggaatggggaatatgcttccagttcttccttcgttttcgggtttttcaatacttccccttgaccgtcgatgatacccagcttgtaagccgtccattcagtccagggctttttcagtaggcgaatcattcgcacactgtaggttaaatccatgtttttgattaattgatcgctcatagtctttactctattgtgaaagtgaaaaggttttgcgcgggttcttgctccggttcagggaattccatgcagacaacttcacacatcggtttcacgcctttccattcttccagataatatccggtatcaatgccgcaacctggttgcatttcaaggccagtttcatcaagaaactttttgcatttcgatgttgtcgttgattcgtcctgttggaaataacgccgtccagagtaacggaaattcgcggacatctgcgggagaatgaacgtacccgcacgggcaatctgtgaagcacgttcaatcactttatattcaaattccgcgcccgtatacttacccttaaaattggatgtctttatcttgccgaaaggtggattactgatcgccatatcaaacagagtatcaaactccgtcgttaacgcgtctgcgttaatccaggtcgcttccggtacgatacgcttacccaacttatagtatgtatggtttaactccacacagacgatttcacgcggtttggcgtacatcatcatatgaagcatcgcgaaggatagcccaccgatacccgcgcacaggtcaacaacgcttccactggtacaagcatcaatggtgaaatcgcgagcaagtccgatcggggtaaagaatgcacccagttcagagttattcgtaaatgcaccttcatggaagttttcgataatgaataatttttcgtcgtaggttagcgccttgtcagactccaccagatccattatcttgttgtgttgtttggtttccgctttcgttaacttcgccattgaccttttccggtaataagaacagaggggtagattctaccacatcaaagccccagtcatcaacaatattgctttcccagtcgcgggtttcccacgggctgcaaatccacttatacaccccagcaggatcttcaacctgttcaggcatacccagcatttccgcattgataccttcatccagatagccaggatgaatattaggccagcgcatgatatcaacgtagcctttatcgtcaaccgatacgatccattcggaacgatacggactatcgaacttcggttcttcttcgtctggaagtatcatatctaataaatcactcatttcactaaaccttctttaacgccctctttcatggctttcagaacaccgataaaagcgtctttgccaccgatagcgccgatgataagcatcaggacaccaacacaacccgctaaaccgattctgaacaggttccaggcaaacgggatagccagaagcactaaccacgggaacggaaagcccataagtgcgtttagaaccagtaagataaaagcgattgcaagtttcatgatgtcctcctttgtttgtttagaataaggtatcacctttcgagaatgattgcaatacctacagatacaaaaaagcccctttcggggcttgatttttatgctttgttgattagataccgaagaacgtttttggcctgaacttcgttacagcagagtttgaattctgggtcgattgggaggaagccccagaggaaatcaacgctaccttcaacatctgctttcccacttttcagcatttcaaccagcaaacctctgtttactacgctgttcactactgcatcgaaataacccgcgctgaaatccagttctgggttcatcacttcgtcgtatgggttgttcagtacgttcatttggtatctcctaatcagtttttgttgtctacgggagtcatattatcacaatcataactcccgtcaacccctaatcaggattattttgcgttttttgcaatccagagagtcagtttagggaatacatttgccattgccaccacaaacagcacccagaaagccagcttaaccacaccgatcacgatcagaggcgcaaatacaagccaccaggaagcatttgccataaccccgattgctgccagtttcagagacaggaggatcaggaacacaataacgagaatctttttcatttcactataccttttgaggggccgaagccccgttaaaattgaatgtctgtactgtttgctacttcggctaacttactgcttcggttagtctcggcttgttttaccatagcaccttgtgcttcttcaagcgttttcggcatctgacgacctttataatcagattggaacccgatatcgctgttgtcggtatccatccagcgttgattacccttgcgcacttcgagtttgaagtggttaaagtggttcttatcgccgtaacgggatttgatctgcttgaacaactgcaagccctgatcagctaactcgtcggtctcaatcacagctaacataaagtcagcggtagctggaagaccagcagattcggcaacgtcgcccatgctgatatcagaagcatcccacgcggcgcgggtagtctgcgcaccagtccacattacggtatttgtttcaacagccaaaccgcgaagttcttcggcaatcgctttaaccaggatgtatgtgttttccgccccgcgtacacgggtagaagcacagatccccaggtagtcaacaataatcacatcaggtacgaaactcttcttcaatttaagctctttaatcagcgctttgaagtggttcgcgttcgcccctgctgttgggtattgcttaacgattaaacgcccgaccttcgactgtttgaggcgttccatacggttcttatagtccgcataggtgatgttcccgttgtcgatatcgtccatcgcaacatcaagcaggttagcgtcaatacgtttagaacaaacgtgttcagccatttccatactgatatacaggacgtttttacctgattgcaggtaatcagcagcgagagaacaaagccccagagatttaccaacgttaacaccagccattaagatgttcaatgttccacgttctgcgccgcctttagtaatggcgttcaggatcgggatattgaaagcaatcttcatcgctttggactggtaaagcatccagcgtttttcatagtcttcgaagtaatcatgaccgaccgaactatcgaagctaatcgctaacgcttccgccatgatgtcagggattgccccaacgtcagggattttgttgttgcgttcgccagcaggtttttcagcattcgcctggatctcaattgcacgggacagagcgcgatacattgccttgtcacgacaataggtttccgtttctttcatcaaccattccagatcttccggcgcatttttcatgctgcggatcatctttttggtatcttcgtagactacatcactcaggctctttttgtccagagctacttctaaagcagtttgtgaaggaatgctgttgaattcctgtacgtgcttatccatcaaatcaaagagaatctgcgcgttcccttcgaaatattcacggcgtaaatggggccacgcctgaacaaaatacgtaccattaaaaaccagatttgaaaatattgtttcgacgatcattattacctcttaaaccagattagcgaacatctgaaagaaattatacagctttactttcaacgccgcccataaggtcttttcaggctttgggagattgggcttgatctgcgcgtagattgcatcgtgaaccagcggaatcagtttttctttgtcttcgtccggcgtactaaattcgactttcaggccgttatcccaatacaccttatggatgtacactaagtgtgcaacatcgttttcatcgttgatcaacagttcttgaataacgtcctgcattgcttcatcaagaatgttttttgttttttgttcaatgtccatgattcacctattaaaagggggcaaagcccccagttgtttattactcttctgacatatccacatcatcagggatatcgtcatcgagatcaaatttatttgacggttctactacatcgtcggaataaagatcttcgagtgctgccccgtcagtgatctctttgtcaggaatacggtacttatcctgaatggcatcaaggaatggctggtgagtgaacagaggtttccagaactcgatcgagttggtttccgattcacgccatttcttttcttccagttcaagttcgcccgtttccgtgttcaggaacgcacgaccgcgccagcctttcgttggagtctgaacgaagttcatttccatagccagatccagaagaccagagaacatactgataccgccctcataggtaacatgaagcgggaatttggatttctctttcacgaagcgagatttctcgatgttcatgatgaagtcataaccgacaacttccgtaccttctttcacctgctgtttgcccaggatgatcgcggtatctgcggaatacatcagaccagtaccaccggaaatgactttcttactgtacatttcttgtgtgtcgtatgtgtgacagatacacaccatcggaatatccagatccgccaggtaaggcgtaaccatacggaacatacctttaagtgctttagcgcgggtcatgtcctgtttgtcgttgtcagacagggcatcagccagttcttttttactcgcggtgttgcctacagagtccacgaaaatgatcactttgtcgccgcgttccagcgcgttaagctggcttacaacgtcatttcgaagttgctcaactgtcgtgatacgagtatacaccacacgatcggggtcaacgcccattgatttcaggtaagacttagttacgcctttctctgaatcatagaacagacacacagcatcctcattcgctttgaggtacgccgcaaccgtcaccagccccagattcgatttaaagtgttttgacgggccagcaaacagagttaagccggaagtcagaccaccatcgaaagcgccggacagcgccaggttcaggatcggtacacgagttcgagttttggtgatgttattgaaaacatcgctttcagacagaattgacgcagattgactattcgagtttttgatcagttttttcaggagtgctttattagacatttatttttccggtttatatacacgcataatattttcctcacaaatttatataaatggggcatttctgccccgtcaggtcttaccagtcatcaccaaacagagtgttcagggatgcgcgtttttcgtaatcaattttacatgcttccgtgatgttttgcaacgggctaatcacatgtttttcaaataatccgccgtagtctacccacttcaaaatatcttcttcgatctcagttggtaaacgcgtaccggattgccatgcgatgcaatcagcttgccacgggtttttatctcgcaacggcagaaccatcaccttttcaccttccatgatcggggtgattccttgaatacccttcgtatggcggttaaagaacagaacgcctttgatgtggtttggtgtccctttgattgggaagccagcaccatcattatattttgagatattattagcagatgatacaccagctatttcgcggtagtcaagcgccttatactcttcttcaaatactttgaagtgttcgtgtaaggattcttcaccttcttgcaggatgcgacggatcgcttctttcaagaactttttaaccgctgtcggtgtactacttcgctgggtttccattcccatgatctttaatttaggtttctcgtagcgggttccttcggagtcccatacgttagccgcatatcgtttcttagccgtccagaaactacccagacctttcgatcccagaggtggcccagaaatgatttcacgatccataaacatcaggtgttcgacgttattcatgtactcgcacagttcgcggtagcccttatcaatgataggttccatgcgttctttactgaacttatccaggaagtcaacccaatggttgttatccctgaacttactttcaccgccgactttcgcgatcacgttgtccatacaaacataaatggagtcggtgtcacagtaacgcacgtatgcgtaatccgtggtgttgcacagttcgttaaggtattcgttaaccttacgctcaatccactgaatagccaactgcccgaacatggtgatcgcactggcgtttcgaatatcgaagtaacggaaatgttcgttacccaacgcaccataaagggagttgatactgattttacggttaagctgtgcggtgttcgcctgtgcgattttcttctcacacactttcttcacggctttaagcatttgcttagacagcgttttcagtacagcttttgattcatcaccgaaatcttcgtagaactcgaaatcagggttgatcatttggttgtgcgtgtctgtcaggtgttcaagttcgtgcttaatcagttcgagatttcgctcacccgccatcattcgttttttccacgccttacgctgatcaaatactttcttgatctcgaccggaatcacgcctttaacatcgcgtcggaacatccacccgttaggagagcagctaaattcgtcgctaggacgcggcgcagtcttattgatgtattcatgcatcggacgcactgcaaagctgttagcgattgtctcagggcttatattcacctgtcggatgatagatggatacagactggtcaagtcgaacgatacaatgtaacggtatggagcgacaaccggatctttaacgtatgcaccatcatacggcgttttagtatggcgtttgttttctgggattactttcttctcttcacgcagagagttgtaaatgattgcgtcccacgttttaagcggtgacataaccccagggaagttgattttcgcgtagtatgctacagacagaaccagttcgataaagttgcgtttaccgtcgatatccaacacacggataacgtcaacgatgttatacgtgatgtatttctggtgatccgcttgacgcagttcagacagcgaaccttcgtaatcaactttgcttttacctgtttcgaactcagcgatcgcgcccagagcgtaagttggttgcggggtgaaactgaatttcttatagagatccattccatccatttgagcaacgccgtaaatctcatagcccagttgttcgttcccgtaatggtcggttgttgtcttcgcagtcactttcccgaacgggctgaaatgacgaacaacgttttgcccgaagatgttcaggtaacgggtgatgatatacgcgatatcgaacttgtttgagttccagcctgtaacaataacaggtgtccgctctttccagtctttgatgtacgcagacaacagcgacttttcggtctggaatgaacggtaaacaattttcttcaagtcttcttcgctgatctcattttcggtatcaacttttgacgctacccattcatctaaaccaccctcgacaagatcgtacacaaagaatttatcttcaacgctgtcatagtgggtgattgcgtcgatagcgtattttgcttcgcgtggatcagggaattcaggcgcggtaacttcgatatcaagtgaagcaatgcggatcttgtcgcgatcgtattcgatttcctttctgtaggaatcggagatatacgccagcctgaaatcatccatgcctagcgcttccatgcctacatctttcattcgctgcatccagttttttgcttccttgatgctttcgaagttctttttgatgcaggtcttgccgtaaatgtcgcgatatggtgagtctacacccgccatagcgtgttgaaacattgtaggcgcatattttgttttgcgaacctgttcgcgtccctcagagtcaatgaagcgctcgtagatgtgatcgcccatttgctcaacggatagataaaattcattcattacggttttctttctccgtgtttaatcgtgacaggaatgataccccagccagcttgatcagatcaagcgagcgttgcgctaatttgtgatagcgttgggtgtcaggccgatttagttgttcaaccagcacggtatattcttccatgatgcgggtatagaacttagggaagtgatcccgcgcgtatgcgtaggtgcgcagatcagagagattgcaagtaagagacagtttgatgtcttcgctatgcagacggttgatcaagtgatcgccggattcaatagctttgatgatttcttcaatacgaattttcataatttagtcctcacaagtggtgtacaaccaatataacaaagcccctgcatttctgcaagggcttttgattaatgtccgatccggtacttgtatttcaaagtccattcagctttttgtgcgtgagtcaatacgcggaagttgttctcttcggagaatttcagatccggcgtaaggatggaaaccataccccactcttccagaagtcgcgcaatgttattgcggcgcagttcgtcatcttcggtcatgtcaacctggcgaccgtccagcttcaacagttctttgaagtgtacgataaaataacgcccttgtttctgtaggatgtggcaagactgccacagcattttctttttgttatttgcgatcccgatacgggtcagcgtttcgcgaattttcaggaaactgtcatcgctggacagtttaatttcgagcatgttcatacatcaccatttctttattagttgttcaacctttttctggtcggttttatttttcacaacatcagccaacacagataaagcaactttcatatttttccgcttccactcgtccagtttttcaagctgtttgagttcttcgtaatattccattgctatacgtgtatttacaccgtatcgtttttggagaacatgaaggataactttcatttcgttatcttcggtgagtttagcccacgccccgaaccgcttacctttgcgcaccgtatgcaggtaataatcaaagtgcgcctggtctggtaaaccagaaccgatcatattcatcgtgtatgcagggatcagcgtttcgatatgctggctcattgcattgtcgatgaaaaacttatcgtatgaatcaagggcagagatccgtaatggtgtcttcccgttgttcagttcttcgagcaccataaacaaggtgttttccttgtctttggtgtactctttcacaagttcttcgatcttgtcccagtctttagaacgccaggccgcttcatgttcgttcagttcatcttcatcgagaaaagcagccagtgacattttaagcctcccacgcgagggtaagcattaagcccatgaacaggtattgcaggtgaatctctttgttcactgccagcccgtactgtgcgttgttttcgcctactgcctgaatgagtgcaaccttagattcgttggtgacgatcgggtataccgcatccagaagtttagccaggaaagtttcatactcaggcgcgtacttgattgcttcggctcgcagtgctttgaagttcttcgctttaagcccctcaatcactggtgtgatgtccgaaccaacaatctcagacagaataccagcatcaattttgccacgcttagaatagaacccaagagctttaacgatggatcgcgcgtctgggtagtgcttcttaacgaatccggcgatcacctgctggtcatattcgattttctcgatttcgaggataccgaaacagcgtttgatcatttgcttcatcagttcaacgcgttcttccttcgacggagaaccgaacttgactaccggacagcgggagatcagcgcagggtgaatcccgttgatgttgttcgcggtgatgataacagtaacgttcttgctgtacgcttcgataaagctacgcatgtgcttctgtgcttctgccataccagggcgatcgaattcgtcaatcagaatgattttaccgcctttcttctgcgtcatagaggacgcgtaacgatccagttcgttacggatgaagttcacaccacaatcggaaccgttgacaaacatcacttccgcatcaacttcgttagccagaaccagcgccagcgttgttttacccgtacctggggaatcagaaaccagagtcatgttgtcgatgcgtccagacttgatgaagccgcgcatcgtcgctttatcagcagcagggagaatgcattcatcgatcgtcgtcgggcgatagcgctgatcccatgcgaattcttcgggagactgggagattttgccgtatttggtttcgattaactgtacgttttcactaagttccataatattaccttcaattgattatcaaaaaggggcttaacgccccttgtgtactactttgtttatcttacttgaactggctggttgcttcaagtaccactacatacgcaacgccgttttcggacgagaatttcgcagcgccgcgagaagagatttcaactttgtaatcgctgttgatgaactgcatgttgtcaatcttcatatcgaagttgaacatgttatcaccttcgtaatcgcccacttccacagagaaggttgactggctttctttacttttcgcggtgattaccagcttgccgttgattggctcaacagacaggtcggtcagtttcatcatgcgtgacgctttgataagtttttcgaaatcgttcgcgctaatctggaaaatcagatccgcaactggcatttccagacgcttcttaggctgtacgattgtggttggatcgcttgaacgctcaacgattttcattttctcaccacgaatgacgatttcgccagtggacagatcgtgagttacttcggcatcagtgcctacaacgttcagcatgttcaggaatgagttcagatcgtagatacctacatcttcgtcaattacgtcagaaatcgttgcttctgcgtaaactacgctgttgatggatttcgtcataatgaacgaaccctttttcagcattacagacgggttgatctgggaaaagtttttcaggatatcgatcgtttgtttagagaatttcatattcaacctatagttttcaattaggcaaaagtgccgttaatcagggattctacaacgcgatccgccgcattgtcaaggaattctttgcttttggattctgtgattttcgtacccgcttcgcgagcgtcgtgaatcagtccggtatgtactgcgcttactgcttcgtcgatccgtttgtaatgctcaaagcgttcagcttgaggcatcgcacggaaaatctctttgatgttttccggcactttacctacccaggatttgcgaacgttgttcagatgcgctacatatacgttttgttctaaattcatatctacctcaaactttcaaattgggggctttcgcccccgtaagcattacagatccagcagtttatccaggtcgtcatcaccggaaccaccttccaggtcaaacggaggtgtattatcatcttccggtacgcttccgcctacgttcagttgacttacgccaccagattctttagcacctttggactggttgccattatcgaagtttttcagttcgttgtcaaacgaattcagttcggaatccagatccgcaccagcgcttgcgccagcacccattgcagcaccaccgaatactttggtgaacttcgcggtcagttccgccgttggtttgaactggtctggtgcagtgattggacgcagatcgctcataccttcgaagatttctttctgacgcgcttcgtcttcgatacctttgattggaccaggaacaccaaatttgctgtcgtcgtagttaggccagtcgcctactttcttcgcggtcagggtgaagttagcgccaccaaacggacaggtcacagcaacacctggttcatccagatctgggttccccgcgatagccgcagtgattttatccatgatctttttaccgaagcggaacttaaacaccttaccttcgttttctgggtgcattggatctttaaccaccagaatgttcgcccagaacgattgtttacgtccgatcatacccagtgttttttcggcttcgctgcctttcactttcgctttttcgaacagatcgttttcagagatatactgacacacagggcaagcatcgtaatcgccgtgggtagacgggcagttttcgatgaaccactggttattctttttgaatgaatggttgacgatacgcacgaacgccagttcatcatcagatcggttaggcaggaagcggatcaccgcagaaccgtttttctgtgcatcgacaccgagtttccactctttttcatctttctggaagccggatgaacctttcagagcggcgacttgttcttgcagtttggttggatcttgacgtttaaagaatgacatatgttatttctcgtttaagttaattaaagtttgtttcattaagtttcggtattttacgatttcttcgttactgatttcaactaattttctgtatgcgtttagttttttactaaattcattccagacgaaatccgttgcgatttcatcgtgtttatttatgatgtctaaaaacgagtcgaggatcaagaatgattcataagaaatcaccccagactgtacgagtttgctgatatacgaggttgatgatttgacgctatactgaaacaccgttgagaggggaatgcctttcatgcgggaaaattcatacaggttttttacatcgtccacgaaaatattatcaattcgcctcaacttgcctatgtattgacgataaaacacgatcgtatcttcgtctacatccccgacccagaagtcggggttagctaccatgttggagagaagtataagatatatttctttaaatgtaaacctttcggctaactttttgaaaaaatacttatctcttctcttttcgaacgctttttcagtgatctttatttcccatttgtacttgatcgcgtcataccgtcccgcaaagtgatttttcatcaccagatacagtttgtataccgcaatcggtttcaaacgggaattagcgtctgaactgtcaaacggggttttaaatttcacatgaaatcatccagtgtttgcgtcgtcgcgtggtctttagccacagaaggacgcagcagattgtttttaatggcttcgtcgctaatcttgtcgatgatcgctttcggtactgttttggacagcatagcataatcaatgctgttttcgtccatccattgtaacgtagcttccatgtaggttgccccctcagaggcaaccagattttcgatatacaagccgacttcggttttgtttccgatttcgctcatattacgccttatcgatcacatcgtacagttcgataagttcgttgttctgttcttcgaacgcggtacgtgcctgttcgtgatacagtttgaacagcttgccgaaggttttaccgtcgataccataatccgttttcgctttggatttgatgtctttgaaagaaccctggaagtgttcgatctgggttttcacgttcgacgcttctttgatcagttctttaaccgctttagcgatgtctgggttttcttgcagtaattctacactcattttgttacctcaaaagtcacttagtttttcatacatacgggtaagtttgcattccatgaagtatttctccatttttgctttgttcccgatttttggagcattgtacgcttcttcgattgccgttgcaacatctttcggaataaaatcaaagtcgcgaagttcttcgttttctctgtagcggatcgcccactcttcgggcatacccacggtcggatcgtccgcttccagccaggcttcgagttcagcagccctgatttgtggggcgcgttctccttcaaccttcgtaacaatatagtcatttcgcattttaatgcaagcgatactatcttttttatcgcccttgatgatcttcatgcgcaaatcgttacgaggcgaaccatatttcggtgtaacccatttcttttgggttggcgaccactgacgcacaccctgatatttttgaagggctgcaaagtcaccatcagcagaaacgatcaggacacgtttaccttcggataccgctttacgcgtcaccacaccgatcacgtcatcggcttctgcgaagtcaacacggatacctttgtacggtagattagcacggatttcatcgtatgtcgggtgaaggaaaccattcaggcgatcccagtcccaatccgatgcttcttgttccatttttcgtttctttttgtagtaccaggctttacttctgcgccaatacttgttatcatcaaaggctagaacaatttcagggtactcgcctttgaatttaaccacattgtgacgaatggtgtcaagcactatgtgacgaacaatttgttggttgatgtcattctggtctttcggcttgaagttgttcatcaacgttgctaccgaaaggtttgaaatatctatacacatcacatcaacaggatcatcgtcattgctcattaagctgttcaggttgaacatacttgcaaatgaagacatttcaatacctcgttgttgttgaatgaaactgattatagtgatcactttttcaaagtcaatagatcatttcaaaaatctgagcgaagcgaaggacacgaacgtagtgagtgtctatgtactgaatgtacgttttaatatttttatattttatatatagagaaaacagtacatttccgtatactttttaaccagatctaactatccgtttcgcttcgctcacggaagcgcttcgcgctgattttattaaataatatagattggaagtaggtttgaaacacctgattcaatcggctataatgaatgtattcaatttggagaatataatgactacaaagatttatgcagataatgataagctgtatccagttatgtgtaagtggaaacagcaaatccgtgaaactggtgatcgtaagatgccggatgaactcggtattgcgattatgaacattgctcacggtttggcacgtcgatacaacttcaaccgttattccgaagactggaaaatggatatgatcgatgatggaatttcggcaacgatttccggccttcataactttgacgaaaccaaatatacaaacgtctacggttacatcaacaaggcttgctggcaagcgtttgtaactcgtattctctacgagaagaaagagaacgcgaagaaatacaaatacttcctggaacatgtctatgacagcgatgatactgatatgaccacgatagccgatgaaactttcattcaggatatccatgacaaacttaatcagtatgaagagtccgcgaaaaaacccaaagataaaatcgaggttgtggacgaatcgccaacattggaaatgtttctatgaaaattaaaattgacctgaacaaaattttagcagatgctaacgacgaaattgatctgcttccttaccttgtgaaattagagttgcagagcttagggattccgattatcatcgaccctacagatgtacgagatccagacttccagataacagaaggtcgtctggactatgtaataaacgccgaaacaatgatcatggagatcacttactatgaacgtgcagcatgaagtaatcgacgaagtacaccaaaaatcagcgctggatcttcgtgaagaagaactggactccatcaagggtacacgcattgaacaggaagccctacgcaaagcgcaaaagttcatgcggaagaacaaagcggaatggaagcgactgcataaacacgcagagaacgcactcttcgaaggtaacaaagagcagtacgtatacgcgatcaaaaagatgcgtgatatgctcaagcaaccatacaacgatgaactgattgaaacgatgtggatcacttcgaaccagcagttgaaagacctgttcatcatggcttctgaaaaatacggcaaataaaccccttcgggggttttgaggtttatatgaactatgttttaattggggatacccatgccggacttcgccaggataacccctggaacgaagaaaacctgtatgcggtattcaaacagatcgtagagtattgcaaagaacacgggatcacgcgcggcttccatgctggcgacttcttcgacgttcgaaaagcaaccacacaaacgacaatgaattttgttcgtgaaaagctggttcctcttctgattgaggcggggatcactctggatgttcttgtcggcaaccacgattgccaatttaaggacaaaatacgccccaacgcgccacgcgagatactaagtcaatacgaatgctttaatgtcattgacgaaccgaccacggttgatttaggtggcggaaattcgattgacctgatcccgtggatttgtcaggaaaacagccagcgtatttttgactacatcaaacaatcgaaagctaacttttgtttgggacacttcgaactgtctggttactatttctacaagaacagcaaagccgatcatgggctggaacctgatttcttgaagaagtacgatcgtgtttactctggacactatcaccacgctaacgagggtgataacgtgttttatatcggtacgcctctgactatgagcgcaaacgacgaagacgaaacacgcggattctatgtgttcacgggcaagcctgaattgactttcatcgctaaccctgtgtgtcaccatcgccggatcatgtatccagcacagaaagatgttgatctcgaacagttccgcaactgcgcggtgcgtctgattgtcagtgaaattgatcaggggcttgcaaagttccaaaccaaaattgaagaaattgcctatgaaatcaatatcatagacaaagttcaaacagattcggatgtcgataccgactttgaaatcaaaaccgttcgtggccttatcactgagtatatcgccaacatgcagatcaccgacgatgaaaaagaggaagtgaataagctgatcagcgaactatacgcggaggtgtcaagtgcatagccgttatgatgaatatttcggggaaaatccccgatattctcacctgttgcgtatgttgggaatgaaacacatcatttccacatccgacgaagcaggggaaaccagcgcagtttgtttgaccatcatgaagggtgcatggcattcatcacgaacatggtcaatattcatgcttgatacactggacgacgatactctatcatatagtattgattcatcagttgttcaaatgatcactgaattatgtgaacggattttaaatgaaactaaacttcaaaaaaattaagtatcaaaatattctgtcggttgggaacaccccgatcgaactggaatttgatacggcaaaaaaaaccctgatcacggggaaaaacggtggcggtaaatcgacactgatcgaggcgttaacctatgccctgttcggtaagtcattccgcgatctaaaagtcgggcagttggtgaacagcgtcaacaaaaagaaatgcctggttgaactggaaatcgaatacgggaaagactcgtacaaagttgtgcgcggacaaaagccgaaggtgttcgagatctggaagaacggcgagaagttgccggaagactccgcagcaggtgattatcaggcacagcttgaatctatgctgaacatcaaccttgtgggcttcaaacaggttatcgttctgggtacagcgggttacactccattcatggaactgaaaacccccgaacgccggaaactggttgaagatttgctgtctctgtccgtcatcagtgaaatggacaagttaaacaagtcatacattcgcggtgttaatcagcagttggatacactctcaatgcagggtaatcacatccagcagcagatcgcaacacaccagcgcttcattgacgaacagcgagcgaaagcaaaccagaacaacgcccgatacaaagagatctacgatagccacgtagaaaccgcaaagaacatcaaagcacagcttatgcagttgcaagcggagattgcggaatcggtgatcactggagaagaccggacggaagatatcaacaaactccgtgacggttattcgcggctctcaatgactgtagaacagtttaaaaagctggaggtgatgtatcagaaaggcggtgagtgtccggcatgtaagcaagcgattaaacccactcctgagcgtatggcggagatcgcagagaacatcaaagcgggtacacaacgtttaaccctgatcaaaaccaaacaggacgagttacaagggatcatgaatgacttgctgcaacagcaacgcgcactcaatgccctgaaaaccaaatatgaagccctgaaaggtacactgcaaaacgaagttgccaacgctaaacgcgcacaggcgatcatggaacaggcaagcgcggaagtagtcattgatgaagaacccgtgaagcagttgcaacagcaggaagcagaactgaacgaaaaacgacaaggctacgtcaaggaaaaatatattcgtggtattgttacggatatgttgaaagattccggcgttaaagcgagcatcgttaagcgttatattccgtacttcaacaaacagatagcatattatctggatctgttgggtgctgattatcagttcactttagatgacgagttcaacgaatcgatcaaatcactggggcgcgatgatttcagttatgcgtcattcagtcaaggcgaacgcgctcgcatcaacttgtctattctgttcacatggcgtgacgtgacaagtaaagtatcaggcgtggatctgtctctgctggtacttgatgaagtgtttgatgggccacttgataaagagggttcattcgcgattaaatccttgctggattctgtagatggtaacgttattgtaatcagtcaccaggatcttgatccgcaggacttcgaccgacacatcatcatgtctaaggttgggcggttcacaaaaccatcaatcaaagatatggcgatctcatgttagaacgtgaatttgatttaaagacctctcccgaagtggagaggttttatctccataatgaactattggaagaaaaacatgtagttacaatggcagatgttgaggaagcattcaaagataaccccattgaattgacccgcatcaagaataataaatcttcggtgtggttcctcgaaaaaatctattgacagtaaaacataaataccttaaagtcgcccgtgtactgagttgcacgggtttttattttgaggaacggaaaatgattaacgaacaaatgtcacacagcgaagcattgaagattttgggcgctactggcgacgaatctaaagctgaactgtcaaagctctttaaacgtgcttctctgcgcaatcaccccgaccgtggtggtagcactgaactcatgcagaaaatcaaccaggcgtatgacgttgtaaccaaaacaaacagcgctggtaaaactttcagtgatgttcgcgcagaacacgcagcaaacaagaaagcgtgggaagaaaaatttgcagcgtatttcgtgctggcgaaaaactatttcagcactaaattcaacgcgcaagaatttgcggaatatttcacgaaattcaccggacaaccaacaacctatacccagacaatcagcgaagttcgcggtcacactgttcacgcaacctatcgtttcacttctggtgatgcgttctttgacttctctttctcttgtcaaccgcctaacggtcaaggtttagcagcgccggacgcgtccgcactgggtagcgtatcagttaatactctggttctggttggtacgaagaaacacaaaatggcaagccgcgattaccaatggggcaagaacccagacaaaatcacgccggaaagcctgttccctactaagaaactggaatccatctttagcccgactaagaaggatctcaagttcaaacgcgcggactacatgacatcctttgcccgtatcctgggtgcgaaggttagcggtaacgatgttattgttgatgttggacactataaagttcacttctaccgtcacgtattcatgcgtaaaggcgcgtatgtgttccagtatgttgttgacccaactgtgaacaaattcaaacctgctgaacgtctgaaaggtactatgctggaagacgaagacggtgcatgtctggatatgatcatcgacactttcaaagaaatgcagaaagtgaaaccagacgcaagcggaatcgcagcagtaatcgacaggatgaacgcagagtttgcagcggggcatcgttcagcatcttttgttaaacgtaccgcacagcaagcagcagcgccggaaccagaacagaaaccgaaacgcaccgttaaccgcatcaataaagatgactatttcaacgcactgaaacaagcgggggcaacattccgcagtaactacggtgagtttgataacggcgcgggtttgactttccacttcaaacgcgagatcagcaaccgtaaaggtttctggagtttcagcagctttaactttatgcactccggtcagaaacatgttgaatggttgaaagatatcgacattgacgaggatagcaaaggcgcaagtatcggtttgctggttgataccctgaaacaacttcgtggtgttgctgactggtacacagcccgtaagatcctggaaggtatgcgtgataacttcaaggctggtaaattctccgcacctcatgtgaagaaagaagccgaacagaaacgcactgaaacgcaagctaaggacgagttaggcgcacagcctacgaaaccacaggcagcgaagaaagaagccccagcggttgataaggcgcatcaggcacagatggatcgtgagaagtcacagatgaatgcaaccattcgttctatgctctctgccctggttaaagccggacgcaaagacacgccggaagaaattaaaaaagcagttgatgaagcaatcgctctttggcgcttgaaacactaactgattatgctataatgggaactgttgaaaagcagttcccttttttatgaggaaaatactatgagttgtccaacatgggcgcactttgaaaacctgaaagaaggtacgcaaaaacgcgtgtttatcaatctgggatggttcgcacctacagattttgacattgctgaaattctggttaatgccagtaaagagatcagcgatacttacgaatgggactgtgtgagaatgccagttctaccagggcagtttattgatcgcgagaagttcgaagcaatgcggatcgccgtcgaaggtatcaattcgctgcatcccccaagtttgggtatgcattaccgccagcgttttaccttgaaaaccgcatggactaaagataaagaatgggtgaaagtatgattattcaggtatcggttcagggcaataccctgacagtaacaaattccattatgaccgctatggctgcatgtcgtgatcatgtgatgtcaaaccctccggtaacggaaattctggaaattgatgtatgggaagacggtgtgatcgaagaatcatttggtttcactccgttagaggaagatttacgtaaaatggaacaatggctatggcaaactgtaccccaatgaaactaccaaaacacacaaccctgttaacccgcgaaaaacttcattctgttgaatggagtccgttagatgtgatggtgttcgatctggaatccaaaatcatcaacgctcatgttaacggtttgagtatcttttctgttgaatttgaaaagattcgcgggtacaatgaagcctgtaaagacaaattgcgcgtcatggttgaagctatgggctacatcgtgactattgaagacaacaaaatgtggatcgcgctatgagcaaagtaaaagcagttttcgccgttggtcatgatatgtacgaagtggactatgcgtttggttatgaacagggtttaccgtggggccactgcaaagaggatttgcagaacttcaaagaagaaaccgcaaatagcgtcctgatcatgggtgcgaacacttttacttctctgcctggtaaattgccagggcgagttcattgcgttctgtctgcatccggtcaacgtctggtaacaaagaacgggaataccgctgattatgtcatccacggtggcgggttgtctgctgcaatcgacgtaatgaaagaaacgcatccagatcgtgatgtgtgtctcattggtggtaagtggttgcttctgcaagcaatcaataatacaatggttgatgaagtggttgtgacgcacatttacggacatcatgtatataatgcaccagcttttaaacgtgatgtttcgttcacggttcctgaattctgtgaagcggttctgaaatatgaactgactgatttcaaaattcagcagatcgaatcaaacgaacgcgtcagaaaaattatcgtcgatcgacatacgaaaaaggcataaaatgaaacaatatcttgatatcgtcaacaccgttctaacacacggtactgaatcaaccgatcgtactggtgttggtacactgcgcatcttcgggatgcaagcacgttggaacctcgcagaaggtttcccagctactaccagcaaacagctattcttcaaaccgtgtaagcatgaattacaatggttcctcgaaggttctaccaacgtggaaacactgcgtaaaatgacgtggggtgaagatagcgataagcggacgatctgggacgataactacgaaaatcaggctaaagcgctgggttatacgcatggttatctgggaccgatctacgggcatcaatggcgctcatttggtgcggaaggttcttattatggtgttgaccagattaagaaaatcatcgaacaactgaaaaccacaccagacgatcgcgggatcatcgtttctgcctggaacccgatggatctggatgatatggctttgcgtccgtgtcactgtttcttccagttcgtcgtaatcaacggtaaactgtctctacagtggtatcagcgttcagttgatgtcttcttagggttgccgttcaatatcgcctcctacgctctcctgacgcatattatcgctgatatttgcgggtatgaagtgggcgatctggtttggactggcggtgatgtccatatctacaaaaacgcagtagaacaagcgaaagagttgttgaagccggaacgcgcaccgcttccacttccgaccctttatatgccgaaggtaaatagcttacttgatttggatcaagaattctttgactccatccatttgaaagactataatcaccacggctcgctaaaagcagctatggcagtataaacaaagggggcgaaagcccctttcttaacaaggtaagataatgagtgatattaaaacagtagtgaagtcttctggcgtaagtcaaacgttcgaaaaagaaaaactgttcaaagtccttaattgggcgagtattggaagaaatattgatgttaacgcattccttgaaagtgtcgttgacctgcttcgtgatggtatgactaccaaacagatccaggctgtagcgatcaagtatgcagcggatcgaatctccgcaaaagaacctgactggcagtatgtagcggctaacctcgaaatgttcgcccttcgtaaaaccgtttacgggcagtttgacccgattccgttctacgaacacatcactaagctggttgaggctggaaaatacgataaagaaatcctgacaaaatggactcctgctgagattgattatctggaatcaaaaatcaatcacgataaagattttgaattctcttacgctggcgttcagcagttgatcgggaaatatctgttgcaggatcgcacgtccggcgacatctacgaaacaccacagtatgcattcatgctgatcgcgatgtgtctgcatcaggacgaaaaacacgctgataaaatcagtcatgttgttgacttctataacgcgatttcggatcgtaaactgtcattacctacgcctattatggcgggtgtgcgtactcctacgcgtcagttctccagttgtgttgtaatcgaatccggtgattctctgggttctctgaacgctgttacgtccgcgatcgtgaagtatatctctcaacgtgcgggtatcggtgtcaacgcaggacacattcgcgctatgggttcaaaaatccgtggtggtgaagcagtccatacaggcgttatcccgttctggaaacacattcagacggcggttaaatcctgttcacagggtggtgttcgtggtggtgcagcaaccctgtattatccgatctggcatcttgaagttgaaaacctgctggttctgaaaaataaccgtggcgttgaagaaaaccgtattcgtcacctggactatggcgtacagcttaacgatttgatgtataagcgtttaatcaataacgattacatcaccctgttcagccctgacgttgcgaatgatcgcctctatgacgcattctatcaagcggatcagagtgagttcgaagaactgtataccagtctggaaaaagacccaacggtacgcaagaaacgtattaaagcggtagatctgttccagttgcttgttcaggaacgcgcacagaccggacgcaaatacattttcaacagtcatcacgtaaaccagcagggtagtttctctgttccggttcgtatgtcgaacctgtgttgtgaaatcgcgatcccaacttcaccactggatgacgatgataaactggctggcgaaattggactgtgtacgcttatggcgatcgttctcgataatgccgatataagcgaattcccagcccttacacgcatcgcagtacgcgcactggataacttgcttgattaccagaactaccctgttgcagcggctctgaaagccaaacagcgtcgttctctgggcgttggtatcaccaactatgcatcctggctggcaagcaactattgcgactactccgaagcatacgccggaaacgttcatgagttgatggaagcgtttcaatttaacctgctggttgcctcgatggaactcgcacaggaacgcggtgcatgtggactgttccatgaaacgaaatatgcacaagggctgttgcctattgactggtactgcaaaaacgttgatgaactggcatcacctgtgtataactgcgattgggaatggttacgcggtgaaatcaaaaaacatggcttgcgtaactcaacgctttctgctttaatgccttgtgaaagtagctcgcaggtgagtaactcaaccaacgggattgaacctccgcgcggccctgtgagtgtgaaatcttcgaaagaaggttcattcaatcaggtagtaccaaaccagaataatcagattgacttctatgattatctctggacaatggcaaaacgtggaaacaaaggttatctgtcgcacgtagcggttatgcagaagtttgttgatcaggctatctctgcaaacaccaactatgatccggctaacttcccagatggtaaagtgaaatctgaaatcatccttgaagatctgctgtatgcaaactatttcggcatcaaaacgctttactaccacaacacccgcgacggtgcaggtgaggaagaagcggaagattgcgaaggttgcaaaatttgattcaatgccccttcgggggctttttataaggtaaatccatgttaactgtaatgaacacaaacccagatcacaaacacttagaacagcctatgttctttggtgaggatacgggcgtagcacgatacgaagaacagaaacaccgtgtattcgaaaccctgactgaaaaacaactgtcattcttctggcgaccggaagaagtggatctgtctatcgaccgtatgcagtacgcgaaaatgccggaacacgaaaaggttattttcgattcaaacctgcaatatcaaaccctgctggataccattcagggacgcggcccgaacctggcgttcctccctatcgcttccgatgtctcaatggaaacgtggatcgaaacatgggcgttcagcgaaacaatccatagccgcagttatacgcacattcagcgcaacctacacatcgacccgtcgaaagagttcgataaaattctgcgcaacgaagcgattatgaaacgttcggcttccatgacaaaatactacgatgacctgatcgcagaatgtcatgaactgaaaaacatcgtgctcaaaatcgaaatgttaacgtcccacggatacccagacgaatcgatcgcagagtacgagaagaaacgcaaagagcaaatgcgtaaatgtaaggttgctctatacctgtgtatgcacgctgtcaacgctctggaagcgatccgcttctacgtgtcgtttaccttcacgttcaactttgccgaacaaggcaagatggaaggtaacgcgaagatcatgcgtctgattgcccgtgatgaagcacttcaccagaaaggcactcaaagcaagatccgactctggcagatgggtaaagatgacccagaaatggcggaaatcgcttaccagtatgaagaagaagcgacaaagattttcctggaagtgtacgaacaggaaaaagaatgggctgaacacctgttctctatcggtgatgtagacggcgtatccctgaaaagtacgatcgcttatatcgaacacctgacagatcagcgtatgcgcgcggttggcttgcagtctccatttaaaccaacgccgaacccgtatccgtggatgaacaaatggttgaagtctgacaacgtacaggtagccccacaggaagtagaagtgagttcttacctggttggcaacctcaacaccgagatcagcgacgaagcctatgcaaaatggcgacaaaaatacgcttgattgtcgcgtcgtaaacaagtataaaggtagctgggatgtcgatattcagagaggtacgaaattcggcaatcccttctacaagggaacacgggctgaaaacataatgaagttcatcccgtatttccaaaacttgattcgaactggcgtgatcacaatcgacgaactgaaagcattggacgggaagcggttaggatgtacatgcaaacctctaccgtgccacggtgattatattgctcactgcgtcaatgtgttgaccggaaaggtgaataagttggatatataatggacgatgtaacatttggtgtaatatttcctttgcgtctgggttcagacaagaggatagaccggagtttcgttaaatgtggcgaattccggcattgtgtgtattttattgaaatcgacggtcggatagtgtatgttggaaaatgtcgtgatttgtggaagcggttagacacataccgcaattcgaaatactggagggaagcaaaccccagtaatattttgaaaaccgcacgtctggaaatggcaatcaaaaaacgtaagcgtgtaaatcttatcgtgacaacacacgatgaagacacatatcatgattttgaaataaacatgatccgaaaaatcaatcctgaatggaacaaacagcactatgacaaagctaaccaaaaatcagaaaaccctctttgaccagttgatgaaactgtgtaacgaaagcgaatgcttctacttcattgatcaaaaaactgtgatgcaaaccaacgtgcgcatctttaactatcgcatggcgagctattccgactggttaaaacccggtgcgctggaatgtcgcggtatcatgtttgcgatggatggggaaacccccgtaaaactcgccagtcgccctatggagaagtttttcaactatgccgaggtaaaggcatgggaagcgctgaaagcctctcctgtgacgattggtgaaaccgtagtggatgtgatgattaaggaagatggttccctgatctccaccttctgtgattccggctatctgggcgttaagtctaaagcatccgttcaatctgaacaggctatggacgctatgagcgtgatccagactaaccgcgcattgttcgaccgcctgaccgaactggttaacgatggtttcaccgtcaacatggaatacgtcgcaccgacaaaccgtattgtaattggctatcaggaaccagcagtggtgatcctgaacatccgtaataacgacacgggcgaatatgttgattatcaggatatcttcgcagatggtgtattacgtccgttcctggttgagcgcgagaaaatcgaaatcaccgatctggatgcattcattaccgaagcctacacgaaagaaggtttcgagggttacgtaatcaaaactgataaaggttttgtgaaagcgaaaaccaactggtatgtaaaccttcaccgcacgaaggatagcatcaacaataacaaagatctgttcttaaatattgttgaaaataccgtcgatgacctgaaacaaatgttcctcgatgatatgtacgcactcaagaaaattgacgcattcgaaacgttattccttgatagtctcaatcgtctgactgcaaaagcattccaggcaatcgaagacacgaaaggaaaatcacgcaaagactacgcgatcgccctgagcgctgacttaacccctgacggtcgtatcatcttcgggcctatgatgcgttatttcgatgataccgataagcaaaagctggttgataacatcgttgcattaatggcgaagaactacgaacagtttataccggaagaatataaatgacaaagtgctttggcgctggaagcacaacgttagaagaagagaaagcagggatcgattccctgcttctttacgttgacgttttcccagaaaccggaaaaattttttggaatagcaatgcagcaaaacagaatcagggaaaagaagctggttctattatgagcaaatcaaaaccttacgtgagaattcggcacggcgatagaaaatatttaagacatcgcataattttctattactgtaatggttatctgcctttgcttattgatcataagcatgggttggaagctggggatggtatagaaaatctacaggaatcagatccgcttcataatatgctgaaaagaaaagctaaatcaacacctaaaacggttaaatccaaaggtgttgattacagggcttcgcgtggaaaatatcgagcacagataaagatagacgggaagcaaaaacacatcggttactatgataccgaggaacaagcatcaatagcttacgaggaagcgttatatgaatatcaaaaacgtattgggtacgtttaatataagttcgtggatatggcctgtaatagttgctggttcgttagcagggcttttgtacatgacaatcacgctgaaaagtgaaaatgaccaattggctaaagatatcaaagagttacaggctgatatcaaaaaagtcaaagagacaaacaacaccaatacggtgatctatgtcgaacaaaaaggtaaggatcagcagttggtcaaggatgccggacgtaaagacctgttgttcaagaaaccaggactgatcgaaatcaagatcaacaagtccttcgaagagtatatggcggagtacgacaaatgaaaatttcaacattagcccttgttctgggcgttctgttggtcgggtgtgctgagaagcccccagaaaagattttgcctacgctccccgctaaggtgaatccggtgaatgtgaaatggaaagtggttgcagaagtccgagagattgacggtaaaaaataccttgtcatgccttatgacggcaatccatacgttgccctttcatatcccgattcgttaatcttccgtagctggatgaatgacgttaagcgtcagaaagaccagacggataacattctgtgtaccgtgggataccctgagaaatgcaagtcaaaataatcaagtcatttttccgtgacataaccgaaggaaaggtttatgatgcgaagaaggacaaagaaggtctctggatcgaaaatgactggaaccgtgatatgtggctcaatctaacgaatgagcataacaaagaactgattgaatatgagattgtgaaatgaatctgtttattactgtaggcgtaccaggtagcgggaaaactacatgggcgaaagaaaaagcgcgtcaactggggaacacgctgactgtttcccgtgacgatatccgcaaaaccctttactgtgctggcggtgatctcactggctatcgcttcaccgaagagaaagaactgtttgtttgccgtgtgcaagaagatacagttcgtaatgccctggcgagtgggaagaacgttatcgttcacaatacccatttacaccaaaaagatcatgatgtgtggcgagagatcgcgaaagagttcaatgctgatttccatatcgaatggattgatgccgatatcgtagaactcctgaaacgcaaccataaacgcggtgtgaatgctctacctgtttcccgtgtctgggcgatgttcgaacagtaccgtaaactccgtggctgggttccggctatgagctatgcagatctgagcaaaccgaaatgcgttatcttcgacgttgacgggacattaaccaaagttggacaacgtagcccgtatgacttcacgaaggttatcaacgatccgcctaaccctcctgttcaagaactgttcaggatgtataaggccgctggttatgcctgtgttgttgtgtctgggcgtgagggtactgcacagtgcgcacatgataccgctgcaagcctgatcggatacgatgttgacctgagcgatggtatctacatgcgcgaagaaggtgatcatcgtcacgatttccacgtaaaagagcaaatacttgttgaaaagattctcgataagtattatcctgttcttgcagtggacgacagggatacaccagtcgggatgtggcgaatgaacggtatcccatgtttccaggttgattacggcgacttctaaaaaacagttgacagtgagtgcgggtgtgataagatacccgcacaaacaaaggagaatattatggttattcgtgaaaatgaaaatgtgatggttgaactgggtgatcgtgttaaagttgagaatcctgttgaacttcaactgaaactcaaccagttaggccagcgcattgctgataaaattcctgctggttatacagtgaagattgtccgcgatggtcagttctccttccttctgggtattttgagtcaacgtaacatcgttgaacagcagttcgggattcagtggaatccggtaactaaattcgtagcatgggcgggagtattatgagcgacaaaatcagaaagattcatcaggcatggttatgtactgaaccaacgatgcttcgttatggttgtgtgtttgggttggttgataatgatcctcaacaggacattgcaacaagtccggttgttgaatatgcgattccggcgaacaaatcgtttgttgaagtggtgacacgttcaggtactacgtatcacatcgttaaccctgataacgatttcatcaaagacattctgaaatatatggatgattgttaatgaaattcaaagtaatgaatatgttgagagcaatcgatcggagtcaacgttctcaatgtatttcgaatcgtgtaggtgctattatcgcgataggtggtcgtgccgtcgcgtggggcgaaaataatacggttgaccttgattgtcgttgcaactcatgcaacaatcatatggtgaatgatgacggtaaactgaaagcggttgatcgtcctgaacattcagcatggtcaaacgataacgaaattcatgcagaaatgaaagcgctattgagtgcgcacacaagaggtgttatactcaaagacgcagcactttacacaactgcatcgccttgccctaactgcgcgaaacatatcgaatggtatgttgctagcggggcgattacatcggtgtattatctcgataaatacgatcgtggtaatgatgaatggatttcacgcttgcagaaatatggctgtgtcgtggaacaaattaaacgggaagagttagaatcgtttatcgacttttccaaagtagtgtttaacaacaatgagtaaagaaatgtctgaactgaaagtaaaagcatccggcgaatatgtgatcatcgaagctactgcgcgtccgcagggttccgaaatcaaatctgaatctggtatcgtggttggtgtacgccagcacggggaacaacctttttatggtaaagttgtttctgtaggcgtagacgttccagcagaagcggcagaacgaatcctgggtaaatatatcccactgccaagcgctcacatggcgaatgttcctgaccctgatctggttgcgggttacatttccgaaaaagaagcaaaagagaaggaaacaaaatacgtttccgcacattacaaagcaatccaggcaatctacgagatctaaaaatggctaaatcaattcaagcaattatcgctgataccgtcagcaaatccaaaaagctgttcgacaaaggcgaaattctggaagccccagcgcgtattgacgtaatgacagcaatgatcattgatgcgcatcagggtaaacttaaatcccgtgccgatgaagtcatggcgtacatcgtccagttcgaagacgtatgtaagtacgcgaaagatgttgatccgctggttcgcgaaatctatcgcaaacagttctaaaaaatttgcaggtgtagttcaattggtagaatatctggtttccatccagattgttgagggttcgagtcccttcacctgctccaattcgggtgcgtagcgcaatgccgttaaatggttcggaatatgcaaccatatcccacgggataggctctgttggtatccggtaataggttccccggaatgcggggtgaagtaaagaaacttccagcccactaaacaatgtgagatctatatgagaattcgtgaaaagacggtgtatgactctaagttaggcaaaacaatccatacgttcaaagagattacgccagcgcaattcaaagagcggtacggcatgacattcaacgaatggaaagcggggttatgtaaaaatgactaccgatataaattaaaattccgtgaatgttatgttgatgacgatccttatgcagcagatgtatgtggtgaaacagtaccaattatcgagaattcgcccgacgcactaatacaatcttgtatagacgcagcatatgaaatttaaaagagaaaaatatgaaaggtcttcaaaagctgtttgaattaaccccaaaaattcgcgaaatcgtcgctgcatcaactgaaaaagaaatcaacggtaaattgatgaaactgtttaccgaagaaatcccagatttcgataacgaataccgtaaagcgttcgatgcgtattctgttgatggtttctttgcatcaccgcaggtgaatagcaaacacgaatatcatcgacgattctttgactggtcgatcgtcaatatcgttcgtcgaactgatatcgaacctacgaaccatcagttgatctctatggattcttctgtattctttatccagtaccttatcactggtggatttaaagcagaaggtattccgttctgcaacgaagctctggaagaagaattcgcagaagcgtataagtatatcaaagcagttcgttaatcaacaggctatcttcggatagccttttttctggagaagcacatgcgctttttaaaatacgcaagctggcttgtactggttccccttgatattctttctggtgttctggctattctgctggctcctttcgtggttccgttctacagtgaagaaaccggacacttacctaaagggttccgttggatggaaacattcgataacccgatcgatggtgatggtggacatatccggcgttgggctaacatccggtatcacttaggcgatctgggtgtgtatgcgcaacgtgtaggctggttgtggcgtaacaaagcgtacaacttcgcttatcacgtcttagggcgtgaagcacagtcagacttcgcctggaagggcaacccgaaaacagaaggtggttccgatccatcacgtcacggttatctgttgatgtggaatgattcggcatgggggctttatgtcttcaaaccgtggcttaaagtcggaaaggttcagttctgcttacgcgtgtattgcgggtggaaactgaaacaggaagtaactgaccctaacgggctggatcgtgcaatgctggcgttccatatcaacccgttgcgttattatgtcgtagaaaggtaatacaatgaaagcatatcagattttagaaggtttacacactggcacaatctacctggaagaaggtaatgatgttcgtgtggtggtatccaaaaccctcgaaatggattcagtgatcggtaaagctcgcgttgatccattcgcaaaacgtgaagtcgatattgaatttcaacccactgttaaagtggaaggtggacaacacttaaacgtaaacgtgttgcgccgcgaaactctggaagatgctgtgaagcatccagaaaaatacccgcagttaacgatccgtgtgtccggctatgcagtgcgtttcaattcactgactcctgaacaacagcgcgacgttatcgcccgaacctttacagagagtatataatggcgattgaagacgtacagggctataagccccactcgaaagaaaagatcgacaaagtaaaccgcatcaaggccgcagaagttgccctgggcgaaatcttcaaagaactggatgaagagtattcaagtgattacgcggtatcagataccgattcattcactaccgaagaactcgatgcgatgcttgaacgtatccatcaaatccaaaaggcgaaagaccgactgaaagaagcctctatgtgggcgtgtcgtgcggtgttccagccagaagaaaagtattaaaaatcaagccgttgccgaaaggtggcggcttttttcgtttttatgcaaaataatgcttgcactgaatcgtgagtgtggtaaagtacacacatcgaaacgaaacagagaaaaggaacgagaaaatgattaaattaaacccaatcgacgcagcaaaacatttcgtagtagttgataatggtgttgtggttgcagaagttaaggaaatcgctttctctgacccagacgcggaaatgaaaagaatgggctactcttaccggatcgagcacaaaaacggtgaagtagaatacgccgacgatatctctgacgttcaggcgaaattctaaaaagttgttgacctaatctgggggctgtgagaatatagccccatcgaaacgaaactgaggatgacattatgaaaacttacaacatgaaagaactggtttgcttcaacactcgtcgtgaagcccgtgcgtatgttctggctgctggtaaaaatacctctgctgtaatcgacctgggtactgataaagctgttggcgcacgttgggctgctgttgtggttatcgctgctcctgtgactcctgttaaaactctggttctgggtgcgcgtaaagccgaaactctgaaaaccagcacttgcaataacagaggtgttcataatgtcaccgtcatcaaaaaacgtagctttggtttgagggcttaaccaatgagtaccaaagaattagaacagaaagtaatggggttcatgagtaacagcgaagatcgctatgcaaaacacctcattgtcgaactgatcaccgcgttacgtcgccgcgacaaagagatcgaagaacttaaaaatgcatcggttcaggttgtctataaagatcgcgagcgtagtagctgggaaaaagaatgggatgcaaacccccaagaccgccaccttttcgggaaataatcatgagttccattaacacagaaaaagattttgtgatgtttgttggggtacagactgtaaagaaagatatcttcggtaaactgtacctgtcgaacgacgatcgcaaccccgcatcattcgaaaccgaagatgatgcatatatcgcgaagaacaccagcgataacgaagacattcgccagtatgcgcggatctataaccgtgaagtaacaacccgtctggagagagcgtgatgcgtgaaggtatcgaagtaagaacgttccagttcgaaatgcgtcgtatcccagaagcatcaatgaatctcattcgagagcacaacgtgaaaatcgtagaaattgatgcatacgcgggtactgatctttataatgatgcgaagattgacagcattgatttagaccttgagggtgatattggggatctgaataagctggctattgcattgaatgcagaaaccaacaaatacgggtatacaatcaaatgaaatatattctcgaatatcatgagcatcaaattaccgaagcaatgatcgataagatgcgggtatataaccaaaacattaccagcatcaaaccgctatcagtgtgtcgtgaatttgggggatactccttcgcgatgtacacaaattccgaagacgacgcaaccgcgtatctgaaaagtatcggtgcaatattcgacaaattcgaaaaagtatggaaggtaggtttctaatgaaaaagtattttattgaagcggcagatcgtatcgttcttgctctgttgaactggaaccgtcgccaggatgtctctatcatggcatcaaccaacgggacaacatatgaccgttatgatccggcgcgtggactccataagccttacgaggttaaagcgtgaagtattacggattcaaaacgagtcatttcggtaaagcataccgcactgacaacattgatcgcaaacgtccgtactatgattctctggtacgtgctggacgcaaacgcgctcgccaggaagggaagaaggaagctgaaaatgaaacagaatagtgaactggctttgattgcttttggttttgctctgggttgtatggtttctgcattactcgttaacttcgcggggtgatgatggacatcggatcaggtagtcagtatccatcatgcgcattgagcaacttcgccccgcatccgtttacgtttgacggggtagaatgtgcatcaatggagggctttttacaaagtctgaaattcagcaatccagatatgcaagcgcatgtgtgtacgctggttggtaaagccgccaagttcaaaggcaagaaaaagaaatggtatcgcgatcagaccctatactggaagggtatgccgattcaccgtgaatcagaagcgtatcaaatcctgattgaaaacgcgtacaatgctcttttcctgaatgacgggttccgccgtgcgctggctgcaaccggaaaaagtaccttgactcattcaatgggaaagaataagatgaatgaaacggtactcactgaacgtgagtttgtccgaaatttaacccgattacgggatctactatgatagccttgattgtcatcggtatcattctatacctcgttgttggtgtatactgcgccgcacgtttttcctggtgctttggtgtaagtcataacggatatcacacaccaaaaactttgcttttaaaacataccattttcccgctgatcgtgttattctggcctttcttcggtatatggttaatattcgcactattttttgactgagagttactatgaaagattatgatgaaagagtagaatgcgcgttcctgttcaaaggcgcgattaacccgctggcattactccacgcacagggtgctttgagttctaccctgattatgggtgttatctacaaagcgggtgtgtattacgttaccatcggcgcgaacaacattaacgtgatcaacagctacgttgaaaaatgtaagctgaaagatattgtgttcgataaagtcgaaatggatgttccaggcttcgacgctgtttatatgtacaagggttgatgatgggttacgtagtttatttcgattgttcagatcttgatccgttcgttctgcaacaagcaaagaaatatcatcaagatatcactggtatcagtgtcacgaacgatgatatgctgtgcatcgaatttgattattatcgtacatttgagcgtgacaaattccttgcggatattgaagcgtttaaaagtacccttttctttgatcgttatgaggttaaatcttgaagccagttattcttaccgacattgacgggatcgccgtgaagtggcaaagcggcctcccgttctttttgtctaaacacaacatgccgaccgatattgccctggatatggttacagatgaaaagttccgtgatatgaccgaaatcttcgggtgcgatcatcaactggcgaaaattctcatggaagaatacaataacagttcgtttattcgctatctaagcgcgtatgacgatgcgttgattgtgatcaaccgtctgaaagcccaatatgatttcgtggctgtcacggcgctgggaaccactcctacggcaagccttaaccgtattgcgaacctgaacacgctgttcccttctgcatttaaagaagtgatggttgtcgggcatggtgaaactaaagtacaccgctatctggaagcgaaagccaaatatggcaatcgtctggtttgcttcgttgatgatcttgcggtaaacttaaacgaatgtcataacgtcatcagtcagttgccgttattccatatgttgcgtggtgaacgtgaaaccccgtggtcgcctcaccagtcagttaaatcatggtttgaaatcgaagagaaattacatgatcttacagattctaaatgaactcgcttcgactctgaaaatttcagagaaggaagcgatccttaaacgtaatgcaggtaatgaactgctgaaagagattttccgcattacgtacacgaaacagattatgtttcacattaagaagtttccgcaggtggacggcaagccaggcacaaccccgctatcgaatgctatcgcggatttgatgtctgatttggcaacgcgaaaatatacaggcaatgcagcccgtgatcgtctgctggatatcgtatcatcggtgaacgagaatgaccgcgaagtgcttcgccgtatcattaaccgcgatctggaatgtggtgctggtacaacgttaccaaaccgcgtatggaagaaactcattccagaacagcctcaatgcctcgctacgccgtttagtgagaaagccttaaaacgtattcgcttccctgcttactcgcagcttaaagccgatggtgcgcgttgtatgtccgatctgctggaagacaagatccgcaaagcatcccgcgcggggaatgagtacgaaggtttggtgaatctggacaaggatctgaaaaagattcgtgaatatctgggttatgatgttgtacttgatggagaactgatttatgtccctgctgaaaaaactgctgtcgttccttcaaacagcgttccatttagtcttgctgggtttatgggcgatgacgacgattctgtttctgaccttgtggcagatgttaggcgggaagctaccgagaacgagacacaagcggaagcgaaacgcgaagagggcaacgggattgtaaacaaatccctgaaaggtactatcagcgacgaagaacagcgcaatatcgtttatgttgtctgggatatcgtaccgtatgaagtatactatggcgatgctccgagtgttcaaccatattgcgatcgctttagcatcctggaaggtgcgctggctggctctggtgtaacatcggttaagttgatcccttctatcctggtacagaactacgcggaagcgaaaaaggattacaacaattaccgcaatgacggtaaagagggttcaatcctgaaaaacgttgatttcaaatggaaggattcacgcgttgcggatcaggtgaagttgaagaacaaaaccccgatcgaactgcgaatcatcgacgtgtatgaacacaccaaagaacctcataaggttggcgggttcgtggttgaggacttatcaggagaagccagaacaaacacaggttccggtctgactgatacggactaccgatacgatgaagacggtattaaccgcgtgtacatcccgttagaagaacgtggtgaactggatcgcgaatacattatggcaaacaaagatgactatatcggcgctatcgtcgaaatggaagttgacggactccagaaatcgaaaacgcgtaagaagggcgaacctgagttcagtttcttcctgccaatcatcaagaagattcgacgcgataagaccgaaccggatgatattcacgttatcttcgctgatctgttttaaatagcactttttgctaaagaagccccttgcatatgtgaggggctttttgtatattacacacatcgaaacgaaacagacaaaaggaacatcccatgcaaatcactaaagaactcgaaggtaaagtaatcgttctggtaaatgaagaccgtttggcacaactgggtaacggtggtgaaaaactgccagcggacgcactcgaaagcctttctaaaatgcgcgtgatgcgtgttactgacggttgggttacttgtctgcctctgaacgacgaagacaaagccgtatacgatgcacaagcggattcatgggatatcgaagtacctctggtgaacatcgaagttgaagagtgctacgaaatcgaaaaataatgcttgcttcctgggtagtgtagtgatacattacccacatcgaaacaacacggaaagaggaaaagattatgtcaatggctcacttaactaagaaagcggattttctggctctgattgctggcatgaacgcaccgcgtttaactcgcaacaacattcaggtgtatgtgtttgacgagaagccaagcaataacgaagttcagttcccgactctgatctattgcgcttctaatttccgtgaagaaagctacatcgcagcacagaacaaattgtggaaattccgcgattggatgaacgaggcgaaaaatggttgatatgagtaaagaagccgttgaagcacgggttgcggaagcgctgaaagatattgatttcggtcgcttccttgataatgctccaacgataccggacacaatctgccttaattgtgggcgttgtgttatggttggaaaatgctgtgataacccgaatattgttatcatggaaaggaaagaagtttcggaagaagtctggaatcagattcaggaaatcattaagaatccaccagaaccgacgaagcgtttgcgtgaaatcatgagcaggaataaattatgaaatcagaaccaagtaaaactatccgcctgatccgttgggaagggcaagaaatccgttatgaagacgacgatcgcgaattcgttcatgaaatgcttgctcataatctggggttcaaaaacgccgcactggtgatgatgcagcaaaccagtgatgaagacatctggcaatgcgtcattctcgatctggacaaaaacaaggattacaccgaagatgaactgttcgcgctcacagagaacgctacagcgcgtcagaagtgcttcatgatcgatatgcctcgcgagaactacgagaatatcaagaaagcccgtaaacagaacaagaacaacgtgttcgacctgttcatgggctatcatgaagaaactacggcctaagcctcactggttttgctggtgtcgttcgtagccgctgccacctgtacacattccaatgtttgcaggtggaaatcttttgatacatcgcggatacattcaacgatcagatacttccctgaatattcatcccctaacacctcaatcaatgcccccactttaacatccattcgaccctgattgatatcaaaccgaatacgtttttcataactggataacgtctgacacttaacagcctggaacggttgaccctgtttgtctgggttctggaagttgttctcatataccgcgttcctgttcatggtgatccatgcgttttcaatatcggtactcgcaaggatatcactatacagttttttatccgtcatcgagaaactaaagaaacttgcatcccctaacagggtagtgttatccttatgggtaatgtattcacctttcgtgaataccaaagcgtcacctaaaaacgggttacttacgttgaacttgtaagcctttaacggggtttgtgcgaggatctccgtattgcttttcataaagataccggaaccatcttcccacaaataacagaagtcagacgaatctacgctctgcccgttgtcacggatgtaatcaaacacggtttcatacgtcccgctcaggcaagccggaggaatacgcacgtttgatgcgtcgatatgcggcgtgatcaacttcatatcgttatacagtgccgtcatgcactctgtaatcgtctgtacggcgttgttactgaacgaacgggaaaacttacgacgaaacaccgtatgcaccggagaaaggtttaggcgcagtatagagcggttcatatcatcggtttcgacgtttgaatacagaacaccgtagtaatgctgttctaacgtttcgttatactggaaggatacctgaataatcggtttttctgtcaactgatagattaactggttatcatagatctgcatcaatgtttcagaagtaccgttaatgatggttttctcactcattgagacaagggcaggtaacaattcaagatagacgttatcagcgaacttttcatatgttggatataatttaaccgacacgacgcggtttataactttactggacattagacatcctccctttatattctatttactaaatagtaaatatcgggatacttgaggcgatcatgaaagagaagaaaaacacacttgataaatttatggttacgcgtttaaacatcaagaacagcaaaaataaagtagtcacgttgcctactggtgaacaggttacgatcccccgtctgggttatcgtcatttcacccagattaaagcaatgaaagacccaatgcagttgcttgagtatatcatcaaagagattcaaccgcgcgaattaaccgcagcagaaaccgaattccttttgattcacctgcattatcataatgacgataaggcaatggcgatactgaaagagatcggtattaatctggatgatatgaaaatcagcgaagctaagtatgaacatacttttgataaccttcgattggtcttcaacaaaccgaccctaatgctggatgatctggcattactgcttaaagaagcgtatgacaacgggaagccgatcgaactgacggacgaaaaccgtattcaattaattaactgcctgtatcgttatgaatatgacgatgtaaaacgtggcgtactccaggaagtctatattgtgcatgaggggaaaaccattaaagggcttaacatcatcggtgaatgataatggctagcaatccatattttaacgaagaacaacgtcgccggatgcagaatccaccaaaaccacaggcgcaaccgactgttcgtaagatccaggcaacgttagataaagattcgatgcgtgagttaaaggatatcaatgataatacccttgaaaccgcgctgaatacactggacatcaaagacagcgtgaaatcctttgaggatcgtttcaaagagaaattcgctggcttccaggaacaatacgaacaggatcagcaaccacttgctgaacagttgcccgattttgttgggccagcgcgtccaccatcattaacagacaacagcacaaccagtgttgataactccgtcagtgtatcgaaccagcataacccatttgcgaaaatcgaaacatacaccggaacgattgcagaagcaatcaccaagtttatcgaactcgctgaaaagaaaccagcccccgcgccggaacctgaaccagtaccggaagaggaaccggaggtcgatcgggacaagaagaagatccgcgataaggataaagacgagaagaaattcagcaagaaagtattgtctttgctgggtgcaatcaaggataatacatccggtcttctggctcgctttatcggttattctctcgaagcgctggcgaagtttgcaaaatggactctgattatcggtagtatcgtatttgcgatcgacgtactgagtaaggttgttcagaagtggttccaggatattcttgcagagggtgaagcctcgaaagatttgtttggttcatacttcgggaatatcaaaacccttgctgagaaaatcaacgaaggtctgcaaaacttcgatatgagtaatttgggcgaatcgctgaaaaacttgttccttgaaccgtttaaggttctgggcgataccatcaaaaccgcaatcacggaaggtatcggtaatctgatttacgctctgggtgaatataccggatctgaaacgattaccaacgccggacgcggaatgaaagtatcagcactgcgcgacaaacaaaaatacggtcttgaaattgatcccgatgatctgattctgctgaaacagcaggagatccaggatcagaatgataaagtggttgaggcacgttctaaggttgtcgaacaggttaaggctacccagggcgcattctcatatagtttcggacagcaaacagacgcacagaaagcattgtctaagcaattggaacagatgcgcgatcgtgtggctattgaagaaaagatcaccgaagagaagaagaaagaactgaaagcattgcaggaaaaccccgcactgttacaggctgaggttgataaagagaataccgctaaccgtaagcgcgtggacgaaaccaaacagatcgaagccgcgcaagcgaaagcgaaacctaaagcggataatgaattcgatcagggtgatgaaatcctgaacaaagacaatctgacgggcaacgataaaaaggtaatggaaaaactcatagaatcgcttgaagagaaaaacaattcgaacaagctgaatgaggacgacaaagaccgctatcgtgatatgatctcccgctggcaggaaaagatcaccacagtaccggaaacgagtgcaagtattgacaagcaaccggaagcagtgaaagcccctgttcagcctacaacgcctaacagcgttcaggtcaacaacaaaacagtaaacaacacggttcagcattcagtacaacgaactgaccgtaaaccattgattgcattagcttaaaggaaatttaaatgaaaattacagtattgcaagacactgtacaatcatttgctgaaatcaaaaatgctggcatcccctctgggggtgctgcaacaactaaaaacgcgttgactcaaccgatcgtaacagcggaatttccttcccaacgtgcagcaggtattgataacgcttataatgcatcaagcctgtataataacggcttgctgttcacagcatatgatttcacgggtggacttgcaccaggcagtaaagacaactaccgctcattacgtcaggcagcacagaacgcgcaacagatccttagtgctaacactgggaacgttcgatacaaacaggttttgaatacccgtactatgggtacacttaaccccatttgtcaaatacttttaccgcgaagcctgaacgataacgaagtgaactcacaccgttatcaggatgcaaccgatagtattgttgctaaaggtttatcccgtgcggtatcaaacgttatctggggcgctgtagaatccgtttctggtggtattctggcagaccgtagggaagcaatcgacatcggtacgaaagcagcgtttcaaggctctgataagcgcacaaagatgtattacaatacattcgttatcgaaagccgttatgacctgctggaactgattaaaatctattacctgttcacggtgctgggttatggtactacttcgggcggtactccagcagaattagccggactggttaaacaagcgtataattccagtgcttcgaaggttgcaaacgtttttgcaccatcaacaaaccagacgacagcaagcgatttcaacggcagcatcggggatcagattgttgacttcgtatcgaacgttgaagttattaaatcgcctcctgtgtggtttattcgtgacttccagacaggtgacagtttgcggttccctcattccacgttcgggccagcaggtattaccagcgttcgtttcgggcgtacaatggacaacattgtaaatacgttgagagaatcaccgaacaccccgatcgcagttgaaatcgaaattcagtttatggaactgatcgatatgcgtcaggattcgatttttgatacgcagtattaagggggaacaatgttctatagcgtagatgaatttttgtcaggaatggcaaatagagacttccagcgaagcaacctgtttagtgttgtattcgcaaccagtccagcatcacgcattctcgacagcacgatcgggagtatccgcgatactttaattgatggtactatgagttccattaacgcgaataacccgaacgagttcatgaacgctattacagggggcgtaagcaagctattcagctatacggttgataaagctattatgtccctgaacaaaacaggtttcagtaaaatcatgggggcgttaagccctcgtttaattacttccctgtttggtgatagtgtttacggacagatgctaacagaattccgtgacaaaatgatgtataatatggggttgagcatcgttggtgttcagttgcctggtaaaacactgggttatgaatacgtgtataatggcggtgtaccccagatccgattcacccgaccggagaatggcgaattatcgctaacgttccgtgtggattcagaagcgcgtaacctgaaagtattcaacgaatggttgtcagctattcgtgatgatgtctcaggccagttcgcattcattgatgaagtatcaagcgcgatccaggtaaacttacacaatcgcgatggtgtcccgcacagcacgtatgtattccagaagtgtttgcctgttaaagtcagcaacccagaactgagttatgaaagcaataacgaaatctggacattcactgttgactttgcctataaaacaggctggcttgttgaagcagataaagaaggttgggacggattcaaacaatcacttatcgaaggggcagcaattgccgttcgtggtgtggttactggacaataaggggcgaaagccccttttgaggttaaaatgattgacataatccgcgtaaaactccctggtggagtgaagcgattccctatgtttaccgtgcgcgatcagttgagtttcttactcacaagcgcggacatggaagggaagacgctcacagaacagcaagaaatgctggatgaaattttagatattatgtatccgggttattcccgcaccgaacaggaaaacattttcactaaggtgtattgtgtatcgttcggtaagaacgcaatcaagatccgaatcaaaggaagcaacggacaatcagaagcattcatgcatgtaactgattacgttttgcaaaatgaatatgcccttgatgattcgcttactctgggattcaaattcccgaaacatcgtaacaacagtgaacaattattccttgaatgtatccagtatgtcaagcaggacggcgaaagatacgaatggaatgcattagacgaggacacaaagaacgcgatcctggatctggtgtctattgaagatatggaaaatatcgttaaactgttacgcaagtcctgtcatgttaccgtgcgtgatattgagttcagcgacttattgacactgtacaaaatcctgttcaacaaatcagaactgaatgagttcttcaaaaccaactatttgttaaataagaataccgtacagattgaacctataatgaatggaagcccgatggaacgttcaatttacgttgcattgctggcggaagacttgaaacgaaaagagaatgcaaatgcgtaaacatacaccccgacatatcccaaaatataatgtgacttatcgcccgttaaccattggcgatcttgatgacacggataacttcattattgaaggtgatgtgttcaagcatcagcgcgattatgtttacattatggctctgttcgacagtatcaacaaagagactgtagatctccaaatcaaatgccctgaatgcggggaactgattaagtttgtgctcaatcgtcatcatatcatggtggatgaatacgaagaaaagctgtacggcaatgagatcaagatttcagtcgaaccacaccgcaccggaaaggaagagttacccgaactgattaagtttgtagtcatcgacggtgaacaaatcttatgggatgactgtaaagagtcagagaaagaagccgttctggatagtatcgactatccggtctttaaatcaataaatagcgctctggataagccagcaatcgttgcaaacattccggtaaggtgttcgtgtggctacgagcatatcgttgcactgagaggcttagaggcgtttctaaaggtggttggataaaatgggtgttaaccttcgcttactgtatagcgatatcgatcccaacttaacaaaagactggaacaatgacgtaaccgcctcgaaaggggcggcagcggtaaagaatagtctgatcggtatcgtaacaacacaaaaaggcacacggcctttcgatagcaactttggttgtgagatcggggaacagattttcgagaacatgaacccgctaacagcggaagcagtaaggacttcgattgtctccgcgatccgcgcatacgaaccccgtgtttacaatctggatgttgaagtgattccgcagtatgacgaaaacgcaatcaccgtgacgatttactacagcatcattgatgaaccggaagaagtagaaagaatcaaactccagctatcatcctcataacaaaaagccccgaaaggggcttttcttattccatcacgatccagcccattagctgttgatatcgcaattcgaacggggtgatgaaagagcggttattgataaccttcgtcccgttataggacttaatcacttcctcaccacgaagcacatattcgtatacttcgtccatcgtatcataacgcacttcttcgacttcgaagcagaagttggaatattcaatcattccgatcttgtttgcgtaacggcgttcgatgcagccctgtttttcaatctgagtgatcgcagtatcaatgaactgcgcaagtgcttgcatgaaattaccacattcgacttcacgacccccgcttgagatagccaggtaaacgcggctcaatccatcattgccgatgtaaccgatacagtcaccgccaatatagacagaccagactttacccatcggccccatacccatacgattctcactacgagaaacacctttcagtaacagtgccatgataccgccgcgaacgtaattcattttcatgataagccccttattttttcaggttgattaaccaagatggttgggtttctaaactaaccgctttccaagcatatgcaacactataaccggaatacgtctgacatacaacagcattttcatttaaatatttcactttgtgatctgcctcttgttcattcagggcagcacacacgatattcttttcatacactccgccgtttggctggataatggtttcttcaatcagataaacgctgttcatgctaattccttctcaattgcttcgatgatgtggagaacgtaaccgttcagttcttttgctttatcagcggcttcaaccataccgtaacgaggaacttctaaaacgttcgcaccttcgagcaggttgctttcgatgtctacgattacgtagctctcaccgattactgcgccttttctccagtcttttacgaacttcaccattttagctttcatgttctcgttccttttggctgttccgtttcgatatgtgtaatataacaaagccctcacgcgaacgcaagggctttttgagttaatgcataaaagatttgacgtacttcacgatttcttcacgacacatatcgaccggagtatcctcagcaatagcagcatgacagaagatttcaccatccagccagaacgatagcatgtactgaatatcccgaccttcgttttctttctggtgtttcttgatgcgatcaaatgcatcatccatgctttcggtagctgtaagcatttcagattcacccgctacagcagccatttccccagcttcatcactgaattcgctttccagttcttcccagtatactatcgttatcatggattaccccaaacagattttacatttacagagaggacattccgcctctttaacgcgcaagcgctttgttgctgttcgcttcgctgtgttgtgatcatacacatgcaaacagcggtaacagatcaccaatcgtttagccgtcataaccaccaccgcaacgaacatcaccttcaatgaacagttcgcggttatctctcaggagattgtatttcttttcgagttccggcccgaatgcgtccgcgtcgtcataccagtcatagttataacttccggtttcatcgtcgtattccggttcgtcgccgcgctcattgaagtgaacgattttaacatcatccagattcagttctttcagcttgtcccaaatgcgggttatttcgacgctattacatccgaacgcttccagtgtgattgtaccgtcatcgtgtatttgaggcgaaccccagcgaggacgagtatcatcaaacatatccatcagagattcaacgtttgactcaccgtaaatctttgcaacttcctgttctttaccagggcggacaagtccgatcccgataatgaaactactgcttgagctattgctcacgaacccagaacgaatcttcatcgtcttgcctcatatttcgcgttctccgcgattttctcatgatacaggttgtatgacaacaccagcgggatacaagctactataagcccgatgaccgccagttgatattcgcgtttatcgaacgccataaatgcgatcgtggctcccagaataaacacacctaatgcaatgatgaagaataatgtcattttggcagggtatccatttcacgagattttgctttcaggatgtcaatcacagtagtcatcgcctgttctacatcaccatcatagtgaatcaggaatgttttgtgaagtcccatgatcagacgattgatgatataagccatttctgacggtaacagtttaccattctggcgatcgtactttccaaacaagcggtagagttctgcgctgttgcctggcttctcaatgctgaaattatgcatcccagacagaataccatccagatacagaacagttttgttatcactgcgcaggtgtccaccgaccttgtagtagttgctgaacacatacggcttttcgcggatatcttcgatatcgaaatcaccatgatcttcgatgttgccaacatgggcgaagaaatgatgatcttccagttcgagaaggattgcaccctttttgtaagggaatccgactaaatcaatctgccagccattttcaccgacaaatacatcatcaacaaccacgaaatccggcagcataggcgcgtatgcgtggttcttttcgttgttttcacgataggcttgtggttcggacaggtacaggatatcgccttttacaacttcaccccagaatacgttacgtgacatattattttcctcaatatgccccctttcgggggcggtcattgttagattttgacttctttttcttccaggacgatttcacattcgaatgatgtggtttcccagactttccagaaatcggatggaatattatcttctttcggaagaatatcttttgcagcgatagaaactttggtttcttcgaagtccagatccgcgaaccatgcatgggctactacaacaccgtacattacgcgacttaaacgggcattcagtttacggacttcctgaatcgttgcctttgtctgcttatcaagatactcgactacctgatctttgtcaagcgcatccagttcagatttcacctgatcgtaagcccacaggataatcaggtcgccgttgttcagtttcttcttaccttcgtcacgtttcgcgacggtagccgctacagcaggaagggaggaaacacccttgattttcacgttcagttctttcgacatgtaaacatcagtcgattctgtgcgctcaaccttcggagagaacccgtaatcacgaataccctgttcagacagccattcacccgcagcctcaccaaagcgctgtttcagcccttctgcgttgcgcagtccgatcgcgttgtcacggaagaacttcataaccttctgacggcctttcaggatttccagacgcacgttatcagtcacgaactctttaccgcttaacccgcgagtcatgccacggttaaccagaggcagagaggtaaagtctaccagaaccgacatacgatcatcaccgattttttccagcggcttgatagtcaggccagaagcacgaaggtttttcagtgtcggaatatcggtttccagcggcagaactttaacgttcacgataccatctttaacgatggtgaagttacgcacctgcttagtttcgactttttccggcagaccgaattctttctgtttgctttctgggatagtcacatacccttccagatccgtgttgatggaaatgttcggacgggaactgttacccaccagatgtttaaccgatactttggttgtggtttgggtaaatttcggtgtccagacttcatgcgctaccatttgcgccgccagtgctttacgttcttctggggttgcagcgtttgcgatctgttcggtcagttgatccagtgtatcatcttctttctgtacagtctgacggcctgtgcggttatacgcccagtgctcagaagacaggtcgatcactgtgtcagtttgtgccagcagttcgagcgcatcaaccagagtgaacgcgttttcgtctggaaccatgttgtaatcaataccatcaacgaaacgctgtgatggatctacaacagcctgtgcaatcaggtctttcgcgttggagtagtcctgtttggtaaagcagttgtcatacgctttgatcagacggacatcacccagcttttgaagcactttccatgccagatcagggttcattgtgtgcagtgcatgataaagcacgacatacagaacttgctgttcgctggcgatgttcggatcgaatccgtcaacatcattaatcgcgttttcacccagcgcccagatgtttttgatgtgttctggaaccagcacaacaccgtttgcagcgttcaggacatacacgcgcccttcgtccaggtagatcgcatgggtagcatcagcaactttgacttcgatacgcgcggaagtctgcgcggtgatgatttcgttaaatgctggttcgtatgcgtcgaaaccttcaacgaatttgtgcaatgcgttggttgcttctgccattttttccagcagaggacggtttacataataaccgtattccaggaacgcgatactgttgaaagtcagtggcagaaccgcacacgctttcagaatatcatcggtacgccagcagttatcataaccgtctgtcaggaagatcaggctgttcaggttgccgttttcagattgcagatcggtagcgatttccgcagccagattcaacggctcaacaaagccagtacaacccgtaggtttcaggtaacggtcgatagccgcgcagatgttagacaggtcagagacattgctaaccttctcaccacggaacaccgtgccgtaatcgcctttgctggagaagtacaggatcgaaacggtgtcatcctgtttaaccagactcgccaggtttgctttcaggtgtttacggatcttaggcagttcgttgtacattgaaccggatacgtcacacacgaaaacgtggtttgtcggggttggcttcgatacagcgtttttgaattcgatatttgtgattgacatttaaattttctcgtatttgaatttttctaaaatttcgttaactttattgcttactgcttcgactgtacgatcacacccgaacttacgcgccaggagttcaacgtattcatccatcgtagtgagtttggattcagcaacgtcaaacgcaagcgcatacattaccggattccatacccgaacgatttggagagtatactcgttcagttcaaatcgttcaagatattttcgcaaagaaaatacatcaaacggtgcggggcgatcctggctaaaggggatcgactcccctaatgcatagcgaggcataacaacacaaacttctgttttcagtttattatccatcagtgatgactctttgatgtgtgttcaaggttacggaagatgtttccatgttccagttgagttccgatcgggccgcattcatcggagtacgtgaattcaaagataaacacgccgtcctgattgccgaacttcgtgttgtattcttcatacaaccacattttgatcagagcgtctttctcttctgtgtccagatcgtaccagtctcgcccgtcatacgcaagcgcaatttgaggatttgaacggtaacggttttccgcgctttcttcggtttcccagtcatagcgcttatcgtcgtagaacgattcaaagctattacccagatgaccgcctaagtcacgatgaacgtgattgaccacttcttccgctgtcaatggcggatcgtagtaaccacaatcagggacgcaatcgcccatcatttcgcgcaggttgtcgatattagtcggatctttcgggaaccggacgatgaaactacttgatgaactattgctcacaaaaccagaacggattttcattttacatcctcaaattgtaagttttctttggttgcgttcgcaatggctttttcgttgctcagtgttactatgcgcagacgttcgccagtaaagccgtcgcattcagtgatactcacccagtcaaaaggtttagccatttcaatcgcacgttccagcgatacggtagaaccgaccaaatcactaaatgtatagtaatcttcgcttaaactttcaacagtataaattttcatgatactttaccctttgtttcggatttcaggacgatgttactgtaaggatcttttgctaccagttcccacaggtcgccaggatgttccccgctacggtagacggatgaacggatgatttcgttaaacttgctcagggcttcgtcgatgtcgtcatacccgcgtttgaggggcttacgattgcaacgaatgaagaacatttcgttggtattctccccgcgttcggcgtttttatttttcattcgatcaccattttaccaataacttcttcgtaggtcacagggttcggttcataaccgttagcgcctattgtatcgcctactctgttccccaccaatacagcaaccgcaactttcttaccgtctttccatgcgatgaattcgagatcatcggcaacatacgggaaggtttcgtgattgttcactgcgtcgatacagtccagaatagtatccgatgcgcaaatcagattaccaggctcacaatcaacaagacattcaacagtatagatcataataacttcctcacgaaaaaagcccctttcggggcttgattaatcagtgtccgaacacaccacggatagactctgcgaaagcgtacagttcagggtttttcgctttcactgtttcgatttgttccaggatgtaatctggtttgtatttcgcaccgaaccagcagtaagagaaagaacgatcccacatgaacacgttgtagtattcaccgttacgcacttcaaccatcacgtaacctggattagaacccagcgggtaatctttcaggagattgaatttcgcaccagcgccagtacatccgttaaacaggtcattaaaagtcatggtatgttccttttcagtttcgtttcaacaaggccaatatattacacttcgttaaaccatgcaagatatttcttctcttgtctgttcaaaacgtcataacaagaggcgacacaaacggtttcccacacaacttcatcgtaagcattcacgaagcgaatgatcagagttttgccattagtcatcaaagccggagtgaacccaagttctttaaccgcttttactttcttctggaataacgctttagtcatgttagccattttgtgtctcctttgtttcggtaaagctaaggtatcactatcaactaccggatgcaaacacttttttaaagaattttgtttccggtctttctttgtacggacgcattaccaaatctttaccgtccagcacggttggcttaccttcgagttcaatcaggatgaagttgcctttctggtacttcaatacgccctggctggcagaccattcatcattttcccagtggttgtaatgccattcaacaacggtatcgatcgggatttcaggttgatttctcataatactttccttatctgttttgctattgcctcgataactggcacggaaacggagttacccgcttgtttgtatgcctgtttcttactcgatggaataataaacgaatctgggaagccctgcaagcggaaacattcacgcggggttaatcgtctggggttcttcccgtcctgcaataccagacattgaacaccgtctttgtaatactgcgctgttatcgtcccagtgtgcgcagaatcgcttgtgacggcctgataaccgaaacccttaccgtttgccttatttcgttccttacgctctctaaagcctttccatgcgttatctgagagggtgaatgaatcatcagcatcttcgaggatgtcgcctacgcgtgtaggtgtacgcgggggaacaggaaatgaaaagaatacatcatccaggaagcagacaataaacacgcgttcccgtctttgtggtagtccgaaatcctttgtgttcaggcgttgatagaatacgttgtatccttcggcctccagaagcccgtaaatcgttctgaacgtcttccccttgtcatgggttagcagttcaggcacgttctcaaagaacaacacacggggctttttagcgcgtataatgcggaggatttcaaagaacaccgtaccgcgtacatcatcgaagcccagtttcaatccggctttactgaacgcctgacacgggaaccccgccagcaggatatcatgatccggcactttgttttcatcaatggcgaatagatcaccctgtaggttatcatcgccccagttttcgatatatgtttgctgtgcgaacttgtcgatttcagacgttaaaaggcattcgacaccgccgaacgccttatcaaatcctaatcgaaccccgcccacaccagcgcagaggtcaattattttcatacgtcaaaatcaatctcgtcgattttgtatgagttttcgtcaatgtccgcccatagggttacattaacgtgtttgctatcttcgtacaactggcgaccatcaatcccgcccgtgtaattgctttcggtgcgttcagtaacttccagtcggaggctatcgcgcatgatctgaacaacagcctgttccagtgtaactgcgtctgggtttttggtatcgcccagtacaacatctttaacgttcaaaataacatcagtcattagtgccactccgttttaataccgtgtcggtatgcgtcaatccccagtggggtaatcagcaaccatgctttcgaattatcgtgataacccgttacccttcgagcgtaacctttttgaatcagggcatcacgccctgatttgctgggtacgtcatcgaaatctaagtctagcactttagttgcgtatccgtaaagtttatacagaacatcaatttcagcgccggacaatttaggatacatcatttgtaataccccacaacatgatcgctgtatacgcgttcgatgaaatcgttccagaattcgcgatcaacttctttcggatatgttgaaatcgctgcaaggcgttcgacttcacccatgacttcttccagtttttcctgtacggttgcgaacggtacgccgccagctttaaccagtttcaggaatgcgctatcaggcagaggataaacgatatcaccatctttgtaaatctggatcaactgcataccaccgcgcaacgcgtgacttaatgctttccagtcgatcccgttgttggcttctgcttgtcgtgcgcgttctccgtattcatcccagagtttatacactgacttgcgcatttcatcggctttgatcgtgaactggaatttacgccccagcacttcatagaagtcctgacaaccagatttcattgtcgtgtcggtaacgaatcggcagaactcgtttgtagggaaacgatccttgatgtcagacactttcacttcacgcgtatagcgtttcatatctggcgtgaattcctgaataccaccgatcgtttcggtttctttcagtacatcaacaacttcgcgcaatgcagccagtcgggaacccttcacaccatatttcgcggcttgcttacgaacataaccgaacaagccagttagttcagtggtgtaaaaacgccagcggttagcgcggatatactgccagatttgagagttaacgatcagcttgtcatccgaagcgtgaagcatatcgagcgctacggtatcaccatcacacgcaagactaatgaacttagtcagactatacaactgacggtcaacgtcgtctacggtgtttttagagcttttatcgcctgtgctggtgtcaatagtcttcggggctttccccaggagaatatcgcgcgggtgcgggagaaagatccctttatagtctttgtcgcttgtcggtgtgttcagtccgtacaggtgagaaccgaacacggtttccattacagttttcaaaattcaacccccagggtttttgcgataccgcgcagttcagcggtagtgatatttggtacacgcgttacatgtccacgaccgaacgcgtctttgattttatcagtaagttcgatacggtacaaatgttctttgtattcgtcttcgctatgataaccctgtgtatgattattccagtcattagcgctacctgtttttcgatcaagtcgctcaacacggaaatctttaatatcggtgatatttggatcttccgacgcatacaggtattgacgggcaaccttgatcacatacaaggtgcgaggtcgtggggttttgtgatgactgtatcgacgaataccaggatcaaacagggtatcacccactttcacatcagttaaatctatcatttcattttccaacgttttgacttttcacagtagaacaccggaagacgtgccagaactggcttcactacgtcttcccctgtgttcgtgttatgaaccacttcgatcgtaagggattgcccttcggacggccttacaatgtccagttccaggatctcacgattaccctttgtattgatttccgctacgtagtaatcgtgcccgttgatgtttacgacatcacccataataacgctaattgtgtgaatcatgagtatgcaaacttaattttaacattcagggaatccagcaggatcgcgtcacgtccatcaatgacggttaatcccatgtatttgttatcgtctgcgctcttacgggagtacatgcgacaaaccagagaaccatcttgtgcgatgtattcaacatggtattcacggcgttctgacgtgaagatgtctccaacaacaaccggacgatcgacgggttggcgtttagtcccttcgaaggacagtttaccgttaccgtctacggcgcattcaatacctttatgcgcgatgctcgcaacagtaacaggctctacagttccaccgatcagcattgcgggttctttggttcccagtttcatcaccagcgtttgacgaatgctacttgacataggttcagtaacaaacacataaaccatatcatttttatcacgcgcaactgattgcaaggtgtaattctttgtacctacagaacccgtgtgtttaattcctacacgatgtccaggttccagcgccatgcgacattttacatcagagataccgctaagggttgctactttcatgatttaattccttcaaagtcttcattagatttccagtacacgttaaagttacggcaatcgtgatcagaagtcaacgtatatttttcttttgttttctcgtcggtgatcaccatcgtttcattttcgatggaatccacgccatagacaaacactttatcaccgcgcttattcaggaacgcgtcacctgtttgaatcaactgccagcagttgacaggtaaaccacccgcgcagataggacgggttactaaacagtaaggatgtttcattaatccgccagccttatattgtttggatcaggaacgaatgtatctttctgggtaatcatgaacaccaggaaagcagcgacttcgggatcttcaatcacattgaacttgcgattgcctttccaacgtaccgcgattttaccatcatcaagttttttgatttcggctacttctgatttcttgctcataattacctccttcgtttcgatgcccctaatataacaaaagccctcacgcgaacgcaagggctttttaatctttttatcagagtcccgtaaaggctacgataatctgatagtggtcatcgaagaactcaccacgattttgtttgacttcgtgcataggcatccagaacgcgtctaacgcatcgtcagaaccgcccataatacggggcagacttccatcattgttaggttctaacttgatgtactgcgccacagtcggttttgagaagtatacggaacgtttcggatgatcgaacagcatcgaattacggattgaaccacggataaccttttcaggaactttgatccgcacctcttcgagcagttcacggatcgcacaatccaggaacgtttcatttgagtttttgtgtccgccaggaagggctaacgcgtctttacctggggcgaacttacgacgaattaccagcaggtgattgttacacacaaccacactatcacccgtgcagcagttcagcgcgtcggggtatgggtagtttttgaatttctccaattcgctttcccatttctcgtattcgtagaataaacgccagaacgtgtcttccatcatccatttgtcgatataatcgacggttgtttgaggaacaaagcgcagcagtttcttatcccatccgtttttgtggttgaaaataatcggacgcagatcggttgctgatagatccttgccgtcaacccgaacaggatcaacaggtacgtgtgtccatccgaacgctttaagccagtatgaacccgcatctttttcgtaaccgtagatagcgattttgtcgcctttggtttccctgatagcagtacgaacagaggttttccatttctcttcgttgtaaagataatctggaatgtgttcaaactgaacacgaacaacatcttcgatcgggaagttagcgtttaaccatgagaagatcatcgtttgacgctcacgcgctgtcagagggtttaaaacgttagggtaagcgtaagctgaacccaaaaggatgtaaacggtttttgcttcttcgagtgctttacgcaccattgctgcatgaccattatggaagggttggaatctgccaattacgacagctttatcaaattgtttcataacgtgctccacgtttaaaggttaatcataaaacagacgcaatcaccaatacaccaagaaaaccgccaataaagccgaagaatagcgaaatgaagatagtaaggatgatctgttttatgttcattatagtattctcgttttaggagtcaagcccccagagtgggggctttaaaaccttatttacgagaatcgaaaatcacttgtccatcgtaacccgcacccattacggtatgtggaacaccgccctggtatttctctgcgcgtttcatctgaacgtcaagttctttccagcgaatcatttctggtgtaatggtacgctgcaacacggcgttcgcttcggcttctttcttagccgcatacagacgggcatcagcatcacgctcgttagcctgtgcagcattgctacgggcttctttatcggcaattgcctgaacaaccgcctgttgagcgatttgctctttacgtgccagttctgctttttctgcgttcacctgttcttcacgaattttcgtgttttcaacctgcttcttgatcgcttctggcagatcgatatcctgcaagaatacctgtttcacggtgtagccgtaaggacgggcatactcttcaacttcctgctgaattgcgatctgtagctggctttgaacttctgcgttatacagatcctgtgctttcggtacagatttaccgaactcacggacggtagacagaagtttttcggtcacgtacttatcaagcgcctgatcctgattacccgcgttgatacggttgatcggggctttgttaccatcgaactgcaacatcacggtcatatccacagtggatttgaatttatcctgggacggaacctgcaatttgtcaaacttcattgcgatgtctttggtgttgaacacctcgaaatcagccagtgggtttaccaggtggaagccaggcagaacaggcttcggtgaaactttacccatgaaggtttgagtttttaccgtaccatcctgaacgatagtgtacgagttcggaaccagccacagtgcagcgattacgcccagagcgatcagagtggttttctttgggttgtttacgatagtgtttaagttcatcattatttccattgggtttatgtttcaattcgatagttattctatcatcactttttcgcgtgtcaaactctttttaagaaagttttgtcagcttgtaaatcgtttgatagcacaagcctttgatctcgtccagaatgttcttcaatgaactatctactgaatcatagattgtgtcggcttcggttgctattttacggagatacaccaccgtgtcaagcacattttctgtttttaatacgggtttatatcgaccagtgataccaatatgaatttcggtgaatttatcaaccaaatcctgcatatcttcgtaaaaactctcaaacgctttatgttgagaatacgatccggtcgcaaagtgtgcgctatgcatgtatgttacagacatcagacacataccgataaaggcatctactttgcttgagttatcacgatctgttacttcgttaaatgtttgcatctttcatcccttacgaacgatgaatagtagcaaattcgtttgccaccctatagcccaggtgtttacattctggttcagtgcggcattgtttttgctgccattttcgttccatatagttatagaacaattcactggtatttacactgggagggattgtgtcaagatagacctgtagcgctgcattgatgtaatagtcgaactctttcgggacgacagtatttcgatcagcatgtgatgcaggagacaagattaacaatccaaacatcatcgcttgtgatatgcgtttaatgttcataaacatttctctacgtacacacggatcaacaatagatccgttcctgtatatatttatagcaaaaaaggggcgaatcgccccttatgtaaaattagtctaaaaatacatcaagttatctcataccagcataagctacgctcaaaagcgcggatcttatttgcgttctcgatattttcatcccatccaatcacgccagctttcatccggcgtaactcctgacgcattttagcgcgtactttcgaatcaatctttttgactgcgatcgaaagcatcgcggagatatcaccatgagctttgttaccgtcacgattcaggtttttatcgaatcggatatatgcacaacctgatttgtgtttccagttggttgtgtaccaacgcaaaccatcagggctttctccgtgctgtgcataatactgtgaaaatgcttttgtctcttcgatttgttcgatagaggacttatcacggactggaacatatttcttacggtaagtacggctcatagtgttctcctttgtttgtctgaatacaccttaacagttcagaccaacattatcaagaagtttttcgtgataatgtttgcgacagagcgaaacgtatttgtcttcggctccgatctcaacctgcgccccttcggttacgaagttgccttgtgcgtcgatacgtgcaaccgtagttgctttacgcccacagtgacacattccccgcagttctcggatctcgtctgcccaggccagcaaccagtaagaaccctcgaacagattcaactggaaatcagtacgcagaccgtaagccattacagggatttcgagttcatcgacaacgcgacatagatcgaaaacgtttttcttcgaaaggaattgcgcctcgtcaacgaagatgcaagcaattttattccggcgctgaatgtcccagaacagatccatatcaggcgcaatcaattcacacttttcgttcagcccgatacgcgaactcactgtgtttgatgtgcgggtgtcgattgctggcttatagattacaacacgcataccgcgttctttgtaattgtgtgcgtccgtcaacagtcgcgcactctttccagcgttcattgatgcatagtgataatacagtttagccaattgtaaaccatccgttacccatgagttttttgttacgtcgcgcaagatgctctttgatttctggcatctggatcgcaatatcatactcttctttcgtcatagtatgatttgcgcaacccatacacccgcacacctgcgcgttacaccaacggagtgttccgtatgtcgcaatcaccttcattgctttagctttgattttgtcagtcatgattataaccgcccatttcgctatcttgtgctttatggatatcaagataccacatattgattttgcttttcagttcgcccatttctttatccagtccttcatcaacaagacaaagaatgtcaaccaccgttttacgctgtgtgatgttgattttgttcgctttcatggactgcgccagcgcttcacaggttttcaccagtgcggcgcgttgtcctttgattgcggcgatccgtttgttcgctttcttgatcgcccgacctgctttgataggatcaatcatgataaatccgccttacgtggatcaaccgatggatcgaagtgaacgacgatgaccggatagtctccagtacactcgtcaataatagcgctaatacgcaaccaatcgcccccagcaagccccgcaccgataagaggggtgatgataggcaatttttcaggaaacgccctggcgcgttctacagcgctcacaaagcatgaccggattgcatcgtaatccacttgtgggccagtaccccagaatttaaactgggtgtatgcgttgaagacaatctgaccttcttccgtcatgtagatggagttagtgcctaacttacgctgatcacctttcatcgtcagtgcatcaattttgaacgcgccagggattttgtgcttaacttctttagcaatacccgcgcccatgttgcaatagcagttacacccgtggatcaggtgtacttttcgtttcaggaacaactctacagcgttccctttgatttctttaataatcattttcatcacctgtatagtggcggtaagccagcacagccagccccgcgatcacaaccacaacacacattaaaatataacctgtgttcatttaaattcgtcgtcccatctttgccacgcttccaactcgtcgtcatattcagggaacgaggtttcatttggctttttaacgtaataccagataatgattgctgctgcaatcacacacccgtaaaagattactaatcccatcatcagtataatcctataccagcgttatattcttcaaccaggtaagtacgaagtttttcacaacgttccttatccggcgctttggtgcagaggttcatcattggttcagactgcaagaactcacgctgtttaaccaacttctgacgcttgaagaggtgcgcgttttcttcgccccacacataagccgcgtccagttgttcagcaatcacttgttcacatacggcaacgtctttaatgtcgcgatggttgcagagttcagccagtcgatcatcggcatgagcaaagccagcaaacagggtgagtaacagcgcaagttttttcatcgttttaccttagtatgaatcgtcttcgataggggtataatatcgactttcgcagatatacgcaagcactgatcgcaaactatcgctttcaaattcgggtttttgtttgcgtttcaggctccgacccgtgatacacatccagcgttcttccgcaacatcaaaggctaaccagtatgtgtcatgcagtgaacatgtatgttcgaagacatcaaacatcagtttaccgtcaatcggcttaacgtatggctttatgcgttgaagagatttcaggactgattcgaggttactgcgatcctcattcatcgcgatacgtaggatatgctgattgatttcagggttgtacccgtcgatcgcaagtcccatatcctggaagaacttagtcgcatcatggaaaatctctcgtccgctgttcggtgaattgatgtaaaactccatgcgtttcttcggagtcatcgcgcggacgcgggaagcggttttgtgatcgatctcttctttgatgtctttgcgagcatccagcagtttattcagtttttcctggtaaggtttcattaccgccctgatttctgcaatacgttcatcaacgatcgttaactgctgttccggtgtcagtttagtttccattacgcccccacacgcacaaagcgatcttcaattgcatcattaacacattcgtaaatgctaacgtcattagcgacgtgcttacgaatacctactttcacgatatccatgatctctttgttgctaccccatacgttcaggttgaagtaaacaccgccgctatgaattgtgttgttgccaacatcacgatatgtatcttgactttcacagataaaaagtctgcgtttttcttctccatatgcgaagtagatactgaacgattccatacgatgacgatcgaccgtgatggtttccactttaacctttggatctttgttcagttcatctaacacaccctgaatgatgtgcagcatgttcggcttgatgatagtcgggtgactggtaataactcgatgtgatgtgctcataatttaatcctcaatagttggtacacacataataaaaaagcccctgcgaaattgcaagggctttttatcagataatgcgtttttcttctaacagcttcgcggtatggttaaccatgcgagcataatcacgggcttctttctttgaatacttgaaccccgcgttgtaactcgccagcgcctttttcaagtcgcctttgtggtaatcaagccagtattccagttcgtgaagtgcgtacttggaaccaccccgaagggtttcgagcttattgattactacgcgtttggaatatgatttatccattcgtgcggacgcgctacgggctgttacttgaaaacaaccataagcatgatgattctttttgcctttccctacgttctcacatgcgcgagactcgatccaggcaatagccgctaaatgatatcccaaacgtttcgatgtttccgattcaactggctttgcagtttttcgatcgtattcgttaccgatcctgaaagcatactccaaaacctttttctgctttggtgtaatttcgtccaattccttaacatagctgggggcattggctggggctttcttcattactgttgcttgttgtagcggtaatgttgacttcacagaagggagtgtttggataaactctcctaacggatcagtcgccgcgttgccagaaaaagagcataagaaaatgctggcagcaaagataattttcttcattgtaatacctatttgtaacaagagagggctatgataccctcgtcttattatttatgcaacgattttacgctgttttgcttcggtcagttttttctcgatgaattcagcaatgttatagtttgaaatcgaagcgttcggatcgtacagagctacgatttcatcaaacgatacctgaaccacatgtttaaagtgaacactccagccagtcgtaaagatttcgctgttgtcgaacccgcaatcagggctgaacatggcgcgatatttgtatccgctgtaatctttcaaacgattcgggctgtgtgcgtcactggtgatcaggaatttcccctggtgagtctcaaccacgaagaaataacccagacgttctttgttgtccagcatcgtttcgaacttgcggttgttatcttcacggtcaacgcgagtttggatcttcttccagacctgttcatattcaggccaatcatgctcgacaacaaccccttttatgggttctttgccttgctctttacgatagcgatcaattttattcactaccgcagagagaagcagtttgtcgctatcacttaacgcggcatcaatatccgcatatttaagcactgcataacgttcttcgcgtttcatactactacatccttatcacagactggacaccgaatcacacgatacacatcacgaccgccagtgtaatcagtagataccttttctttgacatcctgcgcagtgtatgacaggacagcaccacaacgacaggtagtttgttttggggtaatactcacaacttgaaccataataacctcacaagaatagtttcacttcgctaccgcatttcgggcagacgatatgttttttcacgatgtaatctgctgcattgaagaaaccattataaaacgcttcggttctcttctgtacatcagacagttcatactctaacccacttttgcaattagcgcaaacggtaattagctttggactgataataacgttgatcatgtatacctcacgaaaaaagggggccgaagcccccttgattaaaagttctcttcgacgaatgcagccagtcgcccacgatatacggtatccaggatcacatgacttgaatgaccgtactctttaagtttttcaaccgcatacacaaagccgttgttaacagcagtattgcgcgggttgtcaatctgtttaatgttcccgcatagtatcagaagggtgttctcaccgcaacgggaaatgatggatttgatttcgtgattgctcaagttttgacattcatcaacaatcagaaccgaacctttacccggatcaggatgcccgattgagcgcccacggaagtaatacaggctagggaactggacaacgtttttctccagcagcccttctacgtatttgtcaacttccggttgatccttaaacagaatgttcaggctcgtaatacatggttccacagcaggacgcagtttttcgcccagagtaccaggtaagaacccgatttcgcccgacagaggactatccgatttaacatacatcaggtttgcaaagtgtccggcgttaaccaggtgcattgcaccagcaacagccagcattgttttacctgaaccagcagcgcccatgatggtcaccacatcggtatttttatccataattgcatcaatgaatgacgcttgcagtgcatcgcgaggctgaattgttttcatcagcttacgcttcatcgcggattcgtgtttgattggtaagagttcaagctgatactctccagcagccactacacgccctacaagttcaccatccgatagaatgtattggttcgggtaataatcgccgtcaggaagcgaggaatagcttatttgggctacttcgccaacatatcccaacacctcgacatcatcccagaatccagggatatcgacatacccagaatacaacacatcgctatctttcagcgagtcatcgcccgtgtattgttcaacaggacatcccttagacatcgcgatcaacagcatgttaatgtcgcgggtgatcagggttgcgttttcctgcatacaggtagcgataattcgcgcatcttgtttatcaagcgggaactcttctaaaccgatataatcaacgatacggagtttcacgctttccggcagtgctgggttcgtcaggttcaacgaaacccctgtttgggtaattgcttcgtacttctgccccaggattactttagacaggaggcggatcgccaatcgtgcttcatgagcggttcgctctttgcttttcaggtgatccagttcttccattgtcgcagaggtgataatgatttcagtacccgcctcaacgaatgagaagattgaatatgggttcgagattaaaacgttggtatctagaacatatttcatagaagttttcctgttaattgcggggtacgcggattcgcaccccgcgcactgcaattacatacccaaacggataatatggatatatgggaacggatgaagatgacttgaacgcatacacaaggtcagcgtttttgccagttcaaaccgttcgtcgatcgtcgtgtcacattcatcgaaaatcaggttgattgcctgatacttgatcgtttgtccacggaaaatggaagtcagatcttgacgtttcgacagaatgaaagacgaatcagcgcccttatccagtccatgttctaccgcagcacaaatacccatctgctttgtcggtgcaacatagatattcagtgtccctttagactgcttgatgatatcgaaagccgctttggttttacccgacatccgacccatatccagcgcagtttcgaagatagac

SEQ ID NO: 34 - DNA, 179010 bp, Unknown
  source: /note="Description of Unknown: KP2-5a Bacteriophage Sequence"
cgtgtaaatcttatcgtgacaacacacgatgaagacacatatcatgattttgaaataaacatgatccgaaaaatcaatcctgaatggaacaaacagcactatgacaaagctaaccaaaaatcagaaaaccctctttgaccagttgatgaaactgtgtaacgaaagcgaatgcttctacttcattgatcaaaaaactgtaatgcaaaccaatgttcgcatctttaactatcgcatggcgagctattccgactggttaaaaccaggtgcgctggaatgtcgcggtatcatgtttgcgatggatggggatacccccgtaaaactcgtcagtcgccctatggagaagtttttcaactatgccgaggtaaaggcatgggaagcactgaaagtctctcctgtgacgattggtgaaaccgtagtggatgtgatgattaaggaagatggttccctgatctccaccttctgtgattccggctatctgggcgttaagtctaaagcatccgttcaatctgaacaggctatggacgctatgagcgtgatccagactaaccgcgcattgttcgatcgcctgaccgaactggttaacgatggtttcacagtcaacatggaatacgtcgcaccgacaaaccgtattgtaattggctatcaggaaccagcagtggtgatcctgaacatccgtaataacgacacgggcgaatatgtcgattatcaggatatcttcgcagatggtgtattacgtccgttcctggttgagcgcgagaaaatcgaagtcaccgatctggatgcattcattaccgaagcctactcgaaagaaggtttcgagggttacgtaatcaaaactgataaaggttttgtgaaagcgaaaaccaactggtatgtaaacctccaccgcacgaaggatagcatcaacaataacaaagatctgttcttaaatattgttgaaaataccgtcgatgacctgaaacaaatgttcctcgatgatatgtacgcactcaagaaaattgacgcattcgaaacgttattccttgatagtctcaatcgtctgactgcaaaagcattccaggcaatcgaagacacgaaaggcaaatcacgcaaagactacgcgatcgcactgagtgctgacttaacccctgacggtcgtattatctttgggcctatgatgcgttatttcgatgataccgataagcaaaagctggttgataacatcgttgcattaatggcgaagaactacgaacagtttataccggaagaatataaatgacaaagtgctttggcgctggaagcacaacgttagaagaagagaaagcagggatcgattccctgcttctttacgttgacgttttcccagaaaccggaaaaattttttggaataacaatgcagcaaaacagaatcagggaaaagaagctggttctattatgagcaaatcaaaaccttacgtgagaattcggcacggcgatagaaaatatttcagacatcgcataattttctattactgtaatggttatctgcctttgcttattgatcataagcatgggttggaagctggggatggtatagaaaatctacaggaatcagatccgcttcataatatgctgaaaagaaaagctaaatcaacacctaaaacggttaaatccaaaggtgttgattacagggcttcgcgtggaaaatatcgagcacagataaagatagacgggaagcaaaaacacatcggttactatgataccgaggaacaagcatcaatagcttacgaggaagcgttatatgaatatcaaaaacgtattgggtacgtttaatataagttcgtggatatggcctgtaatagttgctggttcgttagcagggcttttgtacatgacaatcacgctgaaaagtgaaaatgaccaattggctaaagatatcaaagagttacaggctgatatcaaaaaagtcaaagagacaaacaacaccaatacggtgatctatgtcgaacaaaaaggtaaggatcagcagttggtcaaggatgccggacgtaaagatctgctgttcaagaaaccaggactgatcgaaatcaagatcaataagtccttcgaagagtatatggcggagtacgacaaatgaaaattgcaacgttagcccttgttctgggcgttctgttggttgggtgtgcggaaaagcccccagaaaagattttgcctacactccccgctaaggtgaatccggttaatgtgaaatggaaagtggttgcagaagtccgagagattgacggtaaaaaataccttgtcatgccttatgacggtaatccatatgttgccctttcatatcccgattcgttaatctttcgtagctggatgaatgacgttaagcgtcagaaagaccagacggataacattctgtgtaccgtgggataccctgagaaatgcaaaaaatcaaaataagaataaccgaagttgatttctttagtgacttaaccgttggaaaggtgtatgatgctacaaggatcaaagatcaactttggatctgtagtgattggtctattttcttagatttacacacttatgccaatcgagcactaattgaatatgagattgtgaaatgaatctgtttattactgtaggcgtaccaggtagcgggaaaactacatgggcgaaagaaaaagcacgtcaactgggaaacactttgactgtttcccgcgacgatatccgcaaaaccctttattgtgctggcggtgatctcactggctaccgcttcaccgaagagaaagaactgtttgtttgccgagtgcaagaagatacagttcgtaatgcactggcaagcgggaagaatgttatcgttcacaacacccatttgcaccaaaaagatcatgatggttggcgagagatcgcgaaagagttcaatgctgatttccatatcgaatggattgatgccgatatcgtagaactcctgaaacgcaaccataaacgcggtgtgaatgctctacctgtttcccgtgtctgggcgatgttcgaacagtaccgtaaactccgtggctgggttccggctatgagctatgcagatccaagcaaaccgaaatgtgttatcttcgacgttgacgggacattaaccaaagtcggacaacgtagcccgtatgactttacgaaggtgatcaacgatccgcctaaccctcctgttcaagaactgttcaggatgtataaggccgctggctatgcctgtgttgttgtgtctgggcgtgagggtactgtacagtgcgcacatgataccgctgcaagcctgattgggtatggtgttgacctgagcgatggtatctacatgcgcgaagaaggtgatcatcgtcacgatattcacgtaaaagagcaaatacttgttgaaaagattctcgataagtattatcctgttcttgcagtggacgacagggatacaccagtcgggatgtggcgaatgaacggtatcccatgtttccaggttgattacggcgacttctaaaaaacagttgacagtgagtgcgggtgtgataagatacccgcacaaacaaaggagaatattatggttattcgtgaaaatgaaaatgtgatggttgaactgggtaatcgtgttaaagttgagaatcctgttgaacttcaactgaaactcaaccagttaggccagcgcattgctgataaaattcctgctggttatacagtgaagattgtccgcgatggtcagttctccttccttctgggtattttgagtcaacgtaacatcgttgaacagcagttcgggattcagtggaatccggtaactaaattcgtaacatgggcgggagtattatgagcgacaaaatcagaaagattcatcaggcatggttctgtactgaaccaacgatgcttcgttatggttgtgtgtttgggttggttgataacgatcctcaacaggacattgcaacaagtccggttgttgaatacgcgattccggcgaacaaatcgtttgttgaagtggtgacacgttcaggtactacgtatcacatcgttaaccctgataacgatttcatcaaagacattctgaaatatatggatgatcgttaatgaaattcaaagtaatgaatatgctgagagcaatcgatcggagtcaacgttctcagtgtatttcgaatcgtgtaggtgctattatcgcgatgggtggtcgtgccgtcgcgtggggcgaaaataatacggtagaccttgattgtcgatgcaactcatgcaacaatcatatggtgaatgatgacggtaaactgaaagcggttgatcgtcctacacattcagcgtggtcaaacgataacgaaattcatgcagaaatgaaagcgttattgagtgcgcacacaagaggtgttatactcaaagacgcagcactttacacaactgcatcgccttgccctaactgcgcaaaacatatcgaatggtatgttgctaatggggcgattacatcggtgtattatctcgataaatacgatcgtggtaatgatgaatggatttcacgcttacggaaatatggctgtttcgtggaacaaattaaacgggaagagttagaatcgtttatcgacttttccaaagtagtgtttaacaacaatgagtaaagaaatgtctgaactgaaagtaaaagcatccggcgaatatgtgatcatcgaagctactgcgcgtccgcagggttccgaaatcaaatctgaatctggtatcgtggttggtgtacgccagcacggggaacaacctttttatggtaaagttgtttctgtaggcgtagacgttccagcagaagcggcagaacgaatcctgggtaaatatatcccactgccaagcgctcacatggcgaatgttcctgaccctgatctggttgcgggttacatttccgagaaagaagcaaaagagaaggaaacgaaatacgtttccgcacattacaaagcaatccaggcaatctacgagatctaaaaatggctaaatcaattcaagcaattatcgctgataccgtcagcaaatccaaaaagctgttcgacaaaggcgaaattctggaagccccagcgcgtattgacgtaatgacagcaatgatcattgatgcgcatcagggtaaacttaaatcccgtgccgatgaagtcatggcgtacatcgttcagttcgaagacgtatgtaagtacgcgaaagatgttgatccgctggttcgtggtatctatcgcagtcagttctaaaaattccggccctttagctcaataggttagagcgagcgactcataatcgcgtggttactggttcgagtccagtaggggccaccaaataagcaggtatagttcaattggtagaatatctggcttccatccagaatgttgagggttcgagtccctttacctgctccaattcgggtgcgtagcgcaatgccgttaaatggttcggaatatgcaacctttctcacggagaaggctctgttggtatccggtaataggttccccggaatgcggggtgaagtaaagaaacttccagcccactaaacaatgtgagatctatatgagaattcgtgaaaagacggtgtatgactctaagttaggcagaacaatccatacgttcaaagagattacgccagcgcaattcaaagagcggtacggcatgacattcaacgaatggaaagcggggttatgtaaaaatgactaccgatataaattaaaattccgtgaatgttatgttgatgacgatccttatgcagcagatgtatgtggtgaaattgcaccaattatcgagaattcgcccgacgcactaatacaatcttgcatagatgcagcatacgaaatttaaaagagaaaaatatgaaaggtcttcaaaagctgtttgaattaaccccgaaaattcgcgaaatcatcgcttcatcaaatgaacaggaaatcaacggtaaagtgatgaaactgtttaccgaggaaatcccagatttcgataacgaattccgtaaagcgttcgatgcgtattctgttgatggtttctttgcatcgccgcaggtgaatagcaagcgtgaacacagtcaccgtttattcgactggtcgatcgtgaatatcgttcgtcgaactgatattgaacctactaatcatcagttggtttctatggatgcttcggtattcttcatccagtatcttattactggtggatttaaagcagaaggtattccgttctgtaacgaagctctgtacgaagaattcgcagaagcgtataagtatatcaaagcagttcgttaatcaacaggctatcttcggatagccttttttctggagaagcacatgcgctttttaaaatacgcaagctggcttgtactggttccccttgatattctttctggtgttctggctattctgctggctcctttcgtggttccgttctacagtgaagaaaccggacacttacctaaagggttccgttggatggaaacattcgataacccgatcgatggtgatggtggacatatccggcgttgggctaacatccggtatcacttaggcgatctgggtgtgtatgcgcaacgtgtaggctggttgtggcgtaacaaagcgtacaacttcgcttatcacgtcttagggcgtgaagcacagtcagacttcgcctggaagggcaatccgaaaacagaaggtggttccgatccttcgcgtcacggttatctgttgatgtggaatgattcggcatgggggctttatgtcttcaagccgtggcttaaagtcggaaaggttcagttctgcttacgcgtgtattgcgggtggaaactgaaacaggaagtaactgaccctaacgggctggatcgtgtaatgctggcgttccatatcaacccgttgcgttattatgtcgtagaaaggtaatacaatgaaagcatatcagattttagaaggtttacacactggcacaatctacctggaagaaggtaatgatgttcgtgtggtggtatccaaaaccctcgaaatggattcagtgatcggtaaagctcgcgttgctccattcgcaaaacgtgaagtcgatattgaatttcaacccactgttaaagtggaaggtggacaacacttaaacgtaaacgtgttgcgccgcgaaactctggaagatgctgtgaagcatccagaaaaatacccgcagttaacgatccgtgtgtccggctatgcagtgcgtttcaattcactgactcctgaacaacagcgcgacgttatcgcccgaacctttacagagagtatataatggcgattgaagacgtacagggctataagccccactcgaaagaaaagatcgacaaagtaaaccgcatcaaggccgcagaagttgccctgggcgaaatcttcaaagaactggatgaagagtattcaagtgattacgcggtatcagataccgattcattcactaccgaagaactcgatgcgatgcttgaacgtatccatcaaatccaaaaggcgaaagaccgactgaaagaagcctctatgtgggcgtgtcgtgcggtgttccagcctgacgaaaagtattaaaaatcaagccgttgccgaaaggtagcggcttttttcgtttttatgcaaaataatgcttgcactgaatccgactttcttgtatctttaaccacgtaggcaagacaacttaactttgaggatgacattatgaaaacttacaacatgaaagaactggtttgcttcaacactcgtcgtgaagcccgtgcgtatgttctggctgctggtaaaaatacctctgctgtaatcgacctgggtactgataaagctgttggcgctcgttgggctgctgttgtagttatcgctgctcctgtgactcctgttaaaactctggttctgggtgcgcgtaaagccgaaactctgaaaaccagcacttgcaataacagaggtgttcataatgtcaccgtcatcaaaaaacgtagctttggtttgagggcttaacatgagtaccaaagaattagaacagaaagtaatggggttcatgagtaacagcgaagatcgctatgcaaaacacctcattgtcgaactgatcaccgcgttacgtcgccgcgacaaagagatcgaagaactcaaaaacgcatcggttcaggttgtctataaagatcgcgagcgtagtagctgggaaaaagaatgggatgcaaacccccaagaccgccaccttttcgggaaataagcatgagttccattaacatagaaaaagattttgtgatgtttgttggggtacagactgtaaagaaagatatcttcggtaaactgtacctgtcgaacgacgatcgcaaccccgcatcattcgaaaccgaagatgatgcatatatcgcgaagaacaccagcgataacgaagacattcgccagtatgcgcggatctataaccgtgaagtaacaacccgtctggagagagcgtgatgcgtgaaggtattgaagtaagaacgtttcagttcgaaatgcgtcgtatcccagaagcatcaatgaatctcattcgagaacacaacgtgaaaatcgtagaaattgatgcatacgcgggtactgatctttataatgatgcgaagattgacagcattgatttagaccttgagggtgatattggggatctgaataagctggctattgcattgaatgcagaaaccaacaaatacgggtatacaatcaaatgaaatatattctcgaatatcatgagcatcaaattaccgaagcaatgatcgataagatgcgggtatataaccaaaacattaccagcatcaaaccgctatcagtgtgccgtgaatttgggggatactccttcgcgatgtacacaaattccgaagacgacgcaaccgcgtatctgaaaagtatcggtgcaatattcgacaaattcgaaaaagtatggaaggtaggtttctaatgaaaaagtattttattgaagcggcagatcgtatcgttctggctctgctgaactggaaccgtcgccaggatgtttctatcaaggcatcaaccaacgggacaacatatgaccgttatgatccggcgcgtggactccataagccttacgaggttaaagcgtgaagtattacggattcaaaacgagtcattacggtaaagcataccgcactgacaacatcgatcgcaaacgtccgtactatgattctctggtacgtgctggacgcaaacgcgctcgccaggaagggaagaaggaagcagaaaatgaactttgatcaacccattgcaatgataatcggtgctgtcctgggaatgcttcttttgtttggcggaatcccattaactgcatatatcatgaggttattctaaaatggacatcggaagcggttcacaatatccatcatgcgcattgagcaacttcgccccgcatccgttcacgtttgacggggtagaatgcgcatcaatggagggctttttacaaagtctgaaattcagcaatccagatatgcaagcgcatgtgtgtacgctggttggtaaagccgccaagttcaaaggcaagaaaaagaaatggtatcgcgatcagaccctatactggaagggtatgccgattcaccgtgaatcagaagcgtatcaaatcctgattgaaaacgcgtacaatgctcttttcctgaatgacgggttccgccgtgcgctggctgcaaccggaaaaagtaccttgactcattcaatgggaaagaataagatgaatgaaacggtactcactgaacgtgagtttgtacgcaacttaaccagattaagggatctgttatgataggttataaagattatgatgaaagagtagaatgcgcgttcctgttcaaaggcgcgattaacccgctggcattactccacgcacagggcgctttgagttctaccctgattatgggtgttatctacaaagcgggtgtgtattacgttaccatcggagcgaacaacattaacgtgatcaacagctacgttgaaaaatgtaagctgaaagatattgtgttcgataaagtcgaaatggatgttccgggcttcgacgctgtttatatgtacaagggttgataatgagttacgtaatttatttcgactgttcggatctcgatcctttcgttctgcaacaggcaaagaaatatcatcaagatatcactggtatcagtgtcacgaacgatgatatgctgtgcatcgaatttgattattatcgtacatttgagcgtgacaaattccttgcggatattgaagcgtttaaaagtacccttttctttgatcgttatgaggttaaatcttgaaaccagttattcttaccgacattgacgggatcgccgtgaagtggcaaagcggcctcccgttctttttgtcaaaacacaatatgccgaccgatattgccctggatatggttacagatgaaaaattccgtgatatgaccgaaatcttcgggtgtgatcaccaactggcgaaaattctcatggaagaatacaacaacagttcgtttattcgctatctaagcgcgtatgacgatgcgttgattgtgatcaaccgtctgaaagccaaatatgatttcgtggctgtcacggcgctgggaaccactcctacagcaagccttaaccgtattgcaaacctgaacacgctgttcccttccgcattcaaagaagtgatggttgttgggcatggtgaaaccaaagtacaccgctacctggaagcgaaagccaaatatggtaatcgtctggtttgcttcgttgatgatcttgcagtaaacttaaacgaatgtcataacgtcatcagccagttgccgttattccatatgttgcgtggtgaacgtgaaaccccgtggtcgcctcaccagtcagttaaatcatggtttgaaatcgaagagaaattacatgatcttacagattctaaatgaactcgcttcgactctgaaaatttcagagaaggaagcgatcctgaaacgtaatgcaggtaatgatctgctgaaagagattttccgcattacgtacacgaaacagattatgtttcacattaagaagtttccgcaggtggacggtaagccaggcacaaccccgctatcgaatgctatcgcggatttgatgtctgatttggcaacgcgaaaatatacgggcaacgcagcccgtgatcgtctgctggatatcgtatcatcggtgaacgagaatgatcgcgaagtgcttcgccgtatcattaaccgcgatctggaatgtggtgctggtacaacgttaccgaaccgcgtatggaagaaactcattccagaacagcctcaatgcctcgctacgccgtttagtgagaaagccttaaaacgtattcgcttccctgcttactcgcagcttaaagccgatggtgcgcgttgtatgtccgatctgttagagaatcagatccgcaaagcaacccgcgcgggaaatgagtatgaaggtttggtgaatctggacaaggatctgaaaaagattcgtgaatatctgggttatgatgttgtacttgatggagaactgatttatgtccctgctgaaaaaactgctgtcgttccttcaaacagcgttccatttagtcttgctgggtttatgggcgatgacgacgattctgtttctgaccttgtggcagatgttaggcgggaagctaccgagaacgagacacaagcggaagcgaaacgcgaagagggcaacgggattgtaaacaaatccctgaaaggtactatcagcgacgaagaacagcgcaatatcgtttatgttgtctgggatatcgtaccgtatgaagtatactatggcgatgctccgagtgttcaaccatattgcgatcgtttctctatcctggaaggtgcgctggctggctctggtgtaacatcggttaagttgatcccttctatcctggtgcagaactacgcggaagcgaaaaaggattacaacaattaccgcaatgacggtaaagagggttcaatcctgaaaaacgttgatttcaaatggaaggattcacgcgttgcggatcaggtgaagttgaagaacaaaaccccgattgaactgcgaatcatcgacgtgtacgaacacaccaaagaagctcataaggtcggagggttcgtggttgaggacttatcaggagaagccagaacaaacacaggttccggtctgactgatacggactaccgatacgatgaagacggtattaaccgcgtgtacatcccgttagaagaacgtggtgaactggatcgcgaatacatcatggcgaacaaagatgactatatcggcgctatcgtcgaaatggaagttgacggactccagaagtctaaaacgcgtaagaagggcgaacctgagttcagtttcttcttgccaatcatcaagaagatccgacgcgataagaccgaaccggatgatattcacgttatcttcgctgatctgttttaaatagcactttttgctaaaaagccccttgcatgagtaaggggcttttgttatattacaaacatcgaaacgaaacagacaaaaggaacatcccatgcaaatcactaaagaactcgaaggcaaagtaatcgttctggtaaatgaagaccgtttggcacaactgggtaacggtggtgaaaaactgccagcagacgcactcgaaagcctttctaaaatgcgcgtgatgcgtgttactgacggttgggttacttgtctgcctctgaacgacgaagacaaagccgtatacgatgcacaagcggattcatgggatatcgaagtacctctggtaaacatcgaagttgaagagtgctacgaaatcgaaaaataatgcttgcttactgggtaatgtagtggtacattacccatatcgaaacgaaaggagaaacatcatgaaaattatgcacactgcaaatcaacttcaaaacggcaactacgctatccacgatgctatcggtgcgctggttggggtttatcttcatggtatcaaactccttgaagtaagtgggaataccttttatggtgttgaaaacatcgaagcagcgatggaaattatcggtgacctgaaatgagtaagaaactcgaaatattcgaaactatcagcgaagaccctaatcatcgctggtgctgtgcgaaaactggttttgatgctgcatggggtgatactccagaacaggcgcgtaaaaactgggaacaccaacaattgttttttgcctgtcgggttcctaccaattatgaggggagtcaattgttagcatgaaaaataaagaatatgacccaatagaagttaaagagcggttatcggtagcaagaagattccttgaatctatcgaccctgataaacttggaaaatgccctgatacgatttgccttaattgtgggcgatccgtaatggttggaaagtgctgtgataatcagaatatcgttatcatggacaggaaagaagtttcaccggaagtgtgggatcggattcaagagatcatcaaaaacccacctgaaccgacgaaacgtttacgcgaacttatgagcaggaaaccacgttatgaaaaatgaaccaagtaaaactatccgcctgatccgttgggaagggcaagaaatccgttatgaagacgacgaccgcgaattcgtccatgaaatgcttgcgcataatctgggattcaaaaacgccgcactggtgatgatgcaacaaaccagcgatgaagacacctggcaatgcgtcattctcgatctggacaaaaacaaggaatacaccgaagatgaactgtttgcgctcacagagaacgctacagcgcgtcagaagtgcttcatgatcgatatgcctcgcgagaactacgagaatatcaagaaagcccgtaaacagaacaagaacaacgtgttcgacctgttcatgggctatcatgaagaaactacggcctaagcctcacttgttttgctggtgtcgttagtagccgctgccacctgtacacattccaatgtttgcaggtggaaatcttttgatacgtcgcggacacattcaacgatcagatacttccctgaatattcatcccctaacacctcaatcaatgcccccactttaacatccattcgaccctgattgatatcaaaccgaatacgtttttcatagctggataacgtctgacacttcacagcctggaacggttgaccctgtttgtctgggttctggaagttgttctcatataccgcgtttctgttcatggtgatccatgcgttttcaatatcggtactcgcaaggatatcactatacagttttttatccgtcatcgagaaactaaagaaacttgcatcccctaacagggtagtgttatccttatgggtaatgtattcacctttcgtgaataccaaagcgtcacctaaaaacgggttacttacgttgaacttgtaagcctttaacggggtttgtgcgaggatctccgtattgcttttcataaagataccggaaccatcttcccacagataacagaagtcagacgaatctacgctctgcccgttgtcacggatgtaatcaaacacggtttcatacgtcccgctcaggcaagccggaggaatacgcacgtttgatgcgtcgatatgcggcgtgatcaacttcatatcgttatacagtgccgtcatgcactctgtaatcgtctgtacggcgttgttactgaacgaacgggaaaacttacgacgaaacaccgtatgcaccggagaaaggtttaggcgcagtatagagcggttcatatcatcggtttcgacgtttgaatacagaacaccgtagtaatgctgttctaacgtttcgttatactggaaggatacctgaataatcggtttttctgtcaactgatagattaactggttatcatagatctgcatcaatgtttcagaagtaccgttaatgatggttttctcactcattgagacaagggcaggtaacaattcaagatagacgttatcagcgaacttttcatatgttggatataatttaaccgacacgacgcggtttataactttactggacattagacatcctccctttatattctatttactaaatagtaaatatcgggatacttgaggcgatcatgaaagagaagaaaaacacacttgataaatttatggttacgcgtttaaacatcaagaacagcaaaaataaagtagtcacgttgcctactggtgaacaggttacgatcccccgtctgggctatcgtcatttcacccagattaaagcaatgaaagacccaatgcagttgcttgagtatatcatcaaagagattcaaccgcgcgaattaaccgcagcagaaaccgaattccttttgattcacctgcattatcacaatgacgataaagcaatggcgatactgaaagagatcggtattaatctggatgatatgaaaatcagcgaagctaagtatgaacatacttttgataaccttcgattggtcttcaataaaccgaccctaatgctggatgatctggcattactgcttaaagaagcgtatgacaacgggaagccgatcgaactgacggacgaaaaccgtattcaattaattaactgcctgtatcgttatgaatatgacgatgtaaaacgtggcgtactccaggaagtctatattgtgcatgaggggaaaaccattaaagggcttaacatcatcggtgaatgataatggctagcaatccatattttaacgaagaacaacgtcgccggatgcagaatccaccaaaaccacaggcgcaaccgactgttcgtaagatccaggcaacgttagataaagattcgatgcgcgagttaaaggatatcaatgataatacccttgaaaccgcgctgaatacactggacatcaaagacagtgtgaaatcctttgaggatcgtttcaaagagaaattcgctggcttccaggaacaatacgaacaggatcagcaaccacttgctgaacagttgcccgattttgttgggccagcgcgtccaccatcattaacagacaacagcacaaccagtgttgataactccgtcagtgtatcgaaccagcataacccatttgcgaaaatcgaaacatacaccggaacgattgcagaagcaatcaccaagtttatcgaactcgctgaaaagaaaccagcccccgcgccggaacctgaaccagtaccggaagaggaaccggaggtcgatcgggacaagaagaagatccgcgataaggataaagacgagaagaaattcagcaagaaagtattgtctttgctgggtgcaatcaaggataatacatccggtcttctggctcgctttatcggttattctctcgaagcgctggcgaagtttgcaaaatggactctgattatcggtagtatcgtatttgcgatcgacgtactgagtaaggttgttcagaagtggttccaggatattcttgcagagggtgaagcctcgaaagatttgtttggttcatacttcgggaatatcaaaacccttgctgagaaaatcaacgaaggtctgcaaaacttcgatatgagtaatttgggcgaatcgctgaaaaacttgttccttgaaccgtttaaggttctgggcgataccatcaaaaccgcaatcacggaaggtatcggtaatctgatttacgctctgggtgaatataccggatctgaaacaattaccaacgccggacgcggaatgaaagtatcagcactgcgcgacaaacaaaaatacggtcttgaaattgatcccgatgacctgattctgctgaaacagcaggagatccaggatcagaatgataaagtggttgaggcacgttctaaggttgtcgaacaggttaaggctacccagggcgcattctcatatagtttcggacagcaaacagacgcacagaaagcattgtctaagcaattggaacagatgcgcgatcgtgtggctattgaagaaaagatcaccgaagagaagaagaaagaactgaaagcattgcaggaaaaccccaaactgttacaggctgaggttgataaagagaatgccgctaaccgtaagcgcgtgaacgaaaccaaacagaccgaaaccgagcaagcgaaagcgaaacctaaagcggatagtgaatttgatcagggcgatgaaattctgaacaaagacaatctgacgggcaacgataaaaaggtaatggaaaaactcatagaatcgcttgaagagaaaaacaattcgaacaagctgaatgaggacgacaaagaccgctatcgtgatatgatctcccgctggcaggaaaagatcaccgcagtaccggaaacgagtgcaagtattgacaagcaaccggaagcagtgaaagcccctgttcagcctacaacgcctaacagtgttcaggtcaataacaaaacagtaaacaacacggttcagcattcagtacaacgaactgaccgtaaaccattgattgcattagcttaaaggaaatttaaatgaaaattacagtattgcaagacactgtacaatcatttgctgaaatcaaaaatgctggcatcccctctgggggtgctgcaacaactaaaaacgcgttgactcaaccgatcgtaacagcggaatttccttcccaacgtgcagcaggtattgataacgcttataatgcatcaagcctgtataataacggcttgctgttcacagcatatgatttcacgggtggacttgcaccaggcagtaaagacaactaccgctcattacgtcaggcagcacagaacgcgcaacagatccttagtgctaacactgggaacgttcgatacaaacaggttttgaatacccgtactatgggtacacttaaccccatttgtcaaatacttttaccgcgaagcctgaacgataacgaagtgaactcacaccgttatcaggatgcaaccgatagtattgttgctaaaggtttatcccgtgcggtatcaaacgttatctggggcgctgtagaatccgtttctggtggtattctggcagaccgtagggaagcaatcgacatcggtacgaaagcagcgtttcaaggctctgataagcgcacaaagatgtattacaatacattcgttatcgaaagccgttatgacctgctggaactgattaaaatctattacctgttcacggtgctgggttatggtactacttctggcggtactccagcagaattagccggactggttaaacaagcgtataattccagcgcttcgaaggttgcaaacgtttttgcaccatcaacaaaccagacgacagcaagcgatttcaacggcagcatcggggatcagattgttgacttcgtatctaacgttgaagttattaaatcgcctcctgtgtggtttattcgtgacttccagacaggagacagtttgcggttccctcattccacgttcgggccagcaggtattaccagcgttcgtttcgggcgtacaatggacaacattgtaaatacgttgagagaatcaccgaacaccccgatcgcagttgaaatcgaaattcagtttatggaactgatcgatatgcgtcaggattcgatttttgatacgcagtattaagggggaacaatgttctatagcgtagatgaatttttgtcaggaatggcaaatagagactttcagcgaagcaacctgtttagtgttgtattcgcaaccagtccagcatcacgcattctcgacagcacgatcgggagtatccgcgatactttaatagatggtactatgagttccattaacgcgaataacccgaacgagttcatgaacgctattacagggggcgtaagcaagctattcagctatacagttgataaagctattatgtccctgaacaaaacaggtttcagtaaaatcatgggggcgttaagccctcgtttaattacttccctgtttggtgatagtgtttacggacagatgctaacagaattccgtgacaaaatgatgtataatatggggttgagcatcgttggtgttcagttgcctggtaaaacactgggttatgaatacgtgtataatggcggtgtaccccagatccgattcacccgaccggagaatggagaattatcactaacgttccgtgtggattcagaagcgcgtaacctgaaagtattcaacgaatggttatcagctattcgtgatgatgtatcaggccagttcgcattcattgatgaagtatcaagcgcgatccaggtaaacttacacaatcgcgatggtgtcccgcacagcacgtatgtattccagaagtgtttgcctgttaaagtcagcaatccagaactgagttatgaaagcaataacgaaatctggacattcactgttgactttgcctataaaacaggctggcttgttgaagcagataaagaaggttgggacggattcaaacaatcacttatcgaaggggcagcaattgccgttcgtggtgtggttactggacaataaggggcgaaagccccttttgaggttaaaatgattgacataatccgcgtaaaactccctggtggagtgaagcgattccctatgtttaccgtgcgcgatcaattgagtttcttgctcaccagcgcggacatggaagggaagacgctcacagaacagcaagaaatgctggatgaaattttagatattctgtatccgggttattcccgcaccgaacaggaaaacatattcactaaggtgtattgcgtatcgttcggtaagaacgcaataaagatccgaatcaaaggaagcagcggacaatcagaagcattcatgcatgtaactgattacgttttgcaaaatgaatatgcccttgatgactcgcttactctgggattcaaattcccgaaacatcgtaacaacagtgaacaattattccttgaatgtatccagtatgtcaagcaggacggcgaaagatacgaatggaatgcattagacgaggatacaaagaacgcgatcctggatctggtgtctattgaagatatggaaaatatcgttaaactgttacgcaagtcctgtcatgttaccgtgcgtgatattgagttcagcgacttattgacactgtacaaaatcctgttcaacaaatcagaactgaatgagttcttcaaaaccaactatttgttaaataagaataccgtacagattgaacctataatgaatggaagcccgatggaacgttcaatttacgttgcattgctggcggaagacttgaaacgaaaagagaatgcaaatgcgtaaacatacaccccgacatatcccaaaatataatgtgacttatcgcccgttaaccattggcgatcttgatgacacggataacttcattattgaaggtgatgtgttcaagcatcagcgcgattatgtttacattatggctctgttcgacagtatcaacaaagagactgtagatctccaaatcaaatgccctgattgcggggaactgattaagtttgtgctcaatcgtcatcatatcatggtggacgaatacgaagaaaagctgtacggcaatgagatcaagatttcagtcgaaccacaccgcaccggaaaggaagagttaccagaactgattaagtttgtagtcatcgacggtgaacaaatcttatgggatgactgtaaagagtcagagaaagaagccgttctggatagtatcgactatccggtctttaaatcaataaatagcgctctggataagccagcaatcgttgcaaacattccggtaaggtgttcgtgtggctacgagcatatcgttgcactgagaggcttagaggcgtttctaaaggtggttggataaaatgggtgttaaccttcgcttactgtatagcgatatcgatcccaacttaacaaaagactggaacaatgacgtaaccgcctcgaaaggggcggcagcggtaaagaatagtctgatcggtatcgtaacaacacaaaaaggcacacggcctttcgatagcaactttggttgtgagatcggggaacagattttcgagaacatgaacccgctaacagcggaagcagtaaggacttcgattgtctccgcgatccgcgcatacgaaccccgtgtttacaatctggatgttgaagtgattccgcagtatgacgaaaacgcaatcaccgtgacgatttactacagcatcattgatgaaccggaagaagtagaaagaatcaaactccagctatcatcctcataacaaaaaagccccgaaaggggcttttcttattccatcacgatccagcccattagctgttgatatcgcaattcgaacggggtgatgaaagagcggttattgataaccttcgtcccgttataggacttaatcacttcctcaccacgaagcacatattcgtatacttcgtccatcgtatcataacgaacttcttcgacttcgaagcagaagttggaatattcaatcattccgatcttgttcgcgtaacggcgttcgatgcatccctgtttttcaatctgagtgatcgcagtatcaatgaactgcgcaagtgcttgcatgaaattaccacattcgacttcacgacccccgcttgagatagccaggtaaacgcggctcaatccatcattgccgatgtaaccgatacagtcaccgccaatatagacagaccagactttacccatcggccccatacccatacgattctcactacgagaaacacctttcagtaacagtgccatgatacctccgcgaacgtaattcattttcatgataagccccttattttttcaggttgattaaccaagatggttgggtttctaaactaaccgctttccaagcatatgcaacactataaccggaatacgtctgacatacaacagcattttcatttaaatatttcactttgtgatctgcctcttgttcatccagggcagcacacacgatattcttttcatacactccgccgtttggctggataatggtttcttcaatcagataaacgctgttcatgctaattccttctcgattgcttcgatgatgtggagaacgtaaccgttcagttcttttgctttatcagcggcttcaaccataccgtaacgaggaacttctaaaacgttcgcaccttcgagcaggttgctttcgatgtctacgattacgtagctctcaccgattgtcgcgccttttctccagtcttttacgaacttcatcattttagctttcatgttctcgttccttttggctgttccgtttcgatatgtgtaatataacaaagccctcacgcgaacgcaagggctttttgggttaactgaatttattatagagagtgaaattaatccctatagaattcaatgctttacatgttgcatcaagatctgttggttcgatttcgatgatgtatttcaacgctgtgtttactggaatggtttctggttcttcgaaagatgccagggttggcgctttcaccgtttctggttcagcaagcgcggttttctttacgtcaaacgcttctttgaacttgttgaccctttttagcagatcatcaatcaattcgatgttggctccgtcgaattgtttggtttgttccagcatactcgtaatctttccgtatgtagtgcgtctggtttgttccgtgtaattccctacttcataacggtcgatccggtcgatgattgcccgaatatgtccaagattcgcgcgatcgaaatacgcaatcaacttagattttctgaacacgaacatatatggagcattaccgacaatgtaatgagttgccgttagaccaaaactaggatcgatcagaattttaaccgtgttgaaatacgggattaaatttatttcacgttcaggtaaacggaaaacttcatctttaaagttcttcccaatccggtcgatctcttccagagttttacccatcatcgacgaaattatttcaatttttttagatacataagccatttttcaattctcatttaattaatgcataaaagatttgacgtacttcacgatttcttcacgacacatatcgaccggagtatcctcagcaatagcagcatgacagaagatttcaccatccagccagaacgatagcatgtactgaatatcccgaccttcgttttctttctggtgtttcttgatgcgatcaaatgcatcatccatactttcggtagctgtaagcatttcagattcacccgctacagcagccatttccccagcttcatcactgaattcgctttccagttcttcccagtatactatcgttatcatggattaccccaaacagattttacatttacagagaggacattccgcctctttaacgcgcaagcgctttgttgctgttcgcttcgctgtgttgtgatcatacacatgcaaacagcggtaacagatcaccaatcgtttagccgtcataaccaccaccgcaacgaacatcaccttcaatgaacagttcgcggttatctctcaggagattgtatttcttttcgagttccggcccgaatgcgtccgcgtcgtcataccagtcatagtcataacttccggtttcatcgtcgtattccggttcgtcgccgcgctcattgaagtgaacgattttaacatcatccagattcagttctttcaacttgtcccagatgcgggttatttctacgctattacatccgaacgcttccagtgtgattgtaccgtcatcgtgtatttgaggtaaaccccagcgaggacgagtatcatcaaacatatccatcagagattcaacgtttgactcaccgtaaatctttgcaacttcctgttctttaccagggcggacaagtcctatcccgataatgaaactactgcttgagctattgctcacgaacccagaacggatcttcatcgccttgcctcgtatttcgcgttatctgcgattttctcatgatacaggttgtatgacaacaccagcgggatacaagctactataagcccgatgatagccagttgatattcgcgtttatcgaacgccatgaatgtaatcgtagcgcccagaataaacacacctaacgcaatgatgaagaataatgtcattttggcagggtatccatttcacgagattttgctttcaggatgtcaatcacagtagtcatcgcctgttctacatcaccatcatagtgaatcaggaatgttttgtgaagtcccatgatcagacgattgatgatataagccatttctgacggtaacagtttaccattctgtcgattgtacttctcaaacaagcggtagagttctgcgctattgcctggcttctcgatgctaaaattatgcatcccagacagaataccatccagatacagaacagttttgttatcactgcgcaggtgtccgccaaccttgtagtagttgctgaatacatacggcttttcgcggatatcttcgatatcgaaatcaccatgatcttcgatgttgccaacatgggcgaagaaatgatgatcttccagttcgagaaggattgcaccctttttgtaagggaatccgactaaatcaatctgccagccattttcaccgacaaatacatcatcaacaaccacgaaatccggcagcataggcgcgtatgcgtggttcttttcgttgttttcacgataggcttgtggttcggacaggtacaggatatcgccttttacaacttcaccccagaatacgttacgtgacatattattttcctcaatatgccccctttcgggggcggtcattgttagattttgacttctttttcttccaggacgatttcacattcgaatgatgtggtttcccagactttccagaaatcggatggaatattatcttctttcggaagaatatcttttgcagcgatagaaactttggtttcttcgaagtccagatccgcgaaccatgcatgggctactacaacaccgtacattacgcgacttaaacgggcattcagtttacggacttcctgaatcgttgcctttgtctgcttatcaagatactcgactacctgatctttgtcaagcgcatccagttcagatttcacctgatcgtaagcccacaggataatcaggtcgccgttgttcagtttcttcttaccttcttcacgcttcgcgacggtagccgctacagcaggaagggaggaaacacccttgattttcacgttcagttctttcgacatgtaaacatcagtcgattctgtgcgctcaaccttcggagagaacccgtaatcacgaataccctgttcagacagccattcacccgcagcctcaccaaagcgctgtttcagcccttctgcgttgcgcagtccgatcgcgttgtcacggaagaacttcataaccttctgacgacctttcaggatttctaggcgcacgttatcagtcacgaactctttaccgcttaacccgcgagtcatgccacggttaaccagaggcagagaggtaaagtctaccagaaccgacatacgatcatcaccgattttttcgagcggcttgatagtcaggccagaagcacgaaggtttttcagtgtcggaatatcggtttccagcggcagaactttaacgttcacgataccatctttaacgatggtgaagttacgcacctgcttagtttcgactttttccggcagaccgaattctttctgtttgctttctgggatagtcacatacccttccagatccgtgttgatggaaatgttaggacgggaactgttacccaccagatgtttaaccgatactttggttgtagtctgggtgaacttcggaacccatacttcatgcgctaccatttgcgccgccagtgctttacgttcttctggggttgcagcgtttgcgatctgttcagacagttgatccagtgtatcatcttctttctgtacagtctgacggcctgtgcggttgtacgcccagtgttcagaagacaggtcgatcactgtgtcagtttgtgccagcagttcgagcgcatcaaccagagtgaacgcgttttcgtctggaaccatgctgtaatcaataccatcaacgaaacgctgtgacggatcaacaaccgcttgtgcaatcaggtctttcgcgttggaatagtcctgcttagtaaagcagttgtcatacgccttgatcagacggacatcacccagcttttgaagcactttccatgccagatcagggttcattgtgtgtagtgcatgataaagcacgacatacagaacttgctgttcgctggcgatgttcggatcgaagccgtcaacatcattgatcgcgttgtcacccagcgcccagatgtttttgatgtgttctggaaccagtacaacaccgtttgcagcgttcaggacatacacgcgcccttcgtccaggtagatcgcatgggtagcatcagcaacgttgacttcgatacgcgcggaagtctgcgcggtgataatttcgttaaatgctggttcgtatgcgtcgaaaccttcaacgaatttgtgcaatgcgttggttgcttctgccattttttccagcagaggacggtttacataataaccgtattccaggaacgcgatactgttgaaagtcagtggcagaaccgcacacgctttcagaatatcatcggtacgccagcagttatcataaccgtctgtcaggaagatcaggctgttcaggttgccgttttcagattgcagatcggtagcgatttccgcagccagattcaacggctcaacaaagccagtacaacccgtaggtttcaggtaacggtcgatagccgcgcagatgttagacaggtcagagacattgctaaccttctcaccacggaacaccgtaccgtaatcgcctttgctggagaagtacaggatcgaaacggtgtcatcctgtttaaccagactcgccaggtttgctttcaggtgtttacggatcttaggcagttcgttgtacattgaaccggatacgtcacacacgaaaacatggtttgtcggggttggcttcgatacagcgtttttgaattcgatatttgtgattgacatttaaattttctcgtatttgaatttttctaaaatttcgttaactttattgcttactgcttcgactgtacgatcacacccgaacttatgcgccaggagttcaacgtattcatccatcgttgtgagtttggattctgcaacgtcaaacgcaagcgcatacattaccggattccatactcgaacgatttggagagtatactcgttcagttcaaaacgttcaagatattttcgcaaagaaaatacatcaaacggtgcgggacgatcctggctaaaggggatcgactcccctaacgcatagcgaggcataacaacgcaaacttctgtttttagcttatccatcagtgatgactctttgatgtgtgttcaaggttacggaagatgtttccatgttccagttgagttccgatcgggccgcattcatcggagtacgtgaattcatagataaacacgccgtcctgattaccgaacttcgtgttgtactcttcgtacaaccacattttgatcagagcgtctttctcttctgtgtccagatcgtaccagtctcgcccgtcatacgcaagcgcgatttgagggtttgaacggtagcgggtttctgcgctttcttcggtttcccagtcatagcgcttatcgtcgtagaacgattcaaagctattacccagatgaccgcctaagtcacgatgaacgtgattgaccacttcttccgctgtcaacggcggatcgtagtaaccacaatcagggacgcaatcgcccatcatttcgcgcaggttgtcgatattagtcggatctttcgggaaccggacgatgaaactacttgatgaactgttgctcacaaaaccagaacggattttcattttacatcctcaaattgtaagttttctttggttgcgttcgcaatggctttttcgttgctcagtgttactatgcgcagacgttcgccagtaaagccgtcgcattcagtgatactcacccagtcaaaaggtttagccatttcaatcgcacgttccagcgatacggtagaaccgaccaaatcactaaatgtatagtaatcttcgcttaaactttcaacagtataaattttcatgatactttaccctttgtttcggatttcaggacgatgttactgtaaggatcttttgctaccagttcccacaggtcgccaggatgttccccgctacggtagacggatgaacggatgatttcgttaaacttgctcagggcttcgtctatgtcgtcatacccgcatttgagaggcttacggttgcaacgaatgaagaacatttcgttggtattctcccagcgttcggcgtttttaaccttcataccgcctccattttaccaatgacttcttcgtatgtcacagggttaggttcatagccgttagcgcctattgtatcgcctactctgtttcctactaaagaagcaaccgcaactttcttaccgtctttccacgcagtgaaatgcagattatccgcaacatacgggaaggtttcgtgattgttcaccgcgtcgatgcagtccataacggtatcagacgcgcagatcagattaccaggttcataatcaaccaaacattcaacagtgtaaatcataataatttcctcacgaaaaagcccctttcggggcttgattaatcagtgtccgaacacaccacgaatagactctgcgaacgcgtacagttcagggtttttcgctttcactgtttcgatttgttccaggatgtaatctggtttgtatttcgcaccgaaccagcagtaagagaaagaacgatcccacatgaacacgttgtagtattcaccgttacgcacttcaaccatcacgtaacctggattagaacccagcgggtaatctttcagtagattaaatttcgcaccagcgccagtacatccgttaaacaggtcattaaaagtcatggtatgttccttttcagtttcgtttcgttaaagctaatgtatcactatcctggtcagtatgcaatgtttaattttgcaaatttaccaaaatgttttatcgcttcccgatcgtatgcttttgcagcctcgtattcgtcacgataggaaccgatatgtttaaccttaccatcaaccattatctgcgcgatgtaacgtattccggttggttgattgcgcacacatacacccttgaatcgactggttccttcctttcgtcgtttcctgttctgggagttacgggattgatccgcttcacgcaagttatcaatcccgtcgccagcctcaacaccatttttatgatcaatcacatcaggcagttttccggttgcaacgtagtagatgattcgatgacgtagatatcctttgcttttgaaataaacgcgggtatatcctcctttaatcttcgaacctacttcctttccgatcaagtcagaacgtttgtgtgacgttcgtataattgtccccgtttgtatatcaacagaaacagttttaaggaattcgtcaattcctttctgttcttcttcgattgttcttagtccgttgtgtgacataacaccttcttgatttgttttgctatagcctcgatgactggtattgaaacagaattacctgcttgtttatacgcttgcatcttgcttttgttgataataaacgaatctgggaaaccctgcaaacgaaaacactcacggggagtaagtcttcgggggttctttccttcctgcaataccagacattgaacaccatctttatagtaatttgcagtgatagtcccagtgtgcgtagaatcgcttgtgacggcctgataaccgaaccccttaccgtttgccttatttcgttccttacgctctctaaagcctttccatgcgttatctgagagggtgaatgaatcatcagcatcttcgaggatgtcgcctacgcgtgtaggtgtacgcgggggaacaggaaatgaaaagaatacatcatccaggaagcagacaataaacacgcgttcccgtctttggggtagtccgaaatcctttgtgttcaggcgttgatagaatacgttatatccttcggcctccagaagcccgtaaatcgttttaaacgtcttccccttgtcatgggttagcagttcaggcacgttctcaaagaacagcacacggggctttttggcgcgtataatgcggaggatttcgaagaacaccgtaccgcgtacatcatcgaatcccagtttcaatccggctttactgaacgcctgacacgggaaccccgccagcaggatatcatgatccggtactttgttttcatcaatggcgaatagatcaccctgtaggttatcatcgccccagttttcgatatatgtttgctgtgcgaacttgtcgatttcagacgttaaaaggcattcgacaccgccgaacgccttatcaaatcctaatcgaaccccgcccacaccagcgcagaggtcaattattttcatacgtcaaaatcaatctcgtcgattttgtatgagttttcttcaatgtccgcccatagggttacattaacgtgtttgctatcttcgtacaactggcgaccatcaatcccgcccgtgtaattgctttcggtacgttcagtaacttccagtcggaggctatcgcgcatgatctgaacaacagcctgttccagtgtaactgcgtctgggtttttggtatcgcccagtacaacatctttaacgttcaaaataacatcagtcattagtgccactccgttttaataccgtgtcggtatgcgtcaatccccagtggggtaatcagcaaccatgctttcgaattatcgtgataacccgttactcttcgagcgtaacctttttgaatcagggaatcacgccctgatttgctgggtacgtcattgaaatctaagtctagcactttagttgcgtatccgtaaagtttatacagaacatcaatttcagcgccggacaatttaggatacatcatttgtaataccccacaacatgatcgctgtatatgcgttcgatgaaatcgttccagaactcgcgatcaacttctttcggatatgttgaaatcgctgcaaggcgttcgacttcgcccataacttcttccagtttttcctgtacggttgcgaacggtacgccgccagctttaaccagtttcaggaatgcgctatcaggcagaggataaacgatatcaccatctttgtaaatctggatcaactgcataccaccgcgcaacgcgtgacttaatgctttccagtcgatcccgttgttggcttctgcttgtcgtgcgcgttctccgtattcatcccagagtttatacacagacttacgcatttcatcggctttgatcgtgaactggaatttacgccccagcacttcatagaagtcctgacaaccagatttcattgtcgtgtcggtaacgaatcggcagaactcgtttgtagggaaacgatccttgatgtcagacactttcacttcacgcgtatagcgtttcatatctggcgtgaattcctgaataccaccgatcgtttcggtttctttcagtacatcgacaacttcgcgcagtgcagccagtcgggaacccttcacgccatatttcgcggcttgcttacgaacataaccgaacaagccagttagttcagtggtgtaaaaacgccagcggttagcgcggatatactgccagatttgagagttagcgatcagcttgtcatccgaagcgtgaagcatatcgagcgctacggtatcaccatcacacgcaagactaatgaacttagtcagactatacaactgacggtcaacgtcgtctacggtgtttttagagcttttatcgcctgtgctggtgtcaacagtcttcggggctttccccaggagaatatcgcgcgggtgcgggagaaagatccctttatagtctttgtcgcttgtcggtgtgttcagtccgtacaggtgagaaccgaacacggtttccattacagttttcaaaattcaacccccagggtttttgcgataccgcgcagttcagcggtagtgatatttggtacacgcgttacatgtccacgaccgaacgcgtctttgattttatcagtaagttcgatacggtacaaatgttctttgtattcgtcttcgctatgataaccctgtgtatgattattccagtcattagcgctacctgtttttcgatcaagtcgctcaacacggaaatctttaatatcggtgatatttggatcttccgacgcatacaggtattgacgggcaaccttgatcacatacaaggtgcgaggtcgtggggttttgtgatgactgtatcgacgaataccaggatcaaacagggtatcacccactttcacatcagttaaatctatcatttcattttccaacgttttgacttttcacagtagaacaccggaagacgtgccagaactggcttcactacgtcttcccctgtgttcgtgttatgaaccacttcgatcgtaagggattgcccttcggacggccttacaatgtccagttccaggatctcacgattaccctttgtattgatttccgctacgtagtaatcgtgcccgttgatgtttacgacatcacccataataacgctaattgtgtgaatcatgagtatgcaaacttaattttaacattcagggaatccagcaggatcgcgtcacgtccatcaatgacggttaatcccatgtatttgttatcgtctgcgctcttacgggagtacatgcgacaaaccagagaaccatcttgtgcgatgtattcaacgtggtattcacggcgttctgacgtgaagatgtcaccaactacaacaggacgatcaacactttggcgtttagtcccttcataggacagtttgccgttaccgtctggggtacattccgcgcctttcaacaggatttgtgtcactcggacagattctacggttcccgcaatcaacattgctggatcagcggttcccattttcaggatcagcgttgaacttgttttgtatcgtgatggttcagtgacgaacacgtaaaccatatcgttcttatcacgggcaacagattgcagcgtgaattgcatttgacccggaatacccgacatcgcaatgtgaacacgattaccaggttccagcgccatacgacattttacatcagtgatcccgctaagggttgctactttcatgatttaattccttcaaagtcttcattagatttccagtacacgttaaagttacggcaatcgtgatcagaagtcaacgtatatttttcttttgttttctcgtcggtgatcaccatcgtttcattttcgatggaatccacgccatagacgaacactttatcaccgcgcttattcaggaacgcgtcacctgtttgaatcaactgccagcagttgacgggtaaaccacccgcacagatcggacggtttacgaggcagtaaggacgtttaatcatttaaattcttccattgcataggaagtaagatctttgaaataccttgcggtgttgccttctgggttgtttgtaatctccatcaggataacagcaccatcaactcctgctttcttagccatgaatgaaatggcttcggtagcaataatcgttgctttcataacatcagctttagaaacgttgatcgtattcatttttcttccttttcattattcatgcggtatgtgtatataatacaaaagccctcacgcgaacgcaagggcttttttaatcttttatcagagtcccgtgaaagccacaacgatttgatagtggtcatcgaagaattccccttgtcgttgtacgacctcatgtaagggcatccagaacgcctctaacgcatcgtcagaaccgcccataatgcggggcagactaccatcattgttaggctctaacttgatgtactgcgccacagtcggttttgagaagtgtacggaacgcttcggatgatcgaacagcatcgaattacggattgaaccacgaataaccttttcaggaaccttgattcgtacctcttcgagcagttcgcggatcgcacaatccaggaacgtttcatttgcgtttttgtgtccgccaggaagggctaacgcgtctttacctggtgcgaacttacgacgaattaccagcaggtgattgttacacacaaccacactatcacccgtacagcagtttagcgcttctgggtatgggtagtttttgaatttctccaattcgctttcccatttctcgtattcgtagtacagtcgccaaaatgtatccgtcatcatccatgaattgatataactcacagtagacgaaggaacataacgagatagtttcttatcccatccattcttatgcaaaaagatggttggtcgcaaatcggtcgcagataaatctttcccgtcaaccttaactggatctaccggaacatgagtccatccaaacgctttcagccagtatgaatcagcatccttttcgtaaccatagatcgcgatgttgtcgcctttggtttcgtcgattgctgtacgaacagaggttttccatttttcttcgttgtaaagataatcaggaatatgagcaaatttaacacgacaaacatcttcgtatttgtattcagtcatcagccacgaaaagatcattctttcgcgttcgttcgctgtcagagggtttaaaacgttagggtaagcatatgctgaacccagaaggatgtaaacggtttttgcttcttctaatgctttacgcaccattgctgcatgaccattatggaagggttggaatctgccaattacgacagctttatcaaattgtttcataacgtgctccacgtttaaaggttaatcataaaacagacgcaatcaccaatacaccaagaaaaccgccaataaagccgaagaatagcgaaatgaagatagtaaggatgatctgttttatgttcattatagtattctcgttttaggagtcaagcccccagagtggggctttaaaaccttatttacgagaatcgaaaatcacttgtccatcgtaacccgcacccattacggtatgtggaacaccgccctggtatttctctgcgcgtttcatctgaacgtcaagttctttccagcgaatcatttctggtgtaatggtacgctgcaacacggcgttcgcttcggcttctttcttagccgcatacagacgggcatcagcatcacgctcgttagcctgtgcagcattgctacgggcttctttatcggcaattgcctgaacaaccgcctgttgagcgatttgctctttacgtgccagttctgctttttctgcgttcacctgttcttcacgaattttcgtgttttcaacctgcttcttgatcgcttctggcagatcgatatcctgcaagaatacctgtttcacggtgtagccgtaaggacgggcatactcttcaacttcctgctgaattgcgatctgtagctggctttgaacttctgcgttatacagatcctgtgctttcggtacagatttaccgaactcacggacggtagacagaagtttttcggtcacgtacttatcaagcgcctgatcctgattacccgcgttgatacggttgatcggggctttgttaccatcgaactgcaacatcacggtcatatccacagtggatttgaatttatcctgggacggaacctgcaatttgtcaaacttcattgcgatgtctttggtgttgaacacctcgaaatcagccagtgggtttaccaggtggaagccaggcagaacaggcttcggtgaaactttacccatgaaggtttgagtttttaccgtaccatcctgaacgatagtgtacgagttcggaaccagccacagtgcagcgattacgcccagagcgatcagagtggttttctttgggttgtttacgatagtgtttaagttcatcattatttccattgggtttatgtttcaattcgatagttattctatcatcactttttcgcgtgtcaaactctttttaagaaagttttgtcagcttgtaaatcgtttgatagcacaagcctttgatctcgtccagaatgttcttcaatgaactatctactgaatcatagattgtgtcggcttcggttgctattttacggagatacaccaccgtgtcaagcacattttctgtttttaatacgggtttatatcgaccagtgataccaatatgaatttcggtgaatttatcaaccaaatcctgcatatcttcgtaaaaactctcaaacgctttatgttgagaatacgatccggtcgcaaagtgtgcgctatgcatgtatgttacagacatcagacacataccgataaaggcatctactttgcttgagttatcacgatctgttacttcgttaaatgtttgcatctttcatcccttacgaacgatgaatagtagcaaattcgtttgccaccctatagcccaggtgtttacattctggttcagtgcggcattgtttttgctgccattttcgttccatatagttatagaacaattcactggtatttacactgggagggattgtgtcaagatagacctgtagcgctgcattgatgtaatagtcgaactctttcgggacgacagtatttcgatcagcatgtgatgcaggagacaagattaacaatccaaacatcatcgcttgtgatatgcgtttaatgttcataaacatttctctacgtacacacggatcaacaatagatccgttcctgtatatatttatagcaaaaaaggggcgaatcgccccttatgtaaaattagtctaaaaatacatcaagttatctcataccagcataagctacgctcaaaagcgcggatcttatttgcgttctcgatattttcatcccatccaatcacgccagctttcatccggcgtaactcctgacgcattttagcgcgtactttcgaatcaatctttttgactgcgatcgaaagcatcgcggagatatcaccatgagctttgttaccgtcacgattcaggtttttatcgaatcggatatatgcacaacctgatttgtgtttccagttggttgtgtaccaacgcaaaccatcagggctttctccgtgctgtgcataatactgtgaaaatgcttttgtctcttcgatttgttcgatagaggacttatcacggactggaacatatttcttacggtaagtacggctcatagtgttctcctttgtttgtctgaatacaccttaacagttcagaccaacattatcaagaagtttttcgtgataatgtttgcgacagagcgaaacgtatttgtcttcggctccgatctcaacctgcgccccttcggttacgaagttgccttgtgcgtcgatacgtgcaaccgtagttgctttacgcccacagtgacacattccccgcagttctcggatctcgtctgcccaggccaacaaccagtaagaaccctcgaacagattcaactggaaatcagtacgcagaccgtaagccattacagggatttcgagttcatcaacaacgcgacatagatcgaaaacatttttcttcgaaaggaattgcgcctcgtcaacgaagatgcaagcaattttattccggcgctgaatgtcccagaacagatccatatcaggcgcaatcaattcacacttttcgttcagcccgatacgcgaactcactgtgtttgatgtgcgggtgtcgattgctggcttatagattacaacacgcataccgcgttctttgtaattgtgcgcgtccgtcaacagtcgcgcactctttccagcgttcattgatgcatagtgataatacagtttagccaattgtaaaccatccgttacccatgagttttttgttacgtcgcgcaagatgctctttgatttctggcatctggatcgcaatatcatactcttctttcgtcatagtatgatttgcgcaacccatacacccgcacacctgcgcgttacaccaacggagtgttccgtatgtcgcaatcaccttcattgctttagctttgattttgtcagtcatgattataaccgcccatttcgctatcttgtgctttatggatatcaagataccacatattgattttgcttttcagttcgcccatttctttatccagtccttcatcaacaagacaaagaatgtcaaccaccgttttacgctgtgtgatgttgattttgttcgctttcatggactgcgccagcgcttcacaggttttcaccagtgcggcgcgttgtcctttgattgcggcgatccgtttgttcgctttcttgatcgcccgacctgctttgataggatcaatcatgattagctcgctccactgctaccgcatcacgaaccgcatcattgatttcattttcaacgaaatccagaatatccgccgtaatgtcgtcaatacaggattgattgtagttgcgtgaatcaggatcgtcatcttcggcataatcctgatacgcttcgcccagttgtttcagtttatgttttaacagcttttgttcttgcggtctcattctctcgcctctttacgtccggcatcaaccaggtcatccacaaagctaacgatatcatcccaccaatccagcgcttcctgtgatgctttcgcgtcaccatcaaggaaacggtcacgagcgctcgcaaacttctctattttgctatagagcttttctttatttgcttcaatcatgataagtccgccttacgtggatcaaccgatggatcgaagtgaacgacgatgatcgggtaatctcccgtacactcgtcaataatagcgctaatacgcaaccaatcgcccccagcaagccccgcaccgataagaggggtaatgataggcaatttttcaggaaacgcactggcgcgttctacggcgctcacaaagcatgaccggattgcatcataatccacttgtgggccagtaccccagaatttaaactgggtgtatgcgttgaagacaatctgaccttcttccgtcatgtagatggagttagtgcctaacttccgctgatcgcctttcatagtcagtgcatcaattttgaacgcaccagggattttgtgcttcacttctttagcaatacccgcgcccatgttgcaataacagttacacccatgaatcaagtgtacttttcgtttcaggaacaactctacagcgttccctttgatttctttaataatcattttcatcacctgtatagtggcggtaagccagcacagccagccccgcgatcacaaccacaacacacattaagatataacctgtgttcatttaaattcatcgtcccatctttgccacgcttccaactcgtcatcatatacagggaacgagctttcgtttggctttttaacgtaataccagataatgattgcagcagcaatcacacacccgtaaaagattactaatcccatcatcagtataatcctatgccagcaacatattcatcaaccaggtaagtacggagtttttcacaacgttccttatttggcgcattggtacagaggttcatcattggttcagactgtaaaaactcatgcagtttaaccaacttctgacgcttgaagaggtgcgcgttttcttcgccccacacataagccgcgtccagttgttcggcaatcacctgttcacataccgcaacgtctttaatgtcacgattattgcagagttcagccagtcgatcatcagcatgtgcaaagccagcaaacagagtgagtaacagcgcaagttttttcatcgttttaccttagtatgaatcttcttcgataggggtataataatgggtttcgcagatatacgcaagcactgatcgcaaactatcgctttcaaattctggcttttgattgagtttcaggctccagccagtgaaacacatccatcgttcttctgcaacgtcaaatgctaaccagtacgtattgaactgtgaacatgtatgttcgaagatatcgaacagtaatttaccgccgatcggcttcacatatggcttcacgcgttgaagcgatttcagaactgattcgaggttactgcgatcctcattcatcgcaatacggagaatatgctgattggtttctgggttatacccatcgatcgcaagtcccatatcctggaagaacttagtcgcatcacggaaaatttcatgtccgctgttcggggaattgatgtagaactcaatgcgttgttttggagtcatcgcgcggacacgggaagcggttttgtgatcgatctcgtctttgacctcctgacgggctttcagcaacccgttcagcttttcctgatagggttttacaatcgctcggatttcgtcgatacgttcatcaataattgctaactgctgttccggtgtcagtttagtttccatgttaagcccctacgcgcacaaagcgatcttcaattgcatcattaacacattcgtaaatgctaacgtcattcgggacgtgcttacgaatacccactttcacgatatccatgatctctttgttgctaccccacacgttcaggttgaagtaaacaccgccgctatgaattgtgttgttaccaacatcaagatacgtatcttgactttcgcagataaacagtttgcgtttttcttctccatatgcgaagtagatactgaacgattccatacgatgacgatcgaccgtgatggtttccactttaacctttggatctttgttcagttcatctaacacaccctgaatgatgtgcagcatgttcggcttgatgatagtcgggtgactggtgataactcgatgtgatgtactcatgatttaatcctcaatagttggtacacacataataaaaaagcccctgcgaaattgcaagggctttttatcagataatgcgtttttcttctaacagcttcgcggtatggttaaccatgcgagcataatcacgggcttctttctttgaatacttgaaccccgcgttgtaactcgcaagcgcctttttcaagtcgcctttgtggtaatcaagccagtattccagttcgtgaagtgcgtacttggaaccaccccgaagggtttcgagcttattgattactacgcgtttggaatatgatttatccattcgtgcggacgcgctacgggctgttacttgaaaacaaccataagcatgatgattctttttgcctttccctacgttctcacatgcgcgagactcgatccaggcaatagccgctaaatgatatcccaaacgtttcgatgtttccgattcaactggctttgcagttttgcgatcgtactcatttccgatcctgaaagcgtactccaaaacctttttctgctttggtgtaatatcatccaattccttaacatagctgggggcattggctggcgctttcttcattactgttgcttgttgtagcggtaaagttgacttcacagcggggagtgtttggataaactctcctaacggatcagtcgccgcgttgccagaaaaagagcataagaaaatgctggcagcaaagataattttcttcattgtaacacctatttgtaacaagagagggctatgataccctcgtcttattatttatgcaacatttttaaatgggtttcgccgcacgtagtcttgttcgcgattcatactactacatccttatcacagaccggacaccggatcacacgatacacatcacgaccgccagtgtaatcagtagataccttttctttgacatcctgcgcagtgtatgacagaacagcaccacaacgacaggcagtttgttttggggtaatgcttacaacttgaaccataataacctcacaaaaatagtttcacttcgctaccgcatttcgggcagacgatatgttttttcacgatgtaatccgcagcacggaagaaaccgttgtagaacacttcgtttttcttctgtacatcagacagttcatactctaacccacttttgcagttggcgcaaacggtaattagcttatcggacggaataatgttaatcatgtatacctcacgaaaaaaggggggacgaagcccccttgatcaaaaattgtcttcaacaaaagctgcaagtcgcccacgatatacggtatccaggatcacatgacttgaatgaccgtactctttaagtttttcaaccgcatacacaaagccgttgttaacagcagtgttgcgcgggttgtcaatctgtttaatgttcccgcatagtatcagaagggtgttctcaccgcaacgggaaatgatggatttgatttcgtgattgctcaagttttgacattcatcaacaatcagaaccgaacctttacccggatcaggatgcccgattgagcgcccacggaagtaatacaggctagggaactggacaacgtttttctccagcagcccttctacgtatttgtcaacttccggttgatccttaaacagaatgttcaggctcgtaatacatggttctacagcaggacgcagtttttcgccaagagtaccaggtaagaatccgatttcgcccgacagagggctatctgccttgacatacatcaggtttgcgaagtgtcccgcgtttaccatgtgcattgcaccagcaacagccagcatggttttacctgaacccgccgcgcccatgatggtcacaacgtcattgtttttgtccagaatagcatcaacgaatgacgcttgcagagcatcgcgaggctggattgttttcatcagcttacgctttaacgcctgttcgtgcttaataggcaacacttcaagctgatactctccagcagccactacacgccctacaagttcaccatccgatagaatgtattggttagggtagaaatccgcgtcaggaagcgatgaatacgttataacggcaacaggcccgacatactccaggacttcaacagtttcccagaacagaggcaggtcgatataacctgaatacaacacatcactatctttcagcgagtcatcgccagtgtattgaagaaccgaacaacctttagacatcgcgatcaacagcatgttaatgtcacgagtcaccagagttgcgccctgctgaatacaagttgcaatgatccgcgcatcctgtttatccagagggaattcttcggtgccgtcataatcgacgattttcagtgttacgctttccggtactgctgggttcgataagtttaacgaaactcctgtttgggtaattgcttcataattttgtcccaggattgctttggacaaaagccggatcgccagtcgtgcttcatgagcggttcgctctttgcttttcaggtgatccagttcttccatcgttgcagcggtgataatgatttcgctgtcaggttcgatgtaagaatagattgaatatgggttactaatcaaaacattggtgtctaatacgtattttgacatacattaaccttatgtggtttcgttaaaaaatgtgccgaaaacctctttcgctttccggtcataaacggcttttgcttcttctggagtggtataataccccaaaaattttctttttccatctatgtttatctgcgctttgtacttcccatttgctttgtgataagaaacacctttcaaccccgtactgctgtttgaattacatttctttttcatcgcgttttgttggttcgtcgctttctgtagatttcttgctgtatctccattttcaacaccatacacatgatctacgataggaggaagataaccattctcaacgtaaaacactattcggtgtcgcaaatacatagaacctttaaaatgaatttgggaatactcgttcttgcttccggcttcacttccaggagacatagtgccgcgctgaattttccaatacacttttcccgtagatgtatcaacatctacataactcagaagagactcaatcccttgaatctcttcctgtatggttcttgatgaataaccatgacttttcattacatacccaaacggataatatggatatatgggaacgggtgaagatgacttgaacgcatacacaaggtcagcgtttttgccagttcaaaccgttcgtcgatcgtcgtgtcacattcatcgaaaatcaggttgattgcctgatacttgatggtctgaccacgaaagattgtccgcaaatcctgttttttggaaaggaggatcacgttatcatccccgcgatcgataccatttccgattgcttcatccatcgccatttgtttcgtacaagcaacgtagatattcagtgtccctttcgactgcttgatgatatcgaaagccgctttggttttacccgacatccggcccatatccagcgcagtttcgaagattgacaccccgccgcattcttgcccccaacgcccatcaatgattcgcgcaaggtgcaggttacgtgactgctttacagcgtcaacatagaattgtgaaatcatgttgtcgccttatgcaagttcaacgtgtggtgcgtcgataaatttcgtttcaatcggaaggtttggatcgttcttccagttgataccgtaacgcagttttacgccctgttcatcagcggcttgtttcactgcattcaggacaggcaaccacactttcgggttagtctgccagccagcagggagaacgctaggatacagatccacagcatcaccagtgatgtgttttgagttcatggtctgggaaacacccttgcggacgttctcgcgctgttgctctacggtgcgcagaccttcgcgtacaccaaaatcaacaggcgagagttccaaagcacgttttaccaccttaaccagttccggcttcacgccttgcaggttgttcaggcttttctgactaaatttaaacatacatacctctttatgaaaataccctatgggctacacagggtatttacggtttaagaggcgcaacgttttacatgtaaccccaaattgcatcttccgcgcgatcgcgtttccagcgaatcgtcatttcaacactctcctgtttgtcatcaggaggaagtttatcattattgatttgttcaatatatgcttgcgcatctgcttcgctacggaacaacgcatggaaattataatggttgcgcccagttacgttacgatcatccagagagaattgacctttattttcccaatcatcatacacagtgattccgttaacaaacagccccagcccacgatgttcacgcgggaagccagtgatgatatgttttcgacccatctgtgccttttcaccagtgatactgattacttcgtacaggattgcgccaggtttgatatctttcaggacagcacgtttttcaaaagcgttcataatgtattcctcacaattagttttcatatacagattaccacaatctgttttgatgtcaacaaggtctatcgtttttatttgggaaagttaactggaacaggcgatcgtgtaatgcttcgatccgctcatacgcttgtttcaggatcgtcttatcttctgggttcgttgtctcgatgcagatcagttcgtccgagtcgatagcgatcacatcatccatcagtgaagcgaatatgttcacgtcagggtgtgtcaattcctttatctccgcttccatcccgtcatgctgggataacagttcgatgatatcgcgctgtaaatctccctggtacgggaatccggtttgaagatgattgataattctttctgctttggtcatatttcacctacaaaaaagcccctttcggggctgggattaaatgtctttgcactggcaaacaccgtatttggtgaaaggcttgtcaccgctaaggtaagaccagaaatcgcaagcctgttcagcggtttcgaagattgcagcatcatagaagccgtgttcttcgttaccatctttattgaggaacacaggaagccagctttgcggtttgaagcagtcagtaacaactacccaaccttctttcgctttcattgcttctttgttcgcttcaaccatttccagcatttcgttcagtaagttcattttaatccccttgtttatctgtttcgttgtctacgagagagatattatcacaacggggattagtgtcaacagttattcgaaacgaattgtgctatttttgaaaaacattccagagcacacagatcctttgatctgcttgccgttcacaccagttgcttcgaatccggttgagtatgtgtctttttcagaacatgcaaaccacttgtaacccgtgaactggatgttcgtataaccctgtgcttccaggatacgatgtgcctctttctcgtcagtacagcttgactgcaagaacacaacaacgacaaccatcaaaatacacacaacaattttccacataatttatactcttttaaggttagttttgctggcttcgatccagcttacttggttagatccaatatcacccagacatacagttgtatgactaaatgtgttcggtaaagaaacatcatcaggagataacaacaaatcatgtacacttacgctggttgcatacaaataaccaccggacgtatacagtgtttttatgaaatcatatgaatcgttgggccacttgaaacggtatttctggttccagagttcaacttcatgcacatcatattcatcgaacaggggatcgttgccctttgtcgcttcgtaaagcgcaccgcgccattcaactaaatccgcttcgatatcacttacacaaaactcttcttttgcgctaagtttatcaagcatcatttcaatagtgcggatagccatgcttaattcacgatcgagtttcatacaataccctcttcttcgagcacttcccagatcaggcgatccaggtgcatcaggttccacataacggagtcatacgaacccagcgagcgggagtaaatcactccccatgaacgataagccttttggaatgattcagcactgttttcatcgtgcggcatatcgtcacccgaagcgatcagcagtttcagaaccatcaggctattgagcgcctttggcgtgaattcctgttcgcttaacttcatcgcgtaccgttcgatgatcgcgattgacttcggatctttaatacgcccatctgtacgacgcgttttaaacgcgctcattaattcatcaactacggcggcacacttcatatgcttcatccttttcctgtacagacatccgattatagcggatctcttcgcgctgttcaacttctctcacggcttcggctttcttttcagcggtcagtatgtgatgtactacagcgtttcggattccccagagatattcaatcatctgcatatcttcaacggtgtgatagcctttcgcatcacattcaaatacaatttcatcgcgttctgccattgccacctgtgcggtagaaggacaaataaccattccagagtatttttcaatcaacgattccagtgtacgcggttttgctggaatgtcaatagataccggaaccattcgcatcgttgaatcattatgggattgataaatcatcagaatgtaatctccgcaaactgcattctacgctcaatcgcatggatagcgttatcgcgctgttctttgttttcatatccagcccaggtaatcggggttgaacagatcaggtgaaaagtgattgctgggtgtctcttcccttcaacaacgattgttgcatcatcttcgatccaggttacgtgatccagattcaccggatagtttcttacggtaacagtttcaccaaccaaaagcgacacgtccagaatatcacgatcgcggacatatgatttaatacgagatacgattaacattatttcaactccactgcatatacatcggtttcaggggctttgtgtacgcgcatatctttaccacataccgcataagccggacagttacggcaaccgttatgatccttgttgccagtcagttctttacggaactgttttgttttcgggtgttcccagatatccttcacaaaatcttcggcttccagaacatccagaccttcttcccagccaccttcaacccagcgttcggtaaacgagcaagggaagaactgaccacgttcgttgatgtaagagctaaacatcgtcgcttcacagtcttcggcgtattgcttgtactgttcgaagttcgggtgtccctccatcgcttcaacgaaagcgggggctgaacagctatcgaatccaaatcctacaccagaatcgaggcaatattcaacaagttttttatattgttcgcgggtaacggtgtcccagttcttaccgcgtcctttttgtttcagtcccaggaacacgatcgcgtttacttgtttcaggcgcggatcattcttcacggcatcaaccacgttaaacgcgtcatcataggttttcgagctaaccatgaagtgaaggttgatttgctgttgtccggcttctgtcaggttcgctaccgagtcgaaagcgacatcaaagccagcgtgtttataaaccgataccgcaacagccccagcaaccgccgctaaacgcgctgcaacgtcttttgatacatcagcaatggtaaggttcggcacaatgcctttagaacgcgcataggccatcatatcgaacatatcagggtttgtttgtccctgtgcatcagcaccgagtgcgcattgagttagccagggcattttgtcgatgatttttttgaagttggcaagatccatgttgaacccgttcgggttattggacttgtagcagaacccgcagagtttacccgctggcccgttgcatttggtagtgatctcgatatcgagaatttcggggaatggtgcgtattctggatcgtgggaatatgttgcaccccagcgagcgaattcaccagtatcaacgttgaaattatagttgtagaacttcgagcgagcgaagcgcatattgccgtgttgatagatgaacagggacggcgctttgatgctggtaacgatatcgacagatttcataatataattctcaaaatttaacatgggattggaagacagcgcgagcaaggctttcattgtcgaacggtatcgactggtgtttctctttgctgtcaatgttaacgcgccagaactcactcgaaccgtttttggtggagtaatgcatcagcgttaccgttttattcttttccaggaaagtacgtttgtcaatctctgttttgagttcgtgttgcatcattttacactccgtttcagtttacgttcgtcagccagttcttttttgtacagtttaatgtacttcccgttaagggtgcgaagctgttggaaaaccttgttgcacaaagcacgtttcgctttgtattccggtgtattacggattgattcgatcgtcatacccatttcgtttttagggtaagcgcttaactccgctccgatctctctgtaccagttgcttaactgatcacgctgtgctttgtactcttcaaaagttaacattataactgatctccgtaatctttcgctgcatcttcgggggttgcatccagtcggtaaagctcaacggctaacggactgggtttgatttcgcggttcaggatctcactgataccgcgaaggaattcgatataaggacggaatctcatttgatacgtaccgcgttaaaagcctggttgcgcagttcataagcctgttcaagctgttcagtagtgaacagagggctatcggtattagtggtgaaactacaaatggttttgttgtcggcgttgacttcttcaacaacgatttcataaccccatgccccactgtactcacatttcacgttccggtacttgatgtaaactgctgcaacatcttcttttttgtagttccggcttttgtagatgatttccatgatttcctccttcgtttcgatgtgtgtacaataacagatcagggttatggagttttagcaattcgtgctaattatgccattttcttagcgattttccatgcggctttgaacgctggaacatcttcaacatcaacccagaaaccagaaccgaaaccatcgttgtagcaagggcaaccgtcgcagtagttttcccaggtcatcactttaccaccaacagaagcaccagtttccatcgcacgtaatgcatcttcaactttttccagtttttctgcattgtcgtcataaatgatgaagtaccatttgccgttgtattcgttacccagtttgattgcttcgcgaacaagtttcatgatgttttcctttctctgtttcgtttcgatgtgtgtaatataacaaaagcccctggcggttgcaaggggctttttaaacaaaaagtgctattttgtttcttcgaggattcgaaggatttcggcgcgggtgattggatgttttgccagctcacggatcgcgtggtcaacgtgtatcttacacatcaaaaacttctccccgcacttgtcgcatgttgcatacatatcgccatgtatacgcccgattgcatcagtcacccaataacgcatccatgcataaggagttccccgcatccatccggtagcaacatgattgcatttacgtttaccgaacatattaccacccgttaggattgcggaaatgtgtttgccagtagcgcagttgttcgcggttcatgttttggttatcaatcaccataccctgaatcatctgcaacatcatgcgggtttgattgacatcctccaggctcgctatacgctgttttaaggctttgttttcctcttctaactcaaccatacggttgtatgcgttgacgcgctccagaggcatatcagggcgctctttgaggacacgggcgcgggatacttcgcattcgtgatttgctttccagtgcgcggcttctgattctgctttttgcttgtctcgaagcgcgagtgacagatcgctaaccagatccagaaccgtttgcggatctacggtttccagatattttccgagaccctcttcccagcttttaatctgtgtcgggctatcgccataaggaacaccgtatgagaacgcgcgtttatactctttacccctgaaaccatattcctgatttccctggatgctcatattttcaacgagagtccacttactacccatcatagaagaaatcgaacgggctgatttttcaatttcttcaagtttttcacttgttactttcattttgtactccacaaatcatattgtgcgcgaaggatagcgtaaaggctaccgatattgattgaatcgaccggacactggaacatatcagagcgcatcatattgaactcgatactgttctgttcaacgaagttaccgatcattgatgtccagcccatcaccaggttatatccgtcttcggataacccgtaagccaggttaaccctgatacaacgcttatcagccagttctacgcggatacggttgcttgtgttagtcactttactggggaacttacggaacatctgggtaaggagtttagccgtttcaatgttgatcgcgcgttcctgatccctttgcgcctggttgtcatgacggcgattcagatacttttccatttttgggttgagattcacatgttgcataatatattcctcacaggtttaaagcgttcttttccggttccattacatgaactgcatttcggagatcggtcgctatcatatcgccccgatccgttacatgcaacacatttccgtaatttccagccatacacgaaccgcatgtaataatcggttcgtgcggccttgcgttcgtggaagttcatactttgttgtaaacctgaaccagccacatttcgatgttcggcgcgtaagtaacgtttaccatcggcatagtgcggtatttgtaagcggctttgtacgcatcgagttcagtcggaacacagaaagagaaaccgttgtcataacgttctgcattagaaacttcacaaccaactacagcggcaatgtttttgttcatgttcatgatgttttcctttctctgtttcgtttcgatgtgtgtaatataacaaagcccctgcattgctgcaagggcttttttcactttaatcgaatttttctggcaactggtctacaagtgcttgagtttgatgaagttcttcactcaatttatcacgataatgaaccaattcgcgggttctggatgctgaatagctaatgattttatcagcgttagccatgtaaccgtaaccagcacacgcgatttccagttttgcgttatcgccgttaggtacgcggatatgagcatacgccagcaagtttttaaccgcttgcaacagttcatgatcttctttgccgatgataaactggtttggttctgctgaatccatatacagttcttcgtctttgttcattttgcagccttatacatttcaaggacgcggttcatatgctcttgtgattgaggcacacccgcgaagttcagtttgatgaagaattccagacgatcctttttggtgcattcatccagccccagggcaggtaatgaaatgttttcaaaggctcgctgttcgtgtcgtggcatttcgtcccagaacaaacgggaaccgtccggcataggaatcccaatttcaccttcgtagactttgataatcgtcgtcaggcgttgtttgccgtcgatcacttctacccagtgagtttcgttgaactggctatcaaccgcgatcgcgatgataccgcaagggaaaccactgatcagggtagtcagaaacgcatcttgctctttctgcgtccacacataggggcgctgataagatggattcagatccagatctttattcttccaccaatgcagataactcccaaccatgatcgcgtgatcgcgactgcgaaaagttaactgatcgcggatacggttatgaaccggaatatcatctttagacatgattcaccacccaacccaacaaaccagtattgatagccgcaacggtaaggcaaatcaccgcatacacccgcgcgttgtgaactttggttttcagttctgcgatctcctgatccttttcactttcgaactcttcgcgggttccatagtaaccaggatcagcagcggttgcgggacgaactgcatctttttcaacgatggttgcataaccactcgttacttgcgttgcaccgtaccagtcaccgcgatcggtgttgatgatcaagtgatcacccttcgcgttagctttatgcttcgacttgccaatgacaattacacgttcaccattcataatataatcactctttcacgttttgttgtaagaactctaacagctttccttcggcctgtaaagcataaagtttattcagctttgctatgttctcaaagtctgatttttcgctgaacgaccagacaccatcatcggaaaccagcgcaccaaccgatacgccagtttcaggatcacgcgtcaacgccagccccaggggatgtaggatatctttattgattttccagatcaaccccaattgagataaggtgttgaaatcaacgtgactcattaggcatcgcaccgaatgacagcagccccatacgatgatcgttatctgattcaccagtgctgaattcaaattcttcaccgctgatactgatagcacggaaaccatctttcaggtacggcaacagatacagagggatcagcatcatttttgaatcgtcatcccacttacggaagcccaggtttttcatttcttccagagtcaggtcatttggatcgactggttcgaaatcaggggaagcgtaaaggcgtcctggaagatcgcgaatatttttcacggtgaatgaatcaccccatgacttatacgcgataggttcagcggcgcgggttgcggtagccagaaggatcatttggcagatttggaaagtagttgcttttggtttcatgatgtatatcccacaagtttagtcagtaaattccccatagtcttacgcgcatgatcgcggatctggctatacggaacatatttgaaaccgtccatttctgtgatggttcgcccgttcttcacgaacgttgacgcacagaagcatttatcggcttcggggtaattattgcctttatacacgaataagtaaagctcttttttactggtataatccagtcttccgaggctttccagttcgtgcggttcaacaagaactccggtttcttcgaagcactcacggatcgcagcgtgaataggttcttcgcctttttcgatatgcccctttgggatgtcccaatgaggcgtttcggttgcgtggcccattaaaacgctgccgttattcaggaagagaataccagcagaccgttccattactgcaccctgaacttacgatcgtatgctgccagcgctttatctgctgcatcaacagcctgtgtgtgtttgttagcggagttctcgctaaacacttcgcggtaaatgctaacccagagagatcggcgggtatgttcgctttcttcgttgacacgagaagccgcaaaagcgttatgctctttgatcagttgtgcgaattcagcataatgatcaatggtttgttgttgaatagctgtagaagtcataattcacctatttctttcagttcagttttgagtttttcgagagtcgattggtactgaatgccgttttctggatttggcagacgggcataatacagcgtaccagttttgttgatgtctgacaacacctcttgatcgagggtagccggatcgatgccaaaagccattttaaacatggtttccgcgtctggggcgaatccgtgagagaatgcaaaccccagctttttatcaaactgcatcagggatactttattcactttttccataatgttcttcgtaatcctcgcattctgggagataggtttcgcagaacatacacagcgtgaagaatgtaggctggcgaattccgatattatcgggtaagtacatccagaacgtgttagcaaacacgatgaacgttttcaggttttcaacggttacggtactgataccgtcataaccggattgagtaattgcgcgttccaggggaacagggtattgctcgcagtagttggcgtaatgttcgcttgtcaccagcgcattagccgcttttactagatcggtaattttcattcaatatatccccaacgaatttttacgttatcttctgacgccggacttgtaggagtcgggtacggatagctttgcgcttcccacagataaacaacagcatgttttgtcaattcttcgataacttcatcgaaagtaccgacactggtttgtaaaggcaacgagaaaggtttatcgttggtttctacttgagctattggcccatctaccaagataacacgaaccgttgtgtgctcagacatatgagcatagattttgtttttcatgcgggtacatattccactttgacaggttttgcgataaggcgttctttagtgaagccttgcccgttacagatatcacaagtaacattgaagtcttccatctgatcaacccagccagaatccggtaagccagaaggatacgtgttaacacgtttgacttcgaaccctttaccctcgcatttcgggcatttgtgtgggtactgggatttaaccatactcagcagttgccccagcgttgttgaacgatcgaagcgttcgaccagtgccattacatcagcaatacgaatcgaaccagcatcaataacggtatacaggtttttcggtacatttgagcgcatagtatatttctcacttaaaaaattttttgatgaaagagaggaacaatccaccaccgaacatgatccagtatcccgcgccgtcaccgttaaacaggacatacacagcgacaccatagcaaaagatttccgcgatattcagtaagtttctcataactccctcctttgtctacaccaggtattttaccagaaagtagattactgtcaacaacaaagttttatcaacccacttatcaccagtcattagtaatcccctacaggttgagaagatgcaacgctcaggatacggaaagagcattcattccatttgcaataagttttcgcacagtgaacagtgcctttcattacaaacccgtttgagaacaccagccagtaaagtttcatgattgcctcctttgtttcgacacccctaatataacaaaagcccctgcacgaatgcaagggcttttttcaaatatttttcaacatgtgtagttgaggcggacaatcttttgaagcaatcaggcgatccaggcgtgacataacgcgtctgtagccgtcatactcgaacttgattttaggtgcgatgtaattaacatggatcgcgtttcgcgtgttcaggctcaacgtgtactcagggataacggttcggaatcgtaaagcaatcactggcttttcgtgagcaaccgaatcatccatgttttcgaacatctggacggtgaacgcacaggcaaacactttgccattaatccggcgatatgcaatgacttcctgcataccttcgtttttcgctttcaccgcgtaatacagaacgttacacgaataatgtttagcgagactattaagaatttcactgtagatctcaaagtcttttttgactgacgcggaacgatccaggaatcggtctgcgatgtgatctgtagtcattgaaacctttgtcacataccaatcacttaacgctttactgaaattttggttaacttctctgcgtaagttattgataacatacatcaatcgtgctctgttcataaatcacccattatatttgaaatactcaatctggcgcagacgtttttccgctgcctctttcgaatcatattcaccaagttctttcgtgcgatcatggttcagcacaacccacttatcgccgcgatgttcgatgtgctccgtgatgtcttcgactttcttatccagatccagcggttcagcatcttcccggatgatagtcaaatctacgggcaatgtcaacagtcttttaactccgctgatatcttcgatgcgggaatcatacgcgagggttacatgtggtttgtaatcgtcataatcgtatgttgctccagcatccattgcatctttaaagcggctatggagataatcagactccagaactcccacgatcgtattaccgtatttcgtttcccacttctccacgtcaaccagtcgggcaggttcagagataccggaggcagggaacagatcaaccgtcttacggctatacacaatcgttgtatgcagttttgcagcggaaacaggattctctacacccagaagtttttgcaccttcgcgagcgcttcacaggaagcctgatcgaacttcgcacacatatagatccccggatcaactacgggtttcgctacttcaataaaacttttcatgtgtactccaaatgaaaaaggggctttcgcccccagtggttaaacgcctaagcgttaattatgcttttgatgcatcaatcgcttcattatcaccagcgatttctactgttgctggcagaagtgctttgatcgcgccgatcagggcatcaggggatacaccctgcgaaccgtcgatttccagaagaccgcaaatctggcctacgagttgacggtgatttgccagttcttgttctttaccctgaatgatttcgttcaggtcgaatacacgggctttcaggatcaggacatcgttttgaagctgttgggtttggttttgttcagtcattgtttacactcttaaaagattgaatacattaagcacgttgcgtttcaaatcgtctaacgtaccattatttaggattgtataatcactcaagccaggtgtcaaacctttctccgttgaatgattatcttcaataccagtttcacgttcaaggaacacaaagcgagtcccgaacttgctcaggtatttatattcgtgcggttgacgcacatcggtaatgataaagtgatccgcgtaggatttcaacattttttgaagcgcaattgaagtccagatagacggatctactttacaaacaatatcagtcccgaacacctgcatcaaacggcgaatcgtccagggctggctgttttcttcgcaaattttatgagcgataacatctgcgttactcatgaagaacccgcgagaacttaattttttgataccgctagaaaacagcgcgtatgcatcgttattggacatcaccagcggggcttcacgatcaccctcatagaatgggttcttcgctgccagcgctcgcaattgcgtgttatcgtgatgttccatagaacgtttcaggatagctttgatttcgtcggctaacgcaataacttcaacatttcggaagttatgcacaaccatttgagcaacggtatctttacccgttcgctttttaccacaaataccataaatcatttttgcgttttccgtggagtaggcacgatcacccttccgtcgatctcaatttccatgtgagcgaagttgaacatcgtcatacaggatacggcttcatccgaatcattggtatacataagctcaagctctccgaggttggagggccaagcgccatagaagcgaaatgtcgctacagtttttgactgcgagttatccaggatatgcaaagccattgcctgttgtggttcactccaacgcacggaatcgaaggtgttaaaatcgacagtaccgagcatccaaaggtaaaccccaagatacgatcgcagttcttcatcaacagcaaaacgaatagtcagtggatcgaactccattgcagatcctgggatcttccctcgaatcattgggttcagtgggacatccgtaattggaatgttgatagcaggtagtgtaacaccctgaacttgtagtttcaacccttttacataatcattgtcaggaatatctaacatgaagttagtaggtgaagtctggttcaggatcatagcagttgtattcatgatgatctccattttatagatatttagatcaagaccgtgagcgaagcgaacacacgaacgaagtgagtgttatgtacgatgtactgtttataatatttatattttatatatagagaaaacagtacatttccgtatactttttatacaatcgttaactatccgtcttcgcttcgcttgacggaactcgcttcgctcgtaaccttgaataatttagttgatctattcaataaataggtatatcatacccatactttcaaaagagattgaaaacatgaaatcattcaaagaactactttctgaatctgttcagaacaaaaaatttgctaagaccgttgatctggttgaccgtggtaacgctgcaaaaggtcagatcggtttcctgcatttcgcacatggtgctgattacgatgtgtatgcgccggactcccacgatctcgcttacttcggtaaaggtgttgtccgcctgaaaggtaaaaccactggcaagactcaggcagcgtatattgactgggcgaaaggtactgtttcattctacagcggtgatcctgctgatgacctgaaattcgacaagccactgaaattcaaaggcgcttctctgtacaaagaagcagaagaaaacctggatctgtataatcagttggcggaagatttcgaaattgatctgcctctggatgaagcattggtgaaaggaaaggtgtacaagctcccaagtaacgatatgtgcttgctgtataccggacgtaccaaaaccaaagaaacaggtgaatacgccgtgtttacggttgtagatgcctctggtaaacctcgtctggtatcgggtaaacgctttacccaggaatacaaaggtgatgttctgtctaaactggttctagctgaatcagaagatttgaacgaagccgctaaagatattcgcgaaaaagttattgcggtgttggtgaaacgtgggtttaacgaaaaagacgcagaaaagatggttgataaaaacctgaaagatgcgatgaaggttcgacctggcgcaacccctggcaaactcgcggaaatcgtgagtaccctgtaaaaataaagccccttcctttcggttggggctttttgttaatatctgttccaaactttcttcgcgctgtatggttttcctttggactggaaagcctgtgtaggcaaccaaactgctttcgcccaatcttttggggcgatctctgcaagtggtgaacgtagatgggctggcagatatgctttgatcatttgatcagccccgcgcattcccttcacgttgttccaattgattttcagtctggttttgttagaaagtcgatctgttgatccgtagccacgtttcaggagttcttctaaaaactcttgacgtgctcgcggtggcgcatagtgcaagttcagcccgtacagaaccaagttacccgctttcgaacgtcctgaacccaggaaaatgatcagcgggaaccgatcccagtatggaagggtgtctttgtatttcgcatcgtagatgaacgtatacaagcgacccgttgctggtttcgcaaccctgtgcgtcttaatgctggttttgatgaaatcaccaaaccaatcggtcgaatctttctgacgtttcgcagcggttacaccaacagtcattttcttcaaactgttgcggaaatcgtttacgatatcaaccgcgtgttttttgcgatagtcattacgtttgcgtcgggcttcggtttctgctttacggcgttcgatttcatcatcaatctgctgcttatagcggtgcatagactttgtgaacgttgcgtatgcaatcccgttttcgtccgcgaactttttggctgtcatgccttttaattttgcgcgtcggaatttgataccaagttcaacccattcacccagctttcgcttcggtggcggttttggtttgtcttcttctgcgatgatctcgaactcaaaaataaaactcataattccctccgtttagggtatttattgccctttccatccgaacacacgtttcaacgtgtcctctgtgatgattttgaactcccagcccttttgttttgctgctgcattcgcggctttccatttgtcaatgtttaccgcataagtatacagcgcatcaacaaatttctttttgttgtgaacgttgttgttcgctggcttaggtgggggcaacgtttctttcatcggtttgacttcccaaaggtaggtcacaccgttatccatttcaacatagaaatccatgaagtagcgccgtcgctttccgtctgcgttgctgaaataagggatcacaacctcttcactgttccagcgtttcacatgcgggtttttatcaagccagttcataatatatttttcccagcttgaacgatacgttatctttcgcggatctcccttatatttctgtatgttctggggcataaaagaccccttgtatgtctgtcttccagccattttagatcctaaatatagtaaacattagataggggaaattacaatgttattttcgttctttccaccagttgattacaaaggcacaccaactactgatatctaccgcgattatcgtttttactttaaccgcgtgatcaggaattataagccgcgtacatatcaactgacaggttcattaagacccgaacaattagcggaaacgctatacggaaaccagcaatactactgggttatcctgatgcttaacgataattacgatccgttttacggatggattaccgatcaggaaacggcttatcaatgcgctatccagcgttattcaaaagcaggtggtgaacaggttctttatcatatggatggtaagggcaaccgttattacaatttggttgaagaccctacgaatcccggtcattggtatgacaaaggcgataagaacatgcgttatttgcagtaccagggaacattagtccctgtagatatttatgaagatgcggtgcttcaaaatgaagcaaaacgaaccatcaagattattaacccctctgatattcaatcgtttgtaagcgattatatcaaggaaatggaaaaggcaaacctatgaaatacggtggaaataaatactcccctttctttgagggggtggtcgaagaagtcgatgatcctcgtctactggggcgtgttcaggtgcgtgtattcggtgagcatccggcacagaaacaaaaatctgaaactatcggtattccagttgaggaattaccgtggatgatgcctattcaggatattcgcagcgccgctatttctggtgttggtttttccccgactggtatcacgcgcggtagtttcgttatcggttactggcgcgataaatggcaccaggacggcgttatactgggaacctttgctggtgagtaccgagagaagccggacacccagaaaggcttctgtgacccgtttggtgagtatcctcgctatgtaggtaacgatgtcaacgtactggctcgcggtggcgcagaggggcgcggttcttcgagcgtgattattcgtgatgctaacagttcgttagctgtcaatccagatgatcgcccacttgacgagatcccagaagataaccgtcctgatactggcgggttcactatcgaaaccatgcttaaacaggatgaaggtatccgcacaaaatggtatattgatagtgaaggttatccgactatcgggatcgggcatttgcttatcatggaaaaaacccgtgatactgcgaagattaacgccgcgatcagtaaagcagttggtcgagaagtaaccaatggaacgatcacagcagaagaagtttcaacgctgtttgctcaggatttggcaaaagtccggcaggggatcagcaacacttcaaacgttcgagaagtatacgtgacgttaaaccgtcctcgtcaaatggcaatcgaaaacatgtgcttccagatgggtgttggtggtgttgccaaatttactaatgctctggctgctatgaagcgtcaggactggcaaaccgcttacaacgaactgcgaaactcaacatgggctaaccagacaccaggacgttcttcacgcgtatctaaaatcgtgctgacgggcaacctcgaatcatacggtgttcaggttccagatccagaagggcgttcattgagtgctgcatacaatgctgttgtgttggctgcatcaaacccagaagatccttttgttcctggtgatactcgcgtaatgttcgaggaacctaaatccgcatacgctgctgaatatccatacaacatggtattcgaatcccgttctggacacattcaggaattcgacgatacaccaggctttgaacgttacaaccgtgttcacccagcaggatcatacgaagaaattcgccctgatggaacccgtgttgttaaaatcgttggtgatgattatcaaatcgtcatgcaaggccgtaaattaaacgtcaagggtaatttgcaggttgttatcgagggtgatgcgttcatttacaatatgggtaacgttcaacagaccgttgatggtaacgtgaccgagttcgtgcgcggtaacgtgaatcaaaccgttgaaggtgaatatgtggggctgattaaaggcaacgcagaattaaccgttgaaaaagatgcaaccgtaaacgtgaatcagaatttaatggctaacgttaaacagaatgcaaccgttgccgtaacagaagatgcaacaattaccgcaaaaaatgctctgattgatattgagcaagatttggatattggcgcacgtaatatcaacatgcgagcatcgaataatactttcattgattccggcgcactgactaagatcactggcggtactgtacaggtaggctaaacatgatcatggattatgaaaccatcattgatgggattatgcaaaactttcagcatccttgcgatgctgagatccccgctggatattacagacgcgttatctggcagggacacacagaaaattaccctgctgttggggtagaatgggcgaccgaaatcatcccgatcggaactcacctgtatacgagttcccctttcggacagaaaagcgatccgcttccggtggtgaactctccaaacgtacccacgaatccagacggaaccccaggggtttctactgacattctggttacgaagattggttattatttcgccagtcaagcggatattgatgcctatatcgcatctatcggggctactaagctcgcgggtaatgactggtacggggcggatctatcaaaagcgaatttgttcaagaaccctggcgaactcgcgatgtacaaggtggaaaactccggtggttacttgctgacttccggtccccgttgcgatccgcgaatccgacaggtatacaaccagactacaggcgcgtttaccagcattgattactactggaatggtaatcgtattgcgtacatgaaacacgacgaatcccccgcgcaccagtgcaaatatacagggatgtcagtaaacacgaacgcagataccagcattcctccggttcctccggctctcccgtcaacgtatggggcgctaccgagtgaagccagattgttttctgctcgctctggattgggctgtattccggcgaccgtggggttcccgtatacgaatatcagcgatgctatgctttccgcgtggaacgagactcgtaaaacgttcaagctggctttcgatatgctgacgggtacaattaaaaatggctctggtatcgcgacgatgtttgacgggctttcgatcgggatggaagaaatcacagcgggtgctctggcattgtcacagcaagcatggcaaaccgcaatgaaggtgttccggcagatcattagctctgcgtttaacatcgtgggtggggcatggagtctgatcaataacttcctcccgactgttgcgatcctgggtgttgcaatcaacatttacgatctggtgtttggtgatagttcggttcaatccctgaaagattctttccaggctctgattgattccggcgcacagacgtatgaaagcgtcataaacgcaatctacggggctataggcagttcttacaactacaccgttgaatatgtcaaggctggcgctcgcgaccttgtagacgcttgtagcgcgttatttgactggtgtttgactatgttccaaaacggttgcgttgctctggtggatttgtacgggcgtatgatgcagatctggtcaatgcctcccgaaacaccaaacccgctttggtctgctgtgctggctatccgtaacatcatgcgacagattaaacctcttgatgtgattctgggcggtaacttcccagggtttacagcaatggatctgtatcagcaagcacaagcgaaagtgaaagcgttcattgatgcatcctatgcgcagatctccgcattgtatgatcaggggcaagaactattcaacaccctgaaagcacagacacaggaaagggattcgattaaacgtaagttcgatcagtacctaaactggatgtgggaacctgtaacggaagcaacaaccgctgcttatcaggctgcacttgatgccgctaacgctgctgtgaatgcgactaaggccgcatatgagggaatcaaagcacagattgctactctgcaagatgggatgaaagacacctacagcatggcaatggctgaactcaagaaactgcctgtaatggctcagattaaccagttcttaggttactgtggggttgcattcgatgacctgttaaaaacgtatgagaacgcgctgacgggcgcacaatcgctatataaaaactttgttgacagttcccgctcgtttaaggacacatgcaaggtgatttataaccagatttgtacgcttgctctaagtaaggtaactcaatacgtaaacaaattattgtcattaatcggactcgcgatcacattcggttcaattagtgtttgcgtccctatggttcaatactaaatacccgataacgaggggtaataatggctactacaaagaaacaaattaatcagatccccgatatctttgtcggggctacttttgacgaaatcaaatctgacttaatcaactggctccgaggtcaggacgaattcaaggattatgatttctccggctcgcgcatgaacgtacttgtggatctgttatcatactgtacactgtacattcagcaaatgagtaacaccgcactgttcgaatcgtttattcgtaccgctgcattgcgtagttctgttgttcaacaggctcaggatttgggctatatgccggactcccgcaccgctgcaaatacttcgatcctgatcactgcgaaaaacccactgaacccaacatcgatccgtattccacgcggtacgaaattcatcggtacagtgaaagaaacaaacagtttcccgttcgtcgtatccgatgacgtggtgatcgttcgtgacaaaaacaataactatgtttcgatgttgaacatcgttcaggggcgtttagtacgtaccgaagtcatctttgatggttcgactatcctgatccgcgatccaaacatcgaccgtagccaggttcgcgttaccgtcaacggcgcacaatgggatgactggacaaacgaaagtatcgtaaacgcaacgggtgcatcaactgttttttatatgcgtgaaactgttgatggacataccgaagtttactttggtgaaggtgaaaccagccaacaggtcgctggtggtgctctgactgctgattacatcgggggcttgaaacctgcaaacggttcaaccgttgttattgaatatatttcaaccaacggcgaagaagcaaacggtgctgaaaactttgtttacgtggatacgttgacaaacattagcattacgaatattgttgagaacccgactaattcagcggactatgtaggcgctgatggtggtggtgaaccggaagatatcgaacgtattcgcgaactcgcgcctatcatgcgtgagacacagcgccgttgtgttactgcatcggattatgaatcgttcttgtctcaccgtttcggttctgttattcaggcggttcagtgctttactgataaagaaaaacctggctatgcgttcatcgcggttaaaccgaaatcagggttgcgcttgacatctgttcaaaaagaggacatgcaaaactatctggcgaagtataaccttgcgactattacgccgtcgatccttgacccgaactatctgtatatcgtacaaagcatcaaagtaacgtatgatatcagtaagttggttgaatcagaggaatggttgcgtggtcaagtaatcaacgaggttgacagatattatactgataacgttgaaattttcaacaaatcattcagtaagtccaaaatgttaacctatgttgataacgcggacgtgtcgatcattggttcttctgcgactattcagctattgcgtgaacttgataactattacagcgctccgatgtctggtattcacttcttaaaccaggtgaaatcgcgttctgttgtttcgaacgggttcaaatacacaaacgctgctggtgattcgtatgacgtgcgttatgcatcaaccgatatgaacaccacaaccggacgtgcaaaaattgttatcggaccattcaaaaacggtgatatcagtatcgcagcttatacaggaaccgattttgataaatatcctggagtgaccgatcgtaataaatattacgaagtcggctatgtggaacactacactgatttcattagtttcgatctgggtgtcctgaacgttccatccgatcgattcagcgctgcttatatcgaactgactggtacaccattggaagagaacattttcacccgtgatggttctctgattgtgtttgaaaacgatctccgtcctcaatatacaacattgacaatgaatccaatcagtcaataattttaacccctgtcacccggcaggggttttttgtttgctaaatatgggatataagtaacgcaaatttggagaaacataatgattaaagcgccgtcaattaccagtttgcgcgttgataaactggctgctaacttcgtttatttgaagtgggatagcgtcggcatggatttttactatgtcgtggaaatggcagaaactcgcggggcaggtggtgttactattccagatgaagatttaacctggttccagttgggttacgcttttttgaatgaatggttttcttccgatgtccagccaaacaatttttataaattccgcgtcatggttacgcacaagggctttgaaccgtctgattgggtttatacagatgaattatggacgttcagccttaacgcctacgcatattcaacaatgcgtgaatttacgccaagtgatgcattcataaacgaaaaattcgcaaaggacaatcagaactacgttaacttcaatacagatgtggtaatggcagcgttgatgaaagaagactttgtgttttctccactttacactgacgtatcccagatcagcgataaaattcttacacaagaaaactatcacgaaatccaggatcatattgaacacgtttgtaatgacattaacagaactttcctggtagcgtcaaacggtttattgtacctgtttgaacgttttcagaacatggcgaaggtgtcaaacgacaaagggcaaacatggcattactacaaggcgtttaacgaccgcgtaggaaaccctgtatcgcgctctgttgcgtaccaaagccgaaacacaacctatgtactgggttacgatcgtatcttctacgggcgcacctcaacggatattcgctggtctgcggacgatgtgcgattctctgctgatgatgttacgtttgccaaactggggaaccagactggccttgatttcgacgtagactcatacaacacgtttgctaaactgcctggtaacgtgtcgaaatatgcagaagcaatggcatgttccgatgactggctttatgtggttgcgaaaaacgttgtgcgtcgtatcgcgctgaaacagacaccgatcgacaccgatccgagttctccaacgttcggagaaaagattttcgatacagcaagctatacaattgtccctggaaatgataagatcgttgtcaagaaaatggatgtgatgaacgggattctttatgcactcgttacgggtgaagtgaaaaccgctctgcaagatcctacaaaacccgctaacgtggttccgtccgctgctgctggtgtgtatcaatggcaagaagacacgaaaacctttgtgcgcctgtacgggaacaccgagaaagaacgtttttatatccagcatgaatacaccaatatgtcaacgaacggcacggagatttttatttccgtagcgaactacaaatatccaggcacacttcccgatcctgaattgttgatcgagaaccctgcactggtcggtgctgtaaaatatgatttgcgtcctggttatactgccagccttgcgattaattttgcgacgattcgcgctcatatcgacgacccgactgtttggaaatttggtgcgcaggaatattacaacgaggcgaattatagctggttcttccgcgactctgtgcgcacatggatcactaatgataaccgtcctctggtggtgtatccgaaaatcacctacagccttgtaaccgatagtgctggtccttcgtcatcgcttcgtgtgaacaaagaggtatgggatcgcggacatgttacgatttacattaacaacattaagtttaccggattcacaaagtatacgaacggcgtgttgctgtataagagttcaggcgaaatcatcgggttctttgaactgagttaccgcgctcgcgataacttaacgattttctggaaaccagacaatacgttattgattgccgatcttattcagcaggaacgcgaaaaaccgtatcaaccggatctgtcacctggtttgattgacccagatttaagccatatgattacgcgctttgcgcctcaaagctatctggaacagcagtatttcgagaagttcggggaatactatttgcagttcgtttcgctgggtgaaaacacctactataacaagctgctgaacctgatcaggaacaaatatccgcgtgagaagaacagcgtagaatatctgtggtcggaagtaaaccgccgtaatatctacctggataaaacgaagcgtgatcaggtggttcgtttctttgaatctcgttgtagtgatttctattcaacgaaaggcatcgaagcaagctataaattcctgttcaaactgttgtataacgaagatgtaagtgtagaaatcgaaagttcgaacactctggaatatgatattctggttcattcaacaaatatcaaccaggacattgtaggccggacgatttacacaccaacagcgagagcaaacgtgacgtatatcgaacgccagtatgatgacggtcaattacgttggtcggtaacgctgcacaacgtgatcggtaacttccttgaagggcaggttgtcaagtctgaaaagactaacttcacaggtactattctgcgtggtgtgcgtggtaagcaaatggcgaacaactcgatcgactacttcaaccgtgggcgttcttactacgtgatgaaaattcgttcgaatctgccagcgtcccgttataaggatgacgttttacgattcgtgcatccggtaggctttggctttatcgggatcaccatgctaacggtgttcatcaactccggtttgtctatgacgcatagtgaaacgatcattgacattcttcgaaattatcgcttcgatagcggttatccgaagtattggcctgatcgcgtagcacgtctggacggtaacggaaaccagacatttgaccttgtaactggtgaagcattgtacgacccgcacccgaaagcgggacaaccgtttgatgttccgccacaatatgacattgatgaaaaaccgctgaatggtgtactgccgtccgcgcgtcgatttgatcaaagtcctctgttcgatagttcagcggttaaatactctcagttccgtaacttagtggaaaaacgattgaaagacgatgcgggtaatcctcgcgatccgaatccaccgactcagagaaaggtagcataatggctcaacaaaacatctaccgtgcggtcgtaactggtaagttccgcacggaaaacatgatgaactttcgcgaaatgatcggggacagccccgatcgtaactcgatttatatgtcaatcgggcgtaccgaacaatgggcggataacgaatccgaccctgaattcgctcccccttatccgaacgatgatacagatggtatcgttgatatgtggacgcatatgatcgggatgacgaaagtaccaggcgaaatgattgatgcaatcgttccgcgtaaagactggggcgatactcgatatccaaaccccaaaatcttttacattaatgacatcgtggttgtaaactccgcgccgtataaccgtactgactacggtaaaggatggatggtataccgcgttgtagacgttcctgatattggctcttgttcaatctccagtatcacgggtaaagttgaatgtgtgcgtattggtggcatttggacaccgacccacgaatcgatcgaacctccacgcggagaagcgaacggtatcgacatgggcgacggctatatctgggaatatctgtatacaattccaccagatgttgttatcaaccgctgtacaaatgaacatatcgttgttccgttccctgatgaacttgaagaagatccggttcgttggggttatgataacgtgatcaaatggtatcctgatatgtacgatttggtgtaccgaatgaaggttcactcaatgcgattccgcgcgtatatggattccctgttctttccgcaagcctctttacctggcaaccgtgggttccgtcaaatcagcgttattgtaaatccgctgttgaaaaaggcgcaaccatccgacccagaagtaaaagcaacggggcagtattacacgaaaggacagcttgaacttgactcaggacaaatgatctacatggaaaaccgtcaaccgattattcgttctcctgatcagaccgaagaagtcagtattattttcgaattctaaggaaaccataatggcatatcaaactggtaaaaaattaattgacgtggggcaaatcggcaacccgtcaactggcgacccgctgtatgacggcggtgttaaacttaacgaaatcatcaccaacgtatacaacgcgtttggtgatgtgcgtttactgactgcgaatgatggtgtgggtacaatgttactccacgcgaccggatatttccagaaattaccgcgaacctattattcaggaaacccgattgaactgggttcactgcatgatatggatacctctacagggccaattacggttgtgcttccatcgggtaaacccggcgaagggttctatttcataaatagtaacggtagtatttctgttgatcgtcctgttgtattccgtccgcaagttggtgatggtatcaaaggggttcaggatcaactttacgtgacctctccatatactcagattaaaatctggtgtgtgaagaaagaaggttccgttactacatgggattattctgttgaatcaatgtttggttcaaaaacaatgcctgtagatactactaaactcattctgaaagcatcaccgaccgcaattcctttatttggttatagtgaattcagtggggcgaaaattctcgtgtacgcggagaatatgacaggcacagtcaataaaatggctgaaattcttttgtctgttgaccgtgtcgctaagggcgtgtattcaactgaatacgcagttctcaaaaatagcgaagatgaaatgtacacgcttacgttcactgttggtgcgagtgatattgtttacgcaaacgtacaatccaaaaccgagaatcgcattaaattctcgattaaagcggttgacaccattaaatcagggatcgcagcatgaaacaagaaattcttatcggtaacgtggttgatgacggcgcaggtgattatctgcgtcgtggtggtcaaaagactaacgccaactttaccgagttatataataaactgggtgacgggagtatcccgcacccagcgggtgcgtggaaaacgcacacagcgcctacgctgacccctattttcggtgaatcatgggcgctgaataccagcaacaaccgtattacggtaaacctccctaaaggcagtgtaagcgattataacaaggttattcgcttacgtgacgtatggggtaagtgggcggtaaacaacgtccgtatcgtccctgcaagcggtgataccatcaaaggctcaccgacttacaaagaactgtacaaagacctgatggacgttgaacttgtttattgttctcctggacgttgggaatatgttgaaaacaaacaggttgacaaaatcacaacttcggatctggcaaccgttgcgaaagaaacgtatatcgcgactcagggacaaactgacttcctgaacgtgttcggccctggtaactcatacaacgtccgcgcactggaagtttactatcgcggtaacttgctgtacatcgacgataagaacgggtttaatacatcaaacagtgattacggctcgcctggtgcgagtgcaggacaactggtagatctggatggtgtaaacatccgtcttaaaaccccgtgtaacgctggtgacacgcttcaattcgttacctatctggatggtattgctgcatggcgagcgacgtatgaagcgcataccatgcgcgtatataacacgggtgacacagaacaggttagtatccctggtgaaatctgggttggcgatttatcaactaaacgcacgtttactaatgctgaatttgggatcagtccccgaattttgattaacccaaactcgttcgaactactgttgaacggtcgccagcttgttaaagcaggtgatgcggatctcccgacatttgtttgtgagggcgcagaaggttatgatgaaagtagctgtattgcgaactccggcgcatgggttccttctggacaggattacagtctgatttttgttaactccgtggttacgggcattaaatttgctcaacctctggaatcccgtgatgtggtaactattcgctggttcaacaatgatatcggtactgtcatggaatgggacggtgtaggcggtattaaagaacacaccgataagatttacctgaacaacgaagaagaagtgacgctggttaatcagatcgaatatactgattataacaacccaacgcagaaaacctcgcgtaaagtagcggatacatttagcggtcgtcttctggatctgcaagcgttctttgatgttattcacccaatcgggacaatctacgaaaacgcgcataatgatgctaacccaggcgattatatgggctttggtatctggacacgttacgcggaaggtatgttccttgcaggttggacaaccgatgcatcggatagcgattttggtctgaacaataacgatctggatggttccggtcaaccaactcacacttctggtggtactggtggcgaacgtggttatgaaattaaaccgatcaacgttccacaaattcagtcaaccgataaggtgttgattaaagatgacaacgggatcattattattggtggctgtcaggttgacccagatgcaacagggccaggttacactaaataccgcgaggatgtattaaaagtaaatcgggggaacactactccagataaactaaaaacgctcccgccttatattactgttcaccgctggataagggtagcataaatgactcagtttatttccaaaacaagggagggggcgaaagtcccttcccgcgaagcagactttttgcaatatgaaatgggtacgaaagaaccgctgattggtggtaaacgtactattggtggtgcaaacgtcgatcagcttcgaaaaggggtagattaccctaacgtacaatcagcaattgatgacctgtattctttgtctcagcagatcccgatcaatggggtaatcatgatgacggaagatagccccccttctgcggtgcaacaggtagaatcaattacgtttgatgggacggtttcaaacccagatccagatcaaacacaggcgactattcacgtttatggtttcccgttcgttttcgacaatacaacgaacgcctctaccgtatgcgagacagtctataacaaattcgttgaattcgtcaacgatgaaaaatatttcgatttggttactcgtaaaggtctcaacggggaaattctggaagttcgttttattgattcagttccgcatccggttactaataaaactgaatatggaatttcgatggtaggaacaatcgacgtacaggctaaatctggttacggtacgtggacaaagttaggtgaaattgaccttgctgttactccagcagttccgatttattatttcaagcgtattgcatgaggataacaaatgaacaatacaattaaccacgtaagcgataaatccgtttacgtgacatttgatcctgctggtacgcaatggcctagcacgtttaagaacgtacaacaggcattagccgctattgggccgtgggcgcgtactgatgttggattgcctaatgccgcgcctggtgtgcgcggtattgctgctattgcgacacaggcaatgattgacgcgggtactgacacacagacgattgtaactccggctttgctggcgtatcgtttgcaaaaccctcatgcatcacaaaccgtatggggttacactcgttacgcaactgatgtagaatcagtaacagtaacaaacgatctggtttctcttactccgcgctcgttgaactatgtgtttaacacccgtcaggcaaaagaaaacgtttggggttctgcgaaactgtcaacaactgctcaggcaacgtccggtactgatgacactaccgcaatgactccgcttaaagtgaaacaggcaatctctgctctggttccggtacagtcaaacgcaacagaaagttcgtttggtcttgttcagttagcaacagttgcagaagtccgcgcaggtactattcgcgatgggtttgcgatttcaccatacacgtttattcgtctgactgcaagcgaaagtgatttaggtttactccgtatcgctacccaggcagaagtaaacgcgggtactgataacaccaaagcgattaccccgcaaaaactcgctgctgtgaagggttccggctctactttcggtatggttaaattaacaacagatatcaataccggattagcgaatactgctttgtctgctggtgctaacgtagtaccgagcaacaaaaacagtgcaattactggtggtgcattgtatcagggttcaattactgctgacaataaataccagacaaagacagacgttgacgcaaatatcccgatcggatgtatgatgcttgcagcgtttaacgccgatgttggtaacttgtttatctgtaacgggcgagcgatgaaccgcaattcaaacccagaactgtttgcccgaattggttatacatacggcggttctggtgatattttcaacttgcctgatatgcgcggtcttgtagctcgcggctttgatggtgggcgtggtgtcgatacaggtcgcggttttggtacatatcaggctgatatgtttgcgtatcacgaacatgatctccagatgatttatcagaacggcggtaatcttcctaagagccaagcagtttatgaactgaaaagcgcggaaaaaaatgaccaacgtgttatgcacctgaataacgattacagcaaagcattaggtactggcggaaacgaaacgcgaatgaaaaaccttgcggtcaactacgtaattcgagtacgataaaggggttaatccatgatttcaaaacttaacccgttaccaaagatcccgtttgttgatggtgtccctgcggacaccacacaaacccagatcaattggattgttaacggcgaaactctcgatggtgcaaaaaccaaaaccactaacgagggttctttaaacagatgcggtgttctggttcaaaagaacgcggtacaattagaagcaaatacaactacccagacatcaaaaatcaacgaagttatcgatcaggttaacctcattactgaaaacctcgcggcgatctctgatgatagtgtgatcgacaaactggataaagttgtcgctgatgttgacgtgctgaaagtagatatgtctgctgtacaggcaactacagcaagcaacaccctgaaaattcaggatatcgaaaaggaaattggtgtatgggatgcgtcaaccgatcctaaacatcgtaccattcgaaaagatattattttcctgaaagatgaactgggtgcatatcctggctttaacgaagatggtgatgttgatccgtcctctactggctccggcgtgaaatacaaggtaatggctaacgctcaggcggtatctatccatgaagcacgtattactaagctggaagatgactgggtaaactcagatgtaggtaatttaaccgatgaagttaccgatctgcgtaacgaaatggggccgaagcatttagccactttcgaatctgtgtatgttcgtctgaatggtatcggtggcgatatcactggtattaataccgaactgtcaaacatcaacacttatatcgggcgtacaggctcaggtggttctggtagtattgattcccgcatggaaactgcggaaacgaacattactactctgcaaacccagatgaatgatccggttgttggggttctgcctcgcgtaatccttttggaaagcgctgttggtaactcacaggttccaggtagtatccgttacgatatcagcacaatgaaacgtagcattagcgatctgaatatgatcgttggtgaaacaagtgatgatggtctgcgcggtgaaatggcacaggttatgaccgatatcggtactgactctcagccaacaagcatcaaaggccgtctgctgaatgtggaaaacacacagcgcgacgaccaccaggcactggttgatattaccgcaattgtgggtaatacgtcaactggactcgttgcggctaatatcgcgatgggtaaagctgtttatggtgacgcaaccagttctgatccattcctcaaagatggtattcagaaaacggctcgcgataacaaaactgcgatcggcgttaatactacaggatcagaaacagggatttataaactgatttccgatctgactgcgcgtgttgctgctctcgaagctggcggtggtggtaacgttgaacaacgtctggactaactggaacagaataaagcctctcaccaggatgttactgatgctctggttccgtatatcacagaagttgaagcggataacaaatacgaagcgaagaaagttccactgtcatttactcaaaatctggtcggtcgtaacgattatatcgagggtgatgctatttctttatctgttaccgttacaggtggtaaactgccttatgtgtaccagtggaagaaaggaaccgcaaatatcgggactgattcaccgagtgtaattatccagaacaccacaacgagtgattccggcgtatataaagttgtcgtaaccgacgctgaaaataccgtgattacttctgatgaacttgacattgtggtacatacggttcctcagttcgatacaaacttgagtgatatttctgttgttgatggtgatccattgactctggaagtagtgtttagcggtggtaaaactccgtacacttacgtatggcataaagacggatctgtattgagtggtgaaactggttcttctatcgtcaagtctgctgcaaccagcgcagatgcgggtgattactatgtaaccgtaactgacgcgatgaacagtaccaacgattcagcaaccgcgactgtgactgtaacggtagcataattttaacaaggggcgcaagccccttttgaggatcatatgattacgaacaatccagaacagttaaaggatgaaattcttcgtcgtctgggcgcaccaatcatcaaaatcgaaatcacacaagatcagatttatgactgcattcaacgcgctttagacctgtatgcagaatatcattataacggcacaaacaaaacgtatctgattttgacactgggtgatgataacccgcgcaacgtgttcgacttgagcaaagaacacatcttcgcgatcacgaaggtattgcgtacaaacatgggttcattgaccacaatggacggtacagcggtttatccgtggtttaccgatttcctgatggggttgactggtggctctctgggtgggcgctgtgcatcgagtgtgtacggtatgaacgcatacggcgcggatatgggctactttacccagatgatgtcctatcaacgctcaatgcaagacctgctggccccactgcctgattactggttcaacgatgatactggtcagttctgcgcatgggggcaggtgaacaaaggtgacattatcgttattgaagcgatggttcgttccttcgttgatgtccctagctccgtaggaagcgtcgcaggatacgctacagcgggttctaacgcagtggaagaccaatccatagccgacatctacgaaaacccgtataacagcgttgtgggcggtgtacgagcgggacagggttcaactgttacgggcggaacgtctgcatataacaaccgatgggtaaaagactactctaccgcactggtgaaagagatcaacggacaaattctggctaaattccaggggatgcaattgcctggcggtgttgctcctgatggtacgcgactgatccaggaagcggaaaccaaactgcaaagtctgcgcgatgaactgatttctatgtctgacgcagtaccgatcattatggtgtagggggaataatgcaaaactgggatgaaagtttattcgctcagttgtctacgggggaaggggttgatcgcaacttaaaggatcaggtcactaacccgtatgtaaactggtacaaatacaacccgacacaacagctacacgattcactgacagcagaatcaatccagatgaaatcgcctgatatgtattacgtccggcgtgacttcgtgaatattgataagatcctgggcgaagaccgagaatccaaatttacgaagtcatggaaaattgctgcatatattgaatcgtatgccaactatgaaggacaacgagatttctttagtaaatttggtctgagttcaaacgatgaaatgacgctggtaattaaccctcgtttgttcgcacatcaaactgatggtggtattcctgttctgggggatctggtttattttcctatggacaatagcctgtttgaaattacgtgggtagaagccgatccgttctatcagttcggtgatcgtcctcagcgtaaaatcaacctggcgaaattcatctacactggtgaagaactggctcctgaattgcagcgaaatgaaggaatccatatcgaacctgatgcagaactggatctcgaaccgattcgaaatcttgacgggctggctgatatcaacattgaacagtacgaagaagacaaagaatttgaaagagaaggtgatgaattcatcgaatcttttgatgttgtcaacggacgcggttcaccgtttgcaagtctgccataaatacgttatatgggtataggcgaaagtctataccctcttcgaagaggattttatgatatacgcaaaacttaaagaatggttgcctcatgatctatacgttgagtatgttgatatcataaaggcttctccaaaaactgaacacacagaaaaacatcacatattaccacgttctttatttcctgaattcgaacacgaaccggaaaatttagtagaacttgatataatgaagcatttgatggcccacaggacattagcaaaaaccaatgatcctaaaatgattcttgcgttcttcatgatgttcacctatgaacacaaacgctattcatcgttatctgaacaagaacagcagttcattcttgaagaaaagacaaaggcgcgaaaggcaatgcgcattgttaaaaaagaacagatgaaaggcaaacatgacggtaaaaacaacccattttacgggaaaaaccataccgacgaattcagaaaaagaattggtgctgttcataaaggaaagaagctatcaccagaacatatagcaagtctcgttgctgctcacaaaggcaaaaaacgagaaaaggtacaatgcccccattgtgggataatgtgcgccgctaatacagcgaagcgctggcactttgataactgtaagtctggacgcgtccagcagggggattagaaaatttttggatactggtataatagctcactacgcaactacattgttcttatgggacaattgtttaaccatgttcaggttaaaagagtacgcggcgatcaagaaaaatacatcaaggttccgatcacctatgcatcgaaagagaagtttctcgcttccatgaacaaacttaactacacgttgagtcaggaaaacgttgctaaaacggaaacaattttaccgcgcatgaacttatcactggtggatctgcaatataacgcaatccgtaaaaccagtatcgcggtcaaccaaaaaatgacacagttagcaaccccacgaaaaacgatcacacagtttaaccctgtgccgtatcgtctgattttcgaactgggtgtgtatacgcgatatgaagatgatatgttccagatcgcagaacagattttgccatattttcaaccacacttcaactgtaagattaccgaactgcataagaacgatatcacagttgaccgagacatcaaaatcagtctccaatcggttgcgccggataccacattcgagggcgatgcaaatcaacgccgtcatgttgagtggtcatttatgtttgaattacagggttatctgtacccgcctgtaactgatgttaaaggcgaaatcagaaccgtttacacggatttcttcgctaacatgaacccgttagataaagataactttgaatccgtggatagtcaagccgatccggtagatttgcctatgcaggactacacgggcgaagaatatattcagacgtactcgcacgataagccgatcccgtctggtgatgaacctcctaagccgagggaatgagaatggatgaaaaattagatttgcagcaattgctgaatattgattccctccctggcggcgttgagtctggggaggatgtggttgtttacgaaaaacttgaactggttgacgttcaatcacatccagcagaccggaaaccggatctggaagaggattatacgctcgcgcgtaagactgcgcaccatatgaatcagatgatcatggatatggcgcagattgcattacacaacgcgaagaactccgaatcacctcgccacgtcgaggtattcacaagcctgatgaatcagttaaacgtttcaaacattggcctgatgaagattcacaaagaaatgcgtgagattacggaagagactacaaaaccaggcgctgaaaaaggcggtggtgatggtttgaatatcgagaatgcaaccgtatttgttggttcccctacggaactaatgcagaaatacggcagtgcatatgaacccaaagagggcttcattaatggtgaagctgtagaggtaaaccctgatggaaatggaaccgacgatcgatccgagtaaggaatcagatcaccctatcggattaatgcatcccaaatatctgaaaaagaaaattgatgaattggggatggagtggacacaaagcgaacacgataaaaaatggtatccgacaacgttcagtgactacctgaaaattaacggcattcaaaaggtcgatattcagtctaaggacagttcgaactttgccacgtacaaaaataaaggcaacaagaaaacccgatataacggcaacccaaacctgaaacgtgcgtatatccagactaaatggacgcaacaaatgttgatggagtgggtgaaatgtcgtgatgatatcgtttattttgctgaaacatattgtgcgatcacccacattgactatggtacaatcaaggttcagttgcgtgactatcagcgcgaaatgctgatcgaaatgcacaaaaaccgtatggttgcctgtaacctgtcgcgtcagttgggtaaaacaaccgttgttgcaatcttcctggctcacttcgtgtgtttcaacgaagataaatatgttggtgtgctggctcacaaagcctcaatgtctgcggaagttctggatcgtaccaaacaggcgatcgaactactgcctgacttcttgcagcctggtattgttgaatggaacaaaggttctattgaacttgacaacaaatgtaaaattggtgcgtttgcatcttctcccgatgcggtgcgtggtaactccttcgcgatgatctacatcgacgaatgcgcgtttatcccgaactttgttgatgcgtggttagcgattcaaccagtaatctcttctggtcgtaaatcgaaaatccttatcacaacgacacctaacgggcttaaccacttctatgatatctggaacgctgctatagaaggaaaatccggcttcgtgccttacacggcgatctggacatcggttaaagagcgattgtatacagacggcgacaacggtacatttgatgacggttattcgtggtctgcgaaaatgatcgctggctccagcaaagaggcattcttgcaggaacactgcgcggaattcatgggaaccagtggaaccctgatcgctggttggaagttgtcaaaactcacatggattgatattgatgaaacggaaacgaacttctatcagtataaacgtccagtagaggggcataaatatgttgcggtacttgatccagcggaaggtcgcggacaggattaccatgcaatgcatatcatcgacattacgacgatgccatttgaacaggttgcggtgtatcactcaaacaaaacgtcgcatcttattttgccggatatcctgttacgttatctgaatatgtataacgaggcatggatttacattgagctaaatagcacagggcattcagttgccaaatctctgttttccgaactggaatatgagaatgttatttgtgacagctacaacgatctgggtatgaaacagactaagcgatcaaaagctatgggatgttcgacgctgaaagacctgatcgagaaagataaattgatcataaataacaaaaagacaatactcgaatttcgtactttctcagaaaaaggcgtttcgtgggctgcggaagaaggatatcacgatgacctcgttatgtcgcttgcttgtttcggttggcttacaactcaaatgaaatttgccgaattctgcgagaaagacgatttaagactagccaatgaagtttttgcacgggaacgcgaacagctatacgaagacgcattatgtccggttatcgttacaagcggtgatgaaacgatttcggttggttctcacggtatttcgtttatataaattagaggaaattctataatggctttacaatctccaggtattgaaaccaaagaaacatcggtacaatctaccgttgttcgaaattcaactggtcgcgctgccattgtcggtaaattttcatgggggccagcttatcagatccgtcagatttctaacgaagtcgaaatggtaaactattttggttccccagacaacttgaccgctgactatttcatgagtgctgttaacttcttgcagtacggtaatgatctccgtgtggttcgcgttgtcgataaagatgccgctaaaaacgcaagcgcaattttcaaccagatcaaaacaactatcgcatcacagggttctaactacactgtaaacgatgtgattaaagtaaagtacaacaacgttgttgtagaagaaaacggtaaagtgtccaaagttgacagtaacggcaagatcctcgcggtaatcatcccaagcgaaaaaatcgttgcccgtgctaaacagattggtacttacccagatatttctactggctggactaccgaaattgtttctcagtcttccggtgtttccgcgtctattacgattgacggcatcgaaagcgattcagggatcactctgttgaacctggatattgcaaaagaaacaattcagggaaccgcattccagactcttacccagaaatatcagatcccgtctgtcgtggctctgtatcctggtgaactgggttcaactgttcaggtggagattatctccaaagctgcttacgattctggcgctatgatttcaggctacccttctggggtttccgttaagaacagcggtcgttctgtaatgacctacgggccacagaccgataaccagtacgcttttgttgtgcgtcgtggtggtattgtacaggaatccttcatcgtgtcaactgagaagaccgataaagatatctacggcgtaaacatcttcatggatgactttttcgctaacggtggctctcagtacgtttacggtacttccctgaactggcctaaaggcttctccggtatccttgagttcggcggtggtttgtcctcaaacgacactgtaggcgctgatgaactgatgactggttgggatatgttcgctgatcgtgaagcgctgcatgtacctctgctgattgctggtgcgtgtgctggtgaaactgtagagatcatgtctaccgtccagaaacacgttatctctatcggtgatgaacgtcaggattgtactgtgtttgtgtcgcctccgcgctctctgatggtgaatattccactggcaacagcggttgataacatcattgaatggcgtactggatataaactcagtggtggtactccggttgacaataacctgaacgtaagttcaagctatggcttcctggatggtaactataaatatcagtatgataaatacaatgacgtgaaccgttgggttccgctggcaggtgatatcgctggcctgtgtgtttacactgatagcgttgctcaaccgtggatgtctccagcaggttacaaccgtggtcagatccgcaactgtatcaaactggctatcgaaccgcgcacagcacatcgtgacgcaatgtatcaggttcagattaacccggtaactggtttcgcgggtggttccggcttcgttctgttcggtgataaaacactgactaacgtaccgagtccatttgaccgtatcaacgttcgtcgcttgttcaacatgatcaagaaagacatcggtgataacgcgaaatacaaactgtttgaaaacaacgacgatttcacccgttcttcgttccgtatggatacaggtcagtacatgactaatattcgtgcgctgggtggctgctacgattaccgtgtaatctgcgacaccacgaacaacacaccggacgtaatcgaccgtaacgagtttgtagcaacgatctacgtgaaaccgcctcgttctatcaactacatcactctgaacttcgtagcaacgtctacgggcgcagatttcgatgaactggtagggccgcaagccgtataacgtcaagggggctgaaaagcccccataaataatccgaggttaaaaatgcttactgacattttacgcgcctttgaatccggtgatttcgcacgtccgaacctgttcgaagtagagatcccgtatctgggcaaaaactttaaattcaagtgtaaagcggcaaccatgccagcggctacagttgaaaaagttccggtaggataccaaaaccgcaaaatcaacgttgctggtgaccgtacctatgatgactggacaatcacgatctataacgatgacgcgcataatacgcgtgacgctctggtagcatggtcaaacatgatgcacggaatgggcgatcagattagtggtgatattccagcgaactacaaaaaaaccgctacggtgaaacagaaaaaccgtaacgatgaaattaccgccgaacataccattcacggtcttttccctactaacgtaggcgaagttaccctggactgggacagcaacaacgaagtgtcaacctttgaggttactttcgcgctggactggtgggaataaaggctataaatacaggggtagcaatacccctatcattatttttcggagttactatgaactttttgggctttggcaatgtacttagctttttcaagaatttcgcccgtgaggacgaattagatcttgaacagcaattaaaaaatgatacaggttcggtcgcgcctcctaaaaataatgatggtgcttatgaaatcgaaactgatctgactaatcagaaatacgcaagcgtattccagcagttttattctggacaagatccggcgattcagaacaaagaacaattaatcaatacatatcgcggcatcatgtcttacccagaagtagaaaacgctgtttctgaaattattgacgatgcgatcgtgaatgaacagggcaaagatatcattactttggatcttgccaaaacagattttagtaaggcaatccaggacaaaatcgtagaagaatttgataacgttctaaatatctatgattttgataacatgggtgcgcgtctgttccgtgattggtatgtggattcccgtatctacttccataaaatcatgcataaagacgaaagcaaaggtatccgcgaactgcgtcaacttgatccgcgttcgatggaactgatccgcgaatctatcactgaaacccttgatggtggcgtgaaagtattccgtggttatcgcgaatttttcgtgtatagcgctcctaaaaatggctatacatacaacgggcagatctaccagcataaccagaaggttaaaatcccgcgctccgctatcgtgtatgcgcattctggactggaagattgcagtaacaacattatcggatatctgcaccgcgcagtcaagccagcaaaccaattgcgtttactggaagatgcgatggtcatttaccgtatcacccgcgcacctgaacgccgtgtattctacatcgacgtagggcagatgggcggtaacaaagcgacacagtacgtaaataacatcgcacaggggcttaaaaaccgcgttgtgtacgatgctaaaacgggtactgttaagaaccagcaaaacaacctgtcaatgacagaagattactggttaatgcgtcgtgacggtaaagctatcaccgaagtagacacgcttccaggcggtgctaacttctctgatatggatgatatcaaatggtttaaccgtaagctctatgaagcactgcgtgtgccattaagccgtatgcctcgcgatgatgggggtatgcaaattggtgggggtggtgaaatcacccgtgatgaactgaaattcagtaagtttatccgcacactgcaaattcagttcagccctgtgctttccgatccgttaaaaactaacctgatcgcgaaaaaaatcatcacagaggaagaatgggaagaaaacgttagtaaaatttccttcattttccagcaggattcatattacgcggaagtgaaagatattgagattatggaacgtcgcctaacgttgatgtcacaggttgaaggtgtagttgggaaatatgtctcccataaatacatcatgaaagagattcttcgaatgtctgatgaagacattgacgaacaagcgaagctgatcgaagaagaatccaaagaagaacggttcaaaaatcccgaagaggaagaggaaaacttttgatgaaagaatttatcgaagcaatcaaaagcggtgatctggtggaagcgaagaagcaattctattccatcatggaagaccgtaccgaagcccttcgccaagaaatgcgcgttgaactcgcggaagctgtacgcatcgaaggtgaaaccgacgatgacgacagcgatgacgatgacgacgacaaaggcggcgatgataaaggcgacgacaaagacaaaaagccgtctgataaaaaagacgacgataaagacgaataagaggtgtaaataatgcaactcgaactcgaagaaatcagcgtcgaagatctcgaaccccatttaaccgaagcgaaagcccgtgttgatgttctggggatcgatgacggcactgtgaagatcatcgaaaatttggcggtcaatgaacctcatttagccctggctatgatgtccattgtcgagggtttgagtttagatgaagtcattgttaaacacgtagattcgcgcggtaatgtggaacgtaaaaaagaccgtaaaacccgtgaacgtaatgcgtatcaaacaactggtttaactaaatctcaacgtcgccaaattgcgcgtcgtgcgctaaaaacaaaacgtgcaaacccttctattacaacccgcgcacagcgtaagcgtaaaaaagcgctccgtaaacgcgccgcattagggctataaatatgaatgaatcccaactcaatgaaaacggcgatatgctgctaatcgaggaatggggtttaccttgtgcggatatttccgattcaattttagaatcggtcggtgagtcgaaaaaagacggtaaacttcggattgaaggtattttcctccaggccgaaaaagttaaccgcaataagcgactgtatccgaaaaaagtattagaagaagcagtaaacgattatatcagaactcaggttaatacccgtcaagctctgggtgaaatgaatcacccgccgcgaccgaatgtcgatccgcgtaatgcttgcatcctaattgaaaaattatggtggaaaggtaatgacgtttggggtcgcgctgttgttgtcgaaggtgataacggtgatggggataaactcgcggcgttaattcgcgcaggttgggttccaggtgtttcttctcgcggactgggtaaactttccgattctggaaaaggttacggtatcgtacaagaagggtttaaattggcagtaggcgttgatgttgtttgggggccaagcgctccagatgcttacgttaagccgattaccgaatctcagtcaagcaaaccgcttgttgagaataatagtgctgatgatgacgctttcagaaaactctctgaacgtttgaaaagtctatataaataatatcatatcaaacaggaaacttagaaatgcttaaagaacaactgttggcagaagcccagaacctggataccccagttgagttagacagcattttcgaatcagttgaactttctgatgatgcgaaagcaaacttcaccactgtattcgaacaagctgtaaaagcaggtgctgcgaaactcgctgaaacccacatcgcccagatcgcggaactctccgatgaactggttgaagcccaggttgccgaaaaagctggcgaaatcgaaaataaactgtacgaagatgcgaataaatacttcgaccacatcgcgcaggaatggctctctgaaaacaaagaagctgtgtcccgtgatatcaaggccgatctgttcgaatctctggtaatgggaatgaaagaactgttcgttgaacacaacgtagttatcccagaagcgcaggttgatgttgttgcagaactcgaagatgaactgaccgagaatcagcaggaagttaaacgcctgttcgaagctaatcaggctcaggctaaagagatcgccaacatgaaacgcgataccatcgtttcagaaaaaacaaaagatctgactgaatcgcaaattgaaaaggttcagaacctgatcgaaggtttggaatattccgacaagttcgaatccaaactgaccgcaatcgttgaaatggtagcgactaaagcggaaaaacaggttgaagagagtaccactactcagacaaccactaaagatgactttgttccggtgaatgaaaatacacctccagcagagaaatcgaagatcaataaatatgtacaagcggctaaagccctttcctaatcttataaggtaagaaacaatgtctaagaaaaacgaattgatggaaaaatggaacgatcttctggaatctcaggaaggtttaccggatatcgctaccaaatccaaaaaacaactggttgcagcaattctggaaactcaggaaaaggatgctgatactgatccagtatatcgcgacgaaaaaatcattgaatccttcggcggtttcctggcggaagcagagatcgcgggtgaccacggttacgacgcaaccaacattgcctctggtaaatccagcggtgcaatcaccaacatcggccctgctgtaatcggtatggttcgccgtgcgattcctaacctgatcgcattcgacatttgcggtgttcagcctatgactggccctactggtcaggtgttcgcactccgtgctgtatacggtaaagatcctctggctggcggtactcctgcaaacgttcgtgaagcattccatccgatgttcgctccagacaccatgtattctggtgaaggtgcaaacaccgcgtttgctgctatcgcaactggtgttgctatcgcttccggcgctatcgttaagcacgtattccaggaaactggtgtcgcgtacttccagaacgtaacctccggcaacgtaaccgtaactggtgctgatgctgctgctctggatgctgctgtaatcgcagaaaacgagaaaggcactctggctgaaatttccgaaggtatggctaccagcgtagcagaactccaggaaaacttcaacggttccagcgctaacccgtggaacgaaatggctttccgtatcgacaaacaggttatcgaagctcgtagccgtcaactgaaagcacagtattccgttgaactggcacaggatcttcgtgctgtacacggtatggacgctgacgccgaactgtctgcaatcctggcaactgaaatcatgctggaaatcaaccgcgaaatcgttgacctgatcaactacaccgcgcagattggtaaaactggtttcacccagaccgtaggctctaaagctggtgcgtttgacttccaagaaccagtagatattcgcggcgctcgttgggctggtgaaagctataaagctctgctgattcagatcgacaaagaagcgaacgaaatcgcgcgtcaaactggtcgtggtgctggtaacttcatcatcgcttcccgtaacgtggtttccgctctggctcgtatcgacagcggcatcactccggcaggtcagggtctccagaaaactctgaacgtagacaccactaaagcggtattcgctggtgtactgggtggcacttacaaagtgtacatcgaccagtacgctcgccaggattacttcaccgtgggctacaagggtgataacgaaatggatgctggtatctactacgctccatacgttgcgctgactccgctgcgtggttctgatcctaagaacttccagccagtaatgggcttcaaaactcgttacggtatcggcatcaacccgtttgcgaactctcgctctcaggctccggcagatcgtatcacctctggtatgatcagcaaagaaatgtgcggtaaaaacgcatacttccgtaaggtctgggttaagggcttataagttgttgaaaaacaacgactttttaaagggaaccttcgggttccctttttgtttatataaataatgaaaactattgaggctatattatgaaacacatcatttataaaataacaaacactataaacaataggatctatatcggcgcacattcgactgatgatattaacgattcatacatgggttctggtaaagcaatcaaagcggcccaacgaaaatatggaattgataatttcgtaaaagagattttgttcgtgtttgatacaagcgaagaaatgtatgaaaaggaaagggagattgtaaatttggatttcgtcaatcgtcccgatgtgtacaatatgggcgtaggtggttctggtggtcctatgctgggaatgtttcattcagaagaaaagaaacatgaaatatccaaaagaactcgtgaaagaatgacaccagaagtaaaagaacacctttcaaaaataaaaacaggaaagaaacaatcggaagaatccaacaggaagcgttcagagactatcaaagctatgtataagggttctgcattcgacagaaccggatctaagctcacagacgcgcacaaggccaaaataagccgttctgtgtcgatagatggagttgtttatgcaagtggttctgatgctgctaaagcgttggggctttctcgatctggccttgattaccgtttaaagagtgacaaatttcctgaatggaaattcgttgcataaataaacaatatactccctataaattcaggaaccaaagaaatgagtgataaacactacacaattcacaagttgatgcgtcagtctgcgcttccgtctggtaaacgagaaaaagttatcaacgaagcaacaggcacgaccgacatcaacgtacagaacacgcgcccagaactggtttctttgactcgcgcggttaacaacctgatctatcatgaactggttgctgtacaagaaacagaactccctgttgcaacactgttcggtgttcgctatcgcaaccctaatggtgatatgactttctccagtgctgcaacctattcaggccgaatctctggacgtacagacatcgacgaaatcgatctgactaaagcctacgttaaaggtgatttgttcaagcatgatggtactgacgttgtttatgaggttatcgcaccgattaccctgaacactctggatactgacaaagacaccgcgatcatgaaagctgtgttccaaagcaaaattcgactggttagcgaagccgctgatacttctaagtatgaaaccagtgaagatatcgagtcaacctccttccagatggatcgctggaatattccggtacgctcgcgtaagtttaaaaccgaaatgacggttgaactgatgcaggatttggaagcgaaccagttcgaagctgatggggtgatcgaagacattctgggaaccgtggcaagtgaagaagtcaacaaagacattattcaaacactgatcaccgtttccaaacgttacaacgttgatggactcgttacggatggtatttttgacggtactaccgcatacaccgcgaaggatgctccagcattgggtcgtatcctgtaccaattagcgtgtgaaatggggcaggaaatgaatagaacgacttcatttgatgctacctacgtcctcgcaacagcgcgtgttgtaggcattctggctgcgtctggttggatgcacgaaaccgacgaacaacacccactggcaacaggtaagctgaacaacggttattatgtctatacagacacaaacagcccgttcgattatatgctgactggctgcaaatatgatctgggtgatatggatcacgtaggctctctgttcttcgctccgtataccgaagctgacgaagcaggttcaatcaaagtatccgtagatccggcatccctgcaaccaaaagttgctattctgatgcgttacggtctttccgtgaacccgtatactgctgaaagtgattctgatcgcctgatcaaaggtgatgattggtctgctcttgcaggtaaatctaagctgagtcagatcgtaggtattaaattacctaaactgggttaacaagttttgttttgagaagaccattatagtaataaagatctataaggtcaaacgagcgaagcgagttttcacgaacgaagtgagtgatgggtaagtacgatgtactgtttataatatttatattttatatatagagaaaacagtacatttccgtatactttttaaccaacattcactcactacgttcgttcatgtactcgcttcgctcgtagatttgacttcttgatctaactggttataatgttactttgttttgaggtgatacatggctgaactaaaacttgaagatctacaggctgaacttgaagaggatatgcgtattgatccgttgaagttacaaagcgaatcagcagacattccgaagatttggtcaaaatggcttcgataccattcgaatgctaagaaaaaacttattcaactccaggcgaagaaagaagcgattgtaaaagatcggttactgttctacactggtagacacgaaagcgaaatgaccgatgtcatttacactggttcgggtgaaatcaaaattgctatctccggtgatcctaagaccgttgaagttaacaagctgatccaatacttcgaactgattgcagagtttaccggaaaagcgctggatatcgttaagaacaaaggctactccatcaaaaacatgttggagatccgtaaacttgagagtggtgcataaaatggcagaagaatttgattgcaaatgcgttgtgtgcaaacaaccgatgaactcccgtaatacggcgtttgtcaatgaagctggtccgatctgcggtgtcgtatgtttgcaatatctcaacgaaaggaatgatcgcggtatcaatgaagccgacgatctgaacgaagttcaaatgttgctgtaggtgtgaatatgaaagactattcaaaaatcgactttaacgaagtatttcgtttgctgggattgatggaagaatgtgtgaccagggttcatgcacttcgaatttcgtttgaaagtggttgtatcgaagacgaacgcccagatttatagcagtaaatataattgtagggcaagggcatgtttaccgatggatgcattttcataatcggataaacctaatggcctatatggaatgcaacatatattcgtgattgggatttttttctcaacctggaacctttatgctaacagtgtgcaacggcacgaactacgattgactaccccgcaaatatacgattgcatgttgcggcgaatgtgtcacagtaccccttgtggggcatggctggctgattaatcagcttacgcagtttagaatagcggtgacgacaccgcgttaaaaatcaactatgcttcaaaattaaaaagccccttcctttcggttggggctttctttttaaaacttctcttcttctccggtttcaagttcggctttcagttcttctcgccgtcccttgatcgcgtcacgcattgaaatgtcatcggatgctgcaacctcgacttctttcacgcgggtgttgtaatacttttcaagttctttcaaaccttctagtgtccggcacgaagcaaccttattcatgaaatcatcaatcgctgcttcgtttacgaatgtagtaaaacttttcattttggcctcttaaatttctacctgtttgatcgcgtagtcgaatcgttcttcattgtagatccgcacacgttccatagcatgtttcataccgtagtttgtcgcactgtatttatttttggctgtcttagactttgacagcgtagccaggttatcaacgatatcccatacagtagcgagcgctttcgatccgtgcttacgaagtacacgaccgatagactgtttcaccacaacagcagatttgcaagggtgcgcaaaaatgatgtggtgtaggttcttgattgagatacccgtactcagtaccccgatcgaaccgatgacgattaaacctttcgtcgattctgcaattttcttcatttcgttacgatcgtcaatgtctgtatcaccattgaccaacaccacgttatcgtaaaccttgctcaactgctcgtacagccattttccgtgctctttgtaccggaacatcacaaaggcgttttcgttcttctcacgggctaatttgagcgctaattttagaatccacgcgttgcgccgtgtgtggctggttacgtacttgatttccgtctggtagtccgcacccttcaattttttgacctcttcttctttgtatcgaaggaagatcgtgttaattttcaggttggtgacttgtccatcatccatcaaacgacgcgtatcaactggtttaaagactttgccgaacgcaccgatgtattgcatcatgttcgttttcccttctttcagggaaccggataagcccagtttgaagatacattgatccatcgtgtcgataatctttttgatgctcatgcctgttgagaggtggcattcatcaaccatcaaacacatgaactgttggaaccattcggcaggcattttaaccgctgattgccaggtagaaacgtaaatcagtgcattactgtttttcgctgtaccggaacggatacccagcattgccgatttcgggaacaaacgatagtttgcgatgtcctcgatcatttggtcaacaagtgcggtagtcggaacgatgatcaacactttcccgctgtaatgttccagacaccaacgagagataagcccctgaatcagagatttacctgctgatgttggcaggttcagaacaccgcgacggtttttgataccgtggaacactgattcgcgttgataccagtacgggtcgatctgtttgtcgccgtcataaaccggatgttcgctaacccacttatcaaaatcttcttgcgtgatatcctcagtttcgtggatctttggatcaacccagattgaatacccgcgtgattctgcgaatttggataccagataggctaacccatacgggagtttcccgttgtagtccatcaagtaaatgtaaccgttccatccaccatatttgtatttggcctgatactgatagcctgggggctggaagctgaaatagtcacgcagttcatagacaatgtttggttctgcctgaatctgtacgtggcttgtgtttaaaaatttgacttcaatatccactatgattaccctatgtacaaagtatatacgtatttatgtcataaatattggataaacacttggagataccaatgaacattgattacgaaaaagttgatgggttccgtaccctcgacgcaaaagaacagaaaggcgctttagccgattacgctatgactgtgtttgcggttaagctgaacaaacaaaaatccttcgataacatgctggcggatctggttgctgctttaccggaagatgaagaaaaaccggaactgctgatcgattcccctgaaccggaaatcgttgcatataaaggtgaggtgactatgggtgaacctgtcatcgaagccccgaacgttcccgatgtggttattgatgcttctgcggattttatggagtacgttaaagaggtcgcgccggaagtagccgatcaaatccaattagtacctgatgtcgtagaagctcctgtaagcgcttctgacgagtccaaaggcgaactggtatggttggaagggtttagcccgacaatcttcatgatggggcgctctgcgagttctaacgggtattatacctgtccgtggtggatctatgactggattaaacaaaccccagactggtacaaagatcctgatagctgtccacatgcaagcgcaatcgacacaatcaaatcacttgcgttctatatcgtgcgcgatggtgaagttcgtgttcgcgaaaccagaaatagccgattcgaaacatttaagttttagcactttttgctaaaaaacttgttgacgcataccctcgtttaaagtatatttgtactcgaaggcgggggaatggctctcgcagtgaagaaggaaagcaaaatgaaaaacgaaatgatgaaaaacgcttattacccagttctgtttgtttggtctgatggtaaagtgaagaaagtagtcaattcaaatgctccttactatactgttgaagaagcactgcgccacgcttacgaagctgattatcctgtccctgctgaacctggttatgctcgttggaacggttcaaaatgggttgctgatacctgggacaactacgaagaagcaaaaatggaatgcgatcctgattatgtttctcgccaaatggaagcgcacatgattgcagaccgtcgcctggataacgaagctcgcggtttctattaaaattcaaagggggcgtagcccccttttttgtaggtaaaatatgactgaattaaatcacgaatgcctgaaagacttatcagaaggtaaagagatcggaaacgtcatcttccttgatatcgacggcgttctaaataatatgcggtgcatgaaatttggtgagcatatggacattgaatgtgctcgacacctgcgccggatcgtaaatcatgcgaactgtgatattgtcatttcctctacatggaggatcggcaacacaacccatactctacgggaaatcttctacccgtggggattgtatcgcatcattgggaaaacctgtacgaatctaacagaccgacaagctggacgcggtgatgaaatcaaagcatggatcgacaccttcggatgtaagaattaccttatccttgatgacgataccgatatgctgccggaacagagtgaacatttcatcaataccgatgggttcgtagggctgacagaagaacaatccacttacgcgatccgtaatgtgttcggtgtaacaaacccgttctgtcctgaatgcaacggctatgggcgcgtgaaccaatatgataaatgtccgtcttgtgacggcaaaattttacttctctaaatagagaaaaactaagaggttttgaaaatggctacagaaaaatggactacggtacacccgatcccgtggcgtaacaccagctttacctatctgccgtggtggatctttgatatcatcgtggctgcgaatgctgcaagcgaagactggcgtgattatgccgaagaaaaatacgcgaaagaattcgacacactgaaacaggcgtatattgattacaccgatgttgatttcatcgaatcccgtaacggttatctgtataagctgagtgattttactcctgctgaacctgtcgtaacaattacaccgaaaaccgctcctgctgatttcaaagtaggtgatgcggatctggctgcaactgatctgtttaccatcgatccttctggtacagcaatgactctgagtgttgactcttccggtcatggttctatcgttggtggtaaacttcatgcggttagtgaaggtgatgttgtcgtaacagcaacctctggatctgttactgcaactctgacggtaaacgttaaagcacaaccagtaactattaccgtataaactaagaaggtaaacaatgctgctatttgaattcaatgatgtattcgcaaaattcagcgatgcgatcgaagccaaatttggcaaacgtcctcaaaacatgacagatgcagaatatgaagctgctgtatcgtccctggttcgtacagatttctatgaaaaactggcgatcgaggtgttgggttgggatatgatgaaatggggcatgacctatcgcgatcgcgaagtcggttttattctcgtcaacgaagcaaaaagcccgtcctgggtgaatagtcaaaaaatcgcgtacatggataaagtatgcgcacagatgggtattgtacgtttagacttctggacttgtcgggatctgaacgaactgaaagcccacgcttaccgttgtcctctgatctcccgcaatgataagcatcgtcaagcatgggatagcgcagggaaatatcgtagtgttttcctgaacgacgatatgaacatcactattcaggatgtgaaccgctcctttgcggattacacaccataaacaaaaaagggaaccgcaatggttccctttcttttatgcaatttttctgatttctttcaatgcttcttctttgctaccaacgaagagaatcgctttacctccggcttttctgaatggcaacacagcttttgccctgtcatcaatcagtatacctttgtccgcatatgctgctttctctccgctgcttttggtgtagtggaattcaggcagataaccgaacaccttcatcaacgcttttcttttttgttctgctaccgcatcggaattgtatttccctacgctggttaagatcgcaacctgacctaaagttctcaaatgacagaacaggtcgatgccctcttgtaatggttccagattttcgtagaagtcagtttgtgatatagcctgtttcgcttttttcaattcttcttccggcattctcgccgggtcaccgtacatcggaacaaaagaaccttcccagttgaacagtacaccatccatatcgaacaaaaactttttcatatcaattcctcggtttgtgtgtgcatcatattcatatatgttcctattgtcaaccccatgtatcagttttcggtgcgtatgctgcaactttcgccactaactctttatcaagctgatcaatggatttctgcggctttccttttgccttaactttgatgtagttagacttaacgacaaacataccgcctttgtcagatttcttgatttcgctgtcaatgcctactttgttgaagctgatccagatatcgccgtccatgtactgtttcagagagtcgcccatattcaggatcttcgccatagtgagcgctgccccttcgtgggtatccatgaggatttctttaggcactacacgatcgcgtttaaggttctgctgcatagcaatatgaacatcgttcataacccaaacgatatggatgttttctttctgataacccagcgcttcaacatcacgggcgatacttgccagcttgctcatgcttttcagggttacgtcaaagatcaggtttggtttacggtcttccggtgctgctgtgataccagcgtacacacgcgcctggtttttgttggatacgttgaacacgtctgcgatcacatgatgcagtgttgctacgttgtccgggtttttcaggttcattgttttgacatcgtgaccagttttcgctttgatctctgctgccagtttggtactacccatgaccaattttttgagtgcgtcaacgtccagggtgatcccttcgatacctaacagcttttcgagggtgaaccctttaccagaacccgcgccgccagccaggatgactacctgaccaaatttaggataagccttaccgccgaaggtgatcagcgcttcatcaaggctcgtaaagtctttgaatgatttcatcttagaactccaggtgtttatttaaaagtatttattgacacggtttatgagtgtgtttatagtgcaattgttcgacggataggccggaagaactttaaccataaggtaacaattatgaaaaatgaactgcatgaattcatcaacgccgctgctcttggcgaccagtcaaaatataaatcccgtcgcgataccctgattgacgatttctgtaatctcttggggttcaagcgctggcataccccgtctatgcgtccagattgtgatccaaaatgggattacttcaaatggagtgatcgcgatcgtggttacgtcgataacgtccgcgtaatgtctttcaaccacttatacgcaaattcaacaattgctgttgctaaacgcaacgattcgacttatccgaacgggtggagtgttgctaaagtcatagaaacacttcttcaactgcgtcgcgaatataaatcagcataccgtgtcaatcccaatcctatctataatgaatggcaaatcgtcgcgaaatacctgctgaacatcacctattctattttctgtcgcttcgggacaaaagagattggatttggctctcatgatataattgcagaagcacgtcaccgcatgatccatgcaatcctgaaaattcaaaactctggtgggcttgttcttgctgcgttctgtgatgaaattgtttactacggagaacaggtcgaagttgatgatgttcatcacgaaaaattcaaaagatttgtattcgggcaatataacagctattcatatggaaacgatattcgtgtgatgaggcacccgcgcattatgttggatatggaagggtgggaaccaggtcacggaattggtgatgccgaaagccaacgtgaacgccgtgttcgttcagttgctaaaactcgcgaattgatgacaggtagccttactgattacctgttcagaacaaaagaagacgttgaaaaagaatttgttgacttgtctggagaatagcgataagctgtaatctctgaaaacaaggagataaccatgaataccattaactgccgcaaagagttcgttgagttctatcacggatcatgtactgctgccggaatcgaaagcatgttgttgcctccttgtgattctgatactctgtctgaaaaaggcagaaagaaaaatctggatcgtgttttcttcactgctgatatcgggctggctcgtatctatgctggaagggctgcacgttcaataggtggtgatccggtactgtatcgggttgtgtgtccggtagatgtggtatgcatgaacgatgacaaaggcgcaagcgtttatcatgctgcatgggctttctgtgaggaattatgaaagataaggtgttagcgtatctcgttttcttgctgggatatcgcgttgaagtgatgggtggttattcttctttgtatggggatttaaccgcgatctggatggttgcgttgggggttatgtttacctttatggcgatctgtattgcgaatgaggctgatcaaaatgcttgaattttatcctgctggttgcaagtcaaatccgcctgatgcatcgttccaatcctggatttattttcacagggaactaaacgacatcatcgaaagtcagtggaaagaccatcctgaacgaagtgcccccgatttagtcgatagcgtaacagatgtacgcaccctggaaaaagggctgtatgattgtctggttcagggaatgatgtgtaaattgattttgtggtatgctccgatcggttcagatctaactcgcaaaatcgcccgtggttatatcatgacgaaacgtgagtttgaccagatctggaacgaacccgactgtttcgaacgcgaaaaatacgaaaatgaggttagttgtatatgaaactatttcatgttgtgtatggtggaatgaaaaacatcgacatcgccgcgttatctgctgggatgctggacgaactcgaagcacagatcgggaaacgattcaaagccagtatcaccgaaacgcaaactttgtttgtcgatcaccctgcggatatggaaaaccttgtcaacactctggatgatctgatgatcccgtgtgctgatggttggaacgaagcatccggtgttaatgtagttgtaacttttgttcttaaaaatgttgacagcagaaatgccgaagtgttagagtttattcgtaaaattgattctactaaaggaaagtaactatgaaaatcgttcagcgtaatatcagcgaagttagccagcaggaaaaagtacagattcatttcaaattcaatgatctgaaactgggctatgcacagatcgcccgtgagcacatgctcgataacggcgacatttacgtgattgttcaggaaattgagcgaattcgtgctttccgcgcagaaaatccaaaagtgaaacatgctctgcgccgtgtgtacattaataaacatcgtgaagaacagcgtaagcctaagaccaaagctaaacgcgatccgcgtccagataacaaacgtaaagcaatcaacggcgctatggcgctggcattccaggaagcgggtttagcgtaagaggtttacatgaattcttcaatgatgaatcgctggtcgggcgtgataacttcgactatcaaaaaggatttggtgaaggttgaagcaaaaccaaagccagtagaaccggaatcactcgatcctgctgagttggaacaccgccgccgtgcaaagcaaattgaattcgatctgcgtgtcgctcgttcatacaacagtaaaaacgatgatgcgcgtaaccgcaaccttcaatttgctctgacgttaagcgactgggcgaagctaatgagtgaaccagtatgttcttactccggcagaccatttagcaacaaaggcggttgctctgactcccgaacaatggaacgaatcaacgcttctctgggatacacggttgaaaacacgatcgcagtaaccagcgccgcgaatagcgagaaatcaaatctcgatgcgtttatgaagggttctgtgatccttccagaagtaaaactgaaactgttacgcaaagctgcgtatcaaattgaaaaacaactgaaaatcaaaggttaaattatgtttgtgaaatattcttctctgactaaccattatgaaggtaaattcatcaatggtgtgatcatgaatggttttactggttgtgtgtgggttgcgcgtgaaaagatccacggggctaattttagcctgatcacttcggacggtatcaaagtcattccggcaaaacgtagcggtgaaattctccctgctgaacagttttacggttgtgaaccagtagttgcaaaatactctgaacctgttcgtaagctgtgggaaattctagcaaatacctgtgaatataaggaatatgctgatactggttctttggttgttcaggtatacggcgaatttgcggggcgtggtgttcagaaagatgttgactacggcgaaaaagatttctacgtatttgatatccgcgttaatggtcaattcctccctgataacgttgttgcaaattacgctgttgctgttggcctgaaaatggctccactgctggcatacggtacgtttgacgagatccgcgcattgcctatcacctttgattcggtggttaacctggcgaactccggtgcgatccctgcaaagaacggtgttgaacctgagttcaaaaacttcatgatgttgaaagatgatgaaggtgagaacatcgcagaaggtttcgtgatgaagcctgttcaacccgctttcatgccgaacggtgaacgtgttgcaatcaaatgcaaaacgacgaagttcaccgagaagaagaacaagcaagcgaaccgcttcaatgctccttctgaactgtcagaaacagacaaagtgaagctgaacgaattcacctgcttcctgactgaaaaccgtgtgaaaaacgtcctgtcaaaaattgacagcgcgaatatcaccgcgaaagatttcggtcgcgtgatggggctgacggtacaggatgcgctggaagaaatcgaacgtaactacggacctttcctggaacagttcgaaaatccaacgctggcgaagaaaaccttcactaacgaagcgtcaaatctggttcgtgagaactggggcgcaatcctgaacaatgaattttaaatctgttctcgaaaacgcaaaaacggctaccctgatcggtagccgtgaaccccctgaacgtatcgcgagtatagccataaagattggacgtgctttaagtgatcgggggatcttcgcttactctggtggtgctcctggaatggatagccatttcatgtttgactactcaccagaaagacggcgtataatcctccctgagaacggttttaacgggttgtattcgaatggtaaggatatcatcgactatacagaatacgacacgtacaaagccgctgacgaagcgagaaaggtagctggacacttcgacaaccaaaacgaatgggtacagcgccgatatgctcgcaattcaatgcaggtattaaccgaaaacctggacaaacctacagattttgttctattctgggcggtagagaaagatttttgtgttaaaggtggtactgcgatcgctgcaaggcttgccagattgtataaggttccaacgttcaatctttggaatcaaaacgttctggatgaagtctgcgatactttagggattaacactaaacctcctactctggattttctctggtgataactcccgaacaatcacgtaattacgaacgcctctcagttgaagaggcattaaaaaaggcgaaacataatggtagaaatcaatggaatcggtgtgaacgcacaggcgggaagcgggacacagtgggtcaaacgcgaaacgcaagatgatccccgctgtggacgtagcccgacactggcggaacgtgcgcgtaaacttgttgacgaaatcaacgcgaaaatggtcgaagcatcccgcaaagacatttccgagtatgtcctgaaatatccgactaaacaatcatatacctttgatatgaaacgttttatcggtaaggttatggatcaggaatgtaccgaaaaagcatatgcggatctgggtgaatggctggcggaagaagggtttactttcgatacacagcgcaaccgacaagctgcgttactcaataccttcgcgggttcgcgtcgtattaccaactttagcgatcctaagcgtgacggatatagcgatctgacttattacatcacctggtgaaaataattcgaaaaacttgttgacgggagttatgagtgtggtaatatagctcccgtagacaagacactaacctaaaaggaaaacatcatggaaatcaaattagtacctacttgcgctggctactgcttggcactgaatggtgtagcacacaacggtaaaggcttacgggctaacgttgaagcaatgctgaacgaactgggtgcggtttatgaatatgatgacgttgcaaccagcgttaaaatcataagccttgaaaaagatggtgttaactgtgcgggttggtgggattgctacatcgactatagcgacaaccgggtcttcttactgaccagcaactaaggatcgactatgtttggaatgaatgagtgttcagaagcggacgcgctagaagactgggctgactttgatgaccttgatctcgatgatgaagatggagaattcttctgtgttgggcgcggggttgaaagaacgaagcgtgaacttcgaagccgtttagcaatggggcttactgttggatctggaaagaaacagcaagttaaatattccgatggttctattcgaactgaaacggttgtcaaagaagtaaacgggcgtgtcattacgtccgagcggcagaaggacatcaaacaattgtacgatgttgcaaaagccgctaaagtaggaaccatgatcacttgtcctacgtgcaaacagttgcacaagaagacgacatatcataaggtgttctgctctaatggtaaaaaatccaggaaagactgtaagagtaaatactggaacacgatccatccagaacgtttggatcgtatcttttaaatcaaaacgtggagtacgtttaaatgaaaacttttaatgaactgaatagcctgatcacctcaactgattcctacaaagtgtcccactggttgcagtatccacaaggcactgatgcggcgatgttctatattgaatctcgcggtggtaagtttgatgaagtagtaaccgctggcgttaacttcgttgcgcgggttcttgccgaaccaattaccatgaaacaagttgagttggcacgggtactttaccgtaagcactttgggaaagagattttcaactacgaagggtggaagaagatcgcagaactgggttatgtccctgttactttccgtgcgatcccagaaggtacggttgttccggttaaaaatgccgttgcgactgtgtacgccgaacgtgaattctcatggttggctgggtggctggagacaatgacgattcgcggtatctggtatccgtcatctgtagcaacgctatcgcgtgagtgtaaaaaggttctggctcattaccttgatatgacttctgacctgactggtgaagcatataacatcacactgggtacacgtctgcatgatttcggggcgcgtggcgcgacctctgctgaatctgcgggtattggtgggctggcacacctctataacttcatcgggactgataccgttgaaggtatgattatggcaatcagtctgtttgcggactatcaaactctgtttgatgaagttgaaaacgtcgaagcaatcggtgtttcaattccggctcgcgaacattcgactacgatttcctacggtaaagagaacgaagacgaagcatataaaaacagcatcgaaatgttcggggatagtttctacgcttgtgtgtacgattcctgggactacaaaggcgctgtagatcgcattgctgaatataaagagcaaatcattgctgcgggtggtactctggttgttcgtcctgattccggtgatatgattgataacatcatgtacaccctgcgtaaactgggcgaaatcttcggatacaccgtaaacagcaaaggttacaaagttctgcataattcagttcgaatcatccagggcgacgagatccacgggcctgaaacaatcaaccgtgtgttaagttggatggaagcgaacaagtgggcgagtgagaacatcgcgttcggtatgggcggcggtttgctgcaagaagttacccgcgacactcaaaagtatgctgaaaaactgtgcgctatccgcgtgaatggtgtgtggaaaggcgtttacaaatgcccgaaaggttccgaatggaaacagagtaagaaaggtttgctgatgaccatcactaacggtgtggaattcaaaacaatcgacactctggaaactgagattcctgacgggtggcgtgatgcgatgattacgtattacgagaacggtgtattaaacacctccgatacagtaggggttatccgtgagcgagcaaggatttaatatccgcgccaacgataacggatcagtagtcttctacaacaatcagccccttgtcgctcgcaaggggcttttttgtaagttggtgggctacgggttcaagttggaacaggtggacaacgcgacactaaaagaggttgttcggattgcttatctgttgaaagataaaaaagatgaacaccgtgctattgcaatgcttgagaaattaggcgaaaatcattgcttcgtggtgaatcgtgggtataagtacgaaacgatcgccttatttgagaaaggacttggtgaattatgattaccacaatcaaagaaggggttgacctccatttaggcgactccgtaaagctgattaaacagcttgaatctggttctgttgacttgaccataacttcgcctccgtatgacaacttgcgccattataacggctctggtgatgtctggggtgaacacgtatggaaagagttgatatcggaactgtaccgcgttaccgctcccggtggtgtggttgtgtgggttgtgggtgacgcgactatcaacggtagtgaaacgggtacatctttccgtcaagccttgtacgcgatcgaacaaggttttcggttgcatgatacgatgatctatcacaaaaccgctctaccgaagaaccataaccgatacgaacaggactttgaatacatgttcgtgtggacaaaaggcgcaccaaaaacattcaacccgatccgcattccgtgtaagttccctgaaaaggaaaccgcacgacaaaacagctacttttccgaaaccaacgaaaagaaccgttcagcacgttccggtaagaaacgtaaacctgttggcaaggataaaattaagggtaatatctggtattacgctgtagggcgcaatcactcaacgaaggacgagattgcattcaaacacccagcaatatttcctgaacaactggcagaagatcacattaaaacgtggacggttgaaggggacttggttcttgatatattctctggttctggtacagtgatgaaaatgtcgatactaaccaacagacggttcaaaggcttcgaactgatggagaattattatcacgattctattcttcgtgttcagccatacgttaacaatctggaatcttttctatgagttatttgggtgttatcccctatacaggcaacaagcagtctctattacctgaactcttcaagttgttccccgaaagaagttcatacatgcgtttcattgattgtttttgcggtggccttagtgtgtcgttaaacgtccctaaacccgttctaagcaacgattacgataagacgcttattgatatgtatgagcgtcttaaaacgcttcctgacctgtctcctgtgcgagaattgattgcatcgaagggactggggaaagacaagaaagaagagtatctgaaattccgtgatgaatacaaccagaacaaagatccgttatggctctatgtcctgatcctgcattcattcagcaacgttaaccggacaaacgacaaaggcgacttcaacgctaatttcggatgccggacgctcaacgatgcaacagtaaaacgctttgaacatttcaaaaagaatgtgaaaggcattgagttttccagtggttcattccgtgacattgatatctgtgaaaatgatttcgtgtattgtgatccgccttacctgatcaccgatgcagtgtataacaagttctggaacgaagatcgcgaacgtgagttatatgctttcctggatgaactgcacagcgaaggaatcatgttcgggctgtccaatgtgactcaccacgccggaaaacaaaatgatatcctgattgaatggatgcagaaataccgcgttcataatctggataaaaagtatctgttaggccagcataccgactcttacgagcaaaacaaaacgcaagaagtctacgtgtgcaactaccagaaacgcgacgtaaatacattccctttaacactgaacgatttaatgtaggttaacatgtttaaaatttatggctatatcccttctgtgtataactgcgctccgtgcctgaactcaaagcgcttgctggacgcgaaaaaacatccgtatgagttcgtgtctgttgcggattccgtggaagacggtaaacctgtactgaacgaagcggtgatcgatgaactcgaagcgcttgttggtacgcgccggatgaccatgcctcagattttccatgacgggaaacacgtaggcgggttcgaccaacttcgtgagtacgtccgcaccctgtaataaataatgacaccttactgaatggtgttattatgctgacgaaacgaattaccaaaaaagactacccaactatcaagcaagctctctttaccgaacaagggggctgttgtgctatctgcaaacgtcccctggagggcgagatcgagaaacatcaccttgaccatgaccatgcgttagacggcgaaaacgccggacgtgtgcgcggcctactgtgtaacctatgcaacggtacagaaggtattgtgaagcacaaattcaacagatccggtctggtgtcccgtgatgtcgattacatccagtggttagagaacttgcttgcatatctgaaacaagactattccgaaaaccgtattcatgacaaattcataccagataaggtaaaatggttttcaagacttaccaaacctgatatgattgccgaaatggtttctatgggcttcgagtacgccgacaaagacgaacgcaaagccttaaccgcgaaatatagaaagcaattaatgaaggcaacgaaatgaaagtagaaaaacgcgacggtaaaaacgtcgatttcgataaagaaaaaatccgtattgctgtagaaaaagctggcggtactatgacggatgctgatgccgcaatcatgctggttcagtacaatcagatccgcgatggtagcgcaatgaagatcgcccgtatccaggaactcgttgaagaatccctgatgaaaacgaacccagcggtcgcccgtgcatacatcgaatatcgccacgatcgcgatattgcccgtgaacagaaaagtaagctgttcaaagatatctccggcatggtgaatctgtccaacaaagagatcaccaacgagaacgcgaacaaagacgcaagggtattcccgacacagcgcgatctgctggctggtatcgtagcgaaacacttcgcacgtaaccacattctgccaaaacacattgtagaagcgcatgattctggtgatatccattatcatgatctggattacagcccgttcacgccatacacaaactgctgtctggtggatttgaaaggtatgctggctaatggcttcaagatgggtaacgcagacatcgaacccccgaaatcaatcggtgttgcgactgctcttatggcacagatcaccgcacagattgcctctcaccagtacggcgggacaacctttgctaacgttgataaagtgctggctccatatgttcaaatgacatatgataagcactttaaagatgccaaaaagtatcaaatccctcgtgatgttcagtatgcaatagataaaactgaaaaggatgttttcgacgcgtttcagtcatatgaatacgaagtaaacaccctgcatactgcgaacggtcaaaccccgtttgttacaattacgttcggtactggtcaatcccgatgtgaacgcatgatccagaaagcgattctgaaaaaccgtattcgcggcctgggtaaagagggtatcactccggtattcccgaaactggttatgttcatggaaaaaggaatcaaccttgatccagaggatcgcaactatgacatcaaacaacttgccctggaatgtgcttctaaacgcatgtacccagatatcattagttcagctaacaaccgtgctattactggttctagcgttcctgtatctcctatgggttgtcgcagtttccttagcgtgtggcatgatgataacggtaatgaaattcttgatggacgtaataacctgggtgtggtgacaatcaacctcccgcgtattgctcttgaagcacaggaagcagacgacgcacacgaggctttttggcgtattcttgatgatcgtctgggtttgtgctttgaagccctgatgactcgaattgatagtctacgtggtgttaaagccagcgttgcgcctatcctgtacacagaaggtgcatttggtgtccgtctgaatcctgatgatgaaattctggaactgttcaaaaatgggcgtagttctatcagtctgggttatattggactgcacgaaacgctgttgatgtttggctcaggccagcatccattcgatcgtatcggctcccagaaattaggtcgattgatcattgaatatctccgcgctgcaaccgaagcatggaagaagaaaactggttttggattcagtctgtattcaaccccagcggaatcgctctgccatcgcttctgtaagctggactttgagaagttcggaagcgtcaaggggatcacggataaaggctggtacacaaacagtttccaccttgacgttgatcgcaaggtgacgccgttcgagaaaatcgactatgaagccgattatcattacatcgctactgctggtcatatcagttacgttgaatttcctgatatgaaaaacaatctgcaagccctggaaaaagtctgggattatgcgatggataaactggattacttcggaactaaccttccggtcgataagtgctttgtatgtggctctgatgacgagttcacgcctacagaagaaggtttccactgtaagcactgcggtaatcacgatccggctaaaatgaatgtaactcgtcgtacttgcggatatctgggcgctgctgaacgtccgatgaacaaaggtaaacaaaacgaaatcattcaccgtgtgaaacataactaagaacacctagtattagcgccttcaataaataaagaaaaattgagggcgctaatatgttttacacaatctacaaaataaccaacactatcaatgggcgtgaatatatcggcgctcataaaactgataatctcgatgatcgatacatgggttctggaaagaacatcaaacatgctattgatttctatggcattgaatctttcgtaaaggaaatattgtatgtttttgatacggaagaggaaatgtatctaaaagaagctgaactcgtaacagacgagtatatttcgcttcctcacacatacaacatcaaacccggtggtaaaggcggaacggcctacgaacaaagcgaagaacatcgacgcaaaaacagtaatgcgctaaaaggaagagaaatcactccattacatcgcgatcggatctcccgtgcattgaaaaatcatgtccgtagtgaagaacatcaacggaaactgagtgaagcatcaaagattgctgttagtacacccgaacataaagaaaagatgtctgctcattttacagaactgtataaatctcgtcctgaattgaaacagcaaatatcatcttctgtcaaagcacattatgctaatgaaacagaagaagagaaaaatcaacgtcgattgcgtcatacagggaaggttcggtcggaagaaaccaaacaaaaactatccattgctcataaaggaaaacatacaggagagaaaaatcctatgttcggcaaacctgcatcgaatcgccgtatggtttctggtgatggtgttgtgtatggttccgtcaaagaagctgcggaaacactggggttgtcgcaaggaacaatcgttgctcgatgcaaatcacagaaaaatgtaaattggttctatgtaggtgttgacttgccgaatcaaatcgattagtattttctacatcgaagcaaatcaatttgaaatcaaataaggtaaaattatgttcaagaaaatcgtagcattcgtgactggtaaagttgaaactgcaattgaacaaaacacttccccagaagaagcctggcgcagtgctgcacgtatcctgatcaaagagatcgaccgtctgcaacatactcgtgtttctgctgttcaggaaatcgtgaagttgaaaaagaaagtcaaagaacacaaagaccttcacactggcaaagagtcggagatcaaaaaacttctggcggcagggcaggaagtgtccaacagtcattacgtgctggcgctgcaacaccgtaacatctggcagggcttgcagacgaagatcgaagaactggaagggatgaacaaagagattgatctctctgtcgtcgaactggatcgcaaactggctgatgtcaaaatcaacctggagatcatcgaactgaacaagcaaaccgaaagtctgggtctgactgtaccggaagacgtgatcgccgctgtaggccacacctccgtaagcgtcgataccatcgtgacgaagattgatgtgttgctgggtggcaaaaatgccgcttccgtaacctccgctgacgttagcgcttacatcgactccctgaacgcgaaataagaggaaggggcgaaagccccttttttgctatgtatgattacactattgaacgtgatcgcggtgaagaatggttgatttctcgtaagagaaatttctatgttaaacttcctaaaaactttcatacgttaccgaatgatgatactgaccgcttattgaggattcttgtagatgggaatgttccacagcgcgtttttcaggaaatggttgatcatgcgtgttctgaatgggataaaaagtattgcgaagaactgacgcatgatagtatagtaaacagcaacctaaaagacgcttacgaacgaagaagtgtgtacgacatttacgaaaaagagaggaaaagtgaaatgatgttcgaagacggcaacagtgcattcaaaccagcacgtaaaacgtatccagactggcgcaaacagtacgcagaacagctatggcatattgacattcccgaagcgcttatgaaagcgattagccctgctgttgactactattcaggctggaaagatgaatatgagttagaagtcggatcttttaaggcgcacgtcattaaagcgaccagaatccttgatttcgttgaagcggttgcgtcgtgtgacatcgttgaagatattcgtattccatcaatcaacgtttcgcggtatagttctcctggtaacattcgcggggatcgttatgcgaacctggcaagcactacggataagctaaacttccacaaaatcaatgaaaaaggatttgatggttgtgttctgatctcaatggtggttgtcacaacacaaggcgaatacaagctgatcattgattgcgacaaagcaaaccgcgcagtacccacaatcaaacaatgttttggtgaagatttcaaagcattgatgaaagcccgtgcgatggaaaagttcatccattcgtgcaaaaagaacgtgctggagaagtatgatccggcgctcacatacaccaaaattgataaagatctggtaggtgatttatgctgattaacaaagcgcagtgtaaagcgataaactttcttctgcacgaactgattgaaaacggtatcagatttgaattcgttgatccgattaacggtgatgatcgtcatctgctccgctgggtgtctggtagcaatccgctggattcagtatcccaggttgtagagtctgcgcataacaatatgccttgtcgtgttctgttgggtagcgttaacgcctccacatggaatggatctgatgcttattatgtcggattcaaaaaagagttgacggacgacgaatgatgttataatatgcccctgtagacaacaaactataggggctaaatcatgaaaatcaaaaatactgctactgaaaatctttgtaacgaaatcgcggtgacttactggaaagaaggtcacgtaaaagcaatgaaggattttcaacagtggtgtgatacccagaagttagccaactgggaatacgccgtaatcgtggaacggatcaaagaactgatccttgagaagaaaggtactaaataaccatgtaaatcaacatggaatacttctcatgaactatcacagaatatacaattctctcatatcaaaatataggggagagttgcctttatcatttcgccatacaaaaactggctatgaaatacaccacatatacccaaaatctatgggtggttctaatgaaccagacaacttgatttatctcaccccaaagcaacactatacagcacatcatcttttatctaaaatgtatggcggtgcgatgcacaacgcattctggatcatgtcttgctccggcactgttccgatcacatccagacagtaccaaacggcaaaggataataaaatcaaacatcaaataggaaagaaacattctccagaaactatagagaagctcaaaaaatccaggcgaggaaggacatattccgaagaatcccgaaagaaaatgagtgaatctcagaaaggaaaaactcgtagtgaagaaaccaaagaaaaaacacggaatagttgtcttcgttcgatgtctggtagggtgaaagtagttataggaaccagtattgaatcaccggacgttacaataactctgcgcgggaaaactgatataaagaacaacggattcaatcaaggaaaggttcattcttgttgccgtggtgagataaaaagtcataaaggatatacatggagatttaaatgaattatattagaatttacaatatggatctggtaaacggtaaaggagtccgggttgttatgttcgttgcaggttgtaaccacaaatgcgatgggtgttataaccgtagttcgtggaatccccgcaacggtacaccatacaccgaagagactgaaaacgagttgattaaactcctttcaaatccccatgtggacgggttgacgcttacaggcggcgatccgttttaccgcaccaatcatccaacgctcttaaaactgcttgagcgcgtccgtgcgacgtttcctgataaagacgtgtgggtttggacgggatacaccctcgaagccttacagggcgatacagaacgctctaagctgttaccattcattgatgttctgatcgatggacggtacgaaaaggatcaaccgactaagaaaccgtttcgcggttcggataatcagcgaatgattgagttcaaaaagaattccatcgaaattaaaaatatcgcttgacctggttggtagttctgttaagatatccacatcgaaacaaacttgaggacgagaaaatgaaaaacgcaatcatcaaagaaatctgtgaactggttgatgtgtatggttggagtttaggcgctgcaaaagcagaagccaaatctcgtctgcaagttgtaatcaaagcccgtagcaaagatgaatttgttactaaattgcaagccctctatgagagataatatcatgattctgaatttcaaaacccgtaaagaagcccgcgactattgctggaagtggtcgatcccgctgaaaaacatcaccaaaggaagcggttcacatccgtggacggtgagaaccaaagaaacccgcttcgaaactggtaaagattacaagctggttgatgtcgaaggtttcactgacaacggcaaaaacattgcgaacagtgttcaatcaaaacagatccaccaattactgaacggtgttgtaaacatcgcaagccgtaacggtgatcgctataccttcaatgctccagcaggtgtcgctatgaacacccttcgtgcgtgggaagcgaaatacttcacagaagttgctccggctaaagccccagcgccaaaacgcgctaaaaagccaaaaccagtaggcaaaccgtctgttgctcctgcaccagctaaaccggatctggattctgaactggatggtggcgttaacctcgctccaacaacagaaccagttgcgaaacctgctgcaccacagccagcgcttgtagaagcgatgcctggttgttttgttgccgaccgtccgtatgttctggtagatgaaccaggtttcctgcgctctcacactgcgaacaaacgcattgtgcaacacatcaaaaacaacaacggtgttctggtgttttcgaatgttgacggcgacggtgacgcgacaatcacgcaagatcgtagcctcccgtttgtgatgcaccgtgagcgtaaattcttccgtgaactgggtactggtaatccggcaaacactccagcagttcaggcggttgatatttccaaacagcaacacgatcaactggtcatcgctgctgcacaggcagtagaagacgcactggcagaacaccagaaagcgatcgaagttgtagcgcagaaagctcgcgcagttcgcgaagccgccgcaaaacttgcactgctggcaaataagtaatataattcgggggtgcttacggcatcccctttttatttgaggtaatcatggaattattcgctggaaaaacttacggtttaaccgtatcccctgaaatctttgcagagaaaacctggaaaacaggtatcgcaaacatcattcgtgaaaaaggttacgtgacgattgatcgcacctcgatcggtgagttcgaagaccgcgcgtttatcatggacggtggttacgaatatgaactccctgcatcactatggaaatggttcaaggaagtaacgccggaagagggtgaattcaccccagaagaacccgaagaggttaatctcggtaacggggtcgagactgaaaatggtatgcgtatcgcaacgccggaagaggtttccgctggtgtcactggttcggatctgtgcctgatggatatccctaaattcacgtatcgccctgtacaggaaaatcctttgcgtgatctccgcatcgatccatcatttggggctaacctggaaacgttgagcatcgcaccgatgccagtacgtaaatctgatgcaatgcttcgtttcgccttgcaacatgttttcagtggtggtagcatctatcaaatcaacatggaatctgaactgaaaatgcaggaagaccagattgcaaacctgttcgatctgcacactcagttaaccgctgttgagaatatcgaaaaactgttaggcaaagagaaaaagcgtattttgcaggatctcaaaccatacggaaagaagaatgaaagtcgaaatctacggaattcccgaaagtcttcataactgttacgggtgtatacaagcacaaaagctgttgacagaaaaagggatagaatatacattttatcccgttctgaaagaagcgaaaaacgatctgggctttgaatacgatcgcccacgtatcgaagagttagcaaaacgggtaaggcaacgtagtttagcgtttcaatacccgcgtatttttgtcgataacaaacttatcggcggttatctgcaattgaaacaacttattggtgattaaatgagccgtgaaattttactccctgctgcaaatgctgttcatgctgaaacaatggaatacatggagaaattcgttgaacgcgataacaccgcgatcatcactcctactcacctggacgcgctcgaagatcgtcttcataagcagattaaagatcaattccctgaaaaggttagccgcaacttcattcgtcaggaaatcgttgcaatgatactgaaacattacggcgttgaaatcttcggtgtcgaaccactgaaaccgaagaaagcacgtcaaatgcctaaacagatcaccgacgaagcaatcaagaaataccagaagaaatacgctaagaataaatgatctttaatacgattgaatgtgttccgtcaagtggtaaaacaaaggcgattctgaaccatatcaatcaaacgggcgaaaaagcaatcatcgcatcgatttccatgatgttatcaaaacagtcttatgactactacatcaatcaggtaaaagggaaacgagcggtgattgtggacacggatcaccgaaccaaaagaaccaacaatgactcgctgcgtgaggttgtcaaagattatgatgtgatctttatcactcatgcagcactcaaaaacattgatgactttgatttgtataaggatttttccctgtacattgacgaagttcctgatttggttgcgttcgaaagtctgcgatttaatagcaatatcaagcacatacgcgagatttgcttgccgtttagttgcaatgccgatgatatcgttgatttaaaacttgacgaagaaaaacgagaactggttacacgattagcctatgatggtcttcgtaaacgtgatgatatcgcaatgaagatgttcccgctttaccgtgctctgttaggggctattccggtgaagatgcaatgtagcgattcgggatatgtctgttacttcgtagaggatcatgacgtaagccagtggaagttcaaaaatgtaaccattgcttcatccaacatcaaagacacaattacagggaagatcctacaaacgtttcatgatgtggagttcaaagattcaccgcttcaaaagctggttgactttaagcaatacaaaaacactgggcgcatacatatacatgtgctcgcagagggggattattcgcgttatactggcgatctctctcaatctgggacgacagtatacacccagattaaaaaacgcgtggaggcgcttttagggggcgaacagttcatctattgcactaacacatatagatcgaagtttagcgaggggcaggaaatcccgtataactcgcacggattgaacttctattcaagttatactaacgtggtggcattattcagttacaacccgttaccctggcttcgtcaaatgttgcgagcggttgcggtgtcctctggacttgaagaggaagaattagttgatgcttatgttgtcagtaaatattacgaaccagcctttcaattgtgcgctcgttctgatatcagacacaacaacagcaaacgaaagattaatttatttgtgcctgatatgcggttagcgaaatacatgaaggaaaaatattttcccgatgccattatcgaaaccacagaagcagttcaaacgaaaaggcaacgcaaatcatttcaaacccttttccaaatgacggacaaagagaaaaacgcttttacgccatacaagaaaagaaacaaattagattatgcgaatcctcttcatcacgcgattgttaaagattggctgaacaattaccgtgagaaaaaggcgacttgagggtcgccttttttgtttataaatatcagtattgaataagataaaggaaaacgataatggtagctaaatcattccgcgccacaagtggccttgatgctgctggcgaaaaagttatcaacgttggtaaagcatcacgctctgtgttgagcgacggcgtgaacgttgacttttttaacgaatttaacacgatccaacaatacgattctacccgtggttatgctgcgtttatggctatcatgtacgcgcgtcgtatttggtacgctcgcgcagatattccatcaccagcgggtgctttcgatgaaacaaaatggatctcaacccgtaacgatccaaaatgggtatataacaacgtaacgagcactgacggtctccctcttgaatccggtacgtacttaatggctgatggtcgtttctctgaactgacctatattctgccagatgcccctgttgagggtgatattatcaccattaaagacggtggcggtcttgcaggggttaacaacctgttagtacgttcaaacacccgtcagatccgtttacgtgatattcagtcaagctcttatcgactgactcacccatatataaccgttgcgtttatttttaacggcaacttatggcgtgttgctgaaatgcgtgataaccgtgattcgcagtttgttaatgcgactggtttaaccgctttccaaatgcaagcgggtatggtaacattccgtaacagtggaacgggtaaaattacgttgcagttgcctcgctacgcaaacgatggtgactcaatcacaacttacgatctggatcgccttgcttcggtgaacgttgcgactctgcaagtttatcctggtagcggacacacgatcagttatgacggtatcaataacgtaccctctgtgacttcacagcgttccggttatggtattttcatgttcgatcaggctaataaccgttgggttgtttatgacggtgatcagcgcgttcgtctgcgtcgtatcagtgatgacctgaacatgttgccgaacgattacgtgttcattactcctgttgctggtagtcctccaactgtgcgtaacgttacgctgactcttccgcaagatgttgctgaaggtgatcgcgtgtatatcagtatgtacatgatggggaaaacgcagaactgcacgatcaaagttaaagatggttccggtgaaaagatccgcaccaacaaaaacatgatgcagttcccacagcgtaaggattatccgcctaatgattggttcagtgttgacactctgactttcaatgccgatactgactatcttccatacatggaattgtcgtatctgaaagctacgaaagaatgggtagttgcacagtatcgcccgatcattgaacgtgtcgatccaacaaaccgttctcgtctgggtgtgattgcgctggctacacaggcagaagtaaacaagaaccatgaagatacgccgtctgatgaactggcagtaaccccgcgtacactggcgaataaaaccgctactgaaacgcgtcgtggtatcgctcgcctggcaacaactgcggaagttaaccagaacacgacagcaaccttccttgatgacgtgattgtgacgcctaaaaagctgaacgaacgatcagcaacagaagatcgtcgtggggtgctggaaatcgcaactcaggcagaaacaaacgctggtactgatgacactaccgcaatcacgcctaaaaagctcgacacacgccgcgcgaccgaaaccctagcaggtatcgggaaactcgttacaacgggcgctacgacagcggagggggctttacgtggggatgctggtacgaacgtctacaacttcaataacggtgttgatctgatcaccccgaaatcattgaacgagaagacggcgaccgaaaagtcaaaaggtctggttgttctggcgactgaaaacgaagtggtaactggtgctgctgcgggatctgcttcaatgccgatcgtagtaactcctgaaatgctgcatcgtaaaacgtctactgaaacgcgtatcggattgattgagatcgcaacccagacagaaacaaacacgggaactgatgatctccgtgctgtaacgcctaagaagctgaacgatcgtaaagcgactgaatcacttgatggtattattgccctcgctaccactgcggaagttgcagcaggtacggtaacgaataaggcggttgttccggttaagctgaaagagttcttcgacgttacaagtcatgttgcggttgctaccgatgacggtttaactcagtccggcactatctggacaacgattaacctggggattgcgtctgctactgaaacacagcgcggtactttacgtgttgcgactcagggtgaaactgatgcgggtcttctggataccgtgttcattacgcctaagaaactgcaagcgaagaaagcgacggataccgccgaaggtattattcgttgtgcgactaacgcggaagcgggtgcgggtactgctactaacctggcaattactccggctaccatgcagttcttgaacggtactgatccggcgtggggtgcgacgacaactcgacgcggtgcggtgtttatcactacccaatcaaacactttcatcggtgataatctggttggttctactcaggccgttgacgattatctcgaagatttctatgctgtatcgcctcgcggtctgaactttgctctgcaaaacttcttaccgaaaatggcaacggcacagaatagtttgagtctgggcggtgtggttgctgcaagctggatgcgtcgtgatgcaaaccagacggtaactggaaataacacgtttaacggtacaagcaacttcgttggtaacgtaaccactaacggaacactgacggctaacgctgcggtaacggttaacaacactgtaaccacgaacaataacattaatcagtctgcgaaagcaaacactgtttatgcaaatactgttctgagtggtgaggctgcgggaaccaaaaacttgcttcgtaccttccgtggtggtgtggcggatacgatctggcatgaaactgttcaggcaagcacgtatcgcctggcgacgggtacaacggatctggttgatgttctgacagtaggtgatgtcggtaacggcacaatggcgtattccggtacgaacattcgtctgaatgacaaatctctggctaacatcaacacggcgggtgatttgtttgttgcaagtacagcaacgcctacggtacaattacgaaccgctgcaactaatggttggaacggtgtaacaattagtaatgacggcggcacaaccactgcaaccgtgatcaacacccgaaactttacccagcatcttgacagtacctatgtcaacgtagcgggtgatactatgactggtgcgctgtcagttagcgtaaacggtacgggtggacgctttaccagtgtgagcggtacggcacatgttcaggcaggtgatttctctgggaacgtccagaaaatgcgcttaactggcattgacgataaggtattgactgagttcaacatcaatatcaccgattacaacaaagcgatgatcaacggaaacctgatctatcatgcgggtcgtaaaccgactccggcagaaatcggggcggtagcggtagcgggttcaaccgtcgatactctggttgtacgtgactatatcaaaatcggtaacgtgaaaatcttcgcaaatccagcaactaagacttgtgaatttgtgtgggaggaataatttaaatggcgaataacgaatttatggcgttattcggccctgatagtttcacggcgagtgtgttttcagaagcaaacgccgtgaaatatcgccttgttgtccgtggaacgaataacgattctgcggtcaactcggttgaggtatctatcaatggggctgatattattaaccgaaacgtacagcgcggtcgagggattaaccttgctgtaattgacggtacgagtttggctttgctggatttcaaaacttttgatatgtatggtgatcctactacgaatgggactgcgattagtgattacctatctacacttccagcaaacagaattgtgtgtttctatacgttcgatgctataaaatctaccgatgcgtttttgagttatatgcgcacaatcggatcggttgcatggcctgaaacacgattctttaacacgccgtcatcatcaacaaacaacccgcaacgttcatcctattcagcaatctattcatccacgatgaaaaagatctgtatggaaaacttcgtaggtggttctggtagtggactcaaagacaacacgacgagttttgttgaggttgtattcgatgaattcagtgatatcggggtgactggtattcctgaaagaatggttgatgatgttcaggtatatcagaacagcggcagtgcttacggcttccatttatacgggatgtgggatattggttctactgttttcttgggggacatcttcaagttcactggtgatgtttattgctcgcaagaacttcgcaatgctggcggcgaatgttatctctatatgtggacacagaacgcctctggtcaatggatatcctctgcgatcctgcgaacaactgggttagctcctgatgaatggcattctctgtcaggatatttcactatccctacggacgcactaaacgtgaagatgggctgtatggtatatcactacccgtctaccgtgaaagtggggcttgctcagtgtcgcaatgtccagatcagtaaagttccacgaatcgaaaccgatcgcaacggggcggctatcggtgtcaacggtattaggatgcaaacactttccgaagtcactgatgctggaaccgtaaacccgattgaacaattgctttctctgcctgtttcgcctgttggggttatcagtgacaagaaaattagttcgcataactttgctgaacttgattatattgtttctgatccgactgaatatacttctaccaatacagcggagtaccagttcaaagaatggactgctacccagcaagcggcggtaacgaaagcatcactaagcagttatggcttaaaagctggtgatacgatccgtatgcaatgccaaatgaaacgcgatgcaaacgcaatcgccaacaataaagatgcatatatcgtaatgcagttctgggacgcgaataataagtatatttcagggatccatatgcgtgatgttggtacgatcccgaacgtatattcattctataaaaacgaaggggttattcctgctggtgcggttacgtttgatttcggtttatatcgtcatccaaacaacacaaacatcggtacggtatccgctaaagacgttaaactgtcaatcgtgagataaaggggcgaaagcccctttttcataaatacagtcattacaggagaaatttttatggctgatttgaaattaggtacaacgctgggtggtgcgggtatctggagtgcttctaaccttcctctattgccctctggtggacaattaacgtataaaggctggagagtatacaccgaaaacgatcgtccgacagcggaggatataaacgcactatcgacgattaacggcggtactgttgcgaagaatactacgtttagtcaaaacgtgacagtaggcgttttgttgaccgcaaacaatattcaatctaaccagtgggtcaggatcactggaagtgctgttgctccggcagttgtttttcgtcgttctgatattacttcggttcctgatgtggaatctgggttgatggatattaacgcatacaacggtatttctggcggacagttagcgggtacaattaacgtgaacgctcgcacagacggaggtaataaaatatacatccgtgcctttaaaaatggtactcaaaatacgctgttgagtctggactcacaaacccaacaggtaacagttgaacagggttctttccgtgtgatcgggacttctaacctcggcgtgacgaacgctgcatcaatggcggttagcggtgcggtaactgcgaatacagtaaccccagcaaactgggctaatcatgatgaacgttatatcacgggtattcctcgcggtatgtctggaacaagtttcggggctgctgttgtaactgaaaagaacgatgttctgacagtaggcggtaacatcaccgacggtccatatggtaacactacgtattacgggcaggttgtcaactatcgccgtacattgaatagtggggtttcattagttcaaacatacttcgggaacgaaatgtggtttcgtcttggatcaggttctccgggtgcgtggtcatggaaccagggcgatgctaatggttggcggcgtgtttatgatacggtcagtccaccaactccggcagaagtgggggcagtaaacaaagctggcgataccatgagtggtgttttaaccctggctcctacttctcaaccgcttaaaacgcaaggaggcggtatttttgcgaatgacggaaacgtgtatatcaataaaatcggatttagtggatggattgatgatttgttcttgaaaaatacaggcggtactgtaacaggaacaattatccaggacggccttaactctggtgtttattgtatttctgcattgagtaccctagcaactggaacgaagaattaccttcgtcgtttccgtggtggttctggtgatgtgatttttcatgaaaccgcacaaagtaatacatggcgtattgcatcgggtagttctgattcacaagatgaaatggttctttctgctggtagctgggttcgatatcgtggagaggttgtttcgcaatcagcaaacggatttcgaatcgcatatggtaacaccggatcatttattcgcagtgacggaaacaacacgtatttcctactgacaaatagcggtgatgtttatggtggatataacaatttgcgtccgatttattacagcaacaccacgggtgctgttacaatgggacatacgttatccgttaatggtcgtattagtcaatctagtagttatattgacaatggaaatttaacattaaacggtagcggcaacggacgcgttgaatttattcgcagtggtgcaaaccctagcgatatgtatatcttccatgctggtgatgctactcgcggaaaccgtatagaactgtcggattcatcgtcgtatctggtttattttgaacgtcatccatctagcggcattcagttggtaatgaacggtaatggtagctttaacgatgtatatattcgttctgatgaaagactgaaaagtaatttcagtaagattgaaaatgcattggataaagttgatttacttgatggtatggtgtacgacaaagcaaatcacattgggggtgaagaaactacccgtgaggctggtttagtcgcacaacaactgcaagaagtattaccggaagctgttaagaaaggcgttgatggtgaacagaacgagatcttaactgtttctccgactgctgttattgcgttgttggttaacgcagtaaaagaactccgtgaggaagtcagggaacttaaatcccgctaattaaaagcccttcggggctttttctttttataaatatcataaaagcatttgaggatctaataatggcagatttaaaagcgggtactaccgttggcggtaatactatctggagtcaggcgaacttgcctttgctcccttctggaaacacaatcacatataaaggctttaaaatctacaccgaaaacgataagccaacaaaggcagaaatcggattaggcaacgtaacgaacgatgcacaggtgaagaaagctggcgacgatatgacaggcaacttgacgttaacgaacaatgcttcattaactcttcctcgtcgcattaaccttatttccgataattcatcggcggtgtatactgtagcaacgcgttcggataacaacgcagttacagatccgtttccgtcatcggaaactcgcgtatacagtttattagttaataccaaatcacatacaagcgatcctgcgggtggtgctactttagccgcacatctgtttaaccagaaagcatccggtgcgggtgtgatgtttatacaggtatttggtccacctaataagacaacaggcgcttctggatcggtgacagggcaactgttgatgaacggggaaaatggtcaactacaaatgactggttccggtttaacgatcaggatgcagaccgttgtcagtggtacgatctttggtacgcaaatgtctatcaagggcgattcgaaccgaaacctgtacttccaggatgctggcggtaatgagcttagtttgatctatgctgatacaggaaagaacttatatgttcgtactggtggtggtgcatatgcaaccagatttgcatctgatggaactttagttctcgctaaccatctacaagttccaggtaattctatatttactggggttggtcagtttaatggacgattagtagcaaataccgattatgcgagtatgagtgcgaacgttcctgttttaatggttggtactgttggtgatggtaacgcagttggcgacggaaatactcactttggatataaagattcgaacggaagatataaccatcatcttcgtggttctggttctacgttcatcaacacaaaattggggcttaacgtaaacgtcccatcgtattataacgacgttccacagggcacaccagcgcaatatttcttacctactgttggacagggcgggaaaaactatttgcgccagttccgaggcggtaatgcggatacgatctggcatgaaactgttcagggtggcgtatatcgactggcaacaggttcaactgacggacaggaagaattagcaatttctactgcgggttatgctcgattccgtcaagagatacagagtaatacttatggtactggcggacaattccgcgccgtaggaggaaactatggtttcatcattcgaaatgatggtggaagtacatatttcttacttactgcatccggcgatcagtatggaacatggagtggtctacgtccgtttactatcagtaactcgaatggcgttgtttctatagcaaacggtgcaaacatcaacggttctgttaactttggtaacgcggtaaacttcaacggcacggtcgaaacaaacggtcttggttgtggtactgcaaacggattgggtacgactggtatttctctgggtgataacgatacaggtttcaaacaggaaggtgacggtattctcaacgcctatgcaaatagccagcgtattatgcgatggactactggtgcaactgctaactataaacagttacaggttcagggtgttaacgggccagcattacttctgaataacacagagactaaccaatcatgttatttgctgattactttggcaggtaacaacggcgcatacttcgggtttggtggtgctgatgataacgtatcggtacacaactaccgactgaatacgaccttacagttgcgtacttcggatctgtatatgaaccgtggtctgtatgttgaaggtaacgtaaacgccaacgatgtgtatattcgttccgatattcgactgaaatctaatttggttgaattgaaagattcattaagcaagattgaacagcttaaaggttatatctacgataagcaatcaaaagatgctgatgatatcgtataccatcgcgaatccggtctgatagctcaggatgttgagaaggtattaccggaagcagtgcgcgaagacatcgacactggtatgttaaccatttcaccttcgggaattaacgcgcttctggttaacgcaatcaacgaactgcgtgaacgtctggaagcaatcgaaaacaaattaggggcttaattgcccctctttcatgaggtatttttatggctattgtaggagtccctggctggatcggttcgtctgcggtcacagaaacagggcaacgatggatgtctgctgcgggtaatgcggttcgaatcggaacaccgttttatatgtctcgaatggcgggacaatcggtatataacatcaactttacggtgtatgagcgttactataacaacgcccgttatcgtggtcagtggggggttggttggtattcaccatattcgaaaccttccggtcatgatgcggttggtggtagttttaacggcaacgcattcggtacttgtgtttctgcacaattcagcaatgagattagtgtaattactattcaaaatggccctgctgttaacctaagacttacgatggatgacggcggtgtgtttgactttgacaataacggtcgtatacaggatggatatcgccaatatcagattgcttctgcccaacataacgcgtggtatgactatttgaacgcccgtgtaggccaaacacgatccggtctggtcactcaacgttaagtaaattcctaaatatgttcggggtcggcatccccgaacttgaggattaaacatggcgctattacaagataaattggcggtgcttgaacgggtaatatcgttcatcatggcagtcaaaacatggaaacagctattcattaaattggttcttatcgtcactattttcattatgttcgtaacatggtacaagtgggatgacttattttcagtctggaaaacatcttcaagcgttatagacgtgccgacgatggagattgaaaaggcaaaaaagtttgaatccgtatccatcgaacagttaaacatagtgcatttaactacgggtgcggatttttcggcaatctttgggttcagacctaagaatgtcaattattttgttgatataattgcgtatgaagggaagttaccgcaacagattaacccgaaaaatctgggtggctatcctatagacaagacatcggaagagtataatagacatataaacgggctgtactatatctcagatattgcaagcccgtatcttccaacaaaagaccttgttccggtagcatatacctttagttgtccttacttcaatctcgaaaactactattcaggatcaattctaatggaatggtatatacagaagcccgaagtcgccgatacgaagttaatgatcgtgtgcaatcaggccgctagaattttaggcaggattcgatgataatttcagtttcaaactactcaaagcccgattgatgaaatcttttactttcgtcatcgggcttttatcgtatatgtcccatacgcgcatgagttcgtaaggtgtcggaacatattcatcgttccagtatccaacattacctatcgtaatgcgccggaaaccagcctctacgctgtgatatacaaagaacccagccttacccacaggggcgactttaaaaccgcgtgtagcggctttcatggcttcgtcgtgtgtcatgatagaatcacttcgcctctgtattgattgtgatagatgtatggacgaacacccagtgggtgattatctatgactaagatcaggtcaagttcgtcgtggttatcatcttctgcaactatatcccagtcggtcgctttctgttcttcaacactggcaatgaatacctggttaatctcaaccttacggtgagaacggcgaatgatcgtatccccttcgcggaacacgatcatatctgggttaatagggcggtacgcggttttacccgcgcacacttcattaagcatttcttcgtatgtcattataatacctttactcgctgaacgattgtctgtttaacttctttgtattcgttgtgaagtttaggtgtcgctttgaagcgaatcacatcaccctcttcaacaattttgttaccgtagtagataaccacgttaccatctacgttgattttggtcatgaaacgttccacttcggtgtaataagaaacttgggtatatccgagagaaatcactttctcaacaaccccgctcatttccatacgcttaccgatttccccgatgtgctgtgctgctgcgatcttcgcctggcgctctgcttcccattctgcgcggatctcttcacgtttagcgatgtaatccttctccagcgctacgcccatgcagtaagagcaaatagcctgaaatactgggctatcgttgccgttttctttgcactgatcagcccaccacagaatcgtatacatcggcatatcagcaatcacttcacctttacgcttaccgattggcatgatgccctgttccagcagttccaggttttcggtatcctgtacggacagtttaccgcgacgttcaaacagatcgaaatctgcgaagccctggaacaccatctggaaagtatcggtttggttcagacgatccaccatgcgatcgaagtattcacgcgctttcgcttccgctttatctgggtcagtagacaggttgcagatatagttatcagaagtgaatccacctccacgacgctctacacgcagagtgtacatagcgtttttagcgccagaagaaatgaagtatgtcgcggtaactttagtcaggttagtcatggtgaatctccttagtggtttcgtttcgacaaggccaatatagcaaaagccctcaaccgaagtcaagggcttttttatcatgcgttcgaatctttcataactttatgaagatggatatcaaaaattttccagtatgcttttccgcgaggataaatttttgctttatcaatgtcttcgttgcttccccatgtattgtttgggttacgacaacgattttttgcataatccatgtgccagaataagcgttgcaccgatgaatctgtgcctaatggatcttctttgctgaacagaatttgtgaactcataagaagaaacctgttcgaactactaaatcaatctgtttttccggtatcagtggcgctttatcgtcaacgttgcactgataatacatcccgacatactcatgaggaacgttggattcgctcgcccatttcaggttgtcatctgtacgcggccctaacatgaggttaacgatattgacagcgtgatcctgttctggggtattgttgcatccgttcacataatgtccgtgagcggttttgaggatttcaatgatatcttcgtcggcttcaacgagatacagccccgtgttttctgggatttcctcaagaataatcaaagcggttttcatcacacttacctttatgtttctgcttacgttttgcttctttaagtgctcgcttgcgatcgcggtgagtagaagcgcggttgaaatcatgtttcgctaccaggttgttcatcgaggatataatggcacatgatgttgaatactgacttcgccatacagttttacgatagttaagctatcagatcctttaacaattctgtatttttctggaacaacgcggtcgatttcttttttgacaaagttaagcaatccgaagtcatctatatcttttggtgctttggaaatagaagacagtgatactcgttgacgtgaatcatagtacgaagaaattacaaacatatattattttccttattggggcttttcagccccattttagataattaatccagcagtttgcggattttatccgcgatacgtccggcgcgggatgcactttcgcggtgatccgcttctttgttacccagttcagccagtttgcgctgatgttcttcttccgctgctttgcggtctgctgctacctgtgcgacctgttcgttatcgtgagcaatacgcgcttcgagttcggtcagggttttgtcaaaagttgctacgatttcgtctacagaacggattttggaaaacagtttcatattcattatctcaattagtatggttggaattcaaagtcaaacagatcatttagtgcgcggttgtattcagtatagttctcaccatccccgaaccgcatctgaatcgcgctttccgctattgtaccagtaagatttgagaaaccaaagaggtttttaatcttatcgtgtgcaacgaagtacagagaagcactatccagcaaggccaccatcgctgatggttcatgttcgcggcgtttgatacgtaacagagtacggtttgcgccagtcttacggcgttgatttggggctacgtagaatcggaatactaccttacccgttttatcatcaactaccaggtagaagccgtgttctttcaggtcaaccccttcgaacttggtgaagtcaccgcgcttcatgtcacctatcttaacagcatatttgtggatgtcaagccttgtcagaattcttttcatttttcttcaccagtttatttcctaatttggtgtttacaccagttttcatattcattgtcagtaccagcaagaagatagggcatgacaaaatcaagatcgttgcgccgaacactaagcgaactaagcgaatcaacaacgtcccgatccatttcatcggtatctctacccacttctgaaccgttgcgagtaccagcataacataacccagattaaatgcaagggctgttgcgataataccgtaaggttttttgaagtatgtctgttctccgtcttctgtacgtccagcggtaacgttgcctccgttccagatttctttagcggttttgatggctgtttctgccccgctcaagttctgccagtagtcaggaatgctctgtaggaatttcataatcaaatcctccgcgcctgaatcgctccaggcgctgttttggggttagtagtgactgaatcccacagttacatcacgcatcacctgataacggcatacacgcatcttagcgttatcgtaatctgtcgggattgctacaacatcgcgaggattaaccttaacctgaatgactcgcccacgtcctccgccatagtgaggcaggtacgattttgcggcaacatgcaaaccacatgaacaggttcggtttttattctcgtctacctggttacgtggcatttcaaccacaacaccaggggagttatcaaacttaccggaagccagatcgcggaagtcttcacgaacacgtttccacgcgtagaaatctccgtcatctgccagttcgatatcgttatgtaccatgaacccataaagctgatatacagcatcgcgagaagggttttccatcaacttctcaaagaagttaaccaggtgctcgtaagggcgatcgttgtacatttcgcgaacgatacgttgcgtgataccgctgtcaaacacaatatctttgtacaggactttatgcccgatgattttaatgttgcctttgctgtaaatcttcaacgcttgcgttgtgtccaacagggtagcaactccctcaatgtcgcccttaaccattaaagcatgtgctttttcgaagttagggtgtgacgaatccgctgtgatgatcttgccgtccagtaccagagtaatgaacgattcagaaccaatcattttagatttgacatctgtttgcggaagtggtttcgatgcttccgtattatacttagcgtgttgctcggtaataacgcgcccgatggttcggacgcttacaccaaattgtttagccagtgcggttttgtttgcgctggtcagaaagccctcataaactgctttcttttgtacatcatcaaggatcttaacgtttctcattatttccaccgtataagtttgaccaaatccatcacaattttatcatcattaaacatactgcggaatgtagaataagatgaatgtaacaacatgtaatgaattgatgggttgcgttctgcaaataaatcgtaagcagtatcaacgcgttctttcatatctttccgcattttgtaatacttcgttgacatttcacgaagtaacaggttacgcaccacagtttttgatttgtttttgccctcgataacatcataggtaaacttaccatcaagataatcgagcaacagatacaattctggattatagcggtttttaaccatgcgatcaagggttacgcccatagaatcgcgcagggttcggatctcgcttccgtggtttgatgaaatccatgcagggaaccagttaggttttatcttcttcgctgcgtccgcaaaacgttttaccagataatcatcaaggcatttcatgttgctatctggaatgcgactccacagagagtttcgcagaaccatcacttcgttcagccctgtaaccgttaacatggtcatcatactgctggcgatgctacccaacgaatagttctgtgcttctccgtccagtcggctatattcatcaaccccataaaggcgcatagcgtacatttcatccagtttcacaaactgtgctttagtcaggtacagatcgtttttctgtaagttgccctgatcatccaggaagtaatgatatgctgtaggcgtttttggacgcggttctgaatcaccagaagatgattcacgcgttgctttccagcgcttgcgatcttcggtatacgtttcgaattctttagtcatttcactggttttcagtgtaacgatctcagattcatcgaaatacccagttctgatcaagtcctgaacaggttcactattaatctctttggttacgaaactgatacgttccgaaccattcaacatgcagtaaccgatcagatatgggcggagtgaacgcgcttcattatcgttttcaacaatgaacagtttcttctgtcgccacggttgaatcatgcgcataacgtcctggcgtttggtagtttccgctttgtatgtctcgtgacggcgaccagaacccacacgttcaaatacgcaatctttcccgtcatatgggttagcccagaaaccacggatatattttccggttgcagtttcactacttttaagatgcgtcagaatttcagccaacgattctttacccacacggaaacgattatcacgggttacgaacccctgcaacaaaccaggcagattattaaaccatacgagtttatcgcgggttgtcttctgctttttatactgttccatcaactcttcatcaaagcgtttgttgattttgtccagtcgatccgtaatcactttcttcgtgactttatcaaggctcaactcttcacgcgacggcatgaagtccagcgatcccagagggaaatccagaatatacgcgtaattgctgttacggtagcagtagaacagcgagttttcgaacatgtccatgtcgattggatagcaaatgttacccatacgcgcgtatacgcctgaatagttgatagacttataacggatgatcccgcgatcgtctgcttctttcggttgccagtttacatcaacctgaacaccgataaagcgcggacggatacccgtaaacggttcataaacacgcgccgcttcacgttcccattctgcgatatcttcgactttaaccggaacggtgatttgaacgccgttaggttcgtctgtttcggtttcgtagatttggtcaacgaaaggttcaccattatccatataagccgtgtacgcacgtttaacgccgtcctggatggattcgatagtgaatgtttcggtgtagcagaacggggatttactacccagtcccagcgccccgatcagttcgtcggtgtcggttttggtggattcgaaataggttgcaaacacctctttaaccatccagtcacttaaccctgtgccgtaatcacggacgatgaaacgcggatcgagaacagttggtaactgaacatcgaacgggttcatgttacccgctaccatatgaccatcaatggcgttactggagatttcgcgaatgattgcgcggatcttgtatttgtaaatggttgatgacatgattttgtatgttttcgcactggtagccattttaaacttcgtgcgttcgcctttatcgaagcccgtagtgtgaatggtttgtggtgctaactgacgcaatttcattgtttatatctcacttggtgttaaagatgatgttatcgcatgaatatttcacaggcttttgatcaagcccatattcaacaggtgtacacatccggtcaaggtattcgtaaacctgttgcttctgacgttcgcggtctttcatatccatgataccgaccacgatagcagttacaaaacatattgcaatagtacacagcacagctattgtaatatattttcccgtttttggtgcatcatatggtttcattgaatcgcctctgcatattgttctggtgtcaatttacgcgctactaagcgccctttggttgctcttttgtttcctgaaatgtagatgttcgcaaggttgcgtttaccttcctggatctcattgtacatcttttcaggcatattgcactgataaacttcgccgttcggagttttcaggaacaaagcatacatatcctttttgctttcccgaatcactgatttctcacggatacggcttttacatggtgtaggctgtgcgcccaactcgatagctttacgctgccatacgatcccgtgtccagccccttcggtcagagcatgtgcaatttcgtgcatgagagtatctaaaacgttctcgtagatatcttccttaacgtgagaacggcttaattcaattgacttgcgactgtaattgcattgtcccagagtacgcttgaaacgtccgttaattttgaaagaccaatgagataagccatgcttcgccatgatgcttttggcccagatggttatttccatatcgctacgagttttgaacattttatatcctccccaatcagtgaggacactatagcaaaaaagcctcccgcgatgcaagaggctttttgtaaattatttcaatttcttcgaaagttctttcaaatcattgagatattcagttttcggggttgtttcttcccagtatttcagttgcttacgcagttcgttcgcttcgtcttccagcttttgacgttcatccgtggttagatgatagatgttcatcgcaaccaggatttcggcgtggttctcgcaacccgtccacgtagagacaagtttaaccgcttcgctgcgactaagccccttcaatgcgtcaggctgtgcgatcatctggtcaatgaagtccaccttcgccagcgccttatctaacgcttccttagtctcctggatgcgcttatcaatacgctgttggtaaacaccaatacggatatcaacgaagtctttcagcaacgtttcaggacgctcgtatgaatgcagtttcccgttaaagataacgttgatgttcgggtttgagttctcaatcaatccgaaatctttcaggatcttctcacgggtaagcccgtttgcgtactcacgtttaagggtgatttcgtagcggaaatcttctttcgatagatccttatagcttacgatataccctttttcttccagcttatccagaatagagatatatttcacgcgatcatacttgaccggaatctctgtgatcaccagtttggttttaccctggagttcgtacttgccgtacatcgtaccgttttcaatgtcgcctttgaaatgcgggtatttcagatccagcgtgaaatctttcccgttcaggtaactaacacatccattcagaaccgaaatcggatcgtgtggtggaatgttggtagcgtatgctttcgcgatcccgctgaacccgttaaccagtaccatcggaatgattggcaggtaataggctggcggtacgtgttcaggatcttcatgcgggattgttaaatcttcatccatgtagatagccttgaacagcggagacagcttacatttaatgtaacgcggtgcgcctggctttttaaccagacgggaaccaaagaacccatcgcggtcaaaaagcgggatgttattgcaccagtgcgccgccataagagacaatgcctcttcaacggatgtttccccgtggtgataaccatacattgcaacaccgccagcgatagaggctactttctggaagcctgtaccgcctttcgctgcggaatgcacgaagaaacggtgaactggtttgaacccgtctaccaggtgcgggatcgcacgagaataaattgtgtaaagagcaaatgtaagcccctccacctgtacaacgtctttaatacttctttccatcatttcaccgaaaatttatgttttccgttcacccagtctttacgcggatcggattcatcaccgaaacacagttccagaacgtctttgtattcgtcgcccagtacgattgtatcgtattttaactggtcgcccaacacccgatcgtaatcttctttacgtaaagaacccagccctttgatatatcgtacctctttcgccttatcgcggaacggtgcgaaatcttcaagggagtagaaccatttttcatctttaccgactttcgcaatgataatcggtgtgcggatataacggatctttttcttctcgaacaactcaggccagcggctaaagaacgcaatcagtagggtgagaatatcgcccccgtcaacgtccgcatcgaccatgatcccgatgttgtcgtaagtcatttcggaagagtcgcctggatggagattcaggatcgccatgagttcagacaattctttgtttttgagcacttctaagttactcattccccaggtgttcaacggtttgccacgtagcggaaatgcgccttgtgtctcttcgtttctgcactcgataaactgccccacagcggaatcaccctcggtcagaaacaaagtggtttctaccccgtcagtgtcgatccctgatgccggaacatgttttgcaaccttcgcctttttcgctttcttcttcgctttggtaatggctgctgcttctgctgcctgtttgcgaatcagagcggactcaatgatcggagtgattatttcagaagtatccataatctgtttcgcgatctttttgtagttcagtccggcgtggttgttgaactccccagcggtgttagtcagtttttctttcgtctgactatcaaaagctggtgcattgaagttatgcaaaaacacaaccaaagtcaagcattcttttacacgggctttcgggatctcgatagcgtgtgttttcttgatcatcggttcgagttcagaatagataccgtcgatcatggtgtcaacatgaacaccgccgtttttcgtatccagaccattaacgaaggatttctgtttgaaaccgtcttctgtgctcgccaggatgaaactgattttgttgtttgtctgggtaatcgttttatcaccgtacatcgcgccatacatcgcgaatttgttcgggaggatatcgccgttatatgtgaatttaacggcagggaaagccactgcaagcgccataaggcggtctttgatgacttcctttgtctcttcgtcgataccgtccacaccgaagatagagaagtcaggggtaaacttaacggttgtcccttgctccttcgtcgggctggtgcggtaatccatgttctgcgctccgtccgtacaattgatcgtgactttgcgtttaccgttggatgtctcaccgataaagattgcgctgtaacagtttgtcaggaaagaacctacaccgttcatccccattgttacgcggttttcgtcatcgaagttagaaccggatttagccattgtccaggctgcaacaggtttaggaacaatcttcccttccggcgttctcacgtcatcttgtggaataccgcgcccgttgtccgaaatcgttaccagattgtgatcaatcttcacttcgattttgttcgcatatttgaaatcagttcggatcgcttcgtcgatggagttatccaggatttcgttgatgattttcaccaacccttccacgtattccactttgcggaattgccccatgataaaacgttcatgggcttctttgttcactgaacccacgtacatattcggacgtttgcgaatgtgatcgcgatcgctcaagcagaatgattcatccaccttagcgccctttgctggggcttctggtgctttctgcggctcgttatcgtccattaagaaatctaaactcatattcacctcgttattagttctcaggcattatatagggttctatgaaaaagaaaacccctttcggggttttacttgttgtacgggaatccgtctttcaccatctgcggcttatcaaccgttcgtttcgcctcgcccccgcaatcacaatctttcggttcgtcgcggcttgcgatgctggacattttcggaaattctttttcgcacttggtgcatttataggtatatgttggcattaataaatctctgacaatggaataaaacggatcggggttgcggctttgctgaaaacacattgcttgttccctgcaaacatgagatcagtttcgtacaccatacaaatatatccctgattctccaaaatttgccgctcccagctatcgaaccatttagacaacttctgcaatgaagagaagccgaaaatatagctacgataatttttaccatgttttttgaggttacgcattaaacgaaggtcttcgcatggtgcggggtgacgagtctcggagataccgaagtttaaaccgaactcgattccatgaatatcgagatactcatagagatcgtcttcatcaccgacacaacccgtatacgggcctaattgcttacaccatccatcatatttggataatatagacgctttcaattcaacgcgataaaccaacatgatccgatcctcgtaattgattaactacaagtagagtaccacttatctaatttcttatcaagcagtttattgatcacttgcgcgatttctgtcgtcccgtgggttgtactcagtttcaggtaaatcacatccagggcacacacgatcgcatcaacgctttcttcgacgatatcaccgccgcgttgaggctgaacgagacattcggagatctccccaacctctgcggacaggtggtgaaccacgtcgctaacggttcgttttttgacgctatgagcggtcttgaaaaacttatccagaactacagcggaattttcgcgcggtacttcctcacctttattgacgtggatcgtaatttcagtttccggttctggtgcaacccataccggattgaaaagccctttcatatcgttgaactttacaggaacgggaataccttcaagataaagaatccctgtttcttcatacaccatactgatccggcgtggtgaattgaagtccatcggattcttacgcaacgcgtcatacatacgacgagtcggatcggcttctgatgccatttgacacacagccattaaaatagatttcggggcgtacatatcgccaactttatacttgctcatttacaatacctttatgataaccaacaataaaacagttcacttctggacgttcgccagggaaatgcacacactgcatgacgcgttcagccatgagttcttcgcccaaataaacagaggtggtttcttcgttgtaatgacaatcatacgaagtcttaacactcataccaggcaatccggcgatatgcataaactttgagttcgtgcatggtttaccctcaatgttctttccgtttacatcaaacgttgcaaacatttcggttttgctgttctttgggcgtctgctcatttcttcacaacctcattatatgttgacaggttccattcatgcacttccggcactttggagtaatgatccaggaatactaactggacttgcataacattagcacgatccatattgaaaaggaaacgttgcggggaagtaatacacaggaaatcttcggtacttcctctgcttgcgctaaactcttttgtttctccgccgtcaaatttagcatagactggcgtagaaaaatacggggcgaatagttcgcgtttggaatcgtccgtaatcgcgctgaaacacacgtctacgagctttccggttccttcccgtctgatggtgagcattgtccctttcgtgcgccctaagacgtttacagagcgcgtggtgacatcaccaaaagcgtttgtgtaactcacagtctccacaaagcccatatcacgacgttgttttaacattgcttcgtgttgcgcttctgcatcctgttctactactcgttgtgcggcttcatacgccgctttgttcggatctcttgattgccatgcgaagaataaaacccctgcggctatcagtccgaagattgaccaacttgcggtcgctgatagtttcattttaatattccaaaggggccgaagccccgattttagcgaagatagcgaacgtaaccgctacggtcgatcgcgttctctgggttgttgaagatattaccgcgaatacccttagcaggtgctttccatcctgcggctttcaggatattgccgtcattgtccaggaaaccagcaactgaacgctgatcgaacatttcaccagtctgtttgttgcgagtatcctgcacaatacgatgatacttacggcctttttccagaacgaaaacagtttcaaagaattcgttttcgaatgcgccaccgttacgggctttgaacatcgcatccagtaaaggctgtgctgcggctttcagttcgtcaaaagtatacatggcaatctcctaaagtctgtttcgtttcgatgggataactatatcaaagctatcccgtgaagtctttagcaaaaagtgctatttgttaaacccgtttcccttgataccatttcgggaaaataacccggtcaataaaagttctccccaagttgaaactatcaccgaacaggagaacaccaaacaaagggtcgtgcttgatatcgtttttcccgacagtcttcattttcccttcgtggatcacggtgtcacccaccgtgatatccttgatgcttacttttacatgatgcatacaatcacctctgcgagtttagcaggttttgcttctggtctaactttcaacgcatcattcagattcttttcaaccattgctaccgcgtcgttttcgttgaaaccgttcttaaccagggctttaactactttggcttctaagtttttcatgatgcgttccttttgtctgtttcgtttcgatgtgtgtaatatacaaaaaagcctcctgcattgcaagaggctaatttagcaaaaagtgctattttgaaagaggtataagcatctttcgcataccgccgttttgtgtggcatcatacacgcgtttagcatccataagggagagttcaacatggtatgatttccctttcccgtcaaaatcaaacgttaccgtaccgcttgctacgcttacatgagtaaagatgaactcaccagcgaaatgctttcgaaacgctttgtcgtgatccaggaaccattcaaacgcttccccgtgctggtacagtctgacgataatcattgaaactatgatgaaaatcagaactgctgcgacgatcgtaagctctttcatcacttacccctgtttacagattgacggtgtagcacacggttaacgcgtggcgcttgatacggtttcattttgtacggtgtcggatcagagtattcgatccggttaggtaatgaatacatttcaacatttggctgaatccagcggattgagtcgattaacccttgagttaacgcacgaccgaaacctacaccaactaaacataaacgcataatatccccttactgtgccagaatgtgaagccattcacccagccacacgatcgcctgataagacaaccacaccgcgccggacacacaagcaatcacaccaatgatcgcgaatccaattaaaatgttcaaaccttctttcaaatcaccaaacatgtttcatcctcttttgtttcagtccctacaaaataacaaagcccctgcacgaatgcaagggctttttatcacaattcgactaactgaggcaatttcagaaccatccccggaaggatatagcttgcattgctaacggttttgcggttcaacttagcgatagactgccagcgctcaccacaaccgtataatttttcagcgattgaatacatgctatcgccaggctgaacaacatattcatcgtattcgactttaacgaacgcggggttcatgagaatgtcaaacatctgcgcttttgcttcgttcagtgtttttgcatgtacagttttacctacaaatgataatttaatcatcttttcctcggcagactcaatggatcggtttcttcttcgcttggtggttcttctaaccccagcgcatatctcaatgaatagactatcatcaaaacatctttcgcgcaatcgtgaattgaattatgcatcacaaaaccatcaagcaaccctttccgaagaggacaggtcgaagcatcacgcgttaacaggcggttttcgatacatgtacgcacatcgcgactattccagaacacggtcggcatatcttcgaagatgtcgatcttgccaaccatcttacgcacgatatcaaccaggataccgcgatcgaattcagggccacgaacataatcgagtgattgccaacggctcacaccgtccgcttttaggtcttcaaagaattgtcgatgtcctgcatagagttccagatcttccggcgacggtttcaggatttgacgggcttcttcgctttgttgtttccaccaggcaattgttccctgatcagcaatacgatcaggctggttgcgcaaatcaaatttgtacttgcgcccccgtgcaaccagttccgcgaacgttggcgggttgtggggatcgtcaacaaatggaacgtatgagagttcgatcaccttcccattcggggaaggaccaaccgtttcataatcccatacgtaatctacgggtaaatgactcatgaagttctccgcttatactcttccatgaagtacgccagcgtaagcgcaacttctgggttgatatcaaaagtttcaaactctttgctttgcaaagtcatcataccgaactgacgcagaccggaatgataaattgccttttccagacggttcgcgttttcaacagcttctgtgaattcgtccaacacatcgcgatcgatgaaatgcggaagttcttgaacaggggttttgaaaattagatctgcaattgcttccgcgtggaggcgagggatctggatagatatatcttttttcatgatattaatgtccatatgtctttattttcacgaatgtttcgtgccattctaaggatcagcacgataacgccatattcatcataagtcagttcaacttcttttgcaataggagaccatgaataacttggcccgttcggagaatacagaatatcattagatttttcaatgaagcgcaaacggtgaataacttcttgcggatctgctgcgctatacatcccgaacacattgaccgcatgtggatctttttctcgaattttatcgagtgcttcaagaattcggggaatgtcttttacaaggatagtcaatttcataataacctcaaaaggggcaaagccccttatacataatcaacggtgtaacgtgcgcgggttacgcccacatagattaactgcttacacagatcgtaatctgcgaacgcatacgcatcgcgcgtgtacatatacgcatggtcatacgtgctcccctgcgatttgtggtacgtgcaaaccggaagaggcttaacatcctggaacttgtttttaatcgcccagaacgaatgccacggggctttatagcctgtttgttgcttgatgcgcttataagtgctcgcaacgtaggccagatagttgcccagacggtctttcatcaccggatcaacaacaacttgaatctgtgcttcggtttcctcttcgagcgataccgttttcaggagatagaattcaagttcgatcttctcgtcgcacttctccgccttgataacttcccgacgcgggatgatttctaagactcggattttttcgttgttattatacacaatctcggtaaagatctgcccgttcaaccgcatttcctgaactaacggttcctgcatcacgatcacttcatcgagaatgaaaggttctgttgttttgtacaggtgtttacggatcgttgcgttcagcttgtccacgttgtcgttagtgtaagcgaacatgcggttctcgatcaagtcatccggcgttttgacacggcggaaatactgacggaggaagtcaacagcgttagcatgttggaacacacccagatcaccgacagacatcggtttcagcatcttaccatcacgtacagcccgtgaaacctgaataatcgggttcccttctgcctgacgcatgattttatccatacggatgacatcaaagatttcttcatcaaagaacggggagagttcaacgcgtccatcggcgtttaccggacggatctgatctttatcacccagtcccaaaataacagcgttgcttggaatactgcgccggatgattcggaacagatccatatcaaccattgagacttcttcaacaacgaacacgcgacaggtagacagatcaggcgctttctttcctttctgctgttcgaacacacgcagttcttcgttagtcacagggctaatcttcaatgcagaatgaatcgttgttgcgtccattccggtagccgctgctaacacgtttttagcctggtgtgttggggcagttaaccaaataccgctaatccccaaccctttcagagtgttaaagacaaacttaaccagtgttgttttaccaacaccagggccacccgtaatagttgtatgaatggcgttctggatgttgtggatcacgcgatcatgcgcggacttctgatcgtcactcagatcatcaaatgttaactcgctcataatttgagtaataccccttgaattttcgaattctcaataaaccaacgcatctcttttttctgttcttcggttgctggtagttgctcggttttgcggaagaaactgaaacgcggttcgtccggcgtgtagttcagtttggtttcgtagcacttgcggataaaatctaatttatcttttgcaagttgtggtgatgcaaacagttccggcgttttcccgttttcaacgtatggaatagtaaagccgtctttgtctttcgtaacaatgatatagtatttgtcaatcattttcgcccctcatagatgacgtagaaaaaacctataacccatagcaatgataatactatcaaagcggcttttctgtcaacaccgttaacgtggaaaacgcaccatccgaagagatacgttatcaccgcgcaaacgatataagacaaagcaaatacggcatgtagcgcggtgagttccattagtagttgttagcccaacgacgcaggttttccgcctgtttcagagcatacagcttgtagatggtttccgcatcaagtcccagcgcgaggaacttacacatgaagaagtgccactggtcaatcagttcaaacaggatttccagtttgtcttcttctttcatttctgcgaatacctggctacgcagttcctggtgatttgctttccacggtttccagacaccggaagccgcttttgcaccgcgtgacataccgcccagagcggtgtaaagttcgcgggtttcgtctgcgattgcatcatcttgcagtttcagccagtccaggatctcaccgcacgttttcagttcgttcggacgtggaacccaattcagggtatcagacaggctttgttgtgcatggttttgcaagtccagcatcttttgcagcgggtcaattccgttctgtaatgcattgcggtagaaaccttctaccatttccagatcatcggctttaaccaggtgcgcacagctattaaacacaggagttttatcagtcatatcaatctcattttttcggtgatttgttccacgacttaaaccgaagtttcgccgtgagtccagaaacagtattatctttcaaatactgcatgatttcaagtttagttgcgccgtccgtttttatcatttcgttgatatcttttgacggccacgggcatttgtcccacaacacaaccttttcgccagcctcaatcaattttaaaaggcggtgagtagtatcagggtgtctcgcttcattgtcaagaacccagacacgcatatttttatacggaacatcggacagcgccatttgtccgcccgtaatcgcaccagcattatctacaaacaggctatccagcggcccttcaagcaggtagacaggtttcaacggatcgatggtatcttgaccatacactttcgttgagtgttcacatgctttgattgtcatgtattttgcgttggcattgtcacgcaaggcgcgtccctggaatgactcgattttacccttttcatcaaagatagggatcaccaaacgcggttcatccttcggtaaagggtatgcgtccgcattcacagagttaaccaggtgttgccattgacgcgtaaaccagaggcgatcatatttgtctttaggtatgtgacgacctgcaacatacttaacgatagggtgattttctggcaacgtgtccagacgttcgcagaactgcaattcaggaatatatttcttttcttccttcggcggttcttcgtgcgtctgttttaaatctttacgatccttgaaagattccatcaaatacgccgtgtaatcatccgggtaatagtctttcagaaacacagaaaacggcttgctgtagttgcagttaaaacaaccacacatcatgtgtgtgcctcgttttgacgggaatatccagaaacgttttttgtgcttatccttcatggagtcgccacaaatcggacaacgggaatggatactgaattccccaccccgtcgaacgatttcgctttgtggtaatgatcccatgatacgagttgcgaactctatatcaagatacatgtttacctctatcggctaacttctttctctgtgccgtctaaagtgattttccattcatagaatatcttataaaacggataaggtctaggaatatcgacacccgatgatgtttttctttcgttcgtgtacacgatcgctgtgtcgctcatgtacttgatacggataggaaaccaggtgtaattgttcgcagtaacccagatccgataattcaatggcggtaatggtttcattcttcactcttcatgattttacgtttgcgtttatgcggacgtgtagaacccagaaccttcggccctttgttcgtgatcgcgcctgtagtcacacccgaagcaatattatccacacttccgcctgaatcacctgcaaccatttcttcgttgagtctttcgcgaagttctgggaggttcatcatgatctcttcatgttcttgctcggtcaggttccagcggctccgtaacgagtcatacgcgctcgtaaggttcatgaacccagacatataaggaaccgcgtttaaacggcgcttgatgtgccttacagagcgatggaatggggaatatgcttccagttcttccttcgtcttcgggtttttcaatacttccccttgaccgtcgatgatacccagcttgtaagccgtccattcagtccagggctttttcagtaggcgaatcattcgcacactgtaggttaaatccatgtttttgattaattgatcgctcatagtctttactctattgtgaaagtgaaaaggttttgcgcgggttctggctccggttcggggaattccatacagacaacttcacacatcggtttcacgcctttccattcttccagataatatccggtatcaatgccgcaacctggttgcatttcaaggccagtttcatcaagaaactttttgcatttcgatgttgtcgttgattcgtcctgttggaaataacgccgtccagagtaacgaaaattcgcggacatctgcgggagaatgaacgtacccgcacgggcaatctgtgaagcacgttcaatcactttatattcaaattccgcgcccgtatacttacccttaaaattggatgtctttatcttgccgaaaggaggattgctgatcgccatatcaaacagagtatcaaactccgtcgttaacgcgtctgcgttaatccaggtcgcttccggtacgatacgcttacccaacttatagtatgtatggtttaactccacacagacgatttcacgcggtttggcgtacatcatcatatgaagcatcgcgaaggatagcccaccgatacccgcgcacaggtcaacaacgcttccactggtacaagcatcaatggtgaaatcgcgagcaagtccgatcggggtaaagaatgcacccagttcagagttattcgtaaatgcaccttcatggaagttttcgataatgaataacttttcgtcgtaggttagcgccttgtcagactccaccagatccattatcttgttgtgttgtttggtttccgctttcgttaacttcgccattggctttttccggtaataagaacagaggggtagattctaccacatcaaagccccaatcatcaacaatattgctttcccagtcgcgggtttcccacgggctgcaaatccacttatacaccccagcaggatcttcaacctgttcaggcatacccagcacttccgcattgataccttcgtccagatagccaggatgaatattaggccagcgcatgatatcaacatagcctttgtcgtcaaccgatacgatccattctgaacgatacgggctttcgaactcctgttcttcgtctggaagaatcatatctaataaatcactcatttcactaacccttctttaacgccctctttcatggctttcagaacaccgataaaagcgtctttgccaccgatagcgccgatgataagcatcaggacaccaacacaacccgctaaaccgattctgaacaggttccaggcaaacgggatagccagaagcaccaaccacgggaacggaaatcccataagtgcgtttagaaccagtaagataaaagcgattgcaagtttcatgatgtcctcctttgtttgtttagaataaggtatcacctttcgtgaaggattgcaatacctatagatacaaaaaagcccctttcggggcttaattttatgctttgttgattagataccgaagaacgtttttggcctgaacttcgttacagcagagtttgaattcttggtcgattgggaggaagccccagaggaaatcaacgctaccttcaacatctgctttcccacttttcagcatttcaaccagcaaacctctgtttactacgctgttcactactgcatcgaaataacccgcgctgaaatccagttctgggttcatcacttcgtcgtatgggttgttcagtaagttcatttggtatctcctttaatccgtttcgttgtctacgggagtcatattatcacaatcataactcccgtcaacccctaatcaggattattttgcgttttttgcaatccagagagtcagtttagggaatacatttgccattgccaccacaaacagcacccagaaagccagcttaatcacaccgatcacgatcagaggtgcaaacacaagccaccatgaagcatttgccataaccccgattgctgccagtttcagagacaggaggatcaggaacacaataacgagaatctttttcatttcactatacctttggagggggccgaagccccgttaaaattgaatgtctgtactgtttgctacttcggctaacttactgcttcggttagtctcggcttgttttaccatagcaccttgtgcttcttcaagcgttttcggcatctgacgacctttataatcagattggaacccgatatcgctgttgtcggtatccatccagcgttgattacccttgcgcacttcgagtttgaagtggttaaagtggttcttatcgccgtaacgggatttgatctgcttgaacaactgcaatccctgatcagctaactcgtcggtctcaatcacagctaacataaagtcagcggtagctggaagaccagcagattcggcaacgtcgcccatgctgatatcagaagcatcccacgcggcgcgggtagtctgcgcaccagtccacattacggtattcgtttcaacagccaaaccgcgaagttcttcggcaatcgctttaaccaggatgtatgtgttttccgccccgcgtacacgggtagaagcacagatccccaggtagtcaacaataatcacatcaggtacgaaactcttcttcaatttaagctctttaatcagcgctttgaagtggttcgcgttcgcccctgctgttgggtattgcttaacgattaaacgcccgaccttcgactgtttgaggcgttccatacggttcttatagtccgcataggtgatgtttccgttgtcgatatcgtccatcgcaacatcaagcaggttagcgtcaatacgtttagaacaaacgtgttcagccatttccatactgatatacaggacgtttttacctgattgcaggtaatcagcagcgagagaacaaagccccagagatttaccaacgttaacaccagccattaagatgttcaatgttccacgttctgcgccgcctttagtaatggcgttcaggatcgggatattgaaagcaatcttcatcgctttggactggtaaagcatccagcgtttttcatagtcttcgaagtaatcatgaccgaccgaactatcgaagctaatcgctaacgcttccgccatgatgtcagggattgccccaacgtcagggattttgttgttgcgttcgccagcaggtttttcagcattcgcctggatctcaattgcacgggacagagcgcgatacattgccttgtcacgacaataggtttccgtttctttcatcaaccattccagatcttccggcgcatttttcatgctgcggatcatctttttggtatcttcgtagactacatcactcaggctctttttgtccagagctacttctaaagcagtttgtgaaggaatgctgttgaattcctgtacgtgcttatccatcaaatcaaagagaatctgcgcgttcccttcgaaatattcacggcgtaaatggggccacgcctgaacaaaatacgtaccattaaaaaccagatttgaaaatattgtttcgacgatcattattacctcttaaaccagattagcgaacatctgaaagaaattatacagctttactttcaacgccgcccataaggtcttttcaggctttgggagattgggcttgatctgcgcgtagattgcatcgtgaaccagcggaatcagtttttctttgtcttcgtccggcgtactaaattcgactttcaggccgttatcccaatacaccttatggatgtacactaagtgtgcaacatcgttttcatcgttgatcaacagttcttgaataacgtcctgcattgcttcatcaagaatgttttttgttttttgttcaatgtccatgattcacctattaaaagggggcaaagcccccagttgtttattactcttctgacatatccacatcatcagggatatcgtcatcgagatcaaatttatttgacggttctacttcatcgtcagaataaagatcttcgagtgctgccccgtcagtgatctctttgtcaggaatacggtacttatcctgaatagcatcaaggaatggttggtgagtgaacagaggtttccagaactcaatagagttggtttccgattcacgccatttcttttcttccagttcaagttcgcctgtttccgtgttcaggaacgcacgaccgcgccagcctttcgttggagtctgaacgaagttcatttccatagccagatccagaagaccagagaacatactgataccgccctcataggtaacatgaagcgggaatttggatttctctttcacgaaacgagatttctcgatgttcatgatgaagtcataaccgacaacttccgtaccttctttcacctgttgtttgcccaggatgatcgcggtgtctgcggaatacatcagaccagtaccaccggaaatgactttcttgctgtacatttcttgtgtgtcgtatgtgtgacagatacacaccattggaatatccagatccgccaggtaaggcgtaaccatacggaacatacctttaagtgctttagcgcgggtcatgtcctgtttgtcgttgtcagacagggcatcagccagttcttttttactcgcggtgttgcctacagagtccacgaaaatgatcactttgtcgccacgttccagcgcgttaagctggctcacaacgtcatttcgaagttgctcaactgtcgtgatacgagtatacaccacacgatcggggtcaacgcccattgatttcaggtaagacttagttacgcctttctctgaatcgtagaacagacacacagcatcctcattcgctttgaggtacgccgcaaccgtcaccagccccagattcgatttaaagtgttttgacgggccagcaaacagagttaagccggaagtcagaccaccatcgaaagcgccggacagcgccaggttcaggatcggtacacgggttcgagttttggtgatgttattgaaaacatcgctttcagacagaattgacgcagattgactattcgagtttttgatcagttttttcaggagtgctttattagacatttatttttccggtttatatacacgcataatatattcctcacaaatttatataaatggggcatttctgccccgtcaggtcttaccagtcatcaccgaacagagtgttcagggatgcgcgtttttcgtaatcaattttacatgcttccgtgatgttttgcaacgggctaatcacatgtttttcaaataatccgttgtagtcaacccagttgagaatatcactttcgatctcaacaggtaaacgcgtaccggattgccatgcgatgcaatcggattgccacgggtttttatctcgcaacggcagaaccataaccttctcaccttccataatcggggtaattccttgaaaacccttcgtatatcggttaaagaacagaacgcctttgatgtggtttggtgtccctttgattgggtatccaaaatcatcacgatattttgagatattgttagcagatgatacaccagctatttcgcggtagtcaagcgccttatactcttcttcaaatactttgaagtgttcgtgtaaggattcttcaccttcttgcaggatgcgacggatcgcttctttcaagaactttttaaccgctgtcggtgtactacttcgctgggtttccattcccatgatctttaatttaggtttctcgtagcgggttccttcggagtcccatacgttagccgcatatcgtttcttagccgtccagaaactacccagacctttcgatcccagaggtggaccagaaatgatttcgcgatccataaacatcaggtgttcgacgttgttcatgtactcgcacagttcgcggtagcccttatcaatgataggttccatgcgttctttactgaacttatccaggaagtcaacccaatggttgttatccctgaacttactttcaccgccgactttcgcgatcacgttgtccatacaaacataaatggagtcggtgtcacagtaacgcacgtatgcgtaatccgtggtgttgcacagttcgttaaggtattcgttaaccttacgctcaatccactgaatagccaactgcccgaacatggtgatcgcgctggcgtttcgaatatcgaagtaacggaaatgttcgttacccaacgcaccataaagggagttgattgaaatcttacggttaagctgtgcggtgtttgcctgtgcgatcttcttctcacaaactttcttcacggctttaagcatttgcttagacagcgttttcagtacagcttttgattcatcactgaaatcttcgtagaactcgaaatcagggttgatcatttggttgtgcgcgtccgtcaggtgttcgagttcgtgcttaatcagttcaagatttcgctcacccgccatcattcgttttttccacatcttacgctgatcaaatactttcttgatctcgaccggaatcacgcctttaacatcgcgtcggaacatccacccgttaggagagcagctaaattcatcgctaggacgcggcgcagtcttattgatgtattcatgcatcggacgcactgcaaagctgttagcgattgtctcagggcttatattcacctgtcggatgatagacggatacagactggttaagtcgaacgatacaatgtaacggtatggagcgacaaccggatctttaacgtatgcaccatcatacggcgttttagtatggcgtttgttttctgggattactttcttctcttcacgcagagagttgtaaatgattgcgtcccacgttttaagcggtgacataaccccagggaagttgattttcgcgtagtatgctacagacagaaccagttcgataaagttgcgtttaccgtcgatatccaacacgcggataacgtcaacgatgttatacgtgatgtatttctggtgatccgcttgacgcagttcagacagagaaccttcgtaatcaactttgtttttacccgtttcgaactcagcgatcgcgcccagagcgtaagtcggttgcggggtgaaactgaatttcttgtagagatccattccatccatttgagcaacgccgtaaatctcatagcccagttgttcgttcccgtaatggtcggtcgttgtcttcgcagtcactttcccgaacgggctgaaatgacgaacaacgttttgcccgaagatattcaggtaacgggtgatgatatacgcgatatcgaacttgtttgagttccagcccgtaacaataacaggcgtccgctctttccagtctttgatataagccgacatcagcgacttttcggtctggaatgaacggtaaacaattttcttcaaatcttcttcgctgatctcgttttcggtatcaactttcgacgctacccattcatctaaaccaccctcgaccagatcgtacacaaagaatttatcttcaacgctgtcatagtgggtgattgcgtcgatagcgtattttgcttcgcgtggatcagggaattcaggcgcggtaacttcgatatcaagtgaagcaatgcggatcttgtcgcgatcgtattcgatttcctttctgtaggaatcggagatatacgccagcctgaaatcatccatgcctagcgcttccatgcctacatctttcattcgctgcatccagttttttgcttccttgatgctttcgaagttctttttgatgcaggtcttgccgtaaatgtcgcgatatggcgagtctacacccgccatagcgtgttgaaacattgtaggcgcatattttgttttgcgaacctgttcgcgtccctcagagtcaatgaagcgctcgtagatgtgatcgcccatttgctcaacggatagataaaattcattcattacggttttctttctccgtgtttaatcgtgacaggaatgataccccagccagcttgatcagatcaagcgagcgttgcgctaatttgtgatagcgttgggtgtcaggccgatttagttgttcaaccagcacggtatattcttccatgatgcgggtatagaacttagggaagtgatcccgcgcgtatgcgtaggtgcgcagatcagatagattgcaagtaagagacagtttgatgtcttcgctatgcagacggttgatcaagtgatcgccggattcaatagctttgatgatttcttcaatacgaattttcataatttagtcctcacaagtggtgtacaaccaatataacaaagcccctgcatttctgcaagggcttttgattaatgtccgatccggtacttgtatttcaaagtccattcagctttttgtgcgtgagtcaatacgcggaagttgttctcttcggagaatttcagatccggcgtaaggatggaaaccataccccactcttccagaagtcgcgcaatgttattgcggcgcagttcgtcatcttcggtcatgtcaacctggcgaccgtccagcttcaacagttctttgaagtgtacgataaaataacgcccttgtttctgtaggatgtggcaagactgccacagcattttctttttgttatttgcgatcccgatacgggtcagcgtttcgcgaattttcaggaaactgtcatcgctggacagtttaatttcgagcatgttcatacatcaccatttctttattagttgttcaacctttttctggtcggttttatttttcacaacatcagccaacacagataaagcaactttcatatttttccgcttccactcgtccagtttttcaagctgtttgagttcttcgtaatattccattgctatacgtgtatttacaccgtatcgtttttggagaacatgaaggataactttcatttcgttatcttcggtgagtttagcccacgccccgaaccgcttacctttgcgcaccgtatgcaggtaataatcaaagtgcgcctggtctggtaaaccggaaccgatcatattcatcgtgtatgcagggatcagcgtttcgatatgctggctcattgcattgtcgatgaaaaacttatcgtatgaatcaagggcagagatccgtaatggtgtcttcccgttgttcagttcttcgagcaccataaacaaggtgttttccttgtctttggtgtactctttcacaagttcttcgatcttgtcccagtctttagaacgccaggccgcttcatgttcgttcagttcttcttcatcgagaaaagcagccagtgacatttttaagcctcccacgcgagggtaagcattaatcccatgaacaggtattgcaggtgaatctctttgttcactgccagcccgtactgtgcgttgttttcgcctactgcctgaatgagtgcaaccttagattcgttggtgacgatcgggtataccgcatccagaagtttagccaggaaagtttcatactcaggcgcgtacttgattgcttcggctcgcagtgctttgaagttcttcgctttaagcccctcaatcactggtgtgatgtccgaaccaacaatctcagacagaataccagcatcaattttgccacgcttagaatagaacccaagagctttaacgatggatcgcgcgtctggataatgtttcttcacgaatccggcgatcacctgctggtcatattcgattttctcgatttcgaggataccgaaacagcgtttgatcatttgcttcatgagttcaacgcgttcttccttcgacggggaaccgaacttgactaccggacagcgggagataagcgcagggtgaatcccgttgatgttgttcgcggtgatcagaacagttacgttcttgctatacgcttcgataaagctacgcatgtgcttctgtgcttctgccataccagggcgatcgaattcgtcaatcaggatgattttgccgcctttcttctgcgtcatggaggatgcaaagcgatccatttcgttacggatgaagttcacaccacaatcggaaccgttgacaaacatcacttccgcatcaacttcgttagccagaaccagcgccagcgttgttttacccgtacctggggaatcagaaaccagagtcatgttgtcgatgcgcccagacttgatgaagccgcgcatcgtcgctttatcagcagcagggagaatgcattcatcgatcgtcgtcgggcgatagcgctgatcccatgcgaattcttcgggagactgggagattttgccgtatttggtttcaattaactgtacgttttcactaagttccataatattaccttcaattgattatcaaaaaggggcttaacgccccttgtgtactgctttgtttatcttacttgaactggctggttgcttcaagtaccactacatacgcaacgccgttttcggacgagaatttcgcagcgccgcgagaagagatttcaactttgtaatcgctgttgatgaactgcatgttgtcaatcttcatatcgaagttgaacatgttatcaccttcgtaatcgcccacttctacagagaaggttgactggctttctttacttttcgcggtgattaccagcttgccgttgattggctcaacagacaggtcggtcagtttcatcatgcgtgacgctttgatcagtttttcgaaatcgttcgcgctaatctggaaaatcagatccgcaactggcatttccagacgcttcttaggctgtacgattgtggttggatcgcttgaacgctcaacgattttcattttctcaccacggatgacgatttcgccagtggacagatcgtgagttacttcggcatcagtgcctacaacgttcagcatgttcaggaatgagttcagatcgtagatacctacatcttcgtcaattacgtcagaaatcgttgcttctgcgtaaactacgctgttgatggatttcgtcataatgaacgaaccctttttcagcattacagacgggttgatctgggagaagtttttcaggatatcgatcgtttgtttagagaatttcatattcaacctatagttttcaattaggcaaaagtgccgttaatcagggattctacaatgttcttcgatgcattgtcaaggaattctttgcttttggattctgtgattttcgcacccgcttcgcgagcatcgtaaatgaatccggtatgtactgcgcttactgcttcgtcgatccgtttgtaatgctcaaagcgttcagcttgaggcatcgcacggaaaatctctttgatgttttccggcactttacctacccaggatttgcgaacgttgttcagatgcgctacatatacgttttgttctaaattcatatctacctcaaactttcaaattgggggctttcgcccccgtaagcattacagatccagcagtttatccaggtcgtcatcaccggaaccaccttccagatcaaacggaggtgtatcatcatcttccggtacgcttccgcctacgttcagttgacttacgccaccagattctttagcacctttggactggttgccattatcgaagtttttcagttcgttgtcaaatgagttcagttctgaatccagatccgcaccagcgcttgcgccagcacccattgcagcaccaccgaatactttggtgaacttcgcggtcagttccgcagttggtttgaactggtctggagcagtgattggacgcagatcgctcataccttcgaagatttctttctgacgcgcttcgtcttcgatgcctttgattgggccaggaacaccaaatttgctgtcgtcgtagttaggccagtcgcctactttcttcgcggtcagggtgaagttagcaccaccaaacggacaggttacagcaatacctggttcatccagatcagggttgccagcgatagcagcggtgatcttatccatgattttcttgccgaaacggaacttaaacactttaccttcgttttccggcgctttcggatctttaacgaccagaatgttagcccagaaggattgtttacgtccaatcatacccagagttttatcggcttcgctgcctttcactttggctttttcgaacagatcgttgtcagagatatactgacatacaggacaaccatcataatcgccgtgggtagacggacagttttcaatgaaccattgattgttctttttgaacgaatgattcaccaggcgaacaaacgccagttcgtcatcagagcggttaggcaggaagcgaatagtcgcagaaccgtttttctgtgcatccagagtgagtttccactctttttcatctttctggaagccggatgaacctttcagagcggcgacttgttcttgcagtttggttggatcttgacgtttaaagaatgacatatgttatttctcgtttaagttaattaaagtttgtttcattaagtttcggtattttacgatttcttcgttactgatttcaactaattttctgtatgcgtttagttttttactaaattcattccagacgaaatccgttgcgatttcatcgtgtttatttatgatgtctaaaaacgagtcgagaatcaagaatgattcataagaaatcaccccagactgtacgagtttgctgatatacgaggttgatgatttgacgctatactgaaacaccgttgagaggggaatacctttcatgcgggaaaattcataaaggttttttacatcgtccacgaaaatattatcaattcgcctcaacttgcctatgtattgacgataaaacacgatcgtatcttcgtctacatccccgacccagaagtcggggttagctaccatgttggagagaagtataagatatatttctttgaatgtaaacctttcggctaactttttgaaaaaatacttatctcttctcttttcgaacgctttttcagtgatctttatttcccatttgtacttgatcgcgtcatacttcccagaaaagtgatttttcatcaccatgtacagtttgtataccgcgatcggtttcaaacgggaattagcgtctgaactgtcaaacggggttttaaatttcacatgaaatcatccagggtttgcgtcgtcgcgtggtctttagccacagaaggacgcagcagattgtttttaatggcttcgtcgctaatcttgtcaatgatcgctttcggtactgttttggacagcatagcataatcaatgctgttttcgtccatccattgtaacgtagcttccatgtaggttgccccctcagaggcaaccagattttcgatatacaagccgacttcggttttgtttccgatttcgctcatattacgccttatcgatcacatcgtacagttcgataagttcgttgttctgttcttcgaacgcggtacgtgcctgttcgtgatacagtttgaacagcttgccgaaggttttgccgtcgataccataatccgttttcgctttggatttgatgtctttgaaagaaccctggaagtgttcgatctgagttttcacgttcgacgcttctttgatcagttctttaaccgctttagcgatgtctgggttttcttgcagtaattctacactcattttgttacctcaaaagtcacttagtttttcatacatacgggtaagtttgcattccatgaagtatttctccatttttgctttgttcccgatttttggagcattgtacgcttcttcgattgccgttgcaacatctttcggaataaaatcaaagtcgcgaagttcttcgttttctctgtagcggatcgcccactcttcgggcatacccacggtcggatcgtccgcttccagccaggcttcgagttcagcagccctgatttgtggggcgcgttctccttcaaccttcgtaacaatatagtcatttcgcattttaatgcaagcgatactatcttttttatcgcccttgatgatcttcatgcgcaaatcgttacgaggtgaaccatatttcggtgtaacccatttcttttgggttggcgaccactgacgcacaccctgatatttttgaagggctgcaaagtcaccatcagcagaaacgatcaggacacgtttaccttcggataccgctttacgcgtcaccacaccgatcacgtcatcggcttctgcgaagtcaacacggatacctttgtacggtagattagcacggatttcatcgtatgtcgggtgaaggaaaccattcaggcgatcccagtcccaatccgatgcttcttgttccatttttcgtttctttttgtagtaccaggctttacttctgcgccaatacttgttatcatcaaaggctagaacaatttcagggtactcgcctttgaatttaaccacattgtgacgaatggtgtcaagcactatgtgacgaacaatttgttggttgatgtcattctggtctttcggcttgaagttgttcatcaacgttgctaccgaaaggtttgaaatatctatacacatcacatcaacaggatcatcgtcattgctcattaagctgttcaggttgaacatacttgcaaatgaagacatttcaatacctcgttgttgttgaatgaaactgattatagtgatcactttttcaaagtcaatagatcatttcaaaaatctgagcgaagcgaaggacacgaacgtagtgagtgtctatgtactgaatgtacgttttaatatttttatattttatatatagagaaaacagtacatttccgtatactttttaaccaatttaactatccgtttcgcttcgctcacggaagcgcttcgcgctgattttattaaataatatagattggaagtaggtttgaaacacctgattcaatcggctataataaatgtattcaatttggagaatataatgactacaaagatttatgcagataatgataagctgtatccagttatgtgtaagtggaaacagcaaatccgtgaaactggtgatcgtaagatgccggatgaactcggtattgcgattatgaacattgctcacggtttggcacgtcgatacaacttcaaccgttattccgaagactggaaaatggatatgatcgatgatggaatttcggcaacgatttccggccttcataactttgacgaaaccaaatatacaaacgtctacggttacatcaacaaggcttgctggcaagcgtttgtaactcgtattctctacgagaagaaagagaacgcgaagaaatacaaatacttcctggaacatgtctatgacagcgatgatactgatatgaccacgatagccgatgaaactttcattcaggatatccatgacaaacttaatcagtatgaagagtccgcgaaaaaaccaaaagataaaatcgaggttgtggacgaatcgccaacattggaaatgtttctatgaaaattaaaattgacctgaacaaaattttagcagatgctaacgacgaaattgatctgcttccttaccttgtgaaattagagttgcagagcttagggattccgattatcatcgaccctacagatgtacgagatccagacttccagataacagaaggtcgtctggactatgtaataaacgccgaaacaatgatcatggagatcacttactatgaacgtgcagcatgaagtaatcgacgaagtacaccaaaaatcagcgctggatcttcgtgaagaagaactggaatccatcaagggtacacgcattgaacaggaagccctacgcaaagcgcaaaagttcatgcggaagaacaaagcggaatggaagcgactgcataaacacgcagagaacgcactcttcgaaggtaacaaagagcagtacgtatacgcgatcaaaaagatgcgtgatatgctcaagcaaccatacaacgatgaactgattgaaacgatgtggatcacttcgaaccagcagttgaaagacctgttcatcatggcttctgaaaaatacggcaaataaaccccttcgggggttttgaggtttatatgaactatgttttaattggggatacccatgccggacttcgccaggataacccctggaacgaagaaaacctgtatgcggtattcaaacagatcgtagagtattgcaaagaacacgggatcacgcgcggcttccatgctggcgacttcttcgacgttcgaaaagcaaccacacaaacgacaatgaattttgttcgtgaaaagctggttcctcttctgattgaggcggggatcactctggatgttcttgtcggcaaccacgattgccaatttaaggacaaaatacgccccaacgcgccacgcgagatactaagtcaatacgaatgctttaatgtcatcgacgaaccgaccacggttgatttaggtggcggaaattcgattgacctgatcccgtggatttgtcaggaaaacagccagcgtatttttgactacatcaaacaatcgaaagctaacttttgtttgggacacttcgaactgtctggttactatttctacaagaacagcaaagccgatcatgggctggaacctgatttcttgaagaagtacgatcgtgtttactctggacactatcaccacgctaacgagggtgataacgtgttttatatcggtacgcctctgactatgagcgcaaacgacgaagacgaaacacgcggattctatgtgttcacgggcaagcctgaattgactttcatcgctaaccctgtgtgtcaccatcgccggatcatgtatccagcacagaaagatgttgatctcgaacagttccgcaactgcgcggtgcgtctgattgtcagtgaaattgatcaggggcttgcaaagttccaaaccaaaattgaagaaattgcctatgaaattaatatcatagacaaagttcaaacagattcggatgtcgataccgactttgaaatcaaaaccgttcgtggtcttatcactgagtatatcgccaacatgcagatcaccgacgatgaaaaagaggaagtgaataagctgatcagcgaactatacgcggaggtgtcaagtgcatagccgttatgatgaatatttcggggcgaatccccgatattctcacctgttgcgtatgttgggaatgaaacacatcatttccacatccgacgaagcaggggaaaccagcgcagtttgtttgaccatcatgaagggtgcatggcattcatcacgaacatggtcaatattcatgcttgatacactggacgacgatactctatcatatagtattgattcatcagttgttcaaatgatcactgaattatgtgaacggattttaaatgaaactaaacttcaaaaaaattaagtatcaaaatattctgtcggtcgggaacaccccgatcgaactggaatttgatacagcaaagaaaaccctgatcacggggaaaaacggtggcggtaaatcgacactgatcgaggctttaacctatgccctgttcggtaagtcattccgcgatctaaaagtcgggcagttggtgaacagcgtcaacaaaaagaaatgcctggttgaactggaaattgaatacgggaaagactcgtacaaagtggtgcgcggacaaaagccgaaggtgttcgagatctggaagaacggtgagaagttgccggaagactccgcagcaggtgattatcaggcacagcttgaatctatgctgaacatcaaccttgtgggcttcaaacaggttatcgttcttggtacagcgggctacactccattcatggaactgaaaacccccgaacgccggaaactggttgaagatttgctgtctctgtccgtcatcagtgaaatggacaagttaaacaagtcatacattcgcggtgttaatcagcagttggatacactctcaatgcagggtaatcacatccagcagcagatcgcaacacaccagcgcttcattgacgaacagcgagcgaaagcaaaccagaacaacgcccgatacaaagagatctacgatagccacgtagaaaccgcaaagaacatcaaagcacagcttatgcagttgcaagcggagattgcggaatcggtgatcactggagaagaccggacggaagatatcaacaaactccgtgacggttattcgcggctctcaatgactgtagaacagtttaaaaagctggaggtgatgtatcagaaaggcggtgagtgtccggcctgtaagcaagcgattaaacccactcctgagcgtatggcggagatcgcagagaacatcaaagcgggtacacaacgtttaaccctgatcaaaaccaaacaggacgagttgcaagggatcatgaatgacttgctgcaacagcaacgcgcactcaatgccctgaaaaccaaatatgaagccctgaaaggtactctgcaaaacgaagttgccaacgctaaacgcgcacaggcgatcatggaacaggcaagcgcggaagtagtcattgatgaagaacccgtgaagcagttgcaacagcaggaagcagaactgaacgaaaaacgacaaggctacgtcaaggaaaaatatattcgtggtattgttacggatatgttgaaagattccggcgttaaagcgagtatcgttaagcgttatattccgtacttcaacaaacagatagcatattatctggatctattgggtgctgattatcagttcactttagatgacgagttcaacgaatcgatcaaatcactggggcgcgatgatttcagttatgcgtcattcagtcaaggcgaacgcgctcgcatcaacttgtctattctgttcacatggcgtgacgtgacaagtaaagtatcaggcgtggatctgtctctgctggtacttgatgaagtgtttgatgggccacttgataaagagggttcattcgcgattaaatccctgctggattctgtagatggtaacgttattgtaatcagtcaccaggatcttgatccgcaggacttcgaccgccacatcatcatgtctaaggttggacggttcacaaaaccatcaatcaaagatatggcgatctcatgttagaacgtgaatttgatttaaagacctctcccgaagtggagaggttttatctccataatgaactattggaagaaaaacatgtagttacaatggcagatgttgaggaagcattcaaagataaccccattgaattgacccgcatcaagaataataaatcttcggtgtggttcctcgaaaaaatctattgacagtaaaacataaataccttaaagtcgcccgtgtactgagttgcacgggtttttattttgaggaacggaaaaatgattaacgaacaaatgtcacacagcgaagcattgaagattttgggcgctactggcgacgaatctaaagccgaactgtcaaaactctttaaacgtgcttctctgcgcaatcaccccgatcgtggtggtagcactgaactcatgcagaaaatcaaccaggcgtatgacgttgcaaccaaaacaaacagcgctggtaaaactttcagtgatgttcgcgcagaacacgcagcaaacaaaaaagcatgggaagaaaaatttgcagcgtatttcgcggttgcgaaaaactatttcagcacgaaattcaacgcgcaagaatttgcggaatatttcacgaaattcaccggacaaccaacaacctacacccagacaatcagcgaagttcgcggtcatacggttcacgcaacctatcgtttcacttctggtgatgcgttctttgacttctctttctcctgtcaaccgccgtcagaaggtaaaggtttagcagcgccggacgcgtccgcactgggtagcgtatcagttaatactctggttctggttggtacgaagaaacacaaaatggcaagccgtgattaccaatggggcaagaacccagacaaaatcacgccggaaagcctgttccctactaagaaactggaatccatctttagcccgactaagaaggatctcaagttcaaacgcgcggactacatgacatcctttgcccgtatcctgggtgcgaaggttagcggtaacgatgttattgttgatgttggacactataaagttcacttctaccgtcacgtattcatgcgtaaaggcgcgtatgtgttccagtatgttgttgacccaacggtgaacaaattcaaacctgctgaacgtctgaaaggtactatgctggaagatgaagacggtgcatgtctggatatgatcatcgacactttcaaagaaatgcagaaagtgaaaccagacgcaagcggcatcgcagcggtaatcgaccggatgaacgcagagtttgcagcggggcatcgttcagcatcttttgttaaacgtaccgcacagcaagcagcagctccagcgccggaagagaaaccaaaacgcaccgttaaccgcatcaataaagatgactatttcaacgcactgaaacaagcgggggcaaccttccgcagtaactacggtgagtttgataacggcgcgggtttgactttccacttcaaacgcgagatcagcaaccgtaaaggtttctggagtttcagcagctttgatttcatgcactccggtcagaaacatgtggaatggttgaaagatatcgacattgacgaggatagcaaaggcgcaagtatcggtttgctggttgataccctgaaacaacttcgtggtgttgctgactggtacacagcccgtaagatcctggaaggtatgcgtgataacttcaaggctggtaaattctccgcacctcatgtgaagaaagaagccgaacagaaacgcactgaaacgcaagctaaggacgagttaggcgcacagcctacgaaaccacaggcagcgaagaaagaatccccagcggttgataaggcgcatcaggcacagatggatcgtgagaagtcacagatgaatgcaaccattcgttctatgctctctgccctggttaaagccggacgcaaagacacaccggaagaaatcaaaaaagcagttgatgaagcaatcgctctttggcgcttgaaacactaactggttatgctataatgggaactgttgaaaagcagttcccttttttatgaggtgagtatgattattcaggtatcggttcagggcaacactctgacagtaacaaattccattatgaccgctatggctgcatgtcgtgatcatgtgatgtcaaaccctccggtaacggaaattctggaaattgatgtatgggaagacggtgtgatcgaagaatcctttggtttcactccgttagaggaagatttacgcaaaatggaacaatggctatggcaaactgtaccccaatgaaactaccaaaacacacaaccctgttaacccgcgaaaaacttcattctgttgaatggagtccgttagatgtgatggtgttcgatctggaatccaaaatcattaacgcgcatgttaacggattgagtatcttttctgttgaatttgaaaagattcgcgggtataatgaagcctgtaaagacaaattgcgtgtcatggttgaagctatgggctacatcgtgactattgaagacaacaaaatgtggattgcgctatgagcaaagtaaaagcagttttcgccgttggtcatgatatgtacgaagtggactatgctttcggttatgaacagggtttgccgtggggccactgcaaagaggatttgcagaacttcaaagcagaaaccgcaaatagcgtcctgatcatgggtgcgaacacttttacttctctgcctggtaaattgccagggcgagttcattgcgttctgtctgcatccggtcaacgtttggtaacgaagaacgggaataccgctgattacatcattcacggcggcgggttgtctgctgcaatcgacgtgatgaaagcaacgcatccagatcgtgatgtgtgtctcattggtggtaagtggttgcttctgcaagcaatcaataatacactggttgatgaagtggttgtgacccacatttacggacatcatgcatataatgcaccagcttttaaacgtgatgtttcgttcacggttcctgaattctgcgaagcggttctgaaatatgaactgactgatttcaaaattcaacagatcgaatcaaacgaacgagtcagaaaaattatcgtcgatcgacatacgaaaaaggcataaaatgaaacaatatcttgatatcgtcaacaccgttctaacacacggtactgaatcaaccgatcgtactggtgttggtacactgcgcatcttcgggatgcaagcacgttggaacctcgcagaaggtttcccagctactaccagcaaacagctattcttcaaaccgtgtaagcatgaattacaatggttcctcgaaggttctaccaacgtggaaacactgcgtaaaatgacgtggggtgaagatagcgataagcggacgatctgggacgataactacgaaaatcaggctaaagcgctgggttatacgcatggttatctgggaccgatctacgggcatcaatggcgctcatttggtgcggaaggttcttattatggtgttgaccagattaagaaagtcatcgaacaattgaaaaccaaaccagacgatcgcgggatcatcgtttctgcctggaacccgatggatctggatgatatggctttgcgtccgtgtcactgtttcttccagttcgtcgtaatcaacggtaaactgtctctacagtggtatcagcgttcagttgatgtcttcttagggttgccgttcaatatcgcctcatacgctctcctgacgcatattatcgctgatatttgcgggtatgaagtgggtgatctggtttggactggcggtgatgtccatatctacaaaaacgcagtagaacaagcgaaagagttgttgaagccggaacgcgcaccgcttccacttccgaccctttatatgccgaaggtaaatagcttacttgatttggatcaagaattctttgactccatccatttgaaagactataatcaccacggctcgctaaaagcagctatggcagtataaacaagggggcgaaagcccctttcttaacaaggtaagataatgagtgatattaaaacagtagtgaagtcttctggcgtaagtcaaacgttcgaaaaagaaaaactgttcaaagtccttaattgggcgagtattggaagaaatattgatgttaacgcattccttgaaagtgtcgttgacctgcttcgtgatggtatgactaccaaacagatccaggctgtagcgatcaagtatgcagcggatcgaatctccgcaaaagaacctgactggcagtatgtagcggctaacctcgaaatgttcgcccttcgtaaaaccgtttacgggcagtttgacccgatcccgttctacgaacacatcactaagctggttgaggctggaaaatacgataaagaaatcctgacaaaatggactcctgttgagattgattatctggaatcaaaaatcaatcacgataaagattttgaattctcgtatgctggcgttcagcagttgatcgggaaatatctgttgcaggatcgcacgtccggcgacatctacgaaacaccacagtatgcattcatgctgatcgcgatgtgtctgcatcaggacgaaaaacacgctgataaaatcagtcatgttgttgacttctataacgcgatttcggatcgtaaactgtcattgcctacgcctattatggcgggtgtgcgtactcctacgcgtcagttctccagttgtgttgtaatcgaatcgggtgattctctgggttctctgaacgctgttacgtccgcgatcgtgaagtatatctctcaacgtgcgggtattggtgtcaacgccggacacattcgcgctatgggttcaaaaatccgtggtggtgaagcagtacatacaggcgttatcccgttctggaaacacattcagacggcggttaaatcctgttcccagggcggtgttcgtggtggtgcagcaaccctgtattatccgatctggcatcttgaagttgaaaacctgctggttctgaaaaataaccgtggcgttgaagaaaaccgtattcgtcacctggattatggcgtacagcttaacgatttgatgtataagcgtttaatcaataacgattacatcactctgttcagccctgacgttgcgaacgatcgcctgtatgacgcgttctatcaagcggatcagactgagtttgaagaactgtataccagtctggaaaaagacccaacggtacgcaagaaacgcatcaaagcggtagatctgttccagttgcttgttcaggaacgcgcacagaccggacgcaaatacattttcaacagtcatcacgtaaaccagcagggtagtttctctgttccggttcgtatgtcgaacctgtgctgtgaaatcgcgatcccaacttcaccgctggatgacgatgataaactggctggcgaaattggactgtgtacgcttatggcgatcgttctcgataatgctgatataagcgaattcccagcccttacacgcatcgcagtacgcgcactggataacttgcttgattaccagaactaccctgttgcagcggctctgaaagctaaacagcgtcgttctctgggtgttggtatcaccaactatgcatcctggctggcaagcaactattgcgactactccgaagcatatgccggaaacgttcatgagttgatggaagcgtttcaatttaacctgctggttgcctctatggaactcgcacaggaacgcggtgcatgtggactgttccacgaaacgaaatatgcacaagggctgttgcctattgactggtactgcaaaaacgttgatgaactggcatcacctgtgtataactgcgattgggaatggttacgcggtgaaatcaaaaaacatggcttgcgtaactcaacgctttctgctttaatgccttgtgaaagtagctcgcaggtaagtaactcaaccaacgggattgaacctccgcgcggccctgtgagtgtgaaatcttcgaaagaaggttcattcaatcaggtagtaccaaaccagaataatcagattgacttctatgattatctctggacaatggcaaaacgtggaaacaaaggttatctgtcgcacgtagcggttatgcagaagtttgttgatcaggctatctctgcaaacaccaactatgatccggctaacttcccagatggtaaagtgaaatctgaaatcatccttgaagatctgctgtatgcaaactatttcggcatcaaaacgctgtactaccacaacacccgcgacggtgcaggtgaggaagaagcggaagattgcgaaggttgcaaaatttgattcaatgccccttcgggggctttttataaggtaaatccatgttaactgtaatgaacacaaacccagatcacaaacacttagaacagcctatgttctttggtgaggatacgggcgtagcacgatacgaagaacagaaacaccgtgtattcgaaaccctgactgaaaaacaactgtcattcttctggcgaccggaagaagtggatctgtcgatcgaccgtatgcagtacgcgaaaatgccggaacacgaaaaaatcattttcgattcgaacctgcaatatcaaaccctgttggataccattcaggggcgcggccctaacctggctttcctccctatcgcttccgatgtctcgatggaaacgtggatcgaaacatgggcgttcagtgaaacaatccatagccgcagttatacgcacattcagcgcaacctacacatcgacccgtcaaaagagttcgataaaattctgcgcaacgaagcgatcatgaaacgttcggcttccatgacaaaatactacgatgacctgatcgcagaatgtcacgaactgaaaaacattgtgctcaaaatcgaaatgttaacgtcccacggatacccagacgaatcgatcgcagagtacgaaaagaaacgcaaagagcaaatgcgtaaatgcaaaatcgctctgtatctgtgtatgcacgctgtcaacgctctggaagcgatccgcttctatgtgtcgtttaccttcacgttcaactttgccgaacaaggtaagatggaaggtaacgcgaagatcatgcgtctgattgcccgtgatgaagcacttcatcagaaaggcactcaaagcaagatccgactctggcagatgggtaaagatgacccagaaatggcggaaatcgcttaccagtatgaagaagaagcgacaaagattttcctggaagtgtacgaacaggaaaaagaatgggctgaacacctgttctctatcggtgatgtagacggcgtatccctgaaaagtacgatcgcttatatcgaacacctgacagatcagcgtatgcgcgcggttggcttgcagtctccatttaaaccaacgccgaacccgtatccgtggatgaacaaatggttgaagtctgacaacgtacaggtagccccacaagaagtagaagtgagttcttacctggttggcaacctcaacaccgagatcagcgacgaagcctatgcaaaatggcgacaaaaatacgcttgattgtcgcgtcgtaaacaagtataaaggtagttgggatgtcgatattcagagaggtacgaaattcggtaatcccttctacaagggaacacgggctgaaaacatcatgaacttcatcccgtatttccaaaacttgattcgaactggcgtgatcacaatcgacgaactgaaagcattggacgggaagcggttaggatgtacatgcaaacctctaccgtgccacggtgattatattgctcactgcgtcaatgtgttgaccggaaaggtgaataagttggatatataatggacgatgtaacatttggtgtaatatttcctttgcgtctgggttcagacaaaaggatagaccggagttttgttaaatgtggagaattccggcattgtgtgtattttattgaaatcgacggtcggatagtgtatgttggaaaatgtcgtgatttgtggaagcggttagacacataccgcaattcgaaatactggcgggaagcaaacccccagtaatattctgaaaaccgcacgtctggaaatggcaatcaaaaaacgtaagcgtgtaaatcttatcgtgacaacacacgatgaagacacatatcatgattttgaaataaacatgatccgaaaaatcaatcctgaatggaacaaacagcactatgacaaagctaaccaaaaatcagaaa

SEQ ID NO: 35 - DNA, 178077 bp, Unknown
  source: /note="Description of Unknown: KP2-9a Bacteriophage Sequence"
atccttcggtaaagggtatgcgtccgcattcacagagttaaccaggtgttgccattgacgcgtaaaccagaggcggtcatatttgtctttaggtatgtgacgacctgcaacatacttaacgatagggtgattttctggcaacgtgtccagacgttcgcagaactgcaattcaggaatatatttcttttcttccttcggcggttcttcgtgcgtctgttttaaatctttacgatccttgaaagattccatcaaatacgcggtataatcatccgggtaatagtctttcagaaacacagaaaacggcttgctgtagttgcagttaaaacaaccacacatcatgtgtgtgcctcgttttgacgggaatatccagaaacgttttttgtgcttatccttcatggagtcgccacaaatcggacaacgggaatggatactgaattctccaccccgtcgaacgatttcgctttgtggtaatgatcccatgatacgagttgcgaactctatatcaagatacatgtttacctctatcggctaacttctttctctgtgccgtctaaagtgattttccattcatagaatatcttataaaacggataaggtctaggaatatcaacacccgatgatgtttttctttcgttcgtgtacacgatcgctgtgtcgctcatgtacttgatacggataggaaaccaggtgtaattgttcgcagtaacccagatccgataattcaatggcggtaatggtttcattcttcactcttcatgattttacgtttgcgtttatgcggacgtgtagaacccagaaccttcggccctttgttcgtgatcgcgcctgtagtcacacccgaagcaatattatccacacttccgcctgaatcacctgcaaccatttcttcgttgagtctttcgcgaagttctgggaggttcatcatgatttcttcgtgatcttgctcggtcaggttccagcggctccgtaacgagtcataagcacttgtaaggttcatgaacccagacatataaggaaccgcgtttaaacggcgcttgatgtgtctcacagagcgatggaatggggaatatgcttccagttcttccttcgttttcgggtttttcaatacttccccttgaccgtcgatgatacccagcttgtaagccgtccattcagtccagggctttttcagtaggcgaatcattcgcacactgtaggttaaatccatgtttttgattaattgatcgctcatagtctttactctattgtgaaagtgaaaaggttttgcgcgggttctggctccggttcggggaattccatacagacaacttcacacatcggtttcacgcctttccattcttccagataatatccggtatcaatgccgcaacctggttgcatttcaaggccagtttcatcaagaaactttttgcatttcgatgttgtcgttgattcgtcctgttggaaataacgccgtccagagtaacgaaaattcgcggacatctgcgggagaatgaacgtacccgcacgggcaatctgtgaagcacgttcaatcactttatattcaaattccgcgcccgtatacttacccttaaaattggatgtctttatcttgccgaaaggaggattgctgatcgccatatcaaacagagtatcaaactccgtcgttaacgcgtctgcgttaatccaggtcgcttccggtacgatacgcttacccaacttatagtatgtatggtttaactcaacacagacgatttcacgcggtttggcgtacatcatcatatgaatcatcgcgaaggatagtccaccgatacccgcgcacaggtcaacaacgcttccactggtacaagcatcaatagtgaaatcgcgagcaagtccgatcggggtaaagaatgcacccagttcagagttattcgtaaatgcaccttcatggaagttttcgataatgaataatttttcgtcgtaggttagcgccttgtcagactccaccagatccattatcttgttgtgttgcttcgtttccgctttcgttaactttgccattgtcccagctatacagtaatgttgattcattagggtagaattcccacccgtccacgtatccggtttcccagtcagtagtttgttcaaaaccacagatccattcgtacacacctggcggcagttctacggaatcaggaagcccgatatcttccgcactgcgtccacactcaaaaaatgcatcgtgaatgaacggacgagataataccgtaacataaccttcatcgtcaacagctacgatccagcgcgaactgtgaggactatcgaacttcggttcttcttcgtctgcatcagcttttatttcagccttacaaaaatctaaattcatcatttcactaaaccttctttaacgccctctttcatggctttcagaacaccgataaaagcgtctttgccaccgatagcgccgatgataagcatcaggacaccaacacaacccgccaaaccgattctgaacaggttccatgcaaacgggatagccagaagcaccaaccacgggaacggaaatcccataagtgcgtttagaaccagtaagataaaagcgattgcaagtttcatgatgtcctcctttgtttgtttagaataaggtatcacctttcgtgaaggattgcaatacctatagatacaaaaaagcccctttcggggcttaatttttatgctttgttgataagataccgaagaacgtttttggcctgaacttcgttacagcagagtttgaattctgggtcgattgggaggaagccccagaggaaatcaacgctaccttcaacatctgctttcccacttttcagcatttcaaccagcaaacctctgtttactacgctgttcactactgcatcgaaataacccgcgctgaaatccagttctgggttcatcacttcgtcgtatgggttgttcagtaagttcatttggtatctcctttaatccgtttcgttgtctacgggagtcatattatcacaatcataactcccgtcaacccctaatcaggattattttgcgttttttgcaatccagagagtcagtttagggaatacatttgccattgccaccacaaacagcacccagaaagccagcttaatcacaccgatcacgatcagaggtgcaaacacaagccaccatgaagcatttgccataaccccgattgctgccagtttcagagacaggaggatcaggaacacaataacgagaatctttttcatttcactatacctttggagggggccgaagccccgttaaaattgaatgtctgtactgtttgctacttcggctaacttactgcttcggttagtctcggcttgttttaccatagcaccttgtgcttcttcaagcgttttcggcatctgacgacctttataatcagattggaacccgatatcgctgttgtcggtatccatccagcgttgattacccttgcgcacttcgagtttgaagtggttaaagtggttcttatcgccgtaacgggatttgatctgcttgaacaactgcaatccctgatcagctaactcgtcggtctcaatcacagctaacataaagtcagcggtagctggaagaccagcagattcggcaacgtcgcccatgctgatatcagaagcatcccacgcggcgcgggtagtctgcgcaccagtccacattacggtattcgtttcaacagccaaaccgcgaagttcttcggcaatcgctttaaccaggatgtatgtgttttccgccccgcgtacacgggtagaagcacagatccccaggtagtcaacaataatcacatcaggtacgaaactcttcttcaatttaagctctttaatcagcgctttgaagtggttcgcgttcgcccctgctgttgggtattgcttaacgattaaacgcccgaccttcgactgtttgaggcgttccatacggttcttatagtccgcataggtgatgtttccgttgtcgatatcgtccatcgcaacatcaagcaggttagcgtcaatacgtttagaacaaacgtgttcagccatttccatactgatatacaggacgtttttacctgattgcaggtaatcagcagcgagagaacaaagccccagagatttaccaacgttaacaccagccattaagatgttcaatgttccacgttctgcgccgcctttagtaatggcgttcaggatcgggatattgaaagcaatcttcatcgctttggactggtaaagcatccagcgtttttcatagtcttcgaagtaatcatgaccgaccgaactatcgaagctaatcgctaacgcttccgccatgatgtcagggattgccccaacgtcagggattttgttgttgcgttcgccagcaggtttttcagcattcgcctggatctcaattgcacgggacagagcgcgatacattgccttgtcacgacaataggtttccgtttctttcatcaaccattccagatcttccggcgcatttttcatgctgcggatcatctttttggtatcttcgtagactacatcactcaggctctttttgtccagagctacttctaaagcagtttgtgaaggaatgctgttgaattcctgtacgtgcttatccatcaaatcaaagagaatctgcgcgttcccttcgaaatattcacggcgtaaatggggccacgcctgaacaaaatacgtaccattaaaaaccagatttgaaaatattgtttcgacgatcattattacctcttaaaccagattagcgaacatctgaaagaaattatacagctttactttcaacgccgcccataaggtcttttcaggctttgggagattgggcttgatctgcgcgtagattgcatcgtgaaccagcggaatcagtttttctttgtcttcgtccggcgtactaaattcgactttcaggccgttatcccaatacaccttatggatgtacactaagtgtgcaacatcgttttcatcgttgatcaacagttcttgaataacgtcctgcattgcttcatcaagaatgttttttgttttttgttcaatgtccatgattcacctattaaaagggggcaaagcccccagttgtttattactcttctgacatatccacatcatcagggatatcgtcatcgagatcaaatttatttgacggttctacttcatcgtcagaataaagatcttcgagtgctgccccgtcagtgatctctttgtcaggaatacggtacttatcctgaatagcatcaaggaatggttggtgagtgaacagaggtttccagaactcaatagagttggtttccgattcacgccatttcttttcttccagttcaagttcgcctgtttccgtgttcaggaacgcacgaccgcgccagcctttcgttggagtctgaacgaagttcatttccatagccagatccagaagaccagagaacatactgataccgccctcataggtaacatgaagcgggaatttggatttctctttcacgaaacgagatttctcgatgttcatgatgaagtcataaccgacaacttccgtaccttctttcacctgctgtttgcccaggatgatcgcggtgtctgcggaatacatcagaccagtaccaccggaaatgactttcttgctgtacatttcttgtgtgtcgtatgtgtgacagatacacaccattggaatatccagatccgccaggtaaggcgtaaccatacggaacatacctttaagtgctttagcgcgggtcatgtcctgtttgtcgttgtcagacagggcatcagccagttcttttttactcgcggtgttgcctacagagtccacgaaaatgatcactttgtcgccacgttccagcgcgttaagctggctcacaacgtcatttcgaagttgctcaactgtcgtgatacgagtatacaccacacgatctgggtcaacgcccattgatttcaggtaagacttagttacgcctttctctgaatcgtagaacagacacacagcatcctcattcgctttgaggtacgccgcaaccgtcaccagccccagattcgatttaaagtgttttgacgggccagcaaacagagttaagccggaagtcagaccaccatcgaaagcgccggacagcgccaggttcaggatcggtacacgggttcgagttttggtgatgttattgaaaacatcgctttcagatagaattgacgcagattgactattcgagtttttgatcagttttttcaggagtgctttattagacatttatttttccggtttatatacacgcataatattttcctcacaaatttatataaatggggcatttctgccccgtcaggtcttaccagtcatcaccaaacagagtgttcagggatgcgcgtttttcgtaatcaattttacatgcttccgtgatgttttgcaacgggctaatcacatgtttttcaaataatccgccgtagtctacccacttcaaaatatcttcttcgatctcagttggtaaacgcgtaccggattgccatgcaatgcaatcagcttgccacgggtttttatctcgcaacggcagaaccataaccttttcaccttccataatcggggtgattccttgaataccctttgtatggcggttgaagaacagaacgcctttgatgtggtttggtgtccctttgattgggtatccaaaatcatcacgatattttgagatattgttagcagatgatacaccagctatttctcggtagtcaagtgccttatactcttcctcaaatactttgaagtgttcgtgtaaggattcttcaccttcttgcaggatgcgacggatcgcttctttcaagaactttttaaccgctgtcggtgtactactgcgctgggtttccattcccatgatctttaatttaggcttctcgtaacgggttccttcggagtcccacacgttagccgcatatcgtttctttgccgtccagaaactacccagacctttcgatcccagtggtggcccagaaatgatttcgcgatccataaacatcagatgttcgacgttgttcatgtactcacacagttcgcggtagcccttatcaatgataggttccatgcgttctttactgaacttatccaggaaatcaacccaatggttgttatccctgaacttgctttcaccgccgactttcgcgatcacgttatccatacaaacataaatggagtcggtgtcacagtagcgcacgtatgcgtaatccgtggtgttgcacagttcgttaaggtattcgttaaccttacgttcaatccactgaatagccaactgaccgaacatggtgatcgcgcttgcgtttcgaatatcgaagtaccggaagtgttcattacccaacgcaccataaagggagttgatactgattttacggttaagctgtgcggtgtttgcttgtgcgatcttcttctcacaaactttcttcacggctttaagcatttgcttagacagcgttttcagtacagcttttgattcatcactgaaatcttcgtagaactcgaaatcagggttgatcatttgattgtgcgcgtccgtcaggtgttcaagttcgtgcttaatcagttcgagatttcgctcacccgccatcattcgttttttccacgtcttacgctgatcaaatactttcttgatctcgaccggaatcacgcctttaacatcgcgtcggaacatccacccgttaggagagcagctaaattcatcgctagggcgcggcgcagtcttattgatgtattcgtgcatcggacgcactgcaaagctgttagcgattgtctcagggcttatattcacctgtcggatgatagatggatacagactggttaagtcgaacgatacaatgtaacggtatggagcgacaacaggatctttaacgtatgcaccatcatactgcgttttcgtgtggcgtttattttctgggattactttcttctcttcacgcagagagttgtaaatgatcgcgtcccacgttttaagcggagacataaccccagggaagtttattttcgcatagtacgctacagacagaaccagttcgataaagttgcgtttcccgtcgatatccaacacgcggataacgtcaacgatgttatacgtgatgtatttctggtgatccgcttgacgcagttcagacagtgaaccttcgtaatcaactttgtttttgcctgtttcgaactcagcgattgcgcccagagcgtaagacggttgcggggtgaaactgaatttcttatagagatccattccatccatttgagaaacgccgtaaatctcgtatcccagttgttcattcccataatggtcggttgttgtcttcgcagtcactttcccgaacgggctgaaatgacgaacaacgttttgcccgaagatgttcaggtaacgggtgatgatatacgcgatatcgaatttgttcgagttccagcccgtaacaataacaggtgtccgctctttccagtctttgatataagccgacatcagcgacttttcggtctggaatgaacggtaaacaattttcttcaaatcttcttcgctgatctctttttcggtatcaactttcgacgctacccactcgtctaacccgccctcgaccagatcatacacaaagaatttatcttcaacgctgtcatagtgggtgattgcgtcgatagcatattttgcttcgcgtggatcagggaattcaggcgcggtaacttcgatatcaagtgaagcaatgcggatcttgtcgcgatcgtattcgatttcctttctgtaggaatcggagatatacgccagcctgaaatcatccatgcctagcgcttccatgcctacatctttcattcgctgcatccagttttttgcttccttgatgctttcgaagttctttttgatgcaggtcttgccgtaaatgtcgcgatatggcgagtctacacccgccatagcgtgttgaaacattgtaggcgcatattttgttttgcgaacctgttcgcgtccctcagagtcaatgaagcgctcgtagatgtgatcgcccatttgctcaacggatagataaaattcattcattacggttttctttctccgtgtttaatcgtgacaggaatgataccccagccagcttgatcagatcaagcgagcgttgcgctaatttgtgatagcgttgggtgtcaggccgatttagttgttcaaccagcacggtatattcttccatgatgcgggtatagaacttagggaagtgatcccgcgcgtatgcgtaggtgcgcagatcagagagattgcaagtaagagacagtttgatgtcttcgctatgcagacggttgatcaagtgatcaccggattcaatagctttgatgatttcttcaatacgaattttcataatttagtcctcacaagtggtgtacaaccaatataacaaagcccctgcatttctgcaagggcttttgattaatgtccgatccggtacttgtatttcaaagtccattcagctttttgtgcgtgagtcaatacgcggaagttgttctcttcggagaatttcagatccggcgtaaggatggaaaccataccccactcttccagaagtcgcgcaatgttattgcggcgcagttcgtcatcttcggtcatgtcaacctggcgaccgtccagcttcaacagttctttgaagtgtacgataaaataacgcccttgtttctgtaggatgtggcaagactgccacagcattttctttttgttatttgcgatcccgatacgggtcagcgtttcgcgaattttcaggaaactgtcatcgctggacagtttaatttcgagcatgttcatacatcaccatttctttattagttgttcaacctttttctggtcggttttatttttcacaacatcagccaacacagataaagcaactttcatatttttccgcttccactcgtccagtttttcaagctgtttgagttcttcgtaatattccattgctatacgtgtatttacaccgtatcgtttttggagaacatgaaggataactttcatttcgttatcttcggtgagtttagcccacgccccgaaccgcttacctttgcgcaccgtatgcaggtaataatcaaagtgcgcctggtctggtaaaccggaaccgatcatattcatcgtgtatgcaggtatcagcgtttcgatatgctggctcattgcattgtcgatgaaaaacttatcgtatgaatcaagggcagagatccgtaatggtgtcttcccgttgttcagttcttcgagcaccataaacaaggtgttttccttgtctttggtgtactctttcacaagttcttcgatcttgtcccagtctttagaacgccaggccgcttcatgttcgttcagttcttcttcatcgagaaaagcagccagtgacatttttaagcctcccacgcgagggtaagcattaagcccatgaacaggtattgcaggtgaatctctttgttcactgccagcccgtactgtgcgttgttttcgcctactgcctgaatgagtgcaaccttagattcgttggtgacgatcgggtataccgcatccagaagtttagccaggaaagtttcatactcaggcgcgtacttgattgcttcggctcgcagtgctttgaagttcttcgctttaagcccctcaatcactggtgtgatgtccgaaccaacaatctcagacagaataccagcatcaattttgccacgcttagaatagaacccaagagctttaacgatggatcgcgcgtctgggtagtgcttcttaacgaatccggcgatcacctgctggtcatattcgattttctcgatttcgaggataccgaaacaacgtttgatcatttgcttcatcagttcaacgcgttcttccttcgacggggaaccgaacttgactaccggacagcgggagatcagcgcagggtgaatcccgttgatgttgttcgcggtaatgataacagtaacgttcttgctgtacgcttcgataaagctacgcatgtgcttctgtgcttctgccatgccagggcgatcgaattcgtcaatcagaatgattttaccgcctttcttctgcgtcatagaggacgcgtaacgatccagttcgttacggatgaagttcacaccacaatcggaaccgttgacaaacatcacttccgcatcaacttcgttagccagaaccagcgccagcgttgttttacccgtacctggggaatcagaaaccagagtcatgttgtcgatgcgtccagacttgatgaagccgcgcatcgtcgctttatcagcagcagggagaatgcattcatcgatcgtcgtcgggcgatagcgctgatcccatgcgaattcttcgggagactgggagattttgccgtatttggtttcgattaactgtacgttttcactaagttccataatattaccttcaattgattatcaaaaaggggcttaacgccccttgtgtactactttgtttatcttacttgaactggctggttgcttcaagtaccactacatacgcaacgccgttttcggacgagaatttcgcagcgccgcgagaagagatttcaactttgtaatcgctgttgatgaactgcatgttgtcaatcttcatatcgaagttgaacatgttatcaccttcgtaatcgcccacttctacagagaaggttgactggctttctttacttttcgcggtgattaccagcttaccgttgattggctcaacagacaggtcggtcagtttcatcatgcgtgacgctttgatcagtttttcgaaatcgttcgcgctaatctggaaaatcagatccgcaactggcatttccagacgcttcttaggctgtacgattgtggttggatcgcttgaacgctcaacgattttcattttctcaccacgaatgacgatttcgccagtggacagatcgtgagttacttcggcatcagtgcctacaacgttcagcatgttcaggaatgagttcagatcgtagatacctacatcttcgtcaattacgtcagaaatcgttgcttctgcgtaaactacgctgttaatggatttcgtcataatgaacgaaccctttttcagcattacagatgggttgatctgggagaagtttttcaggatgtcgatcgtttgtttagagaatttcatattcaacctatagttttcaattaggcaaaagtgccgttaatcagggattctacaacgcgatccgccgcattgtcaaggaattctttgcttttggattctgtgattttcgtacccgcttcgcgagcgtcgtgaatcagtccggtatgtactgcgcttactgcttcgtcgatccgtttgtaatgctcaaagcgttcagcttgaggcatcgcacggaaaatctctttgatgttttccggcactttacctacccaggatttgcgaacgttgttcagatgcgctacatatacgttttgttctaaattcatatctacctcaaactttcaaaattgggggctttcgcccccgtaagcattacagatccagcagtttatccaggtcgtcatcaccggaaccaccttccaggtcaaacggaggtgtattatcatcttccggtacgcttccgcctacgttcagttgacttacgccaccagattctttagcaccgttggaatggttgccattatcgaagtttttcagttcgttgtcaaatgagttcagttctgaatccagatccacaccagcgcttgcgccagcacccattgcagcaccaccgaatactttggtgaacttcgcggtcagttccgcagttggtttgaactggtctggagcagtgattggacgcagatcgctcataccttcgaagatttctttctgacgcgcttcgtcttcgatgcctttgattgggccaggaacaccaaatttgctgtcgtcgtagttaggccagtcgcctactttcttcgcggtcagggtgaagttagcgccaccaaacggacaggttacagcaacacctggttcatccagatctgggttccccgcgatagccgcagtgattttatccatgatctttttaccgaagcggaacttaaacaccttaccttcgttttctgggtgcattggatctttaaccaccagaatgttcgcccagaacgattgtttacgtccgatcatacccagtgttttttcggcttcgctgcctttcactttcgctttttcgaacagatcgttttcagagatatactgacacacagggcaagcatcgtaatcgccgtgggtagacgggcagttttcgatgaaccactggttattctttttgaatgaatggttgacgatacgcacgaacgccagttcatcatcagatcggttaggcaggaagcggatcaccgcagaaccgtttttctgtgcatcgacaccgagtttccactctttttcatctttctggaagccggatgaacctttcagagcggcgacttgttcttgcagtttggttggatcttgacgtttaaagaatgacatatgttatttctcgtttaagttaattaaggtttgtttcattaagtttcggtattttacgatttcttcgttactgatttcaactaattttctgtatgcgtttagttttttgctaaattcattccagacgaaatccgttgcgatttcatcgtgtttatttatgatgtctaaaaacgagtcgaggatcaagaatgattcataagaaatcaccccagaaagtacgagcttgctgatatacgaggttgatgatttgacgctatactgaaacaccgttgagaggggaatacctttcatgcgggaaaattcatacaggttttttacatcgtccacgaaaatattatcaattcgcctcaacttgcctatgtattgacgataaaacacgatcgtatcttcgtctacatccccgacccagaagtcggggttagctaccatgttggagagaagtataagatatatttctttgaatgtaaacctttcggctaactttttgaaaaaatacttatctcttctcttttcgaacgctttttcagtgatctttatttcccatttgtacttgatcgcgtcatacttcccagcaaagtgatttttcatcaccagatacagtttgtataccgcgatcggtttcaaacgggaattagcgtctgaactgtcaaacggggttttaaatttcacatgaaatcatccagtgtttgcgtcgtcgcgtggtctttagccacagaaggacgcagcagattgtttttaatggcttcgtcgctaatcttgtcgatgatcgctttcggtactgttttggacagcatagcataatcaatgctgttttcgtccatccattgtaacgtagcttccatgtaggttgccccctcagaggcaaccagattttcgatatacaagccgacttcggttttgtttccgatttcgctcatattacgccttatcgatcacatcgtacagttcgataagttcgttgttctgttcttcgaacgcggtacgtgcctgttcgtgatacagtttgaacagcttgccgaaggttttaccgtcgataccataatccgttttcgctttggatttgatgtctttgaaagaaccctggaaatgttcgatctgagttttcacgttcgacgcttctttgatcagttctttaaccgctttagcgatgtctgggttttcttgcagtaattctacactcattttgttacctcaaaagtcacttagtttttcatacatacgggtgagtttgcattccatgaagtatttctccatttttgctttgttcccgatttttggagcattatacgcttcttcgattgccgttgcaacatctttcggaataaaatcaaagtcgcgaagttcttcgttttctctgtatcggatcgcccactcttcgggcatacccacggtcggatcgtccgcttccagccaggcttcgagttcagcagccctgatttgtggggcgcgttctccttcaaccttcgtaacaatatagtcatttcgcattttaatgcaagcgatactatcttttttatcgcccttgatgatcttcatgcgcaaatcgttacgaggtgaaccatatttcggtgtaacccatttcttttgggttggcgaccactgacgcacaccctgatatttttgaagggctgcaaagtcaccatcagcagaaacgatcaggacacgtttaccttcggataccgctttacgcgtcaccacaccgatcacgtcatcggcttctgcgaagtcaacgcggatacctttgtacggtaaattagcacggatttcatcgtatgtcgggtgaaggaaaccattcaggcgatcccagtcccaatcagatgcttcttgttccatttttcgtttctttttgtagtaccaggctttacttctgcgccaatacttgttatcatcaaaggctagaacaatttcagggtactcgcctttgaatttaaccacattgtgacgaatggtgtcaagcactatgtgacgaacaatttgttggttgatgtcattctggtctttcggcttgaagttgttcatcaacgttgctaccgaaaggtttgaaatatctatacacatcacatcaacaggatcatcgtcattgctcattaagctgttcaggttgaacatacttgcaaatgaagacatttcaatacctcgttgttgttgaatgaaactgattatagtgatcactttttcaaagtcaatagatcatttcaaaaatctgagcgaagcgaaggacacgaacgtagtgagtgtctatgtactgaatgtacgttttaatatttttatattttatatatagagaaaacagtacatttccgtatactttttaaccagtttaactatccgtttcgcttcgctcacggaagcgcttcgcgctgattttattaaataatatagattggaagtaggtttgaaacacctgattcaatcggctataatgaatgtattcaatttggagaatataatgactacaaagatttatgcagataatgataagctgtatccagttatgtgtaagtggaaacagcaaatccgtgaaactggtgatcgtaagatgccggatgaactcggtattgcgattatgaacattgctcacggtttggcacgtcgatacaacttcaaccgttattccgaagactggaaaatggatatgatcgacgatggaatttcggcaacgatttccggccttcataactttgatgaaaccaaatatacaaacgtctacggttacatcaacaaggcttgctggcaagcgtttgtaactcgtattctctacgagaagaaagagaacgcgaagaaatacaaatacttcctggaacatgtctatgacagcgatgatactgatatgaccacgatagccgatgaaactttcattcaggatatccatgacaaacttaatcagtatgaagagtccgcgaaaaaacccaaagataaaatcgaggttgtggacgaatcgccaacattggaaatgtttctatgaaaattaaaattgacctgaacaaaattttagcagatgctaacgacgaaattgatctgcttccttaccttgtgaaattagagttgcagaacgtcggggttccgattatcatcgaccctacagatgtacgagatccagacttccagatagcagaaggtcgtctggactatgtaataaacgccgaaacaatgatcatggagatcacctactatgaacgtgcagcatgaagtaatcgacgaagtacaccaaaaatcagcgctggatcttcgtgaagaagaactggaatccatcaagggtacacgcattgaacaggaagccctacgcaaagcacaaaagttcatgcggaagaacaaagcggaatggaagcgactgcataaacacgcagagaacgcactcttcgaaggtaacaaagagcagtacgtatacgcgatcaaaaagatgcgtgatatgctcaagcaaccatacaacgatgaactgattgaaacgatgtggatcacttcgaaccagcagttgaaagacctgttcatcatggcttctgaaaaatacggcaaataaaccccttcgggggttttgaggtttatatgaactatgttttaattggggatacccatgccggacttcgccaggataacccctggaacgaagaaaacctgtatacggtattcaaacagatcgtagagtattgcaaagaacacgggatcacgcgcggcttccatgctggcgacttcttcgacgttcgaaaagcaaccacacaaacgacaatgaattttgttcgtgaaaagctggttcctcttctgattgaggcggggatcactctggatgttcttgtcggcaaccacgattgtcaatttaaggacaaaatacgccccaacgcgccacgcgagatactaagtcaatacgaatgctttaatgtcatcgacgaaccgaccacggttgatttaggtggcggaaattcgattgacctgatcccgtggatttgtcaggaaaacagccagcgtatttttgactacatcaaacaatcgaaagctaacttttgtttgggacacttcgaactgtctggttactatttctacaagaacagcaaagccgatcatgggctggaacctgatttcttgaagaagtacgatcgtgtttactctggacactatcaccacgctaacgagggtgataacgtgttttatatcggtacgcctctgactatgagcgcaaacgacgaagacgaaacacgcggattctatgtgttcacgggcaagcctgaattgactttcatcgctaaccctgtgtgtcaccatcgccggatcatgtatccagcacagaaagatgttgatctcgaacagttccgcaactgcgcggtgcgtctgattgtcagtgaaattgatcaggggcttgcaaagttccaaaccaaaattgaagaaattgcctatgaaatcaatatcatagacaaagttcaaacagattcggatgtcgataccgactttgaaatcaaaaccgttcgtggccttatcactgagtatatcgccaacatgcagatcaccgacgatgaaaaagaggaagtgaataagctgatcagcgaactatacgcggaggtgtcaagtgcatagccgttatgatgaatatttcggggaaaatccccgatattctcacctgttgcgtatgttgggaatgaaacacatcatttccacatccgacgaagcaggggaaaccagcgcagtttgtttgaccatcatgaagggtgcatggcattcatcacgaacatggtcaatattcatgcttgatacactggacgacgatactctatcatatagtattgattcatcagttgttcaaatgatcactgaattatgtgaacggattttaaatgaaactaaacttcaaaaaaattaagtatcaaaatattctgtcggttgggaacaccccgatcgaactggaatttgatacggcaaagaaaaccctgatcacggggaaaaacggtggcggtaaatcgacactgatcgaggcgttaacctatgccctgttcggtaagtcattccgcgatctaaaagtcgggcagttggtgaacagcgtcaacaaaaagaaatgcctggttgaactggaaatcgaatacgggaaagactcgtacaaagtggtgcgcggacaaaagccgaaggtattcgagatctggaagaacggcgagaagttgccggaagactccgcagcgggtgattatcaggcacagcttgaatctatgctgaacatcaaccttgtgggcttcaaacaggttatcgttctgggtacagcgggttacactccattcatggaactgaaaacccccgaacgccggaaactggttgaagatttgctgtctctgtccgtcatcagtgaaatggacaagttaaacaagtcatacattcgcggtgttaatcagcagttggatacactctcaatgcagggtaatcacatccagcagcagatcgcaacacaccagcgcttcattgacgaacagcgagcgaaagcaaaccagaacaacgcccgatacaaagagatctacgatagccacgtagaaaccgcaaagaacatcaaagcacagcttatgcagttgcaagcggagattgcggaatcggtgatcactggagaagaccggacggaagatatcaacaaactccgtgacggttattctcggctctcaatgactgtagaacagtttaaaaagctggaggtgatgtatcagaaaggcggtgagtgtccggcctgtaagcaagcgattaaacccactcctgagcgtatggcggagatcgcagagaacatcaaagcgggtacacagcgtttaaccctgatcaaaaccaaacaggacgagttacaagggatcatgaatgacttgcttcaacagcaacgcgcactcaatgccctgaaaaccaaatatgaagccctgaaaggtacactgcaaaacgaagttgccaacgctaaacgcgcacaggcgatcatggaacaggcaagcgcggaagtagtcattgatgaagaacccgtgaagcagttgcaacagcaggaagcagaactgaacgaaaaacgacaaggctacgtcaaggaaaaatatattcgtggtattgttacggatatgttgaaagattccggcgttaaagcgagcatcgttaagcgttatattccgtacttcaacaaacagatagcatattatctggatctgttgggtgctgattatcagttcactttagatgacgagttcaacgaatcgatcaaatcactggggcgcgatgatttcagttatgcgtcattcagtcaaggcgaacgcgctcgcatcaacttgtctattctgttcacatggcgtgacgtgacaagtaaagtatcaggcgtggatctgtctctgctggtacttgatgaatgtttcgacggcccccttgacaaagacggctcttttgctgtaaaaggattgcttgatggtgttaacgggaatttgattgtgataagtcatcaggatttagatccagaagattttgaccgacacatcgttatgtcgaaggtcggtcgattctcgaagatggaaatcaagaagtcttaaacttgcagttgtcaaaatgccatcgtttcatattggtggcatcaccaactttagcgcaatgggggcaagttaattgctcccttttcttttgtgtttttctgtctgggttctgagtacaatatggaatatgactgttcaagtaatgcactgtcgattctgtaccgcaatgaggacaagaaccgcgctccgatactacgttgctgtttttatgtgctcgcatgactcctgcaaatgcattcactttcccttcattgcctggcttgtgcttgcagttgtcgaagtgccagcggttcatattacctactaagccggacgtattgcaatgaggacacgtaaccctgttctgttgaagtttggcctgtctcatgcgtaagcgtgtctcttcgctgaactctttttgtttctgggcttcaagtgctttctctttcaaccatccatagcggcggtttgctgtacgcgcagacgatcgagaagtaccgactgtaagcatgttagcagcataaattagtttatggttgcctggatacatcttaactaatagcagatgtgctatgaagtgttgacgtgctgacagttcaaccagattttcgggatcgtccgatcctcccatacattttggaacgatgtgatgtttctctttgtattctgcatccgttccggtagtcatgagttgttcgtaaatcttatgataattcatgatgataaatcctgtttgatagtccgctagatacccctatttaggaacatgattatgttagaaagagagtttgaactgataacaaccccagaaattgagaggttttatctccacaacgagttacacgaaacgaaacatgtagttacaatggcagatgttgaggaagcattcaaggataaccccattgaattgacccgcatcaagaacaataaatcttcggtgtggttcctcgaaaaaatctattgacagcaaaacataaataccttaaagttgcccgtgtactgagttacatgggcttttattttgaggaacggaaaatgattaacgaacaaatgtcacacagcgaagcattgaagattttgggcgctactggcgacgaatctaaagctgaactgtcaaaactctttaaacgtgcttctctgcgcaatcaccccgatcgtggtggtagcactgaactcatgcagaaaatcaaccaggcgtatgacgttgtaaccaaaacaaacagcgctggtaaaacttacagtgatgttcgcgcagaacacgcagcaaacaaaaaagcatgggaagaaaaatttgcagcgtatttcgtggttgcgaaaaactatttcagcacgaaattcaacgcgcaagagttcgcggaatacttcacgaaattcaccggacaaccaacaacctatactcagtcaatcagcgaagttcgcggtcatactgttcacgcaacctatcgtttcacttctggtgatgcgttctttgacttctctttctcttgtcaaccgcctaacggtcaaggtttagcagcgccggacgcgtccgcactgggtagcgtatcagttaatactctggttctggttggtacgaagaaacacaaaatggcaagccgtgattaccaatggggcaagaacccagacaaaatcacgccggaaagcctgttccctactaagaaactggaatccatctttagcccgactaagaaggatctcaagttcaaacgcgcggactacatgacatcctttgcccgtatcctgggtgcgaaggttagcggtaacgatgttattgttgatgttggacactataaagttcacttctaccgtcacgtattcatgcgtaaaggcgcgtatgtgttccagtatgttgttgacccaactgtgaacaaattcaaacctgctgaacgtctgaaaggtactatgctggaagacgaagacggcgcgtgtttggatatgatcatcgacactttcaaagaaatgcagaaagtgaaaccagacgcaagcggcatcgcagcggtaatcgaccggatgaacgcagagtttgcagcggggcatcgttcagcatcttttgttaaacgtaccgcacagcaagcagcagcgccagcgccggaagagaaaccaaaacgcaccgttaaccgcatcaataaagatgactatttcaacgcactgaaacaggcgggggcaacattccgcagtaactacggtgagtttgataacggcgcgggtttgactttccacttcaaacgcgagatcagcaaccgtaaaggtttctggagtttcagcagctttgatttcatgcactccggtcagaaacatgttgaatggttgaaagatatcgacattgacgaggatagcaaaggcgcaagtatcggtttgttggttgataccctgaaacaacttcgtggtgttgctgactggtacacagcccgtaagatcctggaaggtatgcgtgataacttcaaggctggtaaattctccgcacctcatgtgaagaaagaagccgaacagaaacgcactgaaacgcaagctaaggacgagttaggcgcacagcctacgaaaccacaggcagcgaagaaagaatccccagcggttgataaggcgcatcaggcacagatggatcgtgagaaatcacagatgaatgcaaccattcgttctatgctctctgccctggttaaagccggacgcaaagacacgccggaagaaattaaaaaagcagttgatgaagcaatcgctctttggcgcttgaaacactaactgattatgctataatgggaactgttgaaaagcagttccctttttttatgaggtgagtatgattattcaggtatcggttcagggcaacaccctgacagtaacaaattccattatgaccgctatggctgcatgtcgtgatcatgtgatgtcaaaccctccggtaacggaaattctggaaattgatgtatgggaagacggtgtgatcgaagaatcatttggtttcactccgttagaggaagatttacgtaaaatggaacaatggctatggcaaactgtaccccaatgaaactaccaaaacacacaaccctgttaacccgcgaaaaacttcattctgttgaatggagtccgttagatgtgatggttttcgatctggaatccaaaatcattaacgcgcatgttaacggattgagtatcttttctgttgaatttgaaaagattcgcgggtacaatgaagcctgtaaagacaaattgcgcgtcatggttgaagctatgggctacatcgtgactattgaagacaacaaaatgtggatcgcgctatgagcaaagtaaaagcagttttcgccgttggtcatgatatgtacgaagtggactatgcgtttggttatgaacagggtttaccgtggggccactgcaaagaggatttgcagaacttcaaagcagaaaccgcagatagcgtcctgatcatgggtgcgaacacttttacttctcttcctggtaaattgccaggacgaattcactgcgttatgtctgcatccggtcaacgtctggtaacaaagaacgggaataccgctgattatgtcatccacggtggcgggttgtctgctgcaatcgacgtaatgaaagaaacgcatccagatcgtgatgtgtgtctcattggtggtaagtggttgcttctgcaagcaatcaataatacaatggttgatgaagtggttgtgacgcacatttacggacatcatgtatataatgcaccagcttttaaacgtgatgtttcattcacggttcctgaattctgtgaagcggttctgaaatatgaactgactgatttcaaaattcagcagatcgaatcaaacgaacgcgtcagaaaaattatcgtcgatcgacatacgaaaaaggcataaaatgaaacaatatcttgatatcgtcaacaccgttctaacacacggtactgaatcaaccgatcgtactggtgttggtacactgcgcatcttcgggatgcaagcacgttggaacctcgcagaaggtttcccagctactaccagcaaacagctattcttcaaaccgtgtaagcatgaattacaatggttcctcgaaggttctaccaacgtggaaacactgcgtaaaatgacgtggggtgaagatagcgataagcggacgatctgggacgataactacgaaaatcaggctaaagcgctgggttatacgcatggttatctgggaccgatctacgggcatcaatggcgctcatttggtgcggaaggttcttattatggtgttgaccagattaagaaagtcatcgaacaactgaaaaccacaccagacgatcgcgggatcatcgtttctgcctggaacccgatggatctggatgatatggctttgcgtccgtgtcactgtttcttccagttcgtcgtaatcaacggtaaactgtctctacagtggtatcagcgttcagttgatgtcttcttagggttgccgttcaatatcgcctcctacgctctcctgacgcatattatcgcggatatttgcgggtatgaagtgggtgatctggtttggactggcggtgatgtccatatctacaaaaacgcagtagaacaagcgaaagagttgttgaagccggaacgcgcaccgcttccacttccgaccctttatatgccgaaggtaaatagcttacttgatttggatcaagaattctttgactccatccatttgaaagactataatcaccacggctcgctaaaagcagctatggcagtataaacaaagggggcgaaagcccctttcttaacaaggtaagataatgagtgatattaaaacagtagtgaagtcttctggcgtaagtcaaacgttcgaaaaagaaaaactgttcaaagtccttaattgggcgagtattggaagaaatattgatgttaacgcattccttgaaagtgtcgttgacctgcttcgtgatggtatgactaccaaacagatccaggctgtagcgatcaagtatgcagcggatcgaatctccgcaaaagaacctgactggcagtatgtagcggctaacctcgaaatgttcgcccttcgtaaaaccgtttacgggcagtttgacccgattccgttctacgaacacatcactaagctggttgaggctggaaaatacgataaagaaatcctgacaaaatggactccagcggagattgattatctggaatcgaaaatcaatcacgataaagattttgaattctcgtatgctggcgttcagcagttgatcgggaaatatctgttacaggatcgcacgtccggcgacatctacgaaacaccacagtatgcattcatgctgatcgcgatgtgtctgcatcaggacgaaaaacacgctgataaaatcagtcatgttgttgacttctataacgtgatttcggatcgtaaactgtcattacctacgcctattatggcgggtgtgcgtactcctacgcgtcagttctccagttgtgttgtaatcgaatccggtgattctctgggttctctgaacgctgttacgtccgcgatcgtgaagtatatctctcaacgtgcgggtatcggtgtcaacgccggacacattcgcgctatgggttcaaaaatccgtggtggtgaagcagtccatacaggcgttatcccgttctggaaacacattcagacggcggttaaatcctgttcacagggtggtgttcgtggtggtgcagcaaccctgtattatccgatctggcatcttgaagttgaaaacctgctggttctgaaaaataaccgtggcgttgaagaaaaccgtattcgtcaccttgactatggcgtacagcttaacgatttgatgtataagcgtttaatcaataacgattacatcaccctgttcagccctgacgttgcgaatgatcgcctctatgacgcattctatcaagcggatcagagtgagttcgaagaactgtataccagtctggaaaaagacccaacggtacgcaagaaacgtattaaagcggtagatctgttccagttgcttgttcaggaacgcgcacagaccggacgcaaatacattttcaacagtcatcacgtaaaccagcagggtagtttctctgttccggttcgtatgtcgaacctgtgctgtgaaatcgcgatcccaacttcaccgctggacgacgatgataaactggctggcgaaattggactgtgtacgcttatggcgatcgttctcgataatgccgatataagcgaattcccagcccttacacgcatcgcagtacgcgcactggataacttgctggattaccagaactaccctgttgcggcggctctgaaagccaaacagcgtcgttctctgggtgtgggtatcaccaactatgcatcatggctggcaagcaactattgcgactactccgaagcatacgccggaaacgttcatgagttgatggaagcgtttcaatttaacctgctggttgcctctatggaactcgcacaggaacgcggtgcatgtggactgttccacgaaacgaaatatgcacaagggctgttgcctattgactggtactgcaaaagcgttgatgaactggcatcacctgtgtataactgcgattgggaatggttgcgcggtgaaattaaaaaacacggcttgcgtaactcaacactttctgctttaatgccttgtgaaagtagctcgcaggtgagtaactcaaccaacgggattgaacctccgcgcggccctgtgagtgtgaaatcttcgaaagaaggttcattcaatcaggtagtaccaaaccagaataatcagattgacttctatgattatctctggacaatggcaaaacgtggaaacaaaggttatctgtcgcacgtagcggttatgcagaagtttgttgatcaggctatctctgcaaacaccaactatgatccggctaacttcccagatggtaaagtgaaatctgaaatcatccttgaagatctgctgtatgcaaactatttcggcatcaaaacgctgtactaccacaacacccgcgacggtgcaggtgaggaagaagcggaagattgcgaaggttgcaaaatttgattcaatgccccttcgggggctttttataaggtaaatccatgttaactgtaatgaacacaaacccagatcacaaacacttagaacagcctatgttctttggtgaggatacgggcgtagcacgatacgaagaacagaaacaccgtgtattcgaaaccctgactgaaaaacaactgtcattcttctggcgaccggaagaagtggatctgtctatcgaccgtatgcagtacgcgaaaatgccggaacacgaaaaaatcattttcgattcgaacctgcaatatcaaaccctgctggataccattcaggggcgcggcccgaacctggcgttcctccctatcgcttccgatgtctcaatggaaacgtggatcgaaacatgggcgttcagtgaaacaatccatagccgcagttatacgcacattcagcgcaacctacacatcgacccgtcgaaagagttcgataaaattctgcgcaacgaagcgatcatgaaacgttcggcttccatgacaaaatactacgatgatctgatcgcagaatgtcacgaactgaaaaacattgtgctcaaaatcgaaatgttaacgtcccacggatatccagacgaatcgatcgcagagtacgagaagaaacgcaaagagcaaatgcgtaaatgcaaaatcgctctgtatctgtgtatgcacgctgtcaacgctctggaagcgatccgcttctatgtgtcgtttaccttcacgttcaactttgccgaacaaggcaagatggaaggtaacgcaaagatcatgcgtctgattgcccgtgatgaagcacttcatcagaaaggcactcaaagcaagatccgactctggcagatgggtaaagatgacccagaaatggcggaaatcgcttaccagtacgaagaggaagcgacaaagattttcctggaagtatatgaacaggaaaaagaatgggctgaacaccttttctctatcggtgatgtagacggcgtatccctgaaaagtacgatcgcctatatcgaacacctgacagatcagcgtatgcgcgcggttggcttgcagtctccatttaaaccaacgccgaacccgtatccgtggatgaacaaatggttgaagtctgacaacgtacaggtagccccacaggaagtagaagtgagttcttacctggttggcaacctcaacaccgagatcagcgacgaagcctatgcaaaatggcgacaaaaatacgcgtaaggacataacatgattgatgcgattcccgtttatacgggagtccatcacaatctatacgcatacctggcgggttgtgttgattgtgatggatggattagtgaaaaaggaaagaatggttatctggttgggcttacacagcatattcaactatgggatgatatggttagcattcaatctgatttgattaacgatggtgttgatgcaaaattatatgaaagaaccagtagaacaggattaggtaatacgttgatgtgcaacctaattattcaaaaatcatcggatctcttgattctgttaccgagaatcattccataccttcgatttaaaaagcaaaaagcagttgacgcatattttaatttgtgtaaacattcagatcttaatgcaagttcatccgataatgatatgaaaggaagtaaacgaaagtattggaagccggaagaaatatccgaactaattcgtttacattcggagggttacaacaacccagcgatagggattaaaatgaatcgttctaccgattcaataagtcataagttgcatcggttgggtatcatgagaaacgaatgatggaatcgaaagtttatagaatgtctcttgacaaatgcggtcgaatagaccgcagttttatcaagtgtggtgagttaagaaattgcgtttactgtattgaaatcgacggcgtgatcgtgtatgttggtaaagcaaaagacatgtggaagcgattagatacgtacaggaattcaaaatactggagggaagcaaaccccagcaacattttgaaaaccgcacgtctggaaatggcaatcaaaaaacgtaagcgtgtgaatctcattgtgacaacacacgacgaaaacacatatcataattttgaaataaacatgatccgaaaaattaatcctgaatggaataaacagcactatgacaaagctaaccaaaaaccagaaaacactcttcaaccaattaatgaagttgtgtaacgaaaccgaatgcttttactttattgaccaaaaaaccgtaatgcaaacccacgttcgcattttcaactatcgtatggcaagttacagcgattggttgaaacctggtgcgctggaatgtcgcggcattatgtttgcaatggatggggaaacccccgtaaaactcgccagtcgccctatggagaagtttttcaactatgccgaggtaaaggcatgggaagcgctgaaagcctctcctgtgacgattggtgaaaccgtagtggatgtgatgattaaggaagatggttccctgatctccaccttctgtgattccggctatctgggcgttaagtctaaagcatccgttcaatctgaacaggctatggacgctatgagcgtgatccagactaaccgcgcattgttcgaccgcctgaccgaactggttaacgatggtttcaccgtcaacatggaatacgtcgcaccgacaaaccgtattgtaattggctatcaggaaccagcagtggtgatcctgaacatccgtaataacgacacgggcgaatatgttgattatcaggatatcttcgcagatggtgtattacgtccgttcctggttgagcgcgagaaaatcgaaatcaccgatctggatgcattcattaccgaagcctacacgaaagaaggtttcgagggttacgtaatcaaaactgataaaggttttgtgaaagcgaaaaccaactggtatgtaaaccttcaccgcacgaaggatagcatcaacaataacaaagatctgttcttaaatattgttgaaaataccgtcgatgacctgaaacaaatgttcctcgatgatatgtacgcactcaagaaaattgacgcattcgaaacgttattccttgatagtctcaatcgtctgactgcaaaagcattccaggcaatcgaagacacgaaaggaaaatcacgcaaagactacgcgatcgccctgagcgctgacttaacccctgacggtcgtatcatcttcgggcctatgatgcgttatttcgatgataccgataagcaaaagctggttgataacatcgttgcattaatggcgaagaactacgaacagtttataccggaagaatataaatgacaaagtgctttggcgctggaagcacaacgttagaagaagagaaagcagggatcgattccctgcttctttacgttgacgttttcccagaaaccggaaaaattttttggaataacaatgcagcaaaacagaatcagggaaaagaagctggttctattatgagcaaatcaaaaccttacgtgagaattcggcacggcgatagaaaatatttaagacatcgcataattttctattactgtaatggttatctgcctttgcttattgatcataagcatgggttggaagctggggatggtatagaaaatctacaggaatcagatccgcttcataatatgctgaaaagaaaagctaaatcaacacctaaaacggttaaatccaaaggtgttgattacagggcttcgcgtggaaaatatcgagcacagataaagatagacgggaagcaaaaacacatcggttactatgataccgaggaacaagcatcaatagcttacgaggaagcgttatatgaatatcaaaaacgtattgggtacgtttaatataagttcgtggatatggcctgtaatagttgctggttcgttagcagggcttttgtacatgacaatcacgctgaaaagtgaaaacgatcaattggctaaagatatcaaagagttacaggctgatatcaaaaaagtcaaagagacaaacaacaccaatacggtgatctatgtcgaacagaaagcgaaggatcagcagttggtcaaggatgccggacgtaaagatctgctgttcaagaaaccaggactgatcgaaatcaagatcaacaagtccttcgaagagtatatggcggagtacgacaaatgaaaattgcaacgttagcccttgttctgggcgttctgttggtcgggtgtgctgagaagcccccagaaaagattttgcctacgctccccgctaaggtgaatccggtgaatgtgaaatggaaagtggttgcagaagtccgagagattgacggtaaaaaataccttgtcatgccttatgacggaaacccatacgttgccctttcatatcccgattcgttaatcttccgtagctggatgaatgacgttaagcgtcagaaagaccagacagataacattctgtgtaccgtgggataccctgagaaatgcaagtcaaaataatcaagtcatttttccgtgacataaccgaaggaaaggtttatgatgcgaagaaggacaaagaaggtctctggatcgaaaatgactggaaccgtgatatgtggctcaatctaacgaatgagcataacaaagaactgattgaatatgagattgtgaaatgaatctgtttattactgtaggcgtaccaggtagcgggaaaactacatgggcgaaagaaaaagcgcgtcaactggggaacactctgactgtttcccgtgacgatatccgcaaaaccctttattgtgctggcggtgatctcactggctatcgcttcaccgaagagaaagaactgtttgtttgccgtgtgcaagaagatacagttcgtaatgccctggcgagtgggaagaacgttatcgttcacaatacccatttacaccaaaaagatcatgatgtgtggcgagagatcgcgaaagagttcaatgctgatttccatatcgaatggattgatgccgatatcgtagaactcctgaaacgcaaccataaacgcggtgtgaatgctctacctgtttcccgtgtctgggcgatgttcgaacagtaccgtaaactccgtggctgggttccggctatgagctatgcagatccgagcaaaccgaaatgcgttatcttcgacgttgacgggacattaaccaaagttggacaacgtagcccgtatgacttcacgaaggttatcaacgatccgcctaaccctcctgttcaagaactgttcaggatgtataaggccgctggttatgcctgtgttgttgtgtctgggcgtgagggtactgcacagtgcgcacatgataccgctgcaagcctgatcggatacgatgttgacctgagcgatggtatctacatgcgcgaagaaggtgatcatcgtcacgatattcacgtaaaagagcaaatacttgttgaaaagattctcgataagtattatcctgttcttgcagtggacgacagggatacaccagtcgggatgtggcgaatgaacggtatcccatgtttccaggttgattacggcgacttctaaaaaacagttgacagtgagtgcgggtgtgataagatacccgcacaaacaaaggagaatattatggttattcgtgaaaatgaaaatgtgatggttgaactgggtgatcgtgttaaagttgagaatcctgttgaacttcaactgaaactcaaccagttaggccagcgcattgctgataaaattcctgctggttatacagtgaagattgtccgcgatggtcagttctccttccttctgggtattttgagtcaacgtaacatcgttgaacagcagttcgggattcagtggaatccggtaactaaattcgtaacatgggcgggggtattatgagcgacaaaatcagaaagattcatcaggcatggttatgtactgaaccaacgatgcttcgttatggttgtgtgtttgggttggttgataatgatcctcaacaggacattgcaacaagtccggttgttgaatatgcgattccgtcgaacaaatcgtttgttgaagtagtgacacgttcaggtactacgtatcacatcgttaaccctgataacgatttcatcaaagacattctgaaatatatggatgaccgatgaaactacttcacatgatccgtgctattcaacacagccaggcttctcgatgcatatcgacccgtgttggtgcggttatagtaatgaacgggcgtgtggtttcgcagggttcgaataatacggttgattctgattgccgttgtgctgatcataacgagcatatgctgaatgacgaaggtaaactgaaagcggttcaccgtcctgagcattcagcatggtcaaacgataatgagatccacgctgaaatgaaagcgttgctaagtgcgcatactaatggtattatgcttaacaacgcagagttgtacacaaccgcttcgccgtgtccaaactgcgcaaaacatatcgaatggtatgcggcaataggcgctatcaaagcggtgtattacctcgataaatacgatcgtggtaatgatgaatggatttcacgcttacagaaatatggctgtatcgtggaacaaattaaacgggaagagttagaacctcatgttaacttttccagattagtgtttaacaacaatgagtaaagaaatgtctgaactgaaagtaaaagcatccggcgaatatgtgatcatcgaagctactgcgcgtccgcagggttccgaaatcaaatctgaatctggcatcgtggttggtgtacgccagcacggggaacaacctttctatggtaaagttgtttctgtaggcgcagatgttccagaagaagtggcagaacgtatcctgggtaaatatatcccgctgccaagcgctcacatggcgaatgttcctgaccctgatctggttgcgggttacatttccgaaaaagaagcaaaagagaaggaaacgaaatacgtttccgcacattacaaagcaatccaggcaatctacgagatctaaaaatggctaaatcaattcaagcaattatcgctgatactgtcagcaagtccaaaaaactgttcgacaaaggcgaaattctggaagcccccgcgcgtattgacgtaatggcagcaatgatcattgacgcgcatcagggtaaactgaaatcccgtgccgatgaagtcatggcgtacatcgtccagttcgaagacgtatgtaaatacgcgaaagatgttgacccgctggttcgcgaaatttatcgcaagcagttctaaaaattccggccctttagctcaataggttagagcgagcgactcataatcgcgtggttactggttcgagtccagtaggggccaccaaatacgcaggtatagttcaattggtagaatatctggcttccatccagaatgttgagggttcgagtccctttacctgctccaattcgggtgcgtagcgcaatgccgttaaatggttcggaatatgcaacctttctcacggagaaggctctgttggtatccggtaataggttccccggaatgcggggtgaagtaaagaaacttccagcccacaaatttaaaagagaaaaaatatgaaaggtctccaaaagctgtttgagttaaccccaaaaattcgcgaaatcgtcgctgcatcaactgaaaaagaaatcaacggtaaattgatgaaactgtttaccgaagaaatcactgatttcgataaagaatatcgtaaagcgttcgatgcgtattctgttgatggtttctttgcatcaccgcaggtgaatagcaaacatgaatatcatcgacgattctttgactggtcgatcgtcaatatcgttcgtcgaactgatatcgaacctacgaaccatcagttgatctctatggattcttctgtgttctttatccagtatcttattactggtggatttaaagcagaaggtattccgttctgcaacgaagctctggaagaagaattcgcagaagcgtataagtatatcaaagcagttcgttaatcaacaggctatcttcggatagccttttttctggagaagcacatgcgctttttaaaatacgcaagctggtttgtactggttccccttgatattctttctggtgttctggctattctgctggctccttttgtggttccgttctacagtgaagaaaccggacacttacctaaagggttccgttggatggaaacattcgataacccgatcgatggtgatggtggacatatccggcgttgggctaacatccggtatcacttaggcgatctgggtgtgtatgcgcaacgtgtaggctggttgtggcgtaacaaggcgtacaacttcgcttatcacgtcttagggcgtgaagcacaatcagacttcgcctggaagggcaacccgaaaacagaaggtggttccgatccttcgcgtcacggttatctgttgatgtggaatgattcggcatgggggctttatgtcttcaagccgtggcttaaagtcggaaaggttcagttctgcttacgcgtgtattgcgggtggaaactgaaacaggaagtaactgaccctaacgggctggatcgtgcaatgctggcgttccatatcaacccgttacgttattatgtcgtagaaaggtaatacaatgaaagcatatcagattttagaaggtttacacactggtacaatctacctggaagaaggtaatgatgttcgtgtgttggtatccaaaaccctcgaaatggattcagtgatcggtaaagctcgcgttgctccattcgcaaaacgtgaagtcgatattgaatttcaacccactgttaaagtggaaggtggacaacacttaaacgtaaacgtgttgcgccgcgaaactctggaagatgctgtgaagcatccagaaaaatacccgcagttaacgatccgtgtgtccggctatgcagtgcgtttcaattcactgactcctgaacaacagcgcgacgttatcgcccgaacctttacagagagtctataatggcgattgaagacgtacagggctataagccccattcgaaagaaaagatcgacaaagtaaaccgcatcaaggccgcagaagttgccctgggcgaaatcttcaaagaactggatgaagagtattcaagtgattacgcggtatcagataccaattcattcactacagaagaactcgatgcgatgcttgaacgtatccatcaaatccaaaaggcgaaagaccgactgaaagaagcctctatgtgggcgtgtcgtgcggtgttccagcccgaagaaaagtattaaaaatcaagccgttgccgaaaggtagcggcttttttgtttttatgcaaaataatgcttgcgctgaatcgtgagtgtggtaaagtacacacatcgaaacgaaactgaggatgacattatgaaaacttacaacatgaaagaactggtttgcttcaacactcgtcgtgaagcccgtgcgtatgttctggctgctggtaagaatacctctgctgtaatcgacctgggtactgataaagctgttggcgcacgttgggctgctgttgtggttatcgctgctcctgtgactcctgttaaaactctggttctgggtgcgcgtaaagccgaaactctgaaaaccagcacttgcggggcgggtggtgttcataatgttacggtcattcgaaaaagatcttttaatcgagtcggtgtatgaaggtatacggggaaaacagaaagaacaatctccgaagagattgatgtaatcaatgaatttctatgtagaccatacgttaagagagttattatgaatattggtagtggtgattcatacccatcatgcgcattgagcaacttcgccccgcatccgtttacgtttgacggggtagaatgtgcatcaatggagggctttttacaaagtctgaaattcagcaatccagatatgcaagcgcatgtgtgtacgctggttggtaaagccgccaagttcaaaggcaagaaaaagaaatggtatcgcgatcagaccctatactggaagggtatgccgattcaccgtgaatcagaagcgtatcaaatcctgattgaaaacgcgtacaatgctcttttcctgaatgacgggttccgccgtgcgctggctgcaaccggaaaaagtaccttgactcattcaatgggaaagaataagatgaatgaaactgtgctcactgaacgtgagtttgtccgaaatttaacccgattgagagatctgttatgataggttataaagattatgatgaaagagtagaatgcgcgttcctgttcaaaggcgcgattaacccgttggcattactccacgcacagggtgctttgagttctaccctgattattggtgttatctacaaagcgggtgtgtattacgttaccatcggcgcgaacaacattaacgtgatcaacagctacgttgaaaaatgtaagctgaaagatattgtgttcgataaagtcgaaatggatgttcctggcttcgacgctgtttatatgtacaagggttgatgatgggttacgtggtttatttcgattgttcggatcttgatccgttcgttctgcaacaagcaaagaaatatcatcaagatatcactggtatcagtgtcacgaacgatgatatgctgtgtatcgaatttgattattatcgtacatttgagcgtgacaaattccttgcggatattgaagcgtttaagagtacccttttctttgatcgttatgaggttaaatcttgaaaccagttattcttaccgacattgacgggatcgccgtaaaatggcaaagcggcctcccgttctttttgtcaaaacacaacatgccgaccgatatcgcgctggatatggttacggatgaaaagttccgtgatatgaccgaaatctttgggtgtgatcaccaactggctaaaatcctcatggaagaatacaataacagttcgtttattcgctatctaagcgcgtatgacgatgcgttgattgtgatcaaccgtctgaaagtcaaatatgatttcgtggctgtcacggcgctgggaaccactcctacggcaagccttaaccgtattgcaaacctgaacacgctgttcccttctgcattcaaagaagtgatggttgtcgggcatggtgaaaccaaagtacaccgctacctggaagcgaaagccaaatatggcaatcgtctggtttgcttcgttgatgatcttgcggtaaacttaaacgaatgtcataacgtcatcagtcagttgccgttattccatatgttgcgtggtgaacgtgaaaccccgtggtcgcctcaccagtcagttaaatcatggtttgaaatcgaagagaaattaaatgatcttacagattctaaatgaactcgcttcgactctgaaaatctcagagaaggaagcgatcctgaaacgtaatgcaggtaatgatctgctgaaagagattttccgcattacgtacacgaaacagattatgtttcacattaagaagtttccgcaggtggacggtaagccaggcacaaccccgctatcgaatgctatcgcggatttgatgtctgatttggcaacgcgaaaatatacgggcaacgcagcccgtgatcgtctgctggatatcgtatcatcggtgaacgagaatgatcgcgaagtgcttcgccgtatcattaaccgcgatctggaatgtggtgctggtacaacgttaccgaaccgcgtatggaagaaactcattccagaacagcctcaatgcctcgctacgccgtttagtgagaaagccttaaaacgtattcgcttccctgcttactcgcagcttaaagccgatggtgcgcgttgtatgtccgatctgttagagaatcagatccgcaaagcaacccgcgcgggaaatgagtatgaaggtttggtgaatctggacaaggatctgaaaaagattcgtgaatatctgggttatgatgttgtacttgatggagaactgatttatgtccctgctgaaaaaactgctgtcgttccttcaaacagcgttccatttagtcttgctgggtttatgggcgatgacgacgattctgtttctgaccttgtggcagatgttaggcgggaagctaccgagaacgagacacaagcggaagcgaaacgcgaagagggcaacgggattgtaaacaaatccctgaaaggtactatcagcgacgaagaacagcgcaatatcgtttatgttgtctgggatatcgtaccgtatgaagtatactatggcgatgctccgagtgttcaaccatattgcgatcgtttctctatcctggaaggtgcgctggctggctctggtgtaacatcggttaagttgatcccttctatcctggtgcagaactacgcggaagcgaaaaaggattacaacaattaccgcaatgacggtaaagagggttcaatcctgaaaaacgttgatttcaaatggaaggattcacgcgttgcggatcaggtgaagttgaagaacaaaaccccgattgaactgcgaatcatcgacgtgtacgaacacaccaaagaagctcataaggtcggagggttcgtggttgaggacttatcaggagaagccagaacaaacacaggttccggtctgactgatacggactaccgatacgatgaagacggtattaaccgcgtgtacatcccgttagaagaacgtggtgaactggatcgcgaatacatcatggcgaacaaagatgactatatcggcgctatcgtcgaaatggaagttgacggactccagaagtctaaaacgcgtaagaagggcgaacctgagttcagtttcttcttgccaatcatcaagaagatccgacgcgataagaccgaaccggatgatattcacgttatcttcgctgatctgttttaaatagcactttttgctaaaaagccccttgcatgagtaaggggcttttgttatattacaaacatcgaaacgaaacagacaaaaggaacatcccatgcaaatcactaaagaactcgaaggcaaagtaatcgttctggtaaatgaagaccgtttggcacaactgggtaacggtggtgaaaaactgccagcagacgcactcgaaagcctttctaaaatgcgcgtgatgcgtgttactgacggttgggttacttgtctgcctctgaacgacgaagacaaagccgtatacgatgcacaagcggattcatgggatatcgaagtacctctggtaaacatcgaagttgaagagtgctacgaaatcgaaaaataatgcttgcttactgggtaatgtagtggtacattacccatatcgaaacgaaaggagaaacatcatgaaaattatgcacactgcaaatcaacttcaaaacggcaactacgctatccacgatgctatcggtgcgctggttggggtttatcttcatggtatcaaactccttgaagtaagtgggaataccttttatggtgttgaaaacatcgaagcagcgatggaaattatcggtgacctgaaatgagtaagaaactcgaaatattcgaaactatcagcgaagaccctaatcatcgctggtgctgtgcgaaaactggttttgatgctgcatggggtgatactccagaacaggcgcgtaaaaactgggaacaccaacaattgttttttgcctgtcgggttcctaccaattatgaggggagtcaattgttagcatgaaaaataaagaatatgacccaatagaagttaaagagcggttatcggtagcaagaagattccttgaatctatcgaccctgataaacttggaaaatgccctgatacgatttgccttaattgtgggcgatccgtaatggttggaaagtgctgtgataatcagaatatcgttatcatggacaggaaagaagtttcaccggaagtgtgggatcggattcaagagatcatcaaaaacccacctgaaccgacgaaacgtttacgcgaacttatgagcaggaaaccacgttatgaaaaatgaaccaagtaaaactatccgcctgatccgttgggaagggcaagaaatccgttatgaagacgacgaccgcgaattcgtccatgaaatgcttgcgcataatctgggattcaaaaacgccgcactggtgatgatgcaacaaaccagcgatgaagacacctggcaatgcgtcattctcgatctggacaaaaacaaggaatacaccgaagatgaactgtttgcgctcacagagaacgctacagcgcgtcagaagtgcttcatgatcgatatgcctcgcgagaactacgagaatatcaagaaagcccgtaaacagaacaagaacaacgtgttcgacctgttcatgggctatcatgaagaaactacggcctaagcctcacttgttttgctggtgtcgttagtagccgctgccacctgtacacattccaatgtttgcaggtggaaatcttttgatacgtcgcggacacattcaacgatcagatacttccctgaatattcatcccctaacacctcaatcaatgcccccactttaacatccattcgaccctgattgatatcaaaccgaatacgtttttcatagctggataacgtctgacacttcacagcctggaacggttgaccctgtttgtctgggttctggaagttgttctcatataccgcgtttctgttcatggtgatccatgcgttttcaatatcggtactcgcaaggatatcactatacagttttttatccgtcatcgagaaactaaagaaacttgcatcccctaacagggtagtgttatccttatgggtaatgtattcacctttcgtgaataccaaagcgtcacctaaaaacgggttacttacgttgaacttgtaagcctttaacggggtttgtgcgaggatctccgtattgcttttcataaagataccggaaccatcttcccacagataacagaagtcagacgaatctacgctctgcccgttgtcacggatgtaatcaaacacggtttcatacgtcccgctcaggcaagccggaggaatacgcacgtttgatgcgtcgatatgcggcgtgatcaacttcatatcgttatacagtgccgtcatgcactctgtaatcgtctgtacggcgttgttactgaacgaacgggaaaacttacgacgaaacaccgtatgcaccggagaaaggtttaggcgcagtatagagcggttcatatcatcggtttcgacgtttgaatacagaacaccgtagtaatgctgttctaacgtttcgttatactggaaggatacctgaataatcggtttctctgtcaactgatagattaactggttatcatagatctgcatcaatgtttcagaagtaccgttaatgatggttttctcactcattgagacaagggcaggtaacaattcaagatagacgttatcagcgaacttttcatatgttggatataatttaaccgacacgacgcggtttataactttactggacattagacatcctccctttatattctatttactaaatagtaaatatcgggatacttgaggcgatcatgaaagagaagaaaaacacacttgataaatttatggttacgcgtttaaacatcaagaacagcaaaaataaagtagtcacgttgcctactggtgaacaggttacgatcccccgtctgggttatcgtcatttcacccagattaaagcaatgaaagacccaatgcagttgcttgagtatatcatcaaagagattcaaccgcgcgaattaaccgcagcagaaaccgaattccttttgattcacctgcattatcacaatgacgataaagcaatggcgatactgaaagagatcggtattaatctggatgatatgaaaatcagcgaagctaagtatgaacatacttttgataaccttcgattggtcttcaataaaccgaccctaatgctggatgatctggcattactgcttaaagaagcgtatgacaacgggaagccgatcgaactgacggacgaaaaccgtattcaattaattaactgcctgtatcgttatgaatatgacgatgtaaaacgtggcgtactccaggaagtctatattgtgcatgaggggaaaaccattaaagggcttaacatcatcggtgaatgataatggctagcaatccatattttaacgaagaacaacgtcgccggatgcagaatccaccaaaaccacaggcgcaaccgactgttcgtaagatccaggcaacgttagataaagattcgatgcgcgagttaaaggatatcaatgataatacccttgaaaccgcgctgaatacactggacatcaaagacagtgtgaaatcctttgaggatcgtttcaaagagaaattcgctggcttccaggaacaatacgaacaggatcagcaaccacttgctgaacagttgcccgattttgttgggccagcgcgtccaccatcattaacagacaacagcacaaccagtgttgataactccgtcagtgtatcgaaccagcataacccatttgcgaaaatcgaaacatacaccggaacgattgcagaagcaatcaccaagtttatcgaactcgctgaaaagaaaccagcccccgcgccggaacctgaaccagtaccggaagaggaaccggaggtcgatcgggacaagaagaagatccgcgataaggataaagacgagaagaaattcagcaagaaagtattgtctttgctgggtgcaatcaaggataatacatccggtcttctggctcgctttatcggttattctctcgaagcgctggcgaagtttgcaaaatggactctgattatcggtagtatcgtatttgcgatcgacgtactgagtaaggttgttcagaagtggttccaggatattcttgcagagggtgaagcctcgaaagatttgtttggttcatacttcgggaatatcaaaacccttgctgagaaaatcaacgaaggtctgcaaaacttcgatatgagtaatttgggcgaatcgctgaaaaacttgttccttgaaccgtttaaggttctgggcgataccatcaaaaccgcaatcacggaaggtatcggtaatctgatttacgctctgggtgaatataccggatctgaaacgattaccaacgccggacgcggaatgaaagtatcagcactgcgcgacaaacaaaaatacggtcttgaaattgatcccgatgatctgattctgctgaaacaacaggagatccaggatcagaatgataaagtggttgaggcacgttctaaggttgtcgaacaggttaaggctacccagggcgcattctcatatagtttcggacaacaaacagacgcacagaaagcattgtctaagcaattggaacagatgcgcgatcgtgtggctatcgaagaaaagatcaccgaagagaagaagaaagaactgaaagcattgcaggaaaaccccgcactgttaaaagctgaggttgataaagagaataccgctaaccgtaagcgcgtggacgaaaccaaacagatcgaagcagcacaaaaggctgagaagccgaaagcggaaaatgatttcgatcgtggtgatcagattcttgataaagaaaatatcaccaacgaagacaagaaagcaatggagaaaattcttgaatcactcgaagagaaaaacaactccaagaaacttgacgaagacgatagcgaacgattccgctcaatgcttgaccagtggcagaacaagatcgccgcagtaccggaaagcagtgcaagtattgacaagcaaccggaacctgtgaaatcacctgttcagcctacaacgcctaacagcgttcaggtcaacaacaaaacagtaaacaacacggttcagcattcagtacaacgaactgaccgtaaaccattgattgcattagcttaaaggaaatttaaatgaaaattacagtattgcaagacactgtacaatcatttgctgaaatcaaaaatgctggcatcccctctgggggtgctgcaacaactaaaaacgcgttgactcaaccgatcgtaacagcggaatttccttcccaacgtgcagcaggtattgataacgcttataatgcatcaagcctgtataataacggcttgctgttcacagcatatgatttcacgggtggacttgcaccaggcagtaaagacaactaccgctcattacgtcaggcagcacagaacgcgcaacagatccttagtgctaacactgggaacgttcgatacaaacaggttttgaatacccgtactatgggtacacttaaccccatttgtcaaatacttttaccgcgaagcctgaacgataacgaagtgaactcacaccgttatcaggatgcaaccgatagtattgttgctaaaggtttatcccgtgcggtatcaaacgttatctggggcgctgtagaatccgtttctggtggtattctggcagaccgtagggaagcaatcgacatcggtactaaagcagcgtttcaaggctctgataagcgcacaaagatgtattacaatacattcgttatcgaaagccgttatgacctgctggaactgattaaaatctattacctgttcacggtgctgggttatggtactacttcgggcggtactccagcagaattagccggactggttaagcaagcgtataattccagcgcttcgaaggttgcaaacgtttttgcaccatcaacaaaccagacgacagcaagcgatttcaacggcagtatcggggatcagattgttgacttcgtatcgaacgttgaagttattaaatcgcctcctgtgtggtttattcgtgacttccagacaggcgacagtttgcggttccctcattccacgttcgggccagcaggtattaccagcgttcgtttcgggcgtacaatggacaacattgtaaatacgttgagagaatcaccgaacaccccgatcgcagttgaaatcgaaattcagtttatggaactgatcgatatgcgtcaggattcgatttttgatacgcagtattaagggggaacaatgttctatagcgtagatgaatttttgtcaggaatggcaaatagagacttccagcgaagcaacctgtttagtgttgtattcgcaaccagtccagcatcacgcattctcgacagcacgatcgggagtatccgcgatactttaattgatggtactatgagttccattaacgcaaataacccgaacgagttcatgaacgctattacagggggcgtaagcaagttattcagctatacagttgataaagctattatgtccctgaacaaaacaggtttcagtaaaatcatgggggcgttaagccctcgtttaattacttccctgtttggtgatagtgtttacggacagatgctaacagaattccgtgacaaaatgatgtataatatggggttgagcatcgttggtgttcagttgcctggtaaaacactgggttatgaatacgtgtataatggcggtgtaccccagatccgattcacccgaccggagaatggtgaattatcgctaacgttccgtgtggattcagaagcgcgtaacctgaaagtattcaacgaatggttatcagctattcgtgatgatgtctcaggccagttcgcattcattgatgaagtatcaagcgcgatccaggtaaacttacacaatcgcgatggtgtcccgcacagcacgtatgtattccagaagtgtttgcctgttaaagtcagcaacccagaactgagttatgaaagcaataacgaaatctggacattcactgttgactttgcttataaaacaggctggcttgttgaagcagataaagaaggttgggacggattcaaacaatcacttatcgaaggtgcagcaattgccgttcgtggtgtggttacaggacaataaggggcgaaagccccttttgaggttaaaatgattgatataatccgcgtaaaactccctggtggagtgaagcgattccctatgtttaccgtgcgcgatcagttgagtttcttactcacaagcgcggacatggaagggaagacgctcacagaacagcaagaaatgctggatgaaattttagatattctgtatccgggttattcccgcaccgaacaggaaaacattttcactaaggtgtattgtgtatcgttcggtaagaacgcaatcaagatccgaatcaaaggaagcagcggacaatcagaagcattcatgcatgtaactgattacgttttgcaaaatgaatatgcccttgatgattcgcttactctgggattcaaattcccgaaacatcgtaacaacagtgaacaattattccttgaatgtatccagtatgtcaagcaggacggcgaaagatacgaatggaatgcattagacgaggacacaaagaacgcgatcctggatctggtgtctattgaagatatggaaaatatcgttaaactgttacgcaagtcctgtcatgttaccgtgcgtgatattgagttcagcgacttattgacactgtacaaaatcctgttcaacaaatcagaactgaatgagttcttcaaaaccaactatttgttaaataagaataccgtacagattgaacctataatgaatggaagcccgatggaacgttcaatttacgttgcattactggcggaagacttgaaacgaaaagagaatgcaaatgcgtaaacatacaccccgacatatcccaaaatataatgtgacttatcgcccgttaaccattggcgatcttgatgacacggataacttcattattgaaggtgatgtgttcaagcatcagcgcgattatgtttacattatggctctgttcgacagtatcaacaaagagactgtagatctccaaatcaaatgccctgaatgcggggaactgattaagtttgtgctcaatcgtcatcatatcatggtggatgaatacgaagaaaagctgtacggcaatgagatcaagatttcagtcgaaccacaccgcaccggaaaggaagagttacccgaactgattaagtttgtagtcatcgacggtgaacaaatcttatgggatgactgtaaagagtcagagaaagaagccgttctggatagtatcgactatccggtctttaaatcaataaatagcgctctggataagccagcaatcgttgcaaacattccggtaaggtgttcgtgtggctacgagcatatcgttgcactgagaggcttagaggcgtttctaaaggtggttggataaaatgggtgttaaccttcgcttactgtacagcgatatcgatcccaacttaacaaaagactggaacaatgacgtaaccgcctcgaaaggggcggcagcggtaaagaatagtctgatcggtatcgtaacaacacaaaaaggcacacggcctttcgatagcaactttggttgtgagatcggggaacagattttcgagaacatgaacccgctaacagcggaagcagtaaggacttcgattgtctccgcgatccgcgcatacgaaccccgtgtttacaatctggatgttgaagtgattccgcagtatgacgaaaacgcaatcaccgtgacgatttactacagcatcattgatgaaccggaagaagtagaaagaatcaaactccagctatcatcctcataacaaaaagccccgaaaggggcttttcttattccatcacgatccagcccattagctgttgatatcgcaattcgaacggggtgatgaaagagcggttattgataaccttcgtcccgttataggacttaatcacttcctcaccacgaagcacatattcgtatacttcgtccatagtgtcgtaacgcacttcttcgacttcgaagcagaagttggaatattcaatcattccgatcttgttcgcgtaacggcgttcgatgcagccctgtttttcaatctgagtgatcgcagtatcaatgaactgcgcaagtgcttgcatgaaattaccacattcgacttcacgacccccgcttgagatagccaggtaaacgcggctcaatccatcattgccgatgtaaccgatacagtcaccgccaatatagacagaccagactttacccatcggccccatacccatacgattctcactacgagaaacacctttcagtaacagtgccatgataccgccgcgaacgtaattcattttcatgataagccccttattttttcaggttgattaaccaagatggttgggtttctaaactaaccgctttccaagcatatgcaacactataaccggaatacgtctgacatacaacagcattttcatttaaatatttcactttgtgatctgcctcttgttcatccagggcagcacacacgatattcttttcatacactccgccgtttggctggataatggtttcttcaatcagataaacgctgttcatgctaattccttctcgattgcttcgatgatgtggagaacgtaaccgttcagttcttttgctttatcagcggcttcaaccataccgtaacgaggaacttctaaaacgttcgcaccttcgagcaggttgctttcgatgtctacgattacgtagctctcaccgattactgcgccttttctccagtcttttacgaacttcaccattttagctttcatgttctcgttccttttggctgttccgtttcgatatgtgtaatataacaaagccctcacgcgaacgcaagggctttttgagttaatgcataaaagatttgacgtacttcacgatttcttcacgacacatatcgaccggagtatcctctgcaatagcagcatgacagaagatttcaccatccagccagaacgatagcatgtactgaatatcccgaccttcgttttctttctggtgtttcttgatgcgatcaaatgcatcatccatgctttcggtagctgtaagcatttcagattcacccgctacagcagccatttccccagcttcatcactgaattcgctttccagttcttcccagtatactatcgttatcatggattaccccaaacagattttacatttacagagaggacattccgcctctttaacgcgcaagcgctttgttgctgttcgcttcgctgtgttgtgatcatacacatgcaaacagcggtaacagatcaccaatcgtttagccgtcataaccaccaccgcaacgaacatcaccttcaatgaacagttcgcggttatctctcaggagattgtatttcttttcgagttccggcccgaatgcgtccgcgtcgtcataccagtcatagttataacttccggtttcatcgtcgtattccggttcgtcgccgcgctcattgaagtgaacgattttaacatcatccagattcagttctttcagcttgtcccaaatgcgggttatttcgacgctattacatccgaacgcttccagtgtgattgtaccgtcatcgtgtatttgaggcgaaccccagcgaggacgagtatcatcaaacatatccatcagagattcaacgtttgactcaccgtaaatctttgcaacttcctgttctttaccagggcggacaagtccgatcccgataatgaaactactgcttgagctattgctcacgaacccagaacgaatcttcatcgtcttgcctcatatttcgcgttctccgcgattttctcatgatacaggttgtatgacaacaccagcgggatacaagctactataagcccgatgaccgccagttgatattcgcgtttatcgaacgccataaatgcgatcgtggctcccagaataaacacacctaatgcaatgatgaagaataatgtcattttggcagggtatccatttcacgagattttgctttcaggatgtcaatcacagtagtcatcgcctgttctacatcaccatcatagtgaatcaggaatgttttgtgaagtcccatgatcagacgattgatgatataagccatttctgacggtaacagtttaccattctgtcgattgtacttctcaaacaagcggtagagttctgcgctattgcctggcttctcgatgctaaaattatgcatcccggacagaataccatccagatacagaacagttttgttatcactgcgcaggtgtccgccaaccttgtagtagttgctgaatacatacggcttttcgcggatatcttcgatatcgaaatcaccatgatcttcgatgttgccaacatgggcgaagaaatgatgatcttccagttcgagaaggattgcaccctttttgtaagggaatccgactaaatcaatctgccagccattttcaccgacaaatacatcatcaacaaccacgaaatccggcagcataggcgcgtatgcgtggttcttttcgttgttttcacgataggcttgtggttcggacaggtacaggatatcgccttttacaacttcaccccagaatacgttacgtgacatattattttcctcaatatgccccctttcgggggcggtcattgttagattttgacttctttttcttccaggacgatttcacattcgaatgatgtggtttcccagactttccagaaatcggatggaatattatcttctttcggaagaatatcttttgcagcgatagaaactttggtttcttcgaagtccagatccgcgaaccatgcatgggctactacaacaccgtacattacgcgacttaaacgggcattcagtttacggacttcctgaatcgttgcctttgtctgcttatcaagatactcgactacctgatctttgtcaagcgcatccagttcagatttcacctgatcgtaagcccacaggataatcaggtcgccgttgttcagtttcttcttaccttcttcacgcttcgcgacggtagccgctacagcaggaagggaggaaacacccttgattttcacgttcagttctttcgacatgtaaacatcagtcgattctgtgcgctcaaccttcggagagaacccgtaatcacgaataccctgttcagacagccattcacccgcagcctcaccaaagcgctgtttcagcccttctgcgttgcgcagtccgatcgcgttgtcacggaagaacttcataaccttctgacggcctttcaggatttccagacgcacgttatcagtcacgaactctttaccgcttaacccgcgagtcatgccacggttaaccagaggcagagaggtaaagtctaccagaaccgacatacgatcatcaccgattttttccagcggcttgatagtcaggccagaagcacgaaggtttttcagtgtcggaatatcggtttccagcggcagaactttaacgttcacgataccatctttaacgatggtgaagttacgcacctgcttagtttcgactttttccggcagaccgaattctttctgtttgctttctgggatagtcacatacccttccagatccgtgttgatggaaatgttcggacgggaactgttacccaccagatgtttaaccgatactttggttgtggtttgggtaaatttcggtgtccagacttcatgcgctaccatttgcgccgccagtgctttacgttcttctggggttgcagcgtttgcgatctgttcggtcagttgatccagtgtatcatcttctttctgtacagtctgacggcctgtgcggttatacgcccagtgctcagaagacaggtcgatcactgtgtcagtttgtgccagcagttcgagcgcatcaaccagagtgaacgcgttttcgtctggaaccatgttgtaatcaataccatcaacgaaacgctgtgatggatctacaacagcctgtgcaatcaggtctttcgcgttggagtagtcctgtttggtaaagcagttgtcatacgctttgatcagacggacatcacccagcttttgaagcactttccatgccagatcagggttcattgtgtgcagtgcatgataaagcacgacatacagaacttgctgttcgctggcgatgttcggatcgaatccgtcaacatcattaatcgcgttttcacccagcgcccagatgtttttgatgtgttctggaaccagcacaacaccgtttgcagcgttcaggacatacacgcgcccttcgtccaggtagatcgcatgggtagcatcagcaactttgacttcgatacgcgcggaagtctgcgcggtgatgatttcgttaaatgctggttcgtatgcgtcgaaaccttcaacgaatttgtgcaatgcgttggttgcttctgccattttttccagcagaggacggtttacataataaccgtattccaggaacgcgatactgttgaaagtcagtggcagaaccgcacacgctttcagaatatcatcggtacgccagcagttatcataaccgtctgtcaggaagatcaggctgttcaggttgccgttttcagattgcagatcggtagcgatttccgcagccagattcaacggctcaacaaagccagtacaacccgtaggtttcaggtaacggtcgatagccgcgcagatgttagacaggtcagagacattgctaaccttctcaccacggaacaccgtgccgtaatcgcctttgctggagaagtacaggatcgaaacggtgtcatcctgtttaaccagactcgccaggtttgctttcaggtgtttacggatcttaggcagttcgttgtacattgaaccggatacgtcacacacgaaaacgtggtttgtcggggttggcttcgatacagcgtttttgaattcgatatttgtgattgacatttaaattttctcgtatttgaatttttctaaaatttcgttaactttattgcttactgcttcgactgtacgatcacacccgaacttacgcgccaggagttcaacgtattcatccatcgtagtgagtttggattctgcaacgtcaaacgcaagcgcatacattaccggattccatacccgaacgatttggagagtatactcgttcagttcaaatcgttcaagatattttcgcaaagaaaatacatcaaacggtgcggggcgatcctggctaaaggggatcgactcccctaatgcatagcgaggcataacaacacaaacttctgttttcagtttattatccatcagtgatgactctttgatgtgtgttcaaggttacggaagatgtttccatgttccagttgagttccgatcgggccgcattcatcggagtacgtgaattcatagataaacacgccgtcctgattgccgaacttcgtgttgtactcttcatacaaccacattttgatcagagcgtctttctcttctgtgtccagatcgtaccagtctcgcccgtcatacgcaagcgcaatttgaggatttgaacggtaacggttttccgcgctttcttcggtttcccagtcatagcgcttatcgtcgtagaacgattcaaagctattacccagatgaccgcctaagtcacgatgaacgtgattgaccacttcttccgctgtcaacggcggatcgtagtaaccacaatcagggacgcaatcacccatcatttcgcgcaggttgtcgatatcagtcggatctttcgggaaccggacgatgaaactacttgatgaactgttgctcacaaaaccagaacggattttcattttacatcctcaaattgtaagttttctttggttgcgttcgcaatggctttttcgttgttcagtgttactatgcgcagacgttcgccagtaaagccgtcgcattcagtgatactcacccagtcaaaagatttagccatttcaatcgcacgttccagcgatacggtagaaccgaccaaatcactaaatgtatagtaatcttcgcttaaactttcaacagtataaattttcatgatactttaccctttgtttcggatttcaggacgatgttactgtaaggatcttttgctaccagttcccacaggtcgccaggatgttccccgctacggtagacggatgaacggatgatttcgttaaacttgctcagggcttcgtctatgtcgtcatacccgcatttgagaggcttacggttgcaacgaatgaagaacatttcgttggtattctccccgcgttcggcgtttttaaccttcataccgcctccattttaccaatgacttcttcgtatgtcacagggttaggttcatagccgttagcgcctattgtatcgcctactctgtttcctactaaagaagcaaccgcaactttcttgccgtctttccacgcagtgaaatgcagattatccgcaacatacgggaaggtttcgtgattgttcaccgcgtcgatgcagtccataacggtatcagacgcgcagatcagattaccaggttcataatcaaccaaacattcaacagtgtaaatcataataatttcctcacgaaaaagcccctttcggggcttgattaatcagtgtccgaacacaccacgaatagactctgcgaacgcgtacagttcagggtttttcgctttcactgtttcgatttgttccaggatgtaatctggtttgtatttcgcaccgaaccagcagtaagagaaagaacgatcccacatgaacacgttgtagtattcaccgttacgcacttcaaccatcacgtaacctggattagaacccagcgggtaatctttcagtagattgaatttcgcaccagcgccagtacatccgttaaacaggtcattaaaagtcatggtatgttccttttcagtttcgtttcgttaaagctaagataccactatcaactactggatgcaaacacttttttgaagaattttgtttccggtctttctttgtacggacgcattaccaaatctttaccgtccagcacggttggcttaccttcgagttcgatcaggatgaagtttcctttatgatacttcaatacgccctggctggcagaccattcatcattatcccagtggttgtaatgccattcaacaacggtatcgatcgggatttctggttgatttctcataatactttcctaatttgtttcgctatggcttcaatcacgggtattgaaactgaatttcccgcttgacgatatgcctgttttttactatccggtatgataaatgaatctgggaacccttgcaaacgaaaacactcacggggagtaagtcttctggggttctttccttcctgcaacaccagacattgaacgccgtccttgtaatactgctgggtgatagtcccagtgtgcgtagaatcgcttgtgacggcctgataaccgaaacccttaccgtttgccttatttcgttccttacgctctctaaagcccttccatgcgttatctgacagggtgaacgaatcatcagcatcttcgaggatgtcgcctactcgcgtaggggtgcgcgggggaaccggaaacgaaaagaatacgtcatccagaaagcagacaataaacacgcgttcgcgtctttgaggtagtccgaaatcctttgtgttcaggcgttgatagaatacgttgtatccttcggcctccagaagcccgtaaatcgttttaaacgtcttccccttgtcatgggttagcagttcaggtacgttctcaaagaacagcacacggggctttttagcgcgtataatgcggaggatttcaaagaacactgtaccgcgcacatcttcgaatcccagtttcaatccggctttactgaacgcctgacacgggaaccccgccagcaggatatcatgatccggtacttcgttttcatcaatctggaacagatcaccttgtaggttatcattgccccagttttcgatatatgtttgctgtgcgaacttgtcgatttcagacgttataaggcattcgacaccgccgaatgccttatcaaatcctaatcgaaccccgcccacacccgcgcagaggtcaattattttcatacgtcaaaatcaatctcgtcaattttgtatgagttttcatcaatgtccgcccatagggttacattaacgtgtttgctatcttcgtacaactggcgaccatcaatcccgcccgtgtaattgctttcggtacgttcagtaacttccagtcggaggctatcgcgcatgatctgaacaacagcctgttccagtgtaaccgcgtctgggtttttggtatcgcccagtacaacatctttaacgttcaaaataacatcagtcattagtgccactccgttttaataccgtgtcggtatgcgtcaatccccagtggggtaatcagcaaccatgctttcgaattatcgtgataacccgttacccttcgagcgtaacctttttgaatcagggcatcacgccctgatttgctgggtacgtcatcgaaatctaagtctagcactttagttgcgtatccgtaaagtttatacagaacatcaatttcagcgccggacaatttaggatacatcatttgtaataccccacaacatgatcgctgtatacgcgttcgatgaaatcgttccagaattcgcggtcaacttctttcggatatgttgaaatcgctgcaagccgttcgacttcgcccatgacttcttccagcttttcctgtacggttgcgaacggtacgccgccagctttaaccagtttcaggaatgcgctatcaggcagaggataaacgatatcaccatctttgtaaatctggatcaactgcataccaccgcgcaacgcgtgacttaaagccttccagtcgatgccgttgttggcttctgcttgtcgtgcgcgttctccgtattcatcccagagtttgtacactgacttacgcatttcatcggctttgatcgtgaactggaatttacgccccagcacttcatagaagtcctgacaaccagatttcattgtcgtgtcggtaacgaatcggcagaactcgtttgtagggaaacgatccttgatgtcagacactttcacttcacgcgtatagcgtttcatatctggtgtgaattcctgaataccaccgatcgtttcggtttctttcagtacatcgacaacttcgcgcagtgcagccaggcgagaacctttcacaccatattttgcggcttgcttgcgaacataaccgaacaggccagttagttcagtggtgtaaaaacgccagcggttagcgcggatatactgccagatttcagagttagcgatcagcttgtcatccgaagcgtgaagcatatcgagcgctacggtatcaccatcacacgcaaggctgataaacttagtcagactatacaactgacgatcaacgtcgtctacggtgtttttagagcttttatcgcccgtgctggtgtcgatagtctttggggctttccccaggagaatatcgcgcgggtgcgggagaaagatccctttatagtctttatcgcttgtcggtgtgttcagtccgtacaggtgagaaccgaacacggtttccattacagttttcaaaattcaacccccagggtttttgcgataccgcgcagttcagcggtagtgatttcaggaacaacaacagcgtgagaaccgaactcttttcggatcttttcactcagttcagcacgatactggatttctttgtatactgcttcgctgcgatacatataaaatccgccccagcccccactaccagaagtcaatccagtcttacgatcgactttctcgatgttccagcttttcaaatcagcgtctttatcagtggatgcatacagatattgacgcgcaacctttagaacgtgaaattcgcgagggtttgctgttttacgggtattgtataacctttcgccaggatcgtaaagggtatcacccactttcacatcagttaaatctttcggattcatttcattttccaacgttttgacttttcacagtagaacaccggaagacgggccagaactggcttcactacgtcttcccctgtgttcgtgttatgaaccacttcgattgtaagggattgcccttcggacggccttacaatgtccagttccaagatctcacgattaccctttgtattgatttccgctacgtagtaatcgtgtccattgatgtttacgacatcacccataataacgctaattgtttgaatcatgagtatgcaaacttaattttaacattcagggaatccagcaggattgaatcacgcccatcaatgacggttaatcccttgtatttgctatcgtcttcgctcttacgggagtatacgcgacaaaccagagaaccatcctgtgctatgtattcaacatggtattcacggcgttctgacgtaaacacatcaccaacaacaaccggacgatcgacattctggcgtttagtcccttcgtaggacagtttgccgttgccgtctacggcgcattcaatgcccttatgtgtgacgctcgcaacagtaacaggctctacagttccaccgatcagcattgccggatctttggttcccagtttcatcaccagtgtttgacggatattatttgacatcggttctgtaacaaacacataaaccatatcgtttttatcacgcgcaacagattgcaaagtgaaattcttcgtacctacagaaccagtatgattgattcctacacgattaccgggttccagcgacatacgacattttacatcagagataccgctaagggttgctactttcatgatttaattccttcaaagtcttcattagatttccaatacacgttgaagttacggcaatcgtggtcggaagtcaacgtatatttttcttttgttttctcgtcggtgatcaccatcgtttcattctcgatcgagtccacaccatagacgaatactttatcaccgcgtttattcaggaacgcttcacctgtttcaaccaactgccagcagttgacgggtaaaccacccgcacagatcggacggtttacgaggcagtaaggacgtttaatcatttaaattcttccattgcataggaagtaagatctttgaaataccttgcggtgttgccttctgggttgtttgtaatctccatcaggataacagcaccatcaactcctgctttcttagccatgaatgaaatggcttcggtagcaataatcgttgctttcataacatcagctttagaaacgttgatcgtattcatttttcttccttttcattattcatgcggtatgtgtatataatacaaaagccctcacgcgaacgcaagggcttttttaatcttttatcagagtcccgtgaaagctacaacgatttgatagtggtcatcgaagaattccccttgtcgttgtacgacctcatgtaagggcatccagaacgcctctaacgcatcgtcagaaccgcccataatgcggggcagacttccatcattgttaggctctaacttgatgtactgcgccacagtcggttttgagaagtgtacggaacgcttcggatgatcgaacagcatcgaattacggattgaaccacggataaccttttcaggaaccttgatccgtacctcttcgagcagttcgcggatcgcacaatccaggaacgtttcatttgcgtttttgtgtccgccgggaagggctaacgcgtctttacctggggcgaacttacgacgaattaccagcaggtgattgttgcacacaaccacactatcacccgtgcaacagtttagcgcgtcggggtatgggtagtttttgaatttctccaattcgctttcccatttctcgtattcgtagaataaacgccagaacgtgtcttccatcatccatttgtcgatataatcaacggttgcttgaggaacaaagcgcaacagtttcttatcccacccgtttttatggttaaagataatcggacgcagatcggttgctgatagatccttgccgttaatctggacaggtggaactggtacgtgtgtccatccgaacgctttaagccagtatgaacctgcatctttttcgtaaccgtagatagcgattttgtcgcctttggtttccctgatagcagtacgaacagaggttttccatttctcttcgttgtaaagataatctggaatgtgctcaaactgaacacgaacaacatcttcgatcgggaagttagcgtttaaccatgagaagatcatggtttgacgctcacgcgccgtcagcgggtttaaaacgttagggtaagcatatgctgaacccagaaggatgtaaacgatctttgcttctccgagtgctttacgcaccattgctgcatgaccattatggaagggttggaatctgccaattacgacagctttatcaaattgtttcataacgtgctccacgtttaaaggttaatcataaaacagacgcaatcaccaatacaccaagaaaaccgccaataaagccgaagaatagcgaaatgaagatagtaaggatgatctgttttatgttcattatagtattctcgttttaggagtcaagcccccaagagcgggggctttaaaaccttatttacgagaatcgaaaatcactttaccagcgtaatcagaacccatgacagtttgaggtacaccgccctgatatttgtccgcgatggtctgctgaacatcaagttctttccagcggatcatttctggggtgattgtgcgttgcagaatggcgttcgcttcggcttctttcttagccgcatacagacgggcatcagcatcacgctcgttagcctgtgcagcattgctacgggcttctttgtcggcaattgcctgaacaactgcctgttgagcgatttgctctttacgtgccagttctgctttttctgcgttcacctgttcttcacgaattttcgtgttttcaacctgcttcttgatcgcttccggcaggtcgatatcctgcaagaatacctgtttcacggtgtaaccgtaaggacgggcatactcttcaacttcctgctggatcgcgatctgtagctggctttgaacttctgcattatacagatcctgtgctttcggtacagatttaccgaactcacggacagttgacagaagtttttcagtcacatatttatccagcgcctgatcctgactacccgcattgatacggttgatcggggctttgctaccatcgaactgtaacatcacggtcatatccacagtggatttgaatttatcctgggacggaacctgcaatttgtcaaacttcattgcgatgtctttggtgttgaacacctcgaaatcagccagtggatttaccaggtggaaaccaggcagaacaggcttcggtgaaactttacccatgaaggtttgagtttttaccgtaccatcctgaacgatagtgtacgagttcggaaccagccacagagcggcgattacgcccagagcgatcagtgtggttttcttcgggttgtttacgatagtgtttaagttcatcattatttccattgggtttatgtttcaattcgatagttattctatcatcactttttcgcttgtcaaactctttttaagaaagttttgtcagcttgtaaatcgtttgatagcacaagcctttgatctcgtccaggacgttcttcaatgaactatctactgaatcatagatttcgttggcttcatcggctattttacggagatacgcgaccgtgtcaagcacattttctgtttttaatacgggtttgtatcgaccagtaatgcctatatggatttcggtgaatttatcaaccaaatcctgcatatcttcgtaaaacccttcaaatgctttatgctgtgaatatgaaccagtcgcaaaatgtgcgctgtgcatataggttacagacattaagcaagtgccaataaaggcatcaattttactcgcggtatcgcgttctgttacttcgttaaacgtctgcatcttcatcccttatgaacgatgaatagcggcgaattcacttgcaacccgtagccctaaacgtttacattcgggttcggatttacattgcttctgctgccattttcgttccatgtaattatagaatagttcgctggtatttacgctgggagggatggtgtcaagatatacctgtagcgccgcgttgatgtagtaatcgaactctttggcgactacggatctatcatcagcatgtgatgacggagacaagattaacaaaccaaacatcagcgctttagatatgcgtttaatgttcataagcaattctctacgtgcttacggatcaacaatagatccgttcctgtatatatttatagcaaaaaaggggcgaatcgccccttatgtaaaattagtctaaaaatacatcaagttatctcataccagcataagctacgctcaaaagcgcggatcttatttgcgttctcgatattttcatcccatccaattacgccagctttcatccggcgtaattcctgacgcattttagcgcgtactttcgaatcaatctttttcacagcgattgaaagcatcgcggagatatcacgatgagctttgttaccgtcgcgattcaggtttttatcgaaccggatatatgcgcaacctgatttgtgtttccagttggttgtataccaacgtaaaccatcaggactttccccgtgctgtgcataatactctgaaaatgcttttgtctcttcgatctgttcgatggaggacttatcacggactggaacatatttcttacggtaagtacggctcatagtgttctcctttgtttgtctgaatacaccttaacagttcagaccaacattatcaagaagtttttcgtgataatgtttgcgacagagcgaaacgtatttgtcttcggctccgatctcaacctgcgccccttcggttacgaagttgccttgtgcgtcgatacgtgcaaccgtagttgctttgcgtccacagtgacacattccgcgcagttctcggatctcgtctgcccaggccagcaaccagtaagaaccctcgaacagattcaactggaaatcagtacgcagaccgtaagccattacagggatttcgagttcatcaacaacgcgacacagatcgaaaacgtttttcttcgaaaggaattgcgcctcgtcaacgaagatgcaagcaattttattccggcgctgaatgtcccagaacagatccatatcaggcgcaatcaattcacacttttcgttcagcccgatacgcgaactcactgtgtttgatgtgcgggtgtcgattgctggcttatagattacaacacgcataccgcgttctttgtaattgtgcgcgtccgtcaatagtcgcgcactctttccagcgttcatggatgcatagtgataatacagtttagccattgacacgctccacaaacttaatatgattctggaatttaccctcaccttcatggtttttgcatgttttgtttgaacagtatatccaccaatcccactcgtcgtaagggggtttgtcaatgttcatgacgcaaatcaaagggaaatgacaatcccgacaacgaactttttctataatgtgtgcgttagccaattgtaaaccacccgttacccatgagttttttgttacgtcgcgcaagatgctctttgatttccggcatctggatagcaatatcatactcttctttcgtcatggtatgatttgcacaacccatacacccgcacacctgcgcgttacaccaacggagtgttccgtatgtcgcaatcaccttcattgctttagctttgattttgtcagtcatgattataaccgcccatttcgctatcttgtgctttatggatatcaagataccacatgttgattttgcttttcagttcgcccatttctttatccagtccttcatcaacaagacaaagaatgtcaaccaccgttttacgctgtgtgatgttgattttgttcgctttcatggactgcgccagcgcttcacaggttttcaccagtgcggcgcgttgtcctttgattgcggcgatccgtttgttcgctttcttgatcgcccgacctgctttgataggatcaatcatgataaatccgccttacgtggatcaaccgatggatcgaagtgaacgacgatgatcgggtaatctcccgtacactcgtcaataatggcgctaatacgcagccaatcacccccagcaagccccgcaccgataagaggggtaatgataggcaatttctcaggaaacgccctggcgcgttctactgcgctcacaaagcatgaccggattgcatcataatccacttgtgggccagtaccccagaatttaaactgagtgtatgcattgaagacaatctgaccttcttccgtcatgtagatggagttagtgcctaacttccgctgatcgcctttcatagtcagtgcatcaattttgaacgcaccagggattttgtgcttcacttctttagcaatacccgcgcccatgttgcaataacagttacacccatgaatcaagtgtacttttcgtttcaggaacaactctacagcgttccctttgatttctttaataatcattttcatcacctgtatagtggcggtaagccagcacagccagccccgcgatcacaaccacaacacacattaagatataacctgtgttcatttaaattcatcgtcccatctttgccacgcttccaactcgtcatcatatacagggaacgagctttcgtttggctttttaacgtaataccagataatgattgcagcagcaatcacacacccataaaagatcactaatcccaacatcagtataatcctataccagcgttatattcttcaaccaggtaagtacggagtttttcacaacgttcattatttggcgctttggtgcagaggttcatcatcggttcagactgcaaaaactcacgctgtttaaccagcttctgacgcttgaagaggtgcgcattttcttcgccccatacataagccgcgtccagttgttcagcgattacctgttcacataccgcaacgtctttaatgtcgcgatggttgcagagttcagccagtcgaacatcagcatgagcaaagccagcaaacagagtgagtaacagcgcaagttttttcatcgttttaccttagtatgaatcgttttcgataggggtataataatgggtttcgcagacatacgcaagcactgatcgcaaactatcgctttcaaattctggattttgattgagtttcagactccaacccgtgaagcacatccagcgttcttctgcaacgtcaaaggctaaccaatacgtgttgaactgtgaacatgtatgttcgaagatatcgaatagtagtttaccgccgatcggtttcacatatggtttcacgcgttgaagcgatttcaggactgtttcgaggttactgcgatcctcattcatcgcgatacggagaatatgctgattggtttcttggttatatccatcaatccccagacccatatcctggaagaacttagtcgcatcatggaaaatctctcgtccgctgttcggggaattgatgtagaactcaatgcgttgttttggagtcatcgcgcggacacgggaagcggttttgtgatcgatctcgtctttgacctcctgacgggctttcagcaacccgttcagcttttcctgatagggttttacaatcgctcggatttcgtcgatacgttcatcaataattgctaactgctgttccggtgtcagtttagtttccatgttaagcccctacgcgcacaaagcgatcttcaattgcatcattaacacattcgtaaatgctaacgtcattcgggacgtgcttacgaatacccactttcacgatatccatgatctctttgttgctaccccacacgttcaggttgaagtaaacgccaccgctatgaattgtgttgttgccaacatcaagatacgtatcttgactttcgcagataaacagtttgcgtttttcttctccatatgcgaagtagatactgaacgattccatacgatgacgatcgaccgtgatggtttccactttaacctttggatctttgttcagttcatctaacacaccctgaatgatgtgcagcatgttcggcttgatgatagtagggtgactggtaataactcgatgtgatgtgctcataatttaatcctcaatagttggtacacacataataaaaaagcccctgcgaaattgcaagggctttttatcagataatgcgtttttcttctaacagcttcgcggtatggttaaccatgcgagcgtaatcacgggcttctttctttgaatacttgaatcccgcgttgtaactcgccagcgcctttttcaagtcgcctttgtggtaatcaagccagtattccagttcgtgaagtgcatacttggaaccaccccgaagggtttcgagcttattgattactacgcgtttggaatatgatttatccattcgtgcggacgcgctacgggctgttacttgaaaacaaccataagcatgatgattctttttgcctttccctacgttctcacatgcgcgagactcgatccaggcaatagccgctaaatgatatcccaaacgtttcgatgtttccgattcaactggctttgcagttttgcgatcgtactcatttccgatcctgaaagcgtactccaaaacctttttctgctttggtgtaatatcatccaattccttaacatagctgggggcattggctggcgctttcttcattactgttgcttgttgtagcggtaaagttgacttcacagcggggagtgtttggataaactctcctaacggatcagtcgccgcgttgccagaaaaagagcataagaaaatgctggcagcaaagataattttcttcattgtaatacctatttgtaacaagagagggctatgataccctcgtcttattatttatgcaacgattttacgctgttttgcttcggtcagttttttctcgatgaattcagcaatgttatagtttgaaatcgaaacgttcggatcgtacagttctacgatttcatcaaacgatacctgaaccacatgtttaaagtgaacactccagccagtcgtaaagatttcgctgttgtcgaacccgcaatcagggctgaacatggcgcggtatttgtatccgctgtaatctttcaaacgattcgggctgtgtgcgtcactggtgatcaggaatttcccctggtgagtctcaaccacgaagaaataacccagacgttctttgttgtccagcatcgtttcgaacttgcggttgttatcttcacggtcaacgcgagtttggatcttcttccagacctgttcatattcaggccaatcatgctcgacaacaaccccttttatgggttctttgccttgctctttacgatagcgatcaattttattcactaccgcagagagaagcagtttgtcgctatcacttaacgccgcatcaatatctgcatatttaagcactgcataacgttcttcgcgtttcatactactacatccttatcacagactggacaccggatcacacgatacacatcacgaccgccagtgtaatcagtagataccttttctttgacatcctgcgcagtgtatgacagaacagcaccacaacgacaggtagtttgttttggggtaatgcttacaacttgaaccataataacctcacaagaatagtttcacttcgctaccgcatttcgggcagacgatatgttttttcacgatgtaatcagcagcacggaagaaaccgttgtagaacacttcgtttttcttctgtacatcagacagttcatactctaacccacttttgcagttagtgcaaacggtaattagctttggactaacaataacgctgatcatgtatacctcacgaaaaaggggccgaagcccccttgattaaaagttctcttcgacgaatgcagccagtcgcccacgatatacggtatccaggatcacatgacttgaatgaccgtactctttaagtttttcaaccgcatacacaaagccgttgttaacagcagtgtttcgcgggttgtcaatctgtttaatattcccgcatagtatcagaagggtgttctcaccgcaacgggaaatgatggatttgatttcgtgattgctcaagttttgacattcatcaacaatcagaaccgaacctttacccggatcaggatgcccgattgagcgcccacggaagtaatacaggctagggaactggacaacgtttttctccagcagcccttctacatatttgtcaacttccggttgatccttaaacagaatgttcaggctcgtaatacatggttctacagcaggacgcagtttttcgcccagagtaccaggtaagaacccgatttcgcccgacagaggactatccgatttaacatacatcaggtttgcaaagtgtccggcgttaaccaggtgcattgcaccagcaacagccagcattgttttacctgaaccagcagcgcccatgatggtcaccacatcggtatttttatccataattgcatcaatgaatgacgcttgcagtgcatcgcgaggctgaattgttttcatcagcttacgcttcatcgcggattcgtgtttgattggtaagagttcaagctgatactctccagcagccactacacgccctacgagttcaccatccgacagaatgtattggttcgggtaataatcgccgtcaggaagcgaggaatagcttatttgggctacttcgccaacatatcctaacacctcgacatcatcccagaatccagggatatcgacatagccagaatacaacacatcgctatctttcagcgagtcatcgcccgtgtattgttcaacaggacagcccttagacatcgcgatcaacagcatgttaatatcgcgggtgatcagggttgcgttttcctgcatacaggtagcgataattcgcgcatcttgtttatcaagcgggaactcttctaaaccgatataatcaacgatacggagtttcacgctttccggcagtgctgggttcgtcaggttcaacgaaacccctgtttgggtaattgcttcgtacttctgccccaggattactttagacaggaggcggatcgccaatcgtgcttcatgagcggttcgctctttacttttcaggtgatccagttcttccattgtcgcagaggtgataatgatttcagtacccgcctcaacgaatgagaagattgaatatgggttcgagattaaaacgttggtatctagaacatatttcatagaagttttcctgttaattgcggggtacgcggattcgcaccccgcgcactgcaattacatacccaaacggataatatggatatatgggaacggatgaagatgacttgaacgcatacacaaggtcagcgtttttgccagttcaaaccgttcgtcgatcgtcgtgtcacattcatcgaaaatcaggttgattgcctgatacttgatcgtttgtccacggaaaatggaagtcagatcttgacgtttcgacagaatgaaagacgaatcagcgcccttatccagtccatgttctaccgcagcacaaatacccatctgctttgtcggtgcaacgtagatattcagtgtccctttagactgcttgatgatatcgaaagccgctttggttttacccgacatccgacccatatccagcgcagtttcgaagatagacacaccgccgcattcttgcccccaacgcccatcaacgattcgcgcaaggtgcaggttacgtgactgctttacagcgtcaacatagaattgtgaaatcatattgtcgccttatgcaagttcaacgtgtggtgcgtcgataaatttcgtttcaatcggaaggttcggatcgttcttccagttgatgccgtagcgcagttttacacccagttcatcagcggcttgtttcactgcattcaggacaggcaaccacactttcgggttagtctgccagccagcagggagaacgctaggatacagatccacagcatcaccagtgatgtgttttgagttcatggtctgggaaacacccttgcggacgttctcgcgctgttgctctacggtgcgcagaccttcgcgtacaccaaaatcaacaggcgagagttccaaagcacgttttaccaccttaaccagttccggcttcacgccttgcaggttgttcaggcttttctgactaaatttaaacatacatacctctttatgaaaataccctatgggctacacagggtatttacggtttaagaggcgcaacgttttacatgtaaccccaaattgcatcttccgcgcgatcgcgtttccagcgaatcgtcatttccagcgaatcgtcatttcaacactctcctgtttgtcatcaggaggaagtttatcattattgatttgttcaatatatgcttgcgcatctgcttcgctacggaacaacgcatggaaattataatggttgcgcccagttacgttacgatcatccagagagaattgacctttattttcccaatcatcatacacagtgattccgttaacaaacagccccagcccacgatgttcacgcgggaagccagtgatgatatgttttcgacccatctgtgccttttcaccagtgatactgattacttcgtacaggattgcgccaggtttgatatctttcaggacagcacgtttttcaaaagcgttcataatgtattcctcacaattagttttcatatacagattaccacaatctgttttgatgtcaacaaggtctatcgtttttatttgggaaagttaacgtgaaaaggcgatcgtgtaatgcttcgatccgttcatacgcttgtttcaggatcgtcttatcttctgggttcgttgtctcgatgcagatcagttcgtccgagtcgatagcgatcacatcatccatcagtgaagcgaatacgttcacgtcagggtgagtcaattcctttatctccgcttccatcccgtcatgctgggataacagttcgatgatatcgcgctgtaaatctccctggtacgggaatccggtttgaagatggttgataattctttctgctttggtcatatttcacctacaaaaaagcccctttcggggctgggattaaatgtctttgcactggcaaacaccgtatttggtgaaaggcttgtcaccgctcaggtaagaccagatatcgcaagcctgttcagcggtttcgaagattgcagcatcatagaagccgtgttcttcgttaccatctttattgaggaacacaggaagccagctttgcggtttgaagcagtcagtaacaactacccaaccttctttcgctttcattgcttctttgttcgcttcaaccatttccagcatttcgttcagtaagttcattttaatccccttgtttatctgtttcgttgtctacgagagagatattatcacaacggggattagtgtcaacagttattcgaaacgaattgtgctatttttgaaaaacattccagagcacacagatcctttgatctgcttgccgttcacaccagttgcttcgaatccggttgagtatgtgtctttttcagaacatgcaaaccacttgtaacccgtgaactggatgttcgtataaccctgtgcttccaggatacgctgtgcctctttctcgtcagtacagcttgactgcaagaacacaacaacgacaaccatcaaaatacacacaacaattttccacataatttatactcttttaaggttagttttgctggcttcgatccagcttacttggttagatccaatatcacccagacatacagttgtatgactaaatgtgttcggtaaagaaacaccatcaggagataacaacaaatcatgtacacttacgctggttgcatacaaataaccaccggacgtatacagtgtttttatgaaatcatatgaatcgttgggccacttgaaacggtatttctggttccagagttcaacttcatgcacatcatattcatcgaacaggggatcgttgccctttgtcgcttcgtaaagcgcaccgcgccattcaactaaatccgcttcgatatcacttacacaaaactcttcttttgcgctaagtttatcaagcatcatttcaatagtgcggatagccatgcttaattcacgatcgagtttcatacaataccctcttcttcgagcacttcccagatcaggcgatccaggtgcatcaggttccacataacggagtcatacgaacccagcgagcgggagtaaatcactccccatgaacgataagccttttggaatgattcagcactgttttcatcgtgcggcatatcgtcacccgaagcgatcagcagtttcagaaccatcaggctattgagcgcctttggcgtgaattcttgttcgcttaacttcatcgcgtaccgttcgatgatcgcgattgacttcggatctttaatacgcccatctgtacggcgcgttttaaacgcgctcattaattcatcaactacggcggtacacttcatatgcttcatccttttcctgtgcagacatccgattatagcggatctcttcgcgctgttcaacttctctcacggcttcggctttcttctcagcagtgagtatgtgatgaactacagcgtttcggattccccagagatattcaatcatctgcatatcttcaacggtgtgatagcctttcgcatcacattcaaatacaatttcatcgcgttctgccattgccacctgtgcggtagaaggacaaataaccattccagagtatttttcaatcaacgattccagtgtacgcggttttgctggaatgtcaatagataccggaaccattcgcatcgttgaatcattatgggattgataaatcatcagaatgtaatctccgcaaactgcattctacgctcaatcgcatggatagcgttatcgcgctgttctttgttttcatatccagcccaggtaatcggggttgaacagatcaggtgaaaagtgattgctgggtgtctcttcccttcaacaacgattgttgcatcatcttcgatccaggttacgtgatccagattcaccggatagtttcttacggtaacagtttcaccaaccaaaagcgacacgtccagaatatcacgatcgcggacatatgatttaatacgagatacgattaacattatttcaactccactgcatatacatcggtttcaggggctttgtgtacgcgcatatctttaccacataccgcataagccggacagttacgacaaccgttatgatccttgttgccagtcagttctttacggaactgttttgttttcgggtgttcccagatatccttcacaaaatcttcggcttccagaacatccagaccttcttcccagccaccttcaacccagcgttcggtaaacgagcaagggaagaactgaccacgttcgttgatgtaagagctaaacatcgtcgcttcacagtcttcggcgtattgcttgtactgttcgaagttcgggtgtccctccatcgcttcaacgaaagcgggggctgaacagctatcgaatccaaatcctacaccagaatcgaggcaatattcaacaagttttttatattgttcgcgggtaacggtgtcccagttcttaccgcgtcctttttgtttcagtcccaggaacacgatcgcgtttacttgtttcaggcgcggatcattcttcacggcatcaaccacgttaaacgcgtcatcataggttttcgagctaaccatgaagtgaaggttgatttgctgttgtccggcttctgtcaggttcgctactgagtcgaaagcgacatcaaaaccagcgtgtttataaaccgataccgcaacagccccagcaaccgccgctaaacgcgctgcaacgtcttttgatacgtcagcaatggtaaggttcggcacaatgcctttagaacgcgcatacgccatcatatcgaacatatcagggtttgtttgtccctgtgcatcagcaccgagggcgcattgagtaagccagggcattttgtcgatgatttttttgaagttggcaagatccatgttgaacccgttcgggttattggacttgtagcagaacccgcagagtttacccgctggcccgttgcatttggtagtgatctcgatatcgagaatttcggggaatggtgcgtattctggatcgtgggaatatgttgcaccccagcgagcgaattcaccagtatcaacgttgaaattatagttgtagaacttcgagcgagcgaagcgcatattgccgtgttgatagatgaacagggacggcgctttgatgctggtaacgatatcgacagatttcataatataattctcaaaatttaacgtgggattggaagacagcgcgagcaaggctttcattgtcgaacggtatcgactggtgtttctctttgctgtcaatattaacgcgccagaactcactcgaaccgtttttggtggagtaatgcatcagcgttaccgttttattcttttccaggaaagtacgtttgtcaatctctgttttgatttcgtgctgcatcattttacactccgtttcagtttacgttcgtcagccagttcttttttgtacagtttaatgtacttcccgttaaggatgcgaagctgttggaaaactttgttacacaaagcacgttttgctttgtattccggcgtattgcggattgattcgatcgtcatacccatttcgtttttagggtaagcgcttaactccgcgccgatctctctgtaccagttgcttaactgatcacgctgtgctttgtactcttcaaaagttaacattataactgatctccgtaatctttcgctgcatcttcgggggttgcatccagtcggtaaagctcaacggctaacggactgggtttgatttcgcggttcaggatctcactgataccgcgaaggaattcgatataaggacggaatctcatttgatacgtaccgcgttaaaagcctggttgcgcagttcataagcctgttcaagctgttcagtagtgaacagagggctatcggtattagtggtgaaactgcaaatggttttgttgtcggcgttgacttcttcaacaacgatttcataaccccatgccccgctgtactcacatttcacgttccggtacttgatgtaaaccgctgcaatatcttcttttttgtagttccggcttttgtagatgatttccatgatatcctccttcgtttcgatgtgtgtacaataacagatcagggttatggagttttagcaattcgtgctaattacagtagcatttccatttgcaacagaacgctccagggattcggcggtaacagaaccattgaccgatattgcttgaccaccaccagacattcacgccgtcagttttgaattcgatgttcaggtagttactgaaaatatgtttcatgttattccccttatgccattttcttagcgattttccatgcggctttgaacgctggaacatcttcaacatcaacccagaaaccagaaccgaaaccatcgttgtagcaagggcaaccgtcgcagtagttttcccaggtcatcactttaccaccaacagaagcaccagtttccatcgcacgtaatgcatcttcaactttttccagtttttctgcattgtcgtcataaatgatgaagtaccatttgccgttgtattcgttacccagtttgattgcttcgcgaacaagtttcatgatgatttcctttttgtctgtttcgtttcgatgtgtgtaatataacaaaagcccctggcggttgcaaggggctttttaaacaaaaagtgctattttgtttcttcgaggattcgaaggatttcggcgcgggtgatcggatgttttgccagctcacggatcgcgtggtcaacgtgtatcttacacatcaaaaacttctccccgcacttgtcgcatgttgcatacatatcgccatgtatacgcccgatcccatcggttacggaatgatgcatccaggcgtaaggagttccccgcatccatccggtagcaacatgtttacattctcgttttcgtccgaacatattaccacccgttaggattgcggaaatgtgtttgccagtagcgcagttgttcgcggttcatgttttggttatcaatcaccataccctgaatcatctgcaacatcatgcgggtttgattgacatcctccaggctcgctatacgctgttttaaggctttgttttcctcttctaactcaaccatacggttgtatgcgttgacgcgctccagaggcatatcagggcgctctttgaggacacgggcgcgggatacttcgcattcgtgatttgctttccagtgcgcagcttctgattctgctttttgcttgtctcgaagcgcgagtgacagatcgctaaccagatccagaaccgtttgcggatctacggtttccagatattttccgagaccctcttcccagcttttaatctgtgtagggctgtcgccatatggaacaccatatgagaacgcgcgtttatactctttgcccctgaaaccatattcctgatttccctggatgctcatattttcaacgagagtccacttactacccatcatagaagaaatcgaacgggctgatttttcaatttcttcaagtttttcacttgttactttcattttgtactccacaaatcatattgtgcgcgaaggatagcgtaaaggctaccgatattgattgaatcgaccggacactggaacatatcagagcgcatcatattgaactcaatattgttctgttcaacgaagttaccgatcattgatgtccagcccatcaccaggttatatccgtcttcggataacccgtaagccaggttaaccctgatacaacgcttatcagccagttctacgctgatacagttacttgaatgcatggaattgcatggaaatttgttaggaaacttacggaacatctgggtaaggagtttagccgtttcaatgttgatcgcgcgttcctgatccctttgcgcctggttgtcatgacggcgattcagatacttttccatttttgggttgagattcacatgttgcataatatattcctcacaggtttaaagcgttcttttccggttccattacatgaactgcatttcggagatcggtcgctatcatatcgccccgatccgttacatgcaacacatttccgtaatttccagccatacacgaaccgcatgtaataatcggttcgtgcggccttgcgttcgtggaagttcatactttgttgtaaacctgaaccagccacatttcgatgttcggcgcgtaagtaacgtttaccatcggcatagtgcggtatttgtaagcggctttgtacgcatcgagttcagtcggaacacagaaagagaaaccgttgtcataacgttctgcattagaaacttcacaaccaactacagcggcaatgtttttgttcatgttcatgatgttttcctttctctgtttcgtttcgatgtgtgtaatataacaaagcccttgcattgctgcaagggcttttttcactttaatcgaatttttctggcaactgatctacaattacctgagtttgatggatttcttcactcaatttatcgcggtaatgaaccagttcacgggttctggatgctgaatagctaatgattttatcagcggtagcggtgtaaccgtaaccagcacatgcgatttccagttttgcgttatcgccattcggtacgcggatatgagcataggtcagcaagtttttaaccgcttgtaacagttcatgatcttctttaccgatgataaactgatttggttctactgaatcaatgttcagttcttcgtctttgttcattttgcagccttatacatttcaaggacgcggttcatatgctcttgtgattgaggcacacccgcgaagttcagtttgatgaagaattccagacgatcctttttggtgcattcatccagccccagggcaggtaatgaaatgttttcaaaggctcgctgttcgtgtcgtggcatttcgtcccagaacaaacgggaaccgtccggcataggaatcccaatttcaccttcgtagactttgataatcgtcgtcaggcgttgtttaccgtcgatgacttctacccagtgagtttcgttgaactggctatcaaccgcgatcgcgatgataccgcaagggaaaccactgatcagggtagtcagaaacgcatcttgctctttctgcgtccacacataggggcgctgataagatggattcagatccagatctttattcttccaccaatgcagataactcccaaccatgatcgcgtgatcgcgactgcgaaaagttaactgatcgcggatacggttatgaaccggaatatcatctttagacatgattcaccacccaacccaacaaaccagtattgatagccgcaacggtaaggcaaatcacagccaacacccgcgcgttatgaactttagttttcagttctgcgatctcctgatccttttcactttcgaactcgtcgcgggttccatagtaaccaggatcagcagcggttgcgatacgcactttgtctgtttcgaataatgttgattttccatgatccggcccaaccacacccagaataccatcacggtcggtattgacaattccgtgcgttccggctttggcaaacttaccatccttaacggttactacacgatcgccagctttgtaagtcataatatatcactctttcacgttttgttgtaagaactctaacagctttccttcggcctgtaaagcataaagtttattcaactttgcgatgttttcaaagtctgatttttcgctgaacgaccagacaccatcatcggaaaccagcgcacctattgatacgccagtttcaggatcacgcgtcaacgccagccccaggggatgtaggatatctttattgattttccagatcaaccccaattgagataaggtgttgaaatcaacgtgactcattaggcatcgcaccgaatgacagcagccccatacgatgatcgttatctgattcaccagtgctgaattcaaattcttcaccgctgatactgatagcacggaaaccatctttcaggtacggcaacagatacagagggatcagcatcatttttgaatcgtcatcccacttacggaagcccaggtttttcatttcttccagagtcaggtcatttggatcgactggttcgaaatcaggggaagcgtaaaggcgtccaggcagatcgcgaatatttttcacggtgaatgaatcaccccatgactgatacgcgataggttcagcggcgcgggttgcggtagccagaaggatcatttggcagatttggaaagtagttgcttttggtttcatgatgtatatcccacaagtttagtcagtaaattccccatagtcttacgcgcatgatcgcggatctggctatacggaacatatttgaagtcatccatttcagtaatggttcgaccatttttaacgaaggttgaagcacaaacacatttttctgcttcggggtaattattacccacatatacgaataacacaagctcttttttactcgtataatcaatcagacccaggctcaacagttcgtgttgttcaactacaacgcccgtttcctcgaagcattcacggatagcagcattgatcggggattcgcctttttcgatatgcccctttgggatgtcccaatgaggcgtttcggttgcgtggcccattaaaacgctgccgttattcaggaagagaataccagcagaccgttccattactgtgctccgaacttacgatcgtatgctgccagcgctttatctgctgcatcaactgcctgagtgtgtttgttagcggatttctcgctgaacacttcgcggtaaatggcaacccagagggatcggcgggtctgttcgctttcttcattgacgcgagaagccgcaaaagcgttatgttctttgatcagttgtgcgaattcagcatcatgatcaatggtttgttgttgaatagctgtagaagtcataattcacctatttctttcagttcagttttgagtttttcgagggttgattggtactgaatgccgttcacaatgtcgttgcgtcgggcataatacagcgtaccagttttgtttatctctgccaacacttctttatcgagtttatcaggttcattgctaaatgcaatcctgaacatttcttcggcgttcggcgcgaatccgttacagaacgtgataccgagtttcggatcgaagaatatcagggatactttattcactttttccataatgttcttcgtaatcctcgcattctgggagataggtttcgcagaacatacacagcgtgaagaatgtaggctggcgaattccgatattatcgggtaagtacatccagaacgtgttagcaaacacgatgaacgttttcaggttttcaacggttacggtactgataccgtcataaccggattgagtaattgcgcgttccaggggaacagggtattgctcgcagtagttggcgtaatgttcgcttgtcaccagcgcattagccgcttttacgagatcggtaattttcattcaatatatccccaacgaatttttacgttatcttctgacgccggacttgtaggagtcgggtacggatagctttgcgcttcccacagataaacaacagcatgttttgtcaattcttcgataacttcatcgaaagtaccgacactggtttgtaaaggcaacgagaaaggtttatcgttggtttctacttgagcgattggcccatctaccaagataacacgaaccgttgtgtgctcagacatatgagcatagattttgtttttcatgcgggtacatattccactttgacaggttttgcgataaggcgttctttagtgaagccttgcccgttacagatatcacaaacgtaactgatatcttccatctgatcaacccatccagaatccggcaagccagaaggatatgtgttgacacgtttgacttcaaaccctttaccttcgcatttagggcatacgtgcggatacttcgctttcagttctttggagatctgacgcaaagttttctcgccgccgaacacagcacacaattgctgtaaatcagggattcgaagatcggcgggagtaatcacactaaatttcttcatcatatatttctcacttaaagaattttttaatgaaagagaggaacaatccaccactgaacatgatccagtatcccgcgccgtcaccgttaaacaggacatacacagcgacaccatagcaaaagatttccgcgatattcagtaagtttctcataactccctcctttgtctacaccaggtattttaccagaaagtagattactgtcaacaacaaagttttatcaacccacttatcaccagtcattagtaatcccctacaggttgagaagatgcaacgctcaggatacggaaagagcattcattccatttgcaataagttttcgcacagtgaacagtgcctttcattacaaacccgtttgagaataccagccagtaaagtttcatgattgcctcctttgtttcgacacccctaatataacaaaagcccctgcacgaatgcaagggcttttttcaaatatttttcaacatgtgtagttgaggcggacaatcttttgaagcaatcaggcgatccaggcgtgacataacgcgtctgtagccgtcatactcgaacttgattttgggtgcgatgtaatttacatgtatcgcgtttcgcgtgttcaggctcaatgtatactcagggataacggttcggaatcgtaaagcaatcactggcttttcgtgagcaaccgaatcatccatgttttcgaacatctggacggtgaacgcacaggcaaacactttgccattaatccggcgatatgcaatgacttcctgcataccttcgtttttcgctttcaccgcgtaatacagaacgttacacgaataatgtttagcgagactattaagaatttcactgtagatctcaaagtcttttttgactgacgcggaacgatccaggaatcggtctgcgatgtgatctgtagtcattgaaacctttgtcacataccaatcacttaacgctttactgaaattttggttaacttctctgcgtaagttattgataacatacatcaatcgtgctctgttcataaatcacccattatgtttaaagtattcgatttgacgcagacgtttttccgctgcctctttcgaatcatattcaccaagttctttcgtgcgatcgtggttcagtacaacccacttatcgccgcgatgttcgatgtgctccgtgatgtcttcgactttcttatccagatccagcggttcagcatcttcctggatgatagtcaaatctacgggcaatgtcaacagtcttttaactccgctgatatcttcgatgcgggaatcatacgcgagggttacatgtggtttgtaatcgtcataatcgtatgttgctccagcatccattgcatctttgaagcggctatggagataatcagactccagaacgcccacgatcgtattaccgtatttcgtttcccacttctccacgtcaaccagtcgggcaggttcagagataccggatgcagggaacagatcaaccgtcttacggctatacacaatcgttgtatgcagctttgcagcggaaacaggattctctacacccagaagtttttgcaccttcgcgagcgcttcacaggaagcctgatcgaacttcgcacacatatagatccccgaatcaactacgggtttcgctacttcaagaaaacttttcatgtgtactccaaatgaaaaaggggctttcgcccccagtggttaaacgcctaagcgttaattatgcttttgatgcatcaatcgcttcattatcaccagcgatttctactgttgctggcagaagtgctttgatcgcgccgatcagggcatcaggggatacaccctgcgaaccgtcgatttccagaagaccgcaaatctggcctacgagttgacggtgatttgccagttcttgttctttaccctgaatgatttcgttcaggtcgaatacacgggctttcaggatcaggacatcgttttgaagctgttgggtttggttttgttcagtcattgtttacactcttaaaagattgaatacattaagcacgttacgtttcaaatcgtctaacgtaccattatttaggattgtataatcagtcaagccaggtgtcaaacctttctccgttgaatgattatcttcaataccagtttcacgttcaaggaacacaaagcgagtcccgaacttgctcaggtatttatattcgtgcggttgacgcacatcggtaatgataaagtgatccgcgtaggatttcaacattttttgaatagcaattgaagtccatatagacggatctattttacaaacaatatcagtcccgaacacctgcatcaaacggcgaatcgtccagggctggctgttttcttcgcaaattttatgagcgataacatctgcgttactcatgaagaacccgcgagaacttaattttttgataccgctagaaaacagcgcgtatgcatcgttattggacatcaccagcggggcttcacgatcaccctcatagaatgggttcttcgctgccagcgctcgcaattgcgtgttatcgtgatgttccatagaacgtttcaggatagctttgatttcgtcggctaacgcgataacttcaacattacggaagttatgcacaaccatttgagcaacggtatctttacccgttcgctttttaccacaaataccataaatcatttttgcgttttccgtggagtaggcacgatcacccgtccgtcgatctcaatttccatgtgagcgaagttgaacatcgtcatacaggatacggcttcatccgaatcattggtatacataagctcaagctctccgaggttggagggccaagcgccatagaagcgaaatgtcgctacagtttttgactgcgagttatccaggatatgcaaagccattgcctgttgtggttcactccaacgcacggaatcgaaggtgttaaaatcgacagtaccgagcatccaaaggtaaaccccaagatacgatcgcagttcttcatcaacagcaaaacgaatagtcagtggatcgaactccattgcagatcctgggatcttccctcgaatcattgggttcagtgggacatccgtaattggaatgttgatagcaggtagtgtaacaccctgaacttgtagtttcaacccttttacataatcattgtcaggaatatctaacatgaagttagtaggtgaaatctggttcaggatcatagcagttgtattcatgatgatctccattttatagatatttagatcaagaccgtgagcgaagcgaacacacgaacgaagtgagtgttatgtacgatgtactgtttataatatttatattttatatatagagaaaacagtacattttcgtatactttttatacaatcgttaactatccgtcttcgcttcgcttgacggaactcgcttcgctcgcgatctaatttttagttgatctattcaataaataggtatatcatacctatactttcaaaagagattgaaaacatgaaatcattcaaagaactactttctgaatctgttcagaacaaaaaatttgctaagaccgttgatctggttgaccgtggtaacgctgcaaaaggtcagattggtttcctgcattttgcacatggtgctgattacgatgtgtatgcgccggactcccacgatctcgcttacttcggtaaaggtgttgtccgcctgaaaggtaaaaccactggcaaaactcaggcagcgtatattgactgggcgaaaggcactgtttcattctacagcggtgatcctgctgatgacctgaaatttgacaagccactgaaattcaaaggcgcttccctgtacaaagaggccgaagaaaaccttgatctgtataatcagttggcggaagatttcgaaattgatctgcctctggatgaagcattggtgaaaggaaaggtgtacaagctcccaagtaacgatatgtgcttgctgtataccggacgtaccaaaaccaaagaaacaggtgaatacgccgtgtttacggttgtagatgcctctggtaagcctcgtctggtatcgggtaaacgctttacccaagaatacaaaggcgatgttctgtctaaactggttctcgctgaatcggaagatctgaacgaagccgctaaagatattcgcgaaaaagttattgcggtgttggtgaaacgtgggtttaacgaaaaagacgcagaaaagatggttgataaaaacctgaaagatgcgatgaaggttcgacctggcgcaacccctggaaaactcgcggaaatcgtgagtaccctgtaaaaataaagccccttcctttcggttggggctttttgttaatatctgttccaaactttcttcgcgctgtatggttttcctttggactggaaagcctgtgtaggcaaccaaactgctttcgcccaatcttttggtgcgatctctgcaagtggtgaacgtagatgggctggcaggtaggctttgatcatttgatcagccccgcgcattcccttcacgttgttccagttgattttcagtctggttttgttagaaagtcgatctgttgatccgtagccacgtttcaggagttcttctaaaaactcttgacgtgctcgcggtggcgcatagtgcaagttcagcccgtacagaaccaagttacccgctttcgaacgtcctgaacccaggaaaatgatcagcgggaaccgatcccagtatggcagggtgtctttgtatttcgcatcgtagatgaacgtatacaagcgacccgttgctggtttcgcaaccctgtgcgtcttaatgctggttttgatgaaatcaccaaaccaatcggtcgaatctttctgacgtttcgcagcggttacaccaacagtcattttcttcaaactgttgcggaaatcgtttacgatatcaaccgcgtgttttttgcgatagtcattacgtttgcgtcgggcttcggtttctgctttacggcgttcgatttcatcatcaatctgctgcttatagcggtgcatagactttgtgaacgttgcgtatgcaatcccgttttcgtccgcgaactttttggctgtcatgccttttaattttgcgcgtcggaatttgataccaagttcaacccattcacccagctttcgcttcggtggcggttttggcttgtcttcttctgcgatgatctcgaactcaaaaataaaactcataattccctccgtttagggtatttattgccctttccatccgaacacacgtttcaatgtgtcctctgtgatgatcttgaactcccagcccttttgttttgctgctgcattcgcggctttccatttgtcgatgtttaccgcataagtatacagcgcatcaacaaatttctttttgttgtgaacgttgttgttcgctggcttaggtgggggcaacgtttctttcatcggtttgacttcccaaaggtaggtcacaccgttatccatttcaacatagaaatccatgaagtagcgccgtcgctttccgtctgcgttgctgaaataagggatcacaacctcttcactgttccagcgtttcacatgcgggtttttatcaagccagttcataatatatttttcccagcttgaacgatacgttatctttcgcggatctcccttatatttctgtatgttctggggcataaaagaccccttgtatgtctgtcttccagccattttagatcctaaatatagtaaacattagataggggaaattacaatgttattttcgttctttccaccagttgattacaaaggcacaccaactactgatatctaccgcgattatcgtttttactttaaccgcgtgatcaggaattataagccgcgtacatatcaactgacaggttcattaagacccgaacaattagcggaaacgctatacggaaaccagcaatactactgggttatcctgatgcttaacgataattacgatccgttttacggatggattaccgatcaggaaacggcttatcaatgcgctatccagcgttattcaaaagcaggtggtgaacaggttctttatcatatggatggtaagggcaaccgttattacaatttggttgaagaccctacgaatcccggtcattggtatgacaaaggcgataagaacatgcgttatttgcagtaccagggaacattagtccctgtagatatttatgaagatgcggtgcttcaaaatgaagcaaaacgaaccatcaagattattaacccctctgatattcaatcgtttgtaagcgattatatcaaggaaatggaaaaggcaaacctatgaaatacggtggaaataaatactcccctttctttgagggggtggtcgaagaagtcgatgatcctcgtctactggggcgtgttcaggtgcgtgtattcggtgagcatccggcacagaaacaaaaatctgaaactatcggtattccagttgaggaattaccgtggatgatgcctattcaggatattcgcagcgccgctatttctggtgttggtttttccccgactggtatcacgcgcggtagttttgttatcggttactggcgcgataaatggcaccaggacggcgttatactgggaacctttgcgggtgagtaccgagagaagccggacacccagaaaggcttctgtgacccgtttggtgagtatcctcgttatgtaggtaatgatgtcaacgtactggctcgcggtggcgcagaggggcgcggttcttcgagcgtgattattcgtgatgctaacagttcgttagctgtcaatccagatgatcgcccacttgacgagatcccagaagataaccgtcctgatactggcgggttcactatcgaaaccatgcttaaacaggatgaaggtatccgcacaaaatggtatattgatagtgaaggttatccgactatcgggatcgggcatttgcttatcatggaaaaaacccgtgatactgcgaagattaacgccgcgatcagtaaagcagttggtcgagaagtaaccaatggaacgatcacagcagaagaagtttcaacgctgtttgctcaggatttggcaaaagtccggcaggggatcagcaacacttcaaacgttcgagaagtatacgtgacgttaaaccgtcctcgtcaaatggcaatcgaaaacatgtgcttccagatgggtgttggtggtgttgccaaatttactaatgctctggctgctatgaagcgtcaggactggcaaaccgcttacaacgaactgcgaaactcaacatgggctaaccagacaccaggacgttcttcacgcgtatctaaaatcgtgctgacgggcaacctcgaatcatacggtgttcaggttccagatccagaagggcgttcattgagtgctgcatacaatgctgttgtgttggctgcatcaaacccagaagatccttttgttcctggtgatactcgcgtaatgttcgaggaacctaaatccgcatacgctgctgaatatccatacaacatggtattcgaatcccgttctggacacattcaggaattcgacgatacaccgggctttgaacgttacaaccgtgttcacccagcaggatcatacgaagaaattcgccctgatggaacccgtgttgttaaaatcgttggtgatgattatcaaatcgtcatgcaaggccgtaaattaaacgttaagggtaatttacaggttgttatcgagggtgatgcgttcatttataatatgggtaacgttcaacagaccgttgatggtaacgtgaccgagttcgttcgcggtaatgtaaatcaaaccgttgaaggtgaatatttggggctgattaaaggcaacgcagaattaaccgttgaaaaagatgcaaccgtaaacgtgaatcagaatttaatggctaacgttaaacagaatgcaactgttgccgtaacagaagatgcaacaattaccgcaaaaaatgctctgattgatattgagcaagatttggatattggcgcacgtaatatcaacatgcgagcatcgaataatactttcattgattccggcgcactgactaagatcactggcggaacagtccaagttgggtaatgtatgaattataaacgcatctacaaagaaatcatcgagaacaggagaaataatcctgttagtggaatggttgaagtacatcatatcattcctaaatctatgggtggtgacgattcagagggcaacttgattgccctttcacccagggaacattttgttgcgcattatcttcttgcgaagattcacaacaacaaatctatgtggtgtgcgtactggtttatgtgcaatacccgtgacgtgaaaataacatcacgccagtatgatacagcccgtaaactttcgagcgaacatttgaaaggaaatactcatacgctggggcatactttatcgcaaagtcatcgcaagaaaataggcgatggtgttcgtggagaacgtaacggaaactacggtaaaactttttcggaagagcataagagaaagattgccgaaagtagaagagggaaaccacacgacgaagaatcccgtaagcgtatgattgaagccgctaaacataaagaaaaagttacctgcattcattgtaatcgtgttcttgacaaaggcaattacaagttatggcatggcgacaaatgcaaaatgaaggtaggctaaacatgatcatggattatgaaaccatcattgatgggattatgcaaaattttcagcatccttgcgatgctgagatccccgctggatattacagacgcgttatctggcagggacacacagaaaattaccctgctgttggggtagaatgggcgaccgaaatcatcccgatcggaactcacctgtatacgagttcccctttcggacagaaaagcgatccgcttccggtggtgaactctccaaacgtacccacgaatccagacggaaccccaggggtttctactgacattctggttacgaagattggttattatttcgccagtcaagcggatattgatgcctatatcgcatctatcggggctactaagctcgcgggtaatgactggtacggggcggatctatcaaaagcgaatctgttcaagaaccctggcgaactcgcgatgtacaaggtggaaaactccggtggttacttgctgacttccggcccccgttgcgatcagcgaatccgacaggtatacaaccagactacaggcgcgtttaccagcattgattactactggaatggtaatcgtattgcgtacatgaaacacgacgaatcccccgcacaccagtgcaaatatacagggatgtcagtaaacacgaacgcagataccagcattcctccggttcctcctgctctcccgtcaacgtatggggcgctaccgagtgaagccagattgttttctgctcgctctggattgggctgtattccggcgaccgtggggttcccgtatacgaatatcagcgatgctatgctttccgcgtggaacgagactcgtaaaacgttcaagctggctttcgatatgctgacgggtacaattaaaaatggctctggtatcgcgacgatgtttgacgggctttcaatcgggatggaagaaatcacagcgggtgctctggcattgtcacagcaagcatggcaaaccgcaatgaaggtgttccggcagatcattagctctgcgtttaacatcgtgggtggggcatggagtctgatcaataacttcctcccgactgttgcgatcctgggtgttgcaatcaacatttacgatctggtgtttggtgatagttcggttcaatccctgaaagattctttccaggctctgattgactccggcgcacagacgtatgaaagcgtcataaacgcaatctacggggctataggcagttcttacaactacaccgttgaatatgtcaaggctggcgctcgcgaccttgtagacgcttgtagcgcgttatttgactggtgtttgactatgttccaaaacggttgcgttgctctggtggatttgtacgggcgtatgatgcagatctggtcaatgcctccagaaacaccaaacccgctttggtctgcggtgctggctatccgtaacatcatgcgacagattaaacctcttgatgtgattctgggcggtaacttcccagggtttacagcaatggatctgtatcagcaagcacaagcgaaagtgaaagcgttcattgatgcatcctatgcgcagatctccgcattgtatgatcaggggcaagaactattcaacaccctgaaaacacagacacaggaaagggattcgattaaacgcaagttcgatcagtacctaaactggatgtgggaacctgtaacggaagcaacaaccgctgcttatcaggctgcacttgatgccgctaacgctgctgtgaatgcgactaaggccgcatatgagggaatcaaagcacagattgctactctgcaagatgggatgaaagacacctacagcatggcaatggctgaactcaaaaaactgcctgtaatggctcagattaaccagttcttaggttactgtggggttgcattcgatgacctgttaaaaacgtatgagaacgcgctgacgggcgcacaatcgctatataaaaactttgttgacagttcccgctcgtttaaggacacatgcaaggtgatttataaccagatttgtacgcttgctctaagtaaggtaactcaatacgtaaacaaattattgtcattaatcggactcgcgatcacattcggttcaattagtgtttgcgtccctatggttcaatactaaatacccgataacgaggggtaataatggctactacaaagaaacaaattaatcagatccccgatatctttgtcggggctacttttgacgaaatcaaatctgacttaatcaactggctccgaggtcaggacgaattcaaggattatgatttctccggctcgcgcatgaacgtacttgtggatctgttatcatactgtacactgtacattcagcaaatgagtaacaccgcactgttcgaatcgtttattcgtaccgctgcattgcgtagttctgttgttcaacaggctcaggatttgggctatatgccggactcccgcaccgctgcaaatacttcgatcctgatcactgcgaaaaacccactgaacccaacatcgatccgtattccacgcggtacgaaattcatcggtacagtgaaagaaacaaacagtttcccgttcgtcgtatccgatgacgtggtgatcgttcgtgacaaaaacaataactatgtttcgatgttgaacatcgttcaggggcgtttagtccgtaccgaagtcatctttgatggttcgactatcctgatccgtgatccaaacatcgaccgtagccaggttcgtgttaccgtcaacggcgcacaatgggatgactggacaaacgaaagtatcgtaaacgcaacgggtgcatcaactgttttctatatgcgtgaaactgttgatggacataccgaagtttactttggtgaaggtgaaaccagccaacaggtcgcgggtggtgctctgactgctgattacatcgggggcttgaaacctgcaaacggttcaaccgttgttattgaatatatttcaaccaacggcgaagaagcaaacggtgctgaaaactttgtttacgtggatacgttgacaaacattagcattacgagtattgttgagaacccgactaattcagcggactatgtaggcgctgatggtggtggtgaaccggaagatatcgaacgtattcgcgaactcgcgcctatcatgcgtgagacacagcgccgttgtgttactgcatcggattatgaatcgttcttgtctcaccgtttcggttctgttattcaggcggttcagtgctttactgataaagaaaaacctggctatgcgttcatcgcggttaaaccgaaatcagggttgcgtttgacctctgttcaaaaagaggatatgcaaaactatctggcgaagtataaccttgcgacgattacgccgtcgatccttgacccgaactatctgtacatcgtacaaagtatcaaagtaacgtatgatatcagtaagttggttgaatcagaggaatggttgcgtggtcaagtaatcaatgaggttgacagatattatactgataacgttgaaattttcaacaaatcattcagtaagtccaaaatgttaacctatgttgataacgcggacgtgtcgatcattggttcttctgcgactattcagctattgcgtgaacttgataactattacagcgctccgatgtctggtattcacttcttaaaccaggtgaaatcacgttctgttgtttcgaacgggttcaaatacacaaacgctgctggtgattcgtatgatgtgcgttatgcatcaaccgatatgaacaccacaaccggacgtgcaaaaattgttatcgggccattcaaaaacggtgatatcagtatcgcagcctatacaggaaccgattttgataaatatcctggagtgaccgatcgtaataaatattacgaagtcggctatgtggaacactacactgatttcattagtttcgatctgggtgtcctgaacgttccatccgagcgattcagcgctgcttatatcgaactgactggtacaccattggaagagaacattttcacccgtgatggttctctgattgtgtttgaaaacgatctccgtcctcaatatacaacattgacaatgaatccaatcagtcaataattttaacccctgtcatccggcaggggttttttgtttgctaaatatgggatataagtaacgcaaatttggagaaacataatgattaaagcgccgtcaattaccagtttgcgcgttgataaactggctgctaacttcgtttatttgaagtgggatagcgtcggcatggatttttactatgtcgtggaaatggcagaaactcgcggggcaggtggtgttactattccagatgaagatttaacctggttccagttgggttacgcttttttgaatgaatggttttcttccgatgtccagccaaacaatttttataaattccgcgtcatggttacgcacaagggctttgaaccgtctgattgggtttatacagatgaattatggacgttcagccttaacgcctacgcatattcaacaatgcgtgaatttacgccaagtgatgcattcataaacgaaaaattcgcaaagaacaatcagaactacgttaacttcaatacagatgtggtaatggcagcgttgatgaaagaagactttgtgttttctccactttacactgacgtatcccagatcagcgataaaattcttacacaagaaaactatcacgaaatccaggatcatattgaacacgtttgtaatgacattaacagaactttcctggtagcgtcaaacggtttgctgtacctgtttgaacgttttcagaacatggcaaaggtgtcaaacgacaaagggcagacatggcattactacaaagcatttaacgaccgcgtaggaaaccctgtatcgcgctctattgcgtaccaaagccgaaacacaacctatgtactgggttacgatcgtatcttctacgggcgcacctcaacggatattcgctggtctgcggacgatgtgcgattctctgctgatgacgttacgtttgccaaactggggaaccagactggccttgatttcgacgtagactcatacaacacattcgctaaactgcctggtaacgtgtcgaaatatgcagaagcaatggcatgttccgatgactggctttatgtggttgcgaaaaacgttgtgcgtcgtatcgcactgaaacagacaccgatcgacaccgatccgagttctccgacgttcggagaaaagattttcgatacagcaagctatacagttgtccctggaaatgataagatcgttgtcaagaaaatggatgtgatgaacgggattctttatgcactcgttacgggtgaagtgaaaaccgctctgcaagatcctacaaaacccgctaacgtggttccgtccgctgctgctggtgtgtatcaatggaaagaagacacgaaaacctttgtgcgcctgtacgggaacaccgagaaagaacgtttttatatccagcatgaatacaccaatatgtcaacgaacggcacggagatttttatttccgtagcaaactacaaatatccaggcacacttcccgatcctgaattgttgatcgagaaccctgcactggtcggtgctgtaaaatatgatctgcgtcctggctatactgccagccttgcgattaactttgcgacgattcgcgctcatatcgacgacccgactgtttggaaatttggtgcgcaggaatactacaacgaggcgaattatagctggttcttccgcgactctgtgcgcacatggatcactaatgataaccgtcctctggtggtgtatccgaaaatcacctacagccttgtaaccgatagtgctggcccttcgtcatcgcttcgtgtgaacaaagaggtatgggatcgcggacatgttacgatttacattaacaacattaagtttaccggattcacgaagtatacgaacggcgtgttgctatataagagttcaggcgaaatcatcgggttctttgaactgagttaccgcgctcgcgataacttaacgattttctggaaaccagacaatacgttattgattgccgatctgattcagcaggaacgcgaaaaaccgtatcaaccggatctgtcacctggtttgattgacccagatttaagccatatgattacgcgctttgcgcctcaaagctatctggatcagcagtatttcgagaagttcggggaatactatttgcagttcgtttcgctgggtgaaaacacctactataacaagctgcttaacctgatcaggaacaaatatccgcgtgagaagaacagcgtagaatatctgtggtcggaagtaaaccgccgtaatatctacctggataaaacgaagcgtgatcaggtggttcgtttctttgaatctcgttgtagtgatttctactcaacgaaaggcatcgaagcaagctataaattcctgttcaaactgttgtataacgaagatgtaagtgtagaaatcgaaagttcgaacactctggaatatgatattctggttcattcaacaaatatcaaccaggatattgtaggccggacgatttacacaccaacagcgagagcaaacgtgacgtatatcgaacgccagtatgatgacggtcaattacgttggtcggtaacgctgcacaacgtgatcggtaacttccttgaagggcaggttgtcaagtctgaaaagactaacttcacaggtactattctgcgtggtgtgcgtggtaagcaaatggcgaacaactcgatcgactacttcaaccgtgggcgttcttactacgtgatgaaaattcgttcgaatctgccagcgtcccgttataaggatgacgttttacgattcgtgcatccggtaggctttggctttatcgggatcaccatgctaacggtgttcatcaactccggtttgtctatgacgcatagtgaaacgatcattgacattcttcgaaattatcgcttcgatagcggttatccgaagtattggcctgatcgcgtagcacgtctggacggtaacggaaaccagacatttgaccttgtaactggtgaagcattgtacgacccgcacccgaaagcgggacaaccgtttgatgttccgccacaatatgacattgatgaaaaaccgctgaatggtgtactgccgtccgcgcgtcgatttgatcaaagtcctctgttcgatagttcagcggttaaatactctcagttccgtaacttagtggaaaaacgattgaaagacgacgcgggtaatcctcgcgatccgaatccaccgactcagagaaaggtagcataatggctcaacaaaacatctaccgtgcggtcgtaactggtaagttccgcacggaaaacatgatgaactttcgcgaaatgatcggggacacccccgatcataactcgatttatatgtcaatcgggcgtaccgaacaatgggcggataacgaatccgaccctgaattcgctcccccttatccgaacgatgatacagatggtatcgttgatatgtggacgcatatgatcgggatgacgaaagtaccaggcgaaatgattgatgcaatcgttccgcgtaaagactggggcgatactcgatatccaaacccaaaaatcttttacattaatgacatcgtggttgtaaactccgcgccttataaccgtactgactacggtaaaggatggatggtataccgcgttgtagacgttcctgatattggatcttgttcaatctccagtatcacgggtaaagttgaatgtgtgcgcattggtggcatttggacaccgacccacgaatcgatcgaacctccgcgcggggaagcgaacggtatcgacatgggcgacggctatatctgggaatatctgtatacaattccaccagatgttgttatcaaccgctgtacaaatgaacatatcgttgttccgttccctgatgaacttgaagaagacccggttcgttggggttatgataacgtgatcaaatggtatcctgatatgtacgatttggtgtaccgaatgaaggttcactcaatgcgattccgcgcgtatatggattccctgttcttcccgcaagcctctttacctggcaaccgtgggttccgtcaaatcagcgttattgtaaacccgctgttgaaaaaggcgcaaccatccgacccagaagtaaaagcaacgaggcagtattacacgaaaggacagcttgaacttgactcaggacaaatgatctacatggaaaaccgtcaaccgattattcgttctcctgatcagaccgaagaagtcagtattattttcgaattctaaggaaaccataatggcatatcaaactggtaaaaaattaattgacgtggggcaaatcggcaacccgtcaactggtgacccgctgtatgacggcggtgttaaacttaacgaaatcatcaccaacgtatacaatgcgtttggtgatgtgcgtttactgactgcgaatgatggtgtgggtacaatgttactccacgcgaccggatatttccagaaattaccgcgaacctattattcaggaaacccgattgaactaggttcactgcatgatatggatacctctacagggccaattacggttgtgcttccatcgggtaaacctggcgaggggttctatttcataaatagtaacggtagtatttctgttgatcgtcctgttgtattccgtccgcaagttggtgatggtatcaaaggggttcaggatcaactttacgtgacctctccatatactcagattaaaatctggtgtgtgaagaaagaaggttccgttactacatgggattattctgttgaatcaatgtttggttcaaaaacaatgcctgtagatactactaaactcattctgaaagcatcaccgaccgcaattcctttatttggttatagtgaattcagtggggcgaaaattctcgtgtacgcggagaatatgacaggcacagtcaataaaatggctgaaattcttttgtctgttgaccgtgtcgctaagggcgtgtattcaactgaatacgcagttctcaaaaatagcgaagatgaaatgtacacgcttacgttcactgttggtgcgagtgatattgtttacgcaaacgtacaatccaaaaccgagaatcgcattaaattctcgattaaagcggttgacaccattaaatcagggatcgcagcatgaaacaagaaattcttatcggtaacgtggttgatgacggcgcgggtgattatctgcgtcgtggtggtcagaagactaacgccaactttaccgaattatataataaactgggtgacgggagtatcccgcacccagcgggtgcgtggaaaacgcacacagcgcctacgctgacccctattttcggtgaatcatgggcgctgaataccagcaacaaccgtattacggtaaacctccctaaaggcagtgtaagcgattataacaaggttattcgcttacgtgacgtatggggtaagtgggcggtaaacaacgtccgtatcgtccctgcaagcggtgataccatcaaaggctcaccgacttacaaagaactgtacaaagacctgatggacgttgaacttgtttattgttctcctggacgttgggaatatgttgaaaacaaacaggttgacaaaatcacaacttcggatctggcaaccgttgcgaaagaaacgtatatcgcgactcagggacaaactgacttcctgaacgtgttcggccctggtaactcgtacaacgtccgcgcactggaagtttactatcgcggtaacttgctgtacatcgacgacaagagcgggtttaattcatcaaacagcgattacggttcacctggtgcgagcgccggacaactggtagatctggatggtgtaaatatccgtcttaaaaacccgtgtaacgctggtgacacgcttcaattcgttacctatctggatggtattgctgcatggcgagcgacgtatgaagcgcataccatgcgcgtatataacacgggcgacacagaacaggttagtatccctggtgaaatctgggttggtgatttatcaactaaacgcacgtttactaatgctgaatttgggatcagtccccgaattttgattaacccaaactcgttcgaactactgttgaacggtcgccagcttgttaaagcaggtgatgcggatctcccgacatttgtttgtgagggcgcagaaggttatgatgaaagtagctgtattgcgaactccggcgcatgggttccttctggacaggattacagtctgatttttgttaactccgtggttacgggtattaaatttgctcaacctctggaatcccgtgatgtggtaactattcgctggttcaacaatgatatcggtactgtcatggaatgggacggtgtaggcggtattaaagaacacaccgataagatttacctgaacaacgaagaagaagtgacgctggttaatcagattgaatataccgattataacaacccaacgcagaaaacctcgcgtaaagtagcggatacatttagcggtcgtcttctggatctgcaagcgttctttgatgttattcacccaatcgggacaatctacgaaaacgcgcataatgatgctaacccaggtgattatatgggctttggtatctggacacgttacgcggaaggtatgttccttgcaggttggacaaccgatgcatcggatagcgattttggtctgaacaataacgatctggacggttccggtcaaccaactcacacttctggtggtactggtggcgaacgtggttatgaaattaaaccgatcaacgttccacaaattcagtcaaccgataaggtgttgattaaagatgacaacgggatcattattattggtggctgtcaggttgacccagatgcaacagggccaggttacactaaataccgcgaggatgtattaaaagtaaatcgggggaacactactccagataaactaaaaacgctcccgccttatattactgttcaccgctggataagggtagcataaatgactcagtttatttccaaaacaagggagggggcgaaagtcccttcccgcaaagcagactttttgcaatatgaaatgggtacgaaagaaccgctgattggcggtaaacgtactattggtggtgcaaacgtcgatcagcttcgaaaaggggtagattaccctaacgtacaatcagcaattgatgacctgtattctttgtctcaacagatccccatcaatggggtaatcatgatgacggaagatagccccccttctgcggtgcaacaggtagaatcaattacgtttgatgggacggtttcaaacccagatccagatcaaacacaggcgactattcacgtttatggtttcccgttcgttttcggcaatacaacgaacgcctctaccgtatgtgagacagtctataacaaattcgttgaattcgtcaacgatgaaaaatatttcgatttggttactcgtaaaggtctcaacggggaaattctggaagttcgttttattgattcagttccgcatccggttactaataaaactgaatatggaatttcgatggtaggaacaatcgacgtacaggctaaatctggttacggtacatggacaaagttaggtgaaattgaccttgctgttactccagcagttccgatttattatttcaagcgtattgcatgaggataacaaatgaacaatacaattaaccacgtaagcgataaatccgtttacgtgacatttgatcctgctggtacgcaatggcctagcacgtttaagaacgtacaacaggcattagccgctattgggccgtgggcgcgtactgatgttggattgcctaatgccgcgcctggtgtgcgcggtattgctgctattgcgacacaggcaatgattgacgcgggtactgacacacagacgattgtaactccggctttgctggcgtatcgtttgcaaaaccctcatgcatcacaaaccgtatggggttacactcgttacgcaactgatgtagaatcagtaacagtaacaaacgatctggtttctcttactccgcgctcgttgaactatgtgtttaacacccgtcaggcaaaagaaaacgtttggggttctgcgaaactgtcaacaactgctcaggcaacgtccggtactgatgacactaccgcaatgactccgcttaaagtgaaacaggcaatctctgctctggttccggtacagtcaaacgcaacagaaagttcgtttggtcttgttcagttagcaacagttgcagaagttcgcgcgggtactattcgcgatgggtttgcgatttcaccatacacgtttattcgtctgactgcaagcgaaagtgatttaggtttactccgtatcgctacccaggcagaagtaaacgcgggtactgataacaccaaagcgatcaccccgcaaaaactcgctgctgtgaagggttccggctctactttcggtatggttaaattaacaacagatatcaataccggattagcgaatactgctttgtctgctggtgctaacgtagtaccgagcaacaaaaacagtgcaattactggtggtgcattgtatcagggttcgattagtgctgacaataaataccagacaaagacagatgttgacgcaaatatcccgatcggatgtatgatgcttgcagcgtttaacgccgatgttggtaacttgtttatctgtaacgggcgagcgatgaaccgcaattcaaacccagaactgtttgcccgaattggttatacatacggcggttctggtgatattttcaacttgcctgatatgcgcggtcttgtagctcgcggctttgatggtgggcgtggtttggatgcaggtcgcggttttggtacatatcaggctgatatgtttgcgtatcacgaacatgatctccagatgatttaccagaacggcggtaatcttcctaagagtcaagcagtttatgaactgaaaggcgcagaaaagaatgaccaacgtgttatgcacctgaataacgattacagcaaagcattaggtactggcggaaacgaaacgcgaatgaaaaaccttgcggtcaactacgtaattcgagtacgataaaggggttaatccatgatttcaaaacttaacccgttaccaaagatcccgtttgttgatggtgtccctgcggacaccacacaaacccagatcaattggattgttaacggcgaaactctcgatggtgcaaaaaccaaaaccactaacgagggttctttaaacagatgcggtgttctggttcaaaagaacgcggtacaattagaagcaaatacaactacccagacatcaaaaatcaacgaagttatcgatcaggttaacctcattactgaaaacctcgcggcgatctctgatgatagtgtgatcgacaaactggataaagttgtcgctgatgttgacgtgctgaaagtagatatgtctgctgtacaggcaactacagcaagcaacaccctgaaaattcaggatatcgaaaaggaaattggtgtatgggatgcgtcaaccgatcctaaacatcgtaccattcgaaaagatattattttcctgaaaggtgaactgggtgcatatcctggcttcaacgaaaatggtgatgtcgatccgtcctctactggctccggcgtgaaatacaaggtaatggctaacgctcaggcggtatctatccatgaagcacgtattactaagctggaagatgactgggtaaactcagatgtaggccatttaaccgacgaagttaccgatctgcgtaacgaaatggggccgaagcatttagccactttcgaatctgtgtatgttcgtctgaatggtatcggtggcgatatcactggtattaataccgaactgtcaaacatcaacacttatatcgggcgtacaggctcaggtggttctggtagtatagattcccgcatggaaactgcggaaacgaacattactactctgcaaacccagatgaatgatccggttgttggtgttctgcctcgcgtaatccttctggaaagcgctgttggtaactcacaggttccaggtagtatccgttacgatatcagcacaatgaaacgtagcattagcgatctgaatatgatcgttggtgaaacaagtgatgatggtctgcgcggtgaaatggcacaggttatgaccgatatcggtactgactctcagccaacgagcatgaaaggccgtattctgaacctggaaaacacacagcgcgacgatcaccaggcactgattgatgttaccgcaattgtgggtaatacgtcaactggactcgttgcggctaatatcgcgatgggtaaagctgtttatggtgacgcaaccagttctgatccattcctcaaagatggtattcagaaaacggctcgcgataacaaaactgcgatcggcgttaatactacaggatcagaaacagggatttataaactgatttccgatctgactgcgcgtgttgctgctctcgaagctggcggtggtggtaacgttgaacaacgtctggacgatctggaacagaataaagcctctcacaaggatgttactgatgctctggttccgtatatcacagaagttgaagcggataacaaatacgaagcgaagaaagttccactgtcatttactcaaaatctggtcggtcgtaacgattatatcgagggtgatgatatttctttatctgttaccgttacaggtggtaaactgccttatgtgtaccagtggaagaaaggaaccgcaaatatcgggactgattcaccgagtgtaatgatccagaacatcacaacgagtgattccggcgtatataaagttgtcgtaaccgacgctgaaaataccgtgattacttctgatgaacttgacattacggtatacacggttcctcagttcgatacaaacttgagcgatatttctgttgctgatggtgaaccattgactctggaagtagtgtttagtggtggtaaacctccatacacttacgtatggtataaagacggttctgtactgactggcgaaactggttcttctatcgttaaatctgctacaaccagcgaagatgcgggtgtttaccatgtaaccgtaactgacgcgatgaatagcacaagcgattcagcaacagcgactgtcacggtagcataattttaacaaggggcgcaagccccttttgaggatcatatgattacgaacaatccagaacagttaaaggatgaaattcttcgtcgtctgggcgcaccaatcatcaaaatcgaaatcacacaagatcagatttatgactgcattcaacgcgctttagacctgtatgcagaatatcattataacggcacaaacaaaacgtatctgattttgacactgggcgatgataatccgcgcaacgtgttcgacttgagcaaagagcacatcttcgcgatcacgaaggtattgcgtacaaacatgggttcattgaccacaatggacggtacagcggtttatccgtggtttaccgatttcctgatggggctgactggtggctctctgggtgggcgctgtgcatcgagtgtgtacggtatgaacgcatacggcgcggatatgggctactttacccagatgatgtcctatcaacgctcaatgcaagacctgctggctccactgcctgattactggttcaacgatgatactggtcagttctgcgcatgggggcaggtgaacaaaggtgacattatcgttattgaagcgatggttcgttccttcgttgatgtccctagctccgtaggaagcgtcgcaggatacgctacagcgggttctaacgcagtggaagaccaatccatagccgacatctacgaaaacccgtataacagcgttgtgggcggtgtacgagcgggacagggttcaactgttacgggcggaacgtctgcatataacaaccgatgggtaaaagactactctaccgcactggtgaaagagatcaacggacaaattctggctaaattccaggggatgcaattgcctggcggtgttgctcctgatggtacgcgactgatccaggaagcggaaaccaaactgcaaagtctgcgcgatgaactgatttcgatgtctgacgcagtaccgatcattatggtgtagggggaataatgcaaaactgggatgaaagtttattcgctcagttgtctacgggggaaggggttgatcgcaacttaaaggatcaggtcactaacccgtatgtaaactggtacaaatacaacccgacacaacagctacacgattcactgacagcagaatcaatccagatgaaatcgcctgatatgtattacgtccggcgcgacttcgtgaatattgataagatcctgggcgaagaccgagaatccaaatttacgaagtcatggaaaattgctgcatatattgaatcgtatgccaactatgaaggacaacgagatttctttagtaaatttggtctgagttcaaacgatgaaatgacgctggtaattaaccctcgtttgttcgcacatcaaactgatggtggtattcctgttctgggggatctggtttatttccctatggacaatagcctgtttgaaattacgtgggtagaagccgatccgttctatcagttcggtgatcgtcctcaacgcaaaatcaaccttgcgaaattcatctacacaggtgaagaactggctcctgaattgcagcgaaatgaaggaatccacattgaacctgatgcagaactggatctcgaaccgattcgaaatcttgacgggctggctgatattaacattgaacagtacgaagaagacaaagaatttgaaagagaaggtgatgaattcatcgaatcttttgatgttgtcaacggacgcggttcaccgtttgcaagtctgccataaatacgttatatgggtataggcggaagtctatacccacaacccatacaggaaaataaaaatgtttggctactggtataatagttctctgcgtaattatatcgtcctgatgggggcgctttttaatcacgttcaggttaaaagagtacgcggcgatcaagaaaaatacataaaggttccgatcacctatgcatcgaaagagaagtttctcgcttccatgaacaaactcaactacacgttgagtcaggaaaacgttgcaaagaccgaaaccattttaccgcgcatgaacttatcactggtggatctgcaatataacgcaatccgtaaaaccagtatcgcggtcaaccaaaaaatgacacagttagcaaccccacgaaaaacgatcacacagtttaaccctgtgccgtatcgtcttattttcgaactgggtgtgtatacgcgatatgaagatgatatgttccagatcgcagaacagattttgccatattttcaaccgcatttcaactgtaagattaccgaactgcataagaacgatatcacagttgaccgagacatcaaaatcagtctccaatcggttgcgccggataccacattcgagggcgatgcaaatcaacgccgtcatgttgagtggtcatttatgtttgaattacagggttatctgtacccgcctgtaactgatgttaaaggcgaaatcagaaccgtttacacggatttcttcgctaacatgaacccgttagataaagataactttgaatccgtggatagtcaagccgatccggtagatctgcctatgcaggactacacgggcgaagaatatattcagacgtactcgcacgataagccgatcccgtctggtgatgaacctcctaagccgagggaatgagaatggatgaaaaattagatttgcagcaattgctgaatattgattccctccctggcggcgttgagtctggggaggatgtggttgtttacgaaaaacttgaactggttgacgttcaatcacatccagcagaccggaaaccggatctggaagaggattatacgctcgcgcgtaagactgcgcaccatatgaatcagatgatcatggatatggcgcagatcgcattacacaacgcgaagaactccgaatcgcctcgccacgtcgaggtattcacaagcctgatgaatcagttaaacgtttcaaacattggcctgatgaagattcacaaagaaatgcgtgagattacggaagagactacaaaaccaggtgctgaaaagggcggtggtggtagtgaaatgaatatcgagaatgcaaccgtatttgttggttcccctacggaactgatgcagaaatacggcagtgcatatgaacccaaagagggcttcattaatggtgaagctgtagaggtaaaccctgatggaaatggaaccgacgatcgatccgagtaaggaatcagatcaccctatcggattaatgcatcccaaatatctgaaaaagaaaattgatgaattggggatggagtggacacaaagcgaacacgataaaaaatggtatccgacaacgttcagtgactacctgaaaattaacggcattcaaaaggtcgatattcagtctaaggacagttcgaactttgccacgtacaaaaataaaggcaacaagaaaacccgatataacggcaacccaaacctgaaacgtgcgtatatccagactaaatggacgcaacaaatgttgatggagtgggtgaaatgtcgtgatgatatcgtttattttgctgaaacatattgtgcgatcacccacattgactatggtacaatcaaggttcagttgcgtgactatcagcgcgaaatgctgatcgaaatgcacaaaaaccgtatggttgcctgtaacctgtcgcgtcagttgggtaaaacaaccgttgttgcaatcttcctggctcacttcgtgtgtttcaacgaagataaatatgttggtgtgctggctcacaaagcctcgatgtctgcggaagttctggatcgtaccaaacaggcgatcgaactactgcccgacttcttgcagcctggtattgttgaatggaacaaaggttctattgaacttgacaacaaatgtaaaattggtgcgtttgcatcttctcccgatgcggtgcgtggtaactccttcgcgatgatctacatcgacgaatgcgcgtttatcccgaactttgttgatgcgtggttagcgattcaaccagtaatctcttctggtcgtaaatcgaaaatccttatcacaacgacacctaacgggcttaaccacttctatgatatctggaacgctgctatagaaggaaaatccggtttcgtgccttacacggcgatctggacatcggttaaagagcgattgtatacagacggcgacaacggtacatttgatgacggttattcgtggtctgcgaagatgatcgctggctccagcaaagaggcattcttgcaggaacactgcgcggaattcatgggaaccagtggaaccctgatcgctggttggaagttgtcaaaactcacatggattgatattgatgaaacggaaacgaacttctatcagtataaacgtccagtagaggggcataaatatgttgcggtacttgatccagcggaaggtcgcggacaggattaccatgcaatgcatatcatcgacattacgacgatgccatttgaacaggttgcggtgtatcactcaaacaaaacgtcgcatcttattttgccggatatcctgttacgttatctgaatatgtataacgaggcatggatttacattgagctaaatagcacagggcattcagttgccaaatctctgttttccgaactggaatatgagaatgttatttgtgacagctacaacgatctgggtatgaaacagactaagcgatcaaaagctatgggatgttcgacgctgaaagacctgatcgagaaagataaattgatcataaataacaaaaagacaatactcgaatttcgtactttctcagaaaaaggcgtttcgtgggctgcggaagaaggatatcacgatgacctcgttatgtcgcttgcttgtttcggttggcttacaactcaaatgaaatttgccgaattctgcgagaaagacgatttaagactagccaatgaagtttttgcacgggaacgcgaacagctatacgaagacgcattatgtccggttatcgttacaagcggtgatgaaacgatttcggttggttctcacggtatttcgtttatataaattagaggaaattctataatggctttacaatctccaggtattgaaaccaaagaaacatcggtacaatctaccgttgttcgaaattcaactggtcgcgctgccattgtcggtaaattttcatgggggccagcttatcagatccgtcagatttctaacgaagtcgaaatggtaaactattttggttccccagacaacttgaccgctgactatttcatgagtgctgttaacttcttgcagtacggtaatgatctccgtgtggttcgcgttgtcgataaagatgccgctaaaaacgcaagcgcaattttcaaccagatcaaaacaactatcgcatcacagggttctaactacactgtaaacgatgtgattaaagtaaaatacaacaacgttgttgtagaagaaaacggtaaagtgtccaaagttgacagtaacggcaagatcctcgcggtaatcatcccaagcgaaaaaatcgttgcccgtgctaaacagattggtacttacccagatatttctactggctggactaccgaaattgtttctcagtcttccggtgtttccgcgtctattacgattgacggcatcgaaagcgattcagggatcactctgttgaacctggatattgcaaaagaaacaattcagggaaccgcattccagactcttacccagaaatatcagatcccgtctgtcgtggctctgtatcctggtgaactgggttcaactgttcaggtggagattatctccaaagctgcttacgattctggcgctatgatttcaggctacccttctggggtttccgttaagaatagcggtcgttctgtaatgacctacgggccacagaccgacaaccagtacgcttttgttgtgcgtcgtggtggcattgtacaggaatccttcatcgtgtcaactgagaagaccgataaagatatctacggcgtaaacatcttcatggatgactttttcgctaacggtggctctcagtacgtttacggtacttccctgaactggcctaaaggcttctccggtatccttgagttcggcggtggtttgtcctcaaacgacactgtaggcgctgatgaactgatgactggttgggatatgttcgctgatcgtgaagcgctgcatgtacctctgctgattgctggtgcgtgtgctggtgaaactgtagagatcatgtctaccgtccagaaacacgttatctctatcggtgatgaacgtcaggattgtactgtgtttgtgtcgcctccgcgctcacttctggtgaatatcccgctggcaactgcggttgataacatgattgaatggcgtactggctataaactcagtggtggtgctgttgttgataacaacctgaacgtaagttcaagctatggcttcatggatggtaactataaatatcagtatgataaatacaatgacgtgaaccgttgggttccgctggcaggtgatatcgctggcctgtgtgtttacactgatagcgttgctcaaccgtggatgtctccagcaggttacaaccgtggtcagatccgcaactgtatcaaactggctatcgaaccgcgcacagcacatcgtgacgcaatgtatcaggttcagattaacccggtaactggtttcgcgggtggttccggcttcgttctgttcggtgataaaacactgactaacgtaccgagtccatttgaccgtatcaacgttcgtcgcttgttcaacatgatcaagaaagacatcggtgataacgcgaaatacaaactgtttgaaaacaacgacgatttcacccgttcttcgttccgtatggatacaggtcagtacatgactaatattcgtgcgctgggtggttgctacgattaccgtgtaatctgtgacaccacgaacaacacgccggacgtaatcgaccgtaacgagtttgtagcaacgatctacgtgaaaccgcctcgttctatcaactacatcactctgaacttcgtagcaacgtctacgggcgcagatttcgatgaactggtaggaccgcaagccgtataacgtcaagggggctgaaaagcccccataaataatccgaggttaaaaaatgcttactgacattttacgcgcctttgaatccggtgatttcgcacgtccgaacctgttcgaagtagagatcccgtatctgggcaaaaactttaaattcacgtgtaaagcggcaaccatgccagcggctacagttgaaaaagttccggtaggataccaaaaccgcaaaatcaacgttgctggtgaccgtacctatgatgactggacaatcacgatctataacgatgacgcgcataatacgcgtgacgctctggtagcatggtcaaacatgatgcacggaatgggcgatcagattagtggtgatattccagcgaactacaaaaaaaccgctacggtgaaacagaaaaaccgtaacgatgaaattaccgccgaacataccatccacggtcttttccctactaacgtaggcgaagttaccctggactgggacagcaacaacgaagtgtcaacatttgaggttactttcgcgctggactggtgggaataaaggctataaatacaggggtagcaatacccctatcattatttttcggagttactatgaactttttgggctttggcaatgtacttagctttttcaagaacttcgcccgtgaggacgaattggatcttgaacagcaattaaaaaatgatacaggttcggtcgcgcctcctaaaaataatgatggtgcttatgaaatcgaaactgatctgactaatcagaaatacgcaagcgtattccagcagttttattctggacaagatccggcgattcagaacaaagaacaattaatcaatacatatcgcggcatcatgtcttacccagaagtagaaaacgctgtttctgaaattattgacgatgcgatcgtgaatgaacagggcaaagatatcattactttggatcttgccaaaacagattttagtaaggcgatccaggacaaaatcgtagaagaatttgataacgttctaaatatctatgattttgataacatgggtgcgcgtctgttccgtgattggtatgtggattcccgtatctacttccataaaatcatgcataaagacgaaagcaaaggtatccgcgaactgcgtcaacttgatccgcgttcgatggaactgatccgcgaatctatcactgaaacccttgatggtggcgtgaaagtattccgaggttatcgcgaatttttcgtgtatagcgctcctaaaaatggctatacatacaacgggcagatctaccagcataaccagaaggttaaaatcccgcgctccgctatcgtgtatgcgcattctggtctggaagattgcagtaacaacattatcggatatctgcaccgcgcagtcaagccagcaaaccaattgcgtttactggaagatgcgatggtcatctaccgtatcacccgcgcacctgaacgccgtgtgttctacatcgatgtaggtcagatgggtggcaacaaagcgacacagtacgtaaataacatcgcacaggggcttaaaaaccgcgttgtgtacgatgctaaaacgggtactgttaagaaccagcaaaacaacctgtcaatgacagaagattactggttaatgcgtcgtgacggtaaagctatcaccgaagtagacacgcttccaggcggtgcgaacttctctgatatggatgatatcaaatggtttaaccgtaagctctatgaagcactgcgtgtgccattaagccgtatgcctcgcgatgatgggggtatgcaaattggtggtggtggcgaaatcacccgtgatgaactgaaattcagtaagtttatccgcacactgcaaattcagttcagccctgtgctttccgatccgttaaaaactaacctgatcgcgaaaaaaatcatcacagaggaagaatgggaagaaaacgttagcaaaatttccttcattttccagcaagattcatattacgcggaagtgaaagatattgagattatggaacgtcgcctaacgttgatgtcacaggttgaaggtgtagttgggaaatatgtctcccataaatacatcatgaaagagattcttcgaatgtctgatgaagacattgacgaacaagcgaagctgatcgaagaagaatccaaagaagaacggttcaaaaatcccgaagaggaagaggaaaacttttgatgaaagaatttatcgaagcaatcaaaagcggtgatctggtggaagcgaagaagcaattctattccatcatggaagaccgtaccgaagcccttcgccaagaaatgcgcgttgaactcgcggaagctgtacgcatcgaaggtgaaaccgacgatgacgacagcgatgacgatgacgacgacaaaggcggcgatgataaaggcgacgacaaagacaaaaagccgtctgataaaaaagacgacgataaagacgaataagaggtgtaaataatgcaactcgaactcgaagaaatcagcgtcgaagatctcgaaccccatttaaccgaagcgaaagcccgtgttgatgttctggggatcgatgacggcactgtgaagatcatcgaaaatttggcggtcaatgaacctcatttagccctggctatgatgtccattgtcgagggtttgagtttagatgaagtcattgttaaacacgtagattcgcgcggtaatgtggaacgtaaaaaagaccgtaaaacccgtgaacgtaatgcgtatcaaacaactggtttaactaaatctcaacgtcgccaaattgcgcgtcgtgcgctaaaaacaaaacgtgcaaacccttctattacaacccgcgcacagcgtaagcgtaaaaaagcgctccgtaaacgcgccgcattagggctataaatatgaatgaatcccaactcaatgaaaacggcgatatgctgctaatcgaggaatggggtttaccttgtgcggatatttccgattcgattttagaatcggtcggtgagtcgaaaaaagacggtaaacttcggattgaaggtattttcctccaggccgaaaaagttaaccgcaataagcgactgtatccgaaaaaagtattagaagaagcagtaaacgattatatcagaactcaggttaatacccgtcaagctctgggtgaaatgaatcacccgccgcgaccgaatgtcgatccgcgtaatgcttgcatcctaattgaaaaattatggtggaaaggtaatgacgtttggggtcgcgctgttgttgtcgaaggtgataacggtgatggggataaactcgcggcgttaattcgcgcaggttgggttccaggtgtttcttctcgcggactgggtaaactttccgattctggaaaaggttacggtatcgtacaagaagggtttaaattggcggtaggcgttgatgttgtttgggggccaagcgctccagatgcttacgttaagccgattaccgaatctcagtcaagcaaaacgcttgttgagaataatagtgctgatgatgacgctttcagaaaactctctgaacgtttgaaaagtctatataaataatatcatatcaaacaggaaacttagaaatgcttaaagaacaactgttggcagaagcccagaacctggataccccagttgagttagacagcattttcgaatcagttgaactttctgatgatgcgaaagcaaacttcaccactgtattcgaacaagctgtaaaagcaggtgctgcgaaactcgctgaaacccacatcgcccagatcgcggaacgctccgatgaactggttgaagcccaggttgccgaaaaagctggcgaaatcgaaaataaactgtacgaagatgcgaataaatacttcgaccacatcgcgcaggaatggctctctgaaaacaaagaagctgtgtcccgtgatatcaaggccgatctgttcgaatctctggtaatgggaatgaaagaactgttcgttgaacacaacgtagttatcccagaagcgcaggttgatgttgttgcagaactcgaagatgaactgaccgagaatcagcaggaagttaaacgcctgttcgaagctaatcaggctcaggctaaagagatcgccaacatgaaacgcgataccatcgtttcagaaaaaacaaaagatctgactgaatcgcaaattgaaaaggttcagaacctgatcgaaggtttggaatattccgacaagttcgaatccaaactgaccgcaatcgttgaaatggtagcgactaaagcggaaaaacaggttgaagagagtaccactactcagacaaccactaaagatgactttgttccggtgaatgaaaatacacctccagcagagaaatcgaagatcaataaatatgtacaagcggctaaagccctttcctaatcttataaggtaagaaacaatgtctaagaaaaacgaattgatggaaaaatggaacgatcttctggaatctcaggaaggtttaccggatatcgctaccaaatccaaaaaacaactggttgcagcaattctggaaactcaggaaaaggatgctgatactgatccagtatatcgcgacgaaaaaatcattgaatccttcggcggtttcctggcggaagcagagatcgcgggtgaccacggttacgacgcaaccaacattgcctctggtaaatccagcggtgcaatcaccaacatcggccctgctgtaatcggtatggttcgccgtgcgattcctaacctgatcgcattcgacatttgcggtgttcagcctatgactggccctactggtcaggtgttcgcactccgtgctgtatacggtaaagatcctctggctggcggtactcctgcaaacgttcgtgaagcattccatccgatgttcgctccagacaccatgtattctggtgaaggtgcaaacaccgcgtttgctgctatcgcaactggtgttgctatcgcttccggcgctatcgttaagcacgtattccaggaaactggtatcgcgtacttccagaacgtgacctccggcaacgtaaccgtaactggtgctgatgctgctgctctggatgctgctgtaatcgcagaaaacgagaaaggcactctggctgaaatttccgaaggtatggctaccagcgtagcagaactccaggaaaacttcaacggttccagcgctaacccgtggaacgaaatggctttccgtatcgacaaacaggttatcgaagctcgtagccgtcaactgaaagcacagtattccgttgaactggcacaggatcttcgtgctgtacacggtatggacgctgacgccgaactgtctgcaatcctggcaactgaaatcatgctggaaatcaaccgcgaaatcgttgacctgatcaactacaccgcgcagattggtaaaactggtttcacccagaccgtaggctctaaagctggtgcgtttgacttccaagatccagtagatattcgcggcgctcgttgggctggtgaaagctataaagctctgctgattcagatcgacaaagaagcgaacgaaatcgcgcgtcaaactggtcgtggtgctggtaacttcatcatcgcttcccgtaacgtggtttccgctctggctcgtatcgacagcggcatcactccggcaggtcagggtctccagaaaactctgaacgtagacaccactaaagcggtattcgctggtgtactgggtggcacttacaaagtgtacatcgaccagtacgctcgccaggattacttcaccgtgggctacaagggtgataacgaaatggatgctggtatctactacgctccatacgttgcgctgactccgctgcgtggttctgatcctaagaacttccagccagtaatgggcttcaaaactcgttacggtatcggtatcaacccgtttgcgaactctcgctctcaggctccggcagatcgtatcacctctggtatgatcagcaaagaaatgtgcggtaaaaacgcatacttccgccgcgtgtgggttaagggactttgatcctaagttgttgaaaaacaacgactttttaaagggaaccttcgggttccctttttgtttatataaatagtgaaaacatttgaggctatattatgaaacatatcatttataaaataacaaacaccatcaataacaaaatatatgttggtgctcactcaaccgaagatatcaacgattcatacatgggttccggtattgcaatcaaaaaagcgcaaaagaaatatggtatggaacatttcacaaaagaaatacttcatgtatttgacacccgtgaagaaatgtatgagaaggaaagggaaatagttgatattgaattcataaatcgaccagatacatataatgctggtattggtggtaaaggtgctccaatggcattgattggatggagtgatgaacaacgcaagctgatttctgaaaatacttcgaaagctatgcaagctccagaaatgcgcgaacgcctttcaaaaatcaaaacaggaaagaagcaatcggaagaatccaacaggaagcgttcagagactatcaaagctatgtataagggttctgcattcgacagaaccggatctaagctcacagacgcgcacaaggccaaaataagccgttctgtgtcgatagatggagttgtttatgcaagtggttctgatgctgctaaagcgttggggctttctcgatctggccttgattaccgtttaaagagtgacaaatttcctgaatggaaattcgttgcataaataaacaatatactccctataaattcaggaaccaaagaaatgagtgataaacactacacaattcacaagttgatgcgtcagtcttcgcttccgtctggtaaacgagaaaaagttatcaacgaagcaacaggcacgaccgacatcaacgtacagaacacgcgcccagaactggtttctttgactcgcgcggttaacaacctgatctatcatgaactggttgctgtacaagaaacagaactccctgttgcaacactgttcggtgttcgctatcgcaaccctaatggtgatatgactttctccagtgctgcaacctattcaggccgaatctctggacgtacagacatcgacgaaatcgatctgactaaagcctacgttaaaggtgatttgttcaagcatgacggcactgacgttgtttatgaggttatcgcaccgattaccctgaacactctggatactgacaaagacaccgcgatcatgaaagctgtgttccaaagcaaaattcgtctggtgagtgaagccgctgacacttctaagtatgaaaccagcgaagatatcgcgtcaacctccttccagatggatcgctggaatattccggtacgctcgcgtaagtttaaaaccgaaatgacggttgaactgatgcaggatttggaagcgaaccagttcgaagctgatggggtgatcgaagacatcctgggaaccgtggcaagtgaagaagtcaacaaagacattattcaaacactgatcaccgtttccaaacgttacaacgtcgatggactcgttacggatggtatttttgacggtactaccgcatacaccgcgaaggatgctccagcattgggtcgtatcctgtatcaattagcgtgtgaaatggggcaggaaatgaatagaacgacttcatttgatgctacctacgtcctcgcaacagcgcgtgttgtaggcattctggctgcgtctggttggatgcacgaaaccgacgaacaacacccactggcaacaggtaagctgaacaacggttattatgtctatacagacaccaacagcccgttcgattatatgctgactggttgcaaatatgatctgggtgatatggatcacgtaggctctctgttcttcgctccgtataccgaagctgatgaagcaggttcaatcaaagtatccgtagatccggcatccctgcaaccgaaagttgctattctgatgcgttacggtctttccgtgaacccatacacagcagaaagcgaatccgatcacctgatcaaaggtgatgattggtctgctcttgcaggtaaatctaagctgagtcagatcgtaggtattaagttacctaaactgggttaacaagttttgttttgagaagaccattatagtaataaagatctataaggtcaaacgagcgaagcgagttttcacgaacgaagtgagtgatgggtaagtacgatgtactgtttataatatttatattttatatatagagaaaacagtacatttccgtatactttttaaccaacattcactcactacgttcgttcatgtactcgcttcgctcgtagatttgacttcttgatctaactggttataatgttactttgttttgaggtgatacatggctgaactaaaacttgaagatctacaggctgaacttgaagaggatatgcgtattgatccgttgaagttacaaagcgaatcagcagacattccgaagatttggtcaaaatggcttcgataccattcgaatgctaagaaaaaacttattcaactccaggcgaagaaagaagcgattgtaaaagatcggttactgttctacactggtagacacgaaagcgaaatgaccgatgtcatttacactggttcgggtgaaatcaaaattgctatctccggtgatcctaagaccgttgaagttaacaagctgatccaatacttcgaactgattgcagagtttaccggaaaagcgctggatatcgttaagaacaaaggctactccatcaaaaacatgttggagatccgtaaacttgagagtggtgcataaaatggcagaagaatttgattgcaaatgcgttgtgtgcaaacaaccgatgaactcccgtaatacggcgtttgtcaatgaagctggcccgatctgcggtgtcgtatgtttgcaatatctcaacgaaaggaatgatcgcggtatcaatgaagccgacgatctgaacgaagttcaaatgttgctgtaggtgtgaatatgaaagactattcaaaaatcgactttaacgaagtatttcgtttgctgggattgatggaagaatgtgtgaccagggttcatgcacttcgaatttcgtttgaaagcggttgtatcgaagacgaacgcccagatttatagcagtaaatagatgtgtaccccttgtggggcttgggcttaccgtgtggcgtacccatttgcgccgtccgatagaatttactttcggtggggtgattggtaagataccttcgagtaaaggccagttaattgtaattcagaatagtacagcactgaaataaaataaatgtacgtgtcggaacaaacggtttccgaaattaaaaagccccttcctttcggttggggctttctttttaaaacttctcttcttctccggtttcaagttcggctttcagttcttctcgccgtcccttgatcgcgtcacgcattgaaatgtcatcggatgctgcaacctcgacttctttcacgcgggtgttgtaatacttttcaagttctttcaaaccttctagtgtccggcacgaagcaaccttattcatgaaatcatcaatcgctgcttcgtttacgaatgtagtaaaacttttcattttggcctcttaaatttctacctgtttgatcgcgtagtcgaatcgttcttcattgtagatccgcacacgttccatagcatgtttcataccgtagtttgtcgcactgtatttatttttggctgtcttagactttgacagcgtagccaggttatcaacgatatcccatacagtagcgagcgctttcgatccgtgcttacgaagtacacgaccgatagactgtttcaccacaacagcagatttgcaagggtgcgcaaaaatgatgtggtgtaggttcttgattgagatacccgtactcagtaccccgatcgaaccgatgacgattaaacctttcgtcgattccgcgattttcttcatttcgttacgatcgtcaatgtctgtatcaccattgaccaacaccacgttatcgtaaaccttgctcaactgctcgtacagccattttccgtgctctttgtaccggaacatcacaaaggcgttttcgttcttctcacgggctaatttgagcgctaattttagaatccacgcgttgcgccgtgtgtggctggttacgtacttgatttccgtctggtagtccgcacccttcaattttttgacctcttcttctttgtatcgaaggaagatcgtgttaattttcaggttggtgacttgtccatcatccatcaaacgacgcgtatcaactggtttaaagactttgccgaacgcaccgatgtattgcatcatgttcgttttcccttctttcagggaaccggataaacccagtttgaagatacattgatccatcgtgtcgataatctttttgatgctcatgcctgttgagaggtggcattcatcaaccatcaaacacatgaactgttggaaccattcggcaggcattttaaccgctgattgccaggtagaaacgtaaatcagtgcattactgtttttcgctgtaccggaacggatacccagcattgccgatttcgggaacaaacgatagtttgcgatgtcctcgatcatttggtcaacaagtgcggtagtcggaacgatgatcaacactttcccgctgtaatgttccagacaccaacgagagataagcccctgaatcagagatttacctgctgatgttggcaggttcagaacaccgcgacggtttttgataccgtggaacactgattcgcgttgataccagtacgggtcgatctgtttgtcgccgtcataaaccggatgttcgctaacccacttatcaaaatcttcttgcgtgatatcctctgtttcgtggatctttggatcaacccagattgaatacccgcgtgattctgcgaatttggataccagataggctaacccatacgggagtttcccgttgtagtccatcaagtaaatgtaaccgttccatccaccatatttgtatttggcctgatactgatagcctgggggctggaagctgaaatagtcacgcagttcatagacaatgtttggttctgcctgaatctgtacgtggcttgtgtttaaaaatttgacttcaatatccactatgattaccctatgtacaaagtatatacgtatttatgtcataaatattggataaacacttggagataccaatgaacattgattacgaaaaagttgatgggttccgtaccctcgacgcaaaagaacagaaaggcgcgttagctgattacgcaatgactgtgtttgctgttaagctgaacaaacaaaaatccttcgataacatgctggcggatctggttgctgctttaccggaagatgaagaaaaaccggaactgctgatcgattcccctgaaccggaaatcgttgcatataaaggtgaggtgactatgggtgaacctgtcatcgaagccccgaacgttcccgatgtggttattgatgcttctgcggattttatggagtacgttaaagaggtcgcgccggaagtagccgatcaaatccaattagtacctgatgtcgtagaagctcctgtaagcgcttctgacgagtccaaaggcgaactggtatggttggaagggtttagcccgacaatcttcatgatggggcgctctgcgagttctaacgggtattatacctgtccgtggtggatctatgactggattaaacaaaccccagactggtacaaagatcctgatagctgtccacatgcaagcgcaatcgacacaatcaaatcacttgcgttctatatcgtgcgcgatggtgaagttcgtgttcgcgaaaccagaaatagccgattcgaaacatttaagttttagcactttttgctaaaaaacttgttgacgcataccctcgtttaaagtatatttgtactcgaaggcgggggaatggctctcgcagtgaagaaggaaagcaaaatgaaaaacgaaatgatgaaaaacgcttattacccagttctgtttgtttgggctgatggtaaagtgaagaaagtagtcaattcaaatgctccttactatactgttgaagaagcactgcgccacgcttacgaagctgattatcctgtccctgctgaacctggttatgctcgttggaacggttcaaaatgggttgctgatacctgggacaactacgaagaagcaaaaatggaatgcgatcctgattatgtttctcgccaaatggaagcgcacatgattgcagaccgtcgcctggataacgaagctcgcggtttctattaaaattcaaagggggcgtagcccccttttttgtaggtaaaatatgactgaattaaatcacgaatgcctgaaagacttatcagaaggtaaagagatcggaaacgtcatcttccttgatatcgacggcgttctaaataatatgcggtgcatgaaatttggtgagcatatggacattgaatgtgctcgacacctgcgccggatcgtaaatcatgcgaactgtgatattgtcatttcctctacatggaggatcggcaacacaacccatactctacgggaaatcttctacccgtggggattgtatcgcatcattgggaaaacctgtacgaatctaacagaccgacaagcaggacgcggtgatgaaatcaaagcatggatcgacaccttcggatgtaagaattaccttatccttgatgacgataccgatatgctgccggaacagagtgaacatttcatcaataccgatgggttcgtagggctgacagaagaacaatccacttacgcgatccgtaatgtgttcggtgtaacaaacccgttctgtcctgaatgcaacggctatgggcgcgtgaaccaatatgataaatgtccgtcttgtgacggcaaaattttacttctctaaatagagaaaaactaagaggttttgaaaatggctacagaaaaatggactacggtacacccgatcccgtggcgtaacaccagctttacctatctgccgtggtggatctttgatatcatcgtggctgcgaatgctgcaagcgaagactggcgtgattatgccgaagaaaaatacgcgaaagaattcgacacactgaaacaggcgtatattgattacaccgatgttgatttcatcgaatcccgtaacggttatctgtataagctgagtgattttactcctgctgatcctgtcgtaacaattacaccaaaaaccgctcctgctgatttcaaagtaggtgatgcggatctggctgcaactgatctgtttaccatcgatccttctggtacagaaatgactctgagtgttgactcttccggtcatggttctatcgttggtggtaaacttcatgcggttagtgaaggtgatgttgtcgtaacagcaacctctggatctgttactgcaactctgacggtaaacgttaaacctgcaccataataacaactaagaaggtaaaaatgctactatttgaattcaatgatgtattcgcaaaattcagcgacgcaatcgaagccaaatttggcaaacgcccacaaaacatgacagatgcagaatatgaagctgctgtatcgtccctggttcgtacagatttctatgaaaaactggcgatcgaggtgttgggttgggatatgatgaaatggggcatgacctatcgcgatcgcgaagtcggttttattctcgtcaacgaagcaaaaagcccgtcctgggtgaatagtcaaaaaatcgcgtacatggataaagtatgcgcacagatgggtattgtacgtttagacttctggacttgtcgggatctgaacgaactgaaagcccacgcttaccgttgccctctgatctcccgcaatgataagcatcgtcaagcatgggatagcgcagggaaatatcgtagtgttttcctgaacgacgatatgaacatcactattcaggatgttaaccgctcctttgcggattacacaccataaacaaaaaagggaaccgcaatggttccctttcttttatgcaatttttctgatttctttcaatgcttcttctttgctaccaacgaagagaatcgctttacctccggcttttctgaatggcaacacagcttttgccctgtcatcaatcagtatacctttgtccgcatatgctgctttctctccgctgcttttggtgtagtggaattcaggcagataaccgaacaccttcatcaacgcttttcttttttgttctgctaccgcatcggaattgtatttccctacgctggttaagatcgcaacctgacctaaagttctcaaatgacagaacaggtcgatgccctcttgtaatggttccagattttcgtagaagtcagtttgtgatatagcctgtttcgcttttttcaattcttcttccggcattctcgccgggtcaccgtacatcggaacaaaagaaccttcccagttgaacagtacaccatccatatcgaacaaaaactttttcatatcaattcctcggtttgtgtgtgcatcatattcatatatgttcctattgtcaaccccatgtatcagttttcggtgcgtatgctgcaactttcgccactaactctttatcaagctgatcaatggatttctgcggctttccttttgccttaactttgatgtagttagacttaacgacaaacataccgcctttgtcagatttcttgatttcgctgtcaatgcctactttgttgaagctgatccagatatcgccgtccatgtactgtttcagagagtcgcccatattcaggatcttcgccatagtgagcgctgccccttcgtgggtatccatgaggatttctttaggcactacacgatcgcgtttaaggttctgctgcatagcaatatgaacatcgttcataacccaaacgatatggatattttctttctgataacccagcgtttcaacatcacgggcgatacttgccagcttgctcatgctttttagggttacgtcaaagatcagatttggtttacggtcttccggtgctgctgcgatacccgcgtacacacgcgcctggtttttgttggatacgttgaacacgtccgcgatcacatgatgcagtgttgctacgttgtctgggtttttcaggttcatggttttgacatcgtgaccagttttcgctttgatctctgctgccagtttggtactacccatgaccaattttttgagtgcgtcaacgtccagtgtgataccttcgatgcctaacagcttttcgagggtgaaccctttaccagaacccgcaccgccagccaggatgactacctgaccaaatttaggataagccttaccgccgaaggtgatcagcgcttcatcaaggctcgtaaagtctttgaatgatttcatcttagaactccaggtgtttatttaaaagtatttattgacacggtttatgagtgcgtttatagtgcaattgttcgacggataagccggaagaactttaaccataaggtaacaattatgaaaaatgaactgcatgaattcatcaacgccgctgttcttggcgaccagtcaaaatataaagcccgtcgcgataccctgattgacgatttctgtaatttcctggggttcaagcgctggcataccccgtctatgcgtccagattgtgatccaaaatgggattacttcaaatggagtgatcgcgatcgtggttacgtcgataacgtccgcgtaatgtctttcaaccacttatacgcaaattcaacaattgctgttgctaaacgcaacgattcgacttatccgaacgggtggagtgttgctaaagtcatagaaacacttcttcaactgcgtcgcgaatataaatcagcataccgtgtcaatcccaatcctatctataatgaatggcaaatcgtcgcgaaatacctgctgaacatcacctattctattttctgtcgcttcgggacaaaagagattggatttggctctcatgatataattgcagaagcacgtcaccgcatgatccatgcaatcctgaaaattcaaaactctggtgggcttgttcttgctgcgttctgtgatgaaattgtttactacggagaacaggtcgaagttgatgatgttcaccacgaaaaattcaaaagatttgtattcgggcaatataacagctattcatatggaaacgatattcgtgtgatgaggcacccgcgcattatgttggatatggaagggtgggaaccaggtcacggaattggtgatgccgaaagccaacgtgaacgccgtgttcgttcagttgctaaaactcgcgaattgatgacaggtagccttactgattacctgttcagaacaaaagaagacgttgaaaaagaatttgttgacttgtcgggcgaatagcgataagctgtaatctctgaaaacaaggagataaccatgaataccattcactgccgcaaagagttcgttgagttctatcacggatcatgtactgctgccggaatcgaaagcatgttgttgcctccttgtgattctgatattctgtctgaaaaaggcagaaagaaaaatctggatcgtgttttcttcactgctgatatcgggctggctcgtatctatgctggaagggctgcacgttcaataggtggtgatccggtactttatcgggttgtgtgtccggtagatgtggtatgcatgaacgatgacaaaggcgcaagcgtttatcatgctgcatgggctttctgtgaggaattatgaaagataaggtgttagcgtatctcgttttcttgctgggatatcgcgttgaagtgatgggtggttattcttctttgtatggggatttaaccgcgatctggatggttgcgttgggggttatgtttacctttatggcgatctgtattgcgaatgaggctgatcaaaatgcttgaattttatcctgctggttgcaagtcaaatccgcctgatgcatcgttccaatcgtggatttattttcacagggaactaaacgacatcatcgaaagtcagtggaaagaccatcctgaacgaagtgcccccgatttagtcgatagcgtaacagatgtacgcaccctggaaaaagggctgtatgattgtctggttcagggaatggtgtgtaaattgattttgtggtatgctccgatcggttcagatctaactcgcaaaatcgcccgtggctatatcatgacgaaacgtgagtttgaccagatctggaacgaacccgactgtttcgaacgcgaaaaatacgaaaatgaggttagttgtatatgaaactatttcatgttgtatatggtggaatgaaaaacatcgacatcgccgcgttatctgctgggatgctggacgaactcgaagcacagatcgggaaacgattcaaagccagtatcaccgaaacgcaaactttgtttgtcgatcaccctgcggatatggaaaaccttgtcaacactctggatgatctgatgatcccgtgtgctgatggttggaacgaagcatccggtgttcatgtagttgtaacttttgttcttaaaaatgttgacagcagaaatgccgaagtgttagagtttattcgtaaaattgattctactaaaggaaagtaactatgaaaatcgttcagcgtaatatcagcgaagttagccagcaggaaaaagtacagattcatttcaaattcaatgatctgaaactgggctatgcacagatcgcccgtgagcacatgctcgataacggcgacatttacgtgattgttcaagaaattgagcgaattcgtgctttccgcgcagaaaatccaaaagtgaaacatgttctgcgtcgtgtgtacatcaataaacatcgtgaagaacagcgcaagcctaaactcaaagctaaacgcgatccgcgtccagataacaaacgtaaagcaatcaacggcgctatggcgctggcgttccaggaagcgggtttggcgtaaggggtttatatgtcttcaatgatgaatcgctggtcgggcgtgataacttcgactatcaaaaaggatttggtgaaggttgaagcaaaaccaaagccagtagaaccggaaaaagttcaaactatggtatcactcgatcctgctgagttagaacaccgccgccgtgcaaagcaaattgaattcgatctgcgtgtcgctcgttcatacaacagtaaaaacgatgatgcgcgtaaccgcaaccttcaatttgctctgacgttaagcgactgggcgaagctaatgagtgaacccgtatgttcttactccggcagaccgtttagcaacaaaggcggttgctctgactcccgaacaatggaacgaatcaacgcttctctgggatacacggttgaaaacacgatcgcagtaaccagcgccgcgaatagcgagaaatcaaatctcgatgcgtttatgaagggttctgtgatccttccagaagtaaaactgaaactgttacgcaaagctgcgtatcaaattgaaaaacaactgaaaatcaagggttaattatgtttgtgaaatattcttctctgactaaccattatgaaggtaaattcatcaatggtgtgatcatgaatggtttgactggtggcgtgtgggttgcgcgtgaaaagatccacggggctaactttagcctgattacttcggacggtatcaaagtcattccggcaaaacgtagcggtgaaatcctccctgctgaacaattctacggttgtgaaccagtagttgcaaaatactctgaacctgttcgtaagatgtgggaaatgctctctgctgcccgtcagttaagtggcgtgtatagcgatgaactggtgattcaggtatacggcgaattcgcggggcgtggtgtccagaaagatgttgactacggcgaaaaagatttctacgtatttgatatccgtgttaatggcgaattcctccctgataacgttgttgcaaattacgctgttgctgttggcctgaaaatggctccactgctggcatacggtacgtttgacgagatccgcacactgcctatcacctttgattcggtggttaacctggcgaactccggtgcgatccctgcaaagaacggtgttgaacctgagttcaaaaacttcatgacgctgaaagatggtgaaggtgagaacatcgcagaaggtttcgtgatgaagcctgttcaacccgctttcatgccgaacggtgaacgcgttgcaatcaaatgcaaaacgacgaagttcacagagaagaagaacaagcaagcgaaccgcttcgatgctccttctgaactgtcagaaacagacaaagtgaagctgaacgaattcacctgctacctgactgaaaaccgcgtgaaaaacgttctgtccaaaattgacagcgcgaatctcaccgctaaagatttcggtcgcgtgatggggcttacggtacaggacgcgctagaagaaatcgaacgtaactacgggcctttcctggaacagttcgaaaatccaacgctggcgaagaaaaccttcactaacgaagcgtcaaatctggttcgtgagaactggggcgcaatcctgaacaatgaattttaaaactgttctcgaaaacgcaaaaacggctaccctgatcggtagccgtgaaccccctgaacgtatcgcgagcatagccataaagattggacgtgctttaagtgatcgggggatcttcgcttactctggtggtgctcctggaatggatagccatttcatgtttgactactcaccagaaagacggcgtataatcctccctgagaacggttttaacgggttgtattctaatggtaaggatatcatcgactatacagaatacgacacgtacaaagccgctgacgaagcgagaaaggtagctggacacttcgacaaccaaagcgaatggacacaacgccgatacgctcgcaattcaatgcaggtattaaccgaaaacctggacaaacctacagattttgttctattctgggcggtagagaaagatttttgtgttaaaggtggtactgcgatcgctgcaaggcttgccagattgtataaagttccaacgttcaacctttggaatcaaaacgttctggatgaagtctgcgatactttagggattaacactaaacctcctactctggattttctctggtgataactcccgaacaatcacgtaattacgaacgcctctctgttgaagaggcattaaaaaaggcgaaacataatggtagaaatcaatggaatcggtgtgaacgtacaggcgggaagcgggacatcgtgggtcaaacgcgaaacacaagatgatccccgctgtggacgtagcccgacactggcggaacgtgcgcgtaaactggttgatgaaatcaacgcgaaaatggtcgaagcatcccgtaaagacatttccgagtatgtcctgaaatatccgactaaacaagcatatacctttgatatgaaacgttttatcggtaaggttatggatcaggaatgtaccgaaaaagcatatgcggatctgggtgaatggctggcggaagaagggtttactttcgatacccagcgcaaccgacaagctgcgttactcaataccttcgcgggttcgcgtcgtattaccaactttagcgatcctaagcgtgacggatatagcgatctgacttattacatcacctggtgaaaataattcgaaaaacttgttgacgggagttatgagtgtggtaatatagctcccgtagacaagacactaacctaaaaggaaaacatcatggaaatcaaattagtacctacttgcgctggctactgcttggcactgaatggtgtagcacacaacggtaaaggcttacgggctaacgttgaagcaatgctgaacgaactgggtgcggtttatgaatatgatgacgttgcaaccagcgttaaaatcataagccttgaaaaagatggtgttaactgtgcgggtttggtgggattgctacatcgactatagcgacaaccgggtcttcttactgaccagcaaataaggatcgaacatgagtgaagcagaatatattgatagctggggtggctatgacgatgacgacgatgatttttgtggtcataatttacgtcgagaaactctaaggcttttgcaacaagcaaatgcgccgaagcaagtcaaaactcctgttaaatattccgatggttcgattcgaactgaaacggttgtcaaagaagtaaacgggcgtgtcattacgtccgagcggcagaaggacatcaaacaattgtacgatgttgcaaaagccgctaaagtaggaaccatgatcacttgtcctacgtgcaaacagttgcacaagaagacgacatatcataaggtgttctgctctaatggtaaaaaatccaggaaagactgcaaaagcaaatactggaacacgatccatccagaacgtttggatcgtatcttttaaatcaaaacgtggagtacgtttaaatgaaaacttttaatgaactgaatagcctgatcacctcaactgattcctacaaagtgtcccactggttgcagtatccacaaggcactgatgcggcgatgttctatattgaatctcgcggtggtaagtttgatgaagtagtaaccgctggcgttaacttcgttgcgcgggttcttgccgaaccaattaccatgaaacaagttgagttgacacgggtactttaccgtaagcactttgggaaagagattttcaactacgaagggtggaagaagatcgcagaactgggttatgtccctgttactttccgtgcgatcccagaaggtacggttgttccggttaaaaatgccgttgcgactgtgtacgccgaacgtgaattctcatggttggctgggtggctggagacaatgacgattcgcggtatctggtatccgtcatctgtagcaacgctatcgcgtgagtgtaaaaaggttctggctcattaccttgatatgacttctgacctgactggtgaagcatataacatcacactgggtacacgtctgcatgatttcggggcgcgtggcgcgacctctgctgaatctgcgggtattggtgggctggcacacctctataacttcatcgggactgataccgttgaaggtatgattatggcaatcagtctgtttgtggactatcaaactctgtttgatgaagttgaaaacgtcgaagcaatcggtgtttcaattccggctcgcgaacattcgactacgatttcctacggtaaagagaacgaagacgaagcatacaaaaacagcatcgaaatgttcggtacagggttctatgcttgtgtgtacgattcctgggactacaaaggcgctgtagatcgcatcgctgaatataaagagcaaatcattgctgcgggtggtactctggttgttcgtcctgattccggtgatatgattgataacatcatgtacaccctgcgtaaactgggcgaaatcttcggttacaccgtaaacagcaaaggttacaaagttctgcataattcagttcgaatcatccagggcgacgagatccacggacctgaaacaatcaaccgtgtgttaagttggatggaagcgaacaagtgggcgagtgagaacatcgcgttcggtatgggcggcggtttgctgcaagaagttacccgcgacactcaaaagtatgctgaaaaactgtgcgctatccgcgtgaatggtgtgtggaaaggcgtttacaaatgcccgaaaggttccgaatggaaacagagtaagaaaggtttgctgatgaccatcactaacggtgtggaattcaaaacaatcgacactctggaaactgagattcctgacgggtggcgtgatgcgatgattacgtattacgacaacggtgtattaaacacctccgatacagtaggggttatccgtgagcgagcaaggatttaatatccgcgccaacgataacggatcggtagtcttctacaacaatcagccccttgtcgctcgcaaggggcttttttgtaagttggtgggctacgggttcaagttggaacaggtggacaacgcgacactaaaagaggttgttcgaattgcttatctgctgaaagataaaaaagatgaacatcgtgctattgcaatgcttgagaaattaggcgaaaatcattgcttcgtggtgaatcgtgggtataagtacgaaacgatcgccttatttgagaaaggacttggtgaattatgattaccacaatcaaagaaggggttgacctccatttaggcgactccgtaaagctgattaaacagcttgaatctggttctgttgacttgaccataacttcgcctccgtatgacaacttgcgccattataacggctctggtgatgtctggggtgaacacgtatggaaagagttgatatcggaactgtaccgcgttaccgcgcctggcggtgtggttgtgtgggttgtgggtgacgcgactatcaacggtagtgaaacgggtacatctttccgtcaagccttgtacgcgatcgaacaaggttttcggttgcatgatacgatgatctatcacaaaaccgctctaccgaagaaccataaccgatacgaacaggactttgaatacatgttcgtgtggacaaaaggcgcaccaaaaacattcaacccgatccgcattccgtgtaagttccctgaaaaggaaaccgcacgacaaaacagctacttttccgaaaccaacgaaaagaaccgttcagcccgttccggtaagaaacgtaaacctgttggcaaggataaaattaagggtaatatctggtattacgctgtagggcgcaatcactcaacgaaggacgagattgcattcaaacacccagcaatatttcctgaacaactggcagaagatcacattaaaacgtggacggttgaaggggacttggttcttgatatattctctggctctggtacagtgatgaaaatgtcgatactaaccaacagacggttcaaaggcttcgaactgatggagaattattatcatgattctattcttcgtgttcagccatacgttaacaatctggaatcttttctatgagttatttgggtgttatcccctatacaggcaacaaacagtcgctattacctgaactcttcaagctgttccccgaaagaagttcatacatgcgtttcattgattgtttttgcggtggccttagtgtgtcgttaaacgtccctaaacccgttctaagcaacgattatgataagacgcttattgatatgtatgagcgtcttaaaacgcttcctgacctgtctccggtgcgagaattgattgcatcaaaggggctggggaaagacaagaaagaagagtatttgaaattccgtgatgaatacaaccagaacaaagatccgttatggctctatgtcctgatcctgcattcattcagcaacgttaaccggacaaacgacaaaggcgacttcaacgctaatttcggatgccggacgcttaacgatgcaacagtaaaacgctttgaacatttcaaaaagaatgtgaaaggcattgagttttccagtggttcattccgtgacattgatatctgtgaaaatgatttcgtgtactgtgatccgccgtacctgatcaccgatgcagtgtataacaagttctggaacgaagatcgcgaacgtgagttatatgctttcctggatgaactgcacagcgaaggaatcatgttcggactgtccaacgtgactcaccatgccggaaaacaaaatgatatcctgattgaatggatgcagaaataccgcgttcataatctggataaaaagtatctgttaggccagcataccgactcttacgagcaaaacaaaacgcaagaagtctacgtgtgcaactaccagaaacgcgacgtaaatacattccctttaacactgaacgatttaatgtaggttaacatgtttaaaatttatggctatatcccttctgtgtataactgcgctccgtgcctgaactcaaagcgcttgctggacgcgaaaaaacatccgtatgagttcgtgtctgttgcggattccgtggaagacggtaaacctgtactgaacgaagcggtgatcgatgaactcgaagcgcttgttggtacgcgccggatgaccatgcctcagattttccatgacgggaaacatgtaggcgggttcgaccaacttcgtgagtacgtccgcaccctgtaataaataatgacaccttactgaatggtgttattatgctgacgaaacgaattaccaaaaaagactacccaactatcaagcaagctctctttaccgaacaagggggctgttgtgctatctgcaaacgtcccctggagggagagatcgagaaacatcaccttgaccatgaccatgcgttagacggcgaaaacgccggacgtgtgcgcggcctcctgtgtaacctgtgtaacggtacagaaggtattgtgaagcacaaattcaacagatccggtcttgtgtcccgtgatgttgactacatccagtggttagagaacttgcttgcatatctgaaacaagattattccgaaaaccgtattcatgacaaattcataccagataaggtaaaatggttttcaagacttaccaaacctgatatgattgccgaaatggtttctatgggcttcgagtacgccgacaaagacgaacgcaaagccttaaccgcaaaatatagaaagcaattaatgaaggcaacgaaatgaaatatctaaacgctcgattatcaacgcaacagaagaaaaagctgatgatgttgatatcctccactgacaaaaagatcatatctctacatgattggatgcttggaaggggtgactctgatttgtgttatgtcaaaccgaaagaccgaacgatgtttgatgatcgcggtcgcacattgactaatttttctcctatcaccgttattgatatgtgggaactccttgagattgtaggacgggatatacctgttgacggggttgaactgatcaaatatcttaacgagattggacacaatttagatattatccataaggcaacgaaatgaaagtagaaaaacgcgacggcaaaaccgtcgatttcgatcaagaaaaaattcgcaatgctgtgtataaagctggcgggactatgacggatgctgatgccgcaatcatgctggttcagtacaatcagatccgtgattttagttcaatgaagatcgcccgtatccaggaactcgttgaagaatccctgatgaaaacgaacccagcggtcgcccgtgcatacatcgaatatcgccacgatcgcgatattgcccgtgaacagaaaagtaagctgttcaaagatatctccggcatggtgaatctgtccaacaaagagatcaccaacgagaacgcaaacaaagacgcacgggtattcccgacacagcgtgatttgctggcgggtattgtagcgaagcatttcgcccgtaatcatatccttccgaaacatatcgtagaagcgcatgactccggcgacatccattatcacgatctggactatagcccgttcaccccttacactaactgctgtctggttgacctgaaaggtatgctggagaacggtttcaagatgggtaacgcggacattgaaccgcctaaatcgatcggtgttgctaccgctctcatggcgcagatcacagcacagattgcctctcaccagtacggcgggacaacctttgcaaacgtggataaagtgctggctccatacgttgaaatgacattcttcaaacatctgcgcgatgctgaacattacggtatcgaacactataatgaatatgtgtatgcgattgaaaagactgaaaaagatgtgtatgatgcgttccagtcctatgagtatgaagtaaacaccctacatactgccaacggacaaaccccgtttgttaccatcactttcggtactggtacgagcgattatgagcgcatgattcagaaagcaattctgaaaaatcgtattcgtggactgggtaaagagggtatcactccggtattccctaaactggttatgttcatggaaaaaggaatcaaccttgatccagaggatcaaaactatgacatcaaacaacttgccctggaatgtgcttctaaacgcatgtacccagatatcattagttcagctaacaaccgtgttattactggttctagcgttcctgtatctcctatgggttgtcgcagtttccttagcgtgtggcatgatgataacggtaatgaaattcttgatggacgtaataacctgggtgtggtgacaatcaacctcccacgcatcgccattgaagcggaagcgcaggaagaagaagacgcacacgacgcattctggcgcatccttgatgaacgtctggaactgtgttttgaagccctgatgactcgtatcgaaagcctacgcggtgttaaagccagtgttgcgccgatcctatacacagaaggtgcttttggtgtccgactgaaaccggatgatgaaattctggaactgttcaaaaatgggcgtagctctatcagtctgggttatatcggactgcatgaaacgctgttgatgtttggttcaggccaacacccatttgatcgtatcggctcccagaaattaggccgattgatcattgaatatctccgcgctgcaaccgaagcatggaagaagaaaacagggtatggatttagtctgtattcaaccccagcggaatcgctatgccatcgcttctgtaagctggactttgagaagttcggaagcgtcaaaggtgtcacggataaaggctggtacacaaacagtttccatctggacgttgatcgcaaggtaacaccgttcgagaaaatcgactatgaagccgattatcattacatcgctactgctggtcatatcagttacgttgaattccctgatatgaaaaacaacctgcaagccctggaaaaagtctgggattatgcgatggaaaaactggactacttcggaactaaccttccggtcgataagtgttttgtatgtggctctgatgacgagttcacgcctacagaagacggtttccactgcaaacactgcggtaatcaagatccggctaaaatgagcgtcacacgccgtacatgcggttatctgggtgctcctgctgttcgtggattcaacgaaggtaagaacaaagaaatgatgcaccgaactaagcatcaaaattaatcaaaaagccccttgcgaaagtgaggggcttttgttatattgcacataccgaaactatgaggtattgaaaatgatgtactggacaaaagactattttgaatttcgcgatgaagaaagttttgggactgtataccgcaatttagctttgcgtggtagtcctctgtcgcctaatcaactttcatctgtcttgtttcctatcaaggtaacgcactgcgatcggaaaggtgtcaatgggattgttgatgccaatggcacaacatggtattccgaagattcttatctgtttgataacgaggatcgcggattctttaaaaagtttgtcgcgcttaaacctgctgttgaaaaagccgacgcgcaacaactgctggattgttctcacctgctggggcgaatttacgtagatggtaagctggtgacgaaacctggcgatctggaaaaattcttgcgtaaggcgcgggaaactaccctgaaagagaccgaaaaacgttacgatactgcaaccgccaatctacagcgtttgtctggtgaactgaaagttctacggggtgaatgatgaccgggataatccttgataccttgtttccctcccgtgtacgtaggcgcgtagaacgggaaaaccgactcgaagaaatccggttcaataagttccttgaggacaagaagaagcgcgaagacgagaaacacccaaacgcaaaaatggctgagggtgtatcgaaatgttctgtcgggcggttctgggttgaaaaggattatcttgacctgataggtgctattgcccctggtgttacgctggaggacttctcccgcgctactgggcgttcgtatactggttgtatcaaccgcttgcgtatgctctctatagtggtgcgtagtgcgcatttcggctatcgtgacgttatccgtccggtgatcccagtaagcagattaaaattttatatggcgggtggaaaaagacttgacttgaccaacgaactgtgtaaaatcggttatatcagagaggggaaagttgttaaagcccctgaatggttcaccaatcaatttgaaatcaaataaggtaaaattatgttcaagaaaatcgtagcattcgtgactggtaaagttgaaactgcaattgaacaaaacacttccccagaagaagcctggcgcagtgctgcacgtatcctgatcaaagagatcgaccgtctgcaacatactcgcgtttctgctgttcaggaaatcgtgaagttgaaaaagaaagtcaaagaacacaaagatcttcattctggtaaagagtcggagatcaaaaaactgctggcggcggggcaggaagtgtccaacagtcattatgttctggcgctgcaacaccgtaacatctggcagggcttgcagacgaagatcgaagaactggaagggatgaacaaagagattgatctctctgtcgttgaactggatcgcaaactggctgatgtcaaaatcaacctggagatcatcgaactgaacaagcaaaccgaaagtctgggtctgactgtaccggaagacgtgatcgccgctgtaggccacacctccgtaagcgtcgataccatcgtgacgaagattgatgtgttgctgggtggcaaaaatgccgcttccgtaacctccgctgacgttagcgcttacatcgactccctgaacgcgaaataagaggaaggggcgaaagccccttttttgctatgtacgattacactattgaacgtgatcgcggtgaagaatggttgatttctcgtgcgagaaacttctatgttaaacttcctaaaaactttcatactttaccgaatgatgatactgatcgcttattgagaattctcgtagatgggaatgttccacagcgagtttttcaggaaatggttgatcatgcgtgttctgaatgggataaaaagtattgcgaagaactgacgcatgatagtatagtaaacagcaaccttaaagacgcttacgaacgaagaagtgtatatgacatttacgaaaaagagaggaaagaaatgatgttcgaagacggcaacagtgcatttaaaccagcacgtaaaacgtatccagactggcgcaaacagtacgcagaacagttatggcacattgacattcccgaagcgctcatgaaagcgattagccctgcggttgactactattcaggctggaaagatgaatatgagttagaagtcggttcgtttaaggcgcacgtcatcaaagcgaccagaattcttgatttcgttgaagctgttgcgtcgtgtgatatcgttgaagatattcgtattccgtcaatcaacgtttcgcggtatagttctcctggtaacattcgcggggatcgttatgcgaacctggcaagcactacggataagctgaactttcacaaaatcaatgaaaaaggatttgatggttgtgttctgatctcaatggtggttgtcacgacgcaaggcgaatacaagctgatcattgattgtgacaaagcggctcgtgcaattcccacaatcaaacaatgctttggtgaagatttcaaagtattgatgaaagcccgtgcgatggaaaagttcatccattcgtgcaaaaagaacgtgctggagaagtatgatccggcgctcacatacaccaaaattgataaagatctggtaggtgatttatgctgattaacaaagcgcagtgcaaagcgattaactttctgctgcacgaactgattgaaaacggtatcagatttgaattcgttgatccgattaacggtgatgatcgtcatctgctccgctgggtgtctggtagcaatccgctggattcagtctcccaggttgtagagtctgcgcataacaatatgccttgtcgtgttctgttgggtagcgttaacgcctcaacatggaatggatctgatgcttattatgtcggattcaaaaaagagttgacggaagacgaatgatgttataatatgcccctgtagacaacaaactataggggctaaatcatgaaaatcaaaaatactgctactgaaaatctttgcaacgaaatcgcggtgacttactggaaagaaggtcacgtaaaagcaatgaaggattttcaacagtggtgtgatacccagaagttagccaactgggaatacgccgtaatcgtggaacggatcaaagaactgatccttgagaagaaaggcactataaaatgattcaactgaaattagacacccaagcgctgaacaacctgttcccagaaggaacacaagcgcgaatggatctgcaagccgctgtcatcaagaatgttgttgacagcgttatcggtaagcgcgtaaccgaagaaatcgaaaacatggtgatcaagcacgtcaatttgatgatgccagccaatcacgaaatcgaaaagattgtgcataaagagtttgctgattacattcagaaacgctatgcatacagcaatgttttcgatatcaattcaggcggcatccgtcagatcaaagaactgatcagcgaacacgttaagaaacagtgtaacgacctgctggattcaatcaagctggaagcaatcaacgatgcaaccaaaaacctcaaagcggacgaagaagcgtttatggctcgtgtaaccaaaaacctcgaagtaacggttcgtcaggaaatcgttaagcgcgtgaataatgaattcccgcaaattatcgacgaagcgatcaaagcccgtttgttcccagaggcgaaaggctgatgaactttgaccgcatctataacatggatgtggttaacggtaaaggaatccgtgtagtgttgtttgtgactggatgcaatcataaatgcgaaggttgctacaacaaatcaacatggaatccccgcaacggtacaccatacaccgaagagactgaaaacgagttgattaaactcctttcaaatccccatgtggacgggttgacgcttacaggcggcgatccgttttaccgcaccaatcatccaacgctcttaaaactgcttgagcgcgtccgtgcgacgtttcctgataaagacgtgtgggtttggacgggatacaccctcgaagccttacagagcgatacagaacgttctaagctgttaccattcattgatgttctgattgatggacggtacgaaaaggatcaaccgactaagaaaccgtttcgcggttcggataatcagcgaatgattgagttcaaaaagaattccatcgaaattaaaaatatcgcttgacctggttggtggttctgttaagatatccacgtagcataaatttaacccaattgagagataatatcatgatcctgaatttcaaaacccgtaaagaagcccgtgactattgctggaagtggtcgatcccgctgaaaaacatcaccaaaggaagtggttcacatccgtggacggtgagaaccaaagaaacccgcttcgaaactggtaaagattacaagctggttgatgtcgaaggtttcactgacaacggcaaaaacattgcgaacagtgttcaatcaaaacagatccaccaattactgaacggtgttgtaaacatcgcaagccgtaacggtgatcgctacaccttcaatgctccggcaggtgttgctatgaacacccttcgtgcatgggaagcgaaatacttcacagaagttgctccggctaaagccccagcgccaaaacgcgctaaaaaaccaaaaccagtaggcaaaccgtctgttgcacctgcaccagcgaaaccggatctggattctgaactggatggtggtgttaacctcgctccggcagtaaccgaaccgtctgttgctaaacctgctgcaccacagccagcgctcgtagaagcgatgcctggttgttttgttgccgaccgtccgtatgttctggtagatgaaccaggtttcctgcgctctcacaccgcgaacaaacgcattgtgcaacacatcaaaaacaacaacggtgttctggtgttttcgaatgttgacggcgacggtgacgcgacaatcacgcaagatcgtagcctcccgtttgtgatgcaccgtgagcgtaaattcttccgtgaactgggtactggtaatccggcaaacactccagcagttcaggcggttgatatttccaaacagcaacacgatcaactggtcatcgctgctgcacaggcagtagaagacgcactggcagaacaccagaaagcgatcgaagttgtagcgcagaaagctcgcgcagttcgcgaagccgccgcaaaacttgcactgctggcaaataagtaatataattcgggggtgcttacggcatcccctttttatttgaggtaatcatggaattattcgctggaaaaacttacggtttaaccgtatcccctgaaatctttgcagagaaaacctggaaaacaggtatcgcaaacatcattcgtgaaaaaggttacgtgacgattgatcgcacctcgatcggtgagttcgaagaccgcgcgtttatcatggacggtggttacgaatatgaactccctgcatcactatggaaatggttcaaggaagtaacgccggaagagggtgaattcaccccagaagaacctgaagaggttaatctcggtaacggggtcgagactgaaaatggtatgcgtatcgcaacgccggaagaggtttccgctggtgtcactggttcggatctgtgcctgatggatatccctaaattcacgtatcgccctgtacaggaaaatcctttgcgtgatctccgcatcgatccatcatttggggctaacctggaaacgttgagcatcgcaccgatgccagtacgtaaatctgatgcaatgcttcgtttcgccttgcaacatgttttcagtggtggtagcatctatcaaatcaacatggaatctgaactgaaaatgcaggaagaccagattgcaaacctgttcgatctgcacactcaattaaccgctgttgaaaatatcgaaaaactgttaggcaaagagaaaaagcgtattttgcaggatctcaaaccatacgggaagaagaatgaaagtcgaaatatacggaatccccgaaagtcttcataactgttacgggtgtatacaagcacaaaagctgttgacagaaaaagggatagaatatacattttatcccgttctgaaagaagcgaaaaacgatctgggctttgaatacgatcgcccacgtatcgaagagttagcaaaacgggtaaggcaacgcagtttagcgtttcaatacccgcgtatttttgtcgataacaaacttatcggcggttatctgcaattgaaacaacttattggtgattaaatgagccgtgaaattttactccctgctgcaaatgctgttcatgctgaaacaatggaatacatggagaaattcgttgaacgcgataacaccgcgatcatcactcctactcacctggacgcgctcgaagatcgtcttcataagcagattaaagatcaatttcctgaaaaggttagccgcaacttcattcgtcaggaaatcgttgcaatgatactgaaacattacggcgttgaaatcttcggtgtcgaaccactgaaaccgaagaaagcacgtcaaatgcctaaacagatcaccgacgaagcaatcaagaaataccagaagaaatacgctaagaataaatgatctttaatacgattgaatgtgttccttcaagcggtaaaacaaaggcgattctgaaccatatcaatcaaacgggcgaaaaagcaatcatcgcttcgatttccatgatgttatcaaaacagtcttatgactattacatcaaccaggtaaaaggaaaacgggcggtgattgtggacacggatcaccgaaccaaaagaaccaataacgatgcgctgcgtgaagtagtcaatgattacgatgtgatctttatcactcatgcagcactcaaaaacattgatgactttgatttgtataaggatttttccctgtacattgacgaagttcctgatttggttgcgttcgaaagtctgcgatttaatagcaatatcaagcacatacgcgagatttgcttgccgtttagttgcaatgccgatgatatcgttgatttaaaacttgacgaagaaaaacgagaactggttacacgattagcctatgatgggcttcgtaaacgtgatgatatcgcaatgaagatgttcccgctttaccgtgctctgttaggggctattccggtgaagatgcaatgtagcgattcgggatatgtctgttacttcgtagaggatcatgacgtaagccagtggaagttcaaaaatgtaaccattgcttcatccaacatcaaagacacgattacagggaagatcctgcaaacgtttcatgatgtggagttcaaagattcaccgcttcaaaagctggttgactttaagcaatacaaaaacactgggcgcatacatatacatgtgctcgcagagggggattattcgcggtatacgggcgatctctctcaatctgggacgacagtatacactcagattaaaaaacgcgtggaggcgcttttagggggcgaacagttcatctattgcaccaacacatacagatcgaagtttagcgaggggcaggaaatcccgtataactcgcacggattgaacttctattcaagttatactaacgtggtggcattattcagttacaacccgttaccctggcttcgtcaaatgttgcgagcggttgcggtgtcctctggacttgaagaggaagaattagttgatgcttatgttgtcagtaaatattacgaaccagcctttcagttatgcgctcgttctgatatccgacacaacaacagcaaaagaaagattaatttatttgtgcctgatatgcggttagcgaaatacatgaaggaaaaatattttcctgatgccattatcgaaaccacagaagcagttcaaacgaaaaggcaacgcaaatcatttcaaacccttttccaaatgacggacaaagagaaaaacgcttttacgccatacaagaaaagaaacaaattagattatgcgaatcctcttcatcacgcgattgttaaagattggctgaacaattaccgtgagaaaaaggcgacttgagggtcgccttttttgtttataaatatcagtattgaataagataaaggaaaacgataatggtagctaaatcattccgcgccacaagtggccttgatgctgctggcgaaaaagttatcaacgttggtaaagcatcacgctctgtgttgagcgacggcgtgaacgttgacttttttaacgaatttaacacgatccaacaatacgattctacccgtggttatgctgcgtttatggctatcatgtacgcgcgtcgtatttggtacgctcgcgcagatattccatcaccagcgggtgctttcgatgaaacaaaatggatctcaacccgtaacgatccaaaatgggtatataacaacgtaacgagcactgacggtctccctcttgaatccggtacgtacttaatggctgatggtcgtttctctgaactgacctatattctgccagatgcccctgttgagggtgatattatcaccattaaagacggtggcggtcttgcaggggttaacaacctgttagtacgttcaaacacccgtcagatccgtttacgtgatattcagtcaagctcttatcgactgactcacccatatataaccgttgcgtttatttttaacggcaacttatggcgtgttgctgaaatgcgtgataaccgtgattcgcagtttgttaatgcgactggtttaaccgctttccaaatgcaagcgggtatggtaacattccgtaacagtggaacgggtaaaattacgttgcagttgcctcgttacgcaaatgatggtgactcaatcacaacttacgatctggatcgccttgcttcggtgaacgttgcgactctgcaagtttatcctggtagcggacacacgatcagttatgacggtatcaataacgtaccctctgtgacttcacagcgttccggttatggtattttcatgttcgatcaggctaataaccgttgggttgtttatgacggtgatcagcgcgttcgtctgcgtcgtatcagtgatgacctgaacatgttgccgaacgattacgtgttcattactcctgttgctggtagtcctccaactgtgcgtaacgttacgctgactcttccgcaagatgttgccgaaggtgatcgtgtgtatatcagtatgtacatgatggggaaaacgcagaactgcacgatcaaagttaaagatggttccggtgaaaagatccgcaccaacaaaaacatgatgcagttcccacagcgtaaggattatccgcctaatgattggttcagtgttgacactctgactttcaatgccgatactgactatcttccatacatggaattgtcgtatctgaaagatacgaaagaatgggtagttgcacagtatcgcccgatcattgaacgtgtcgatccaacaaaccgttctcgtctgggtgtgattgcgctggctacacaggcagaagtaaacaagaaccatgaagatacgccgtctgatgaactggcagtaaccccgcgtacactggcgaataaaacctctactgaaacgcgtcgtggtatcgctcgcctggcaacaactgcggaagttaaccagaacacgacagcaaccttccttgatgacgtgatcgtgacgcctaaaaagctgaacgaacgatcagcaaccgaagatcgtcgtggggtgctggaaatcgctacccaggcagaaacaaacgctggtactgatgacactaccgcaatcacgcctaaaaagctcgatacacgccgcgcgaccgaaaccttagcaggtatcggaaaactcgttacaacgggcgctacgacagcggagggggctttacgtggggatgctggtactaacgtctacaacttcaataacggtgttgatctgatcaccccgaaatcattgaacgagaagacggcgaccgaaaagtcaaaaggtctggttgttctggcgactgaaaacgaagtggtaactggtgctgctgcgggatctgcttcaatgccgatcgtagtaactcctgaaatgctgcatcgtaaaacgtctactgaaacgcgtatcggattgattgagatcgcaacccagacagaaacaaacacgggaactgacgatctccgtgctgtaacgcctaagaagctgaacgatcgtaaagcgactgaatcacttgatggtattattgccctcgctaccactgcggaagttgcagcaggtacggtaacgaataaggcggttgttccggttaagctgaaagagttcttcgacgttacaagtcatgttgcggttgctaccgatgacggtttaactcagtccggcactatctggacaacgattaacctggggattgcgtctgctactgaaacacagcgcggtactttacgtgttgcgactcagggtgaaactgatgcgggtcttctggataccgtgttcattacgcctaagaaactgcaagcgaagaaagcgacggataccgccgaaggtattattcgttgtgcgactaacgcggaagcgggtgcgggtactgctactaacctggcaattactccggctaccatgcagttcttgaacggtactgatccggcgtggggtgcaacgacaaatcgacgcggtgcggtgtttatcactaccaaagcaaacactttcatcggtgataatctggttggttctactcaggccgttgacgattatcttgaagatttctatgctgtatcgcctcgcggtctgaactttgctctgcaaaacttcttaccgaaaatggcaacggcgcagaatagtttgagtctgggcggtgtggttgctgcaagctggatgcgtcgtgatgcaaaccagacggtaactggaaataacacgtttaacggtacaagcaacttcgttggtaacgtaaccactaacggaacactgacggctaacgctgcggtaacggttaacaacaccgtaaccacgaacaataacattaaccagtctgcgaaagcaaacactgtttatgcaaatactgttctgagtggtgaggctgcgggaaccaaaaacttgcttcgtacattccgtggtggcgtggcggatacgatctggcatgaaactgttcagggaagcacgtatcgcctggcgacgggcacaacggatctggttgacgttctgacagtaggtgatgtcggtaacggcacaatggcgtattccggtacgaacattcgtctgaatggtaaagctctggctaacatcaacacggcgggtgatttgtttgttgcaagtacagcaacgcctacggtacaattacgaaccgctgcaactaatggttggaacggtgtaacaatcagtaatgacggcggcacaaccactgcaaccgtgatcaacacccgaaactttacccagcatcttgacagtacctatgtcaacgtagcgggtgatactatgactggtgcgctgtcagttagcgtaaacggtacgggtggacgctttaccagtgtgagcggtacggcacatgttcaggcgggtgatttctctgggaacgtccagaaaatgcgcttaactggcattgacgataaggtattgactgagttcaacatcaatatcaccgattacaacaaagcgatgatcaacggaaacctgatctatcatgcaggtcgtaaaccgactccggcagaaatcggggcggtggcggtagcgggttcaaccgtcgatactctggttgtacgtaactatatcaaaatcggtaacgtgaaaatcttcgcaaacccagcaactaagacttgtgaatttgtgtgggaggaataatttaaatggcgaataacgaatttatggcgttattcggccctgatagtttcacggcgagtgtgttttcagaagcaaacgccgtgaaatatcgccttgttgtccgtggaacgaataacgattctgcggtcaactcggttgaggtatctatcaatggggctgatattattaaccgaaacgtacagcgcggtcgagggattaaccttgctgtaattgacggtacgagtttggctttgctggatttcaaaacttttgatatgtatggtgatcctactacgaatgggactgcgattagtgattacctatctacacttccagcaaacagaattgtatgtttctatacgttcgatgctataaaatctaccgatgcgtttttgagttatatgcgcacaatcggatcagttgcatggcctgaaacacgattctttaacacgccgtcatcatcaacaaacaacccgcaccgttcatcctattcagcaatctattcatccacgatgaaaaagatctgtatggaaaacttcgtaggtggttctggtactggactcaaagacaacacgacgagttttgttgaggttgtattcgatgaattcagtgatatcggggtaactggtattcctgaaagaatggttgatgatgttcaggtatatcagaacagtggcagtgcttacggcttccatttatatgggatgtgggatattggttctactgttttcttgggggacatctttaagttcactggtgatgtttattgctcgcaagaacttcgcaatgctggcggcgaatgttatctctatatgtggacacagaacgcctctggtcaatggatatcctctgcggtactgcgaacaactgggttagctcctgatgaatggcattctctgtcaggatatttcactatccctacggacgcgctaaacgtgaagatgggatgtatggtatatcactacccgtctaccgtgaaagtggggcttgctcagtgtcgcaatgtccagatcagtaaagttccacgaatcgaaaccgatcgcaacggggcggcaattggtgtaaatggtatcaggatgcaaacgctttccgaagttgatgatgctggaacccaaaacccgattgataaattgctttctctgcctgtttcgcctactggggttattagtgacaagaaaatcagttcgcataactttgctgaacttgattatattgtttctgatccggttgaatacacttcgacaaatacagcggagtaccagttcaaagaatggactgctacccagcaagcggcggtaacgaaagcatcactaagcagttacggattaaaagctggtgatacgatccgtatgcaatgccaaatgaaacgcgatgcaaatgcgattgctaacaataaaggcgcatatattgtaatgcagttctgggacgcgaataatacgtatatttcagggatcaacatgcgtgatgttggtacgatcccgaacgtatattcattctacaaaaacgaaggggttattcctgctggtgcggttacgtttgatttcggtttatatcgttatccaaacaacacaaacatcggtacgatatccgctaaagacgttaatttgtcaatcgtgagataaaggggcgaaagcccctttttcataaatacagtcattacaggagaaatttttatggctgatttgaaattaggtacaacgctgggtggtgcgggtatctggagtgcttctaaccttcctctattgccctctggtggacaattaacgtataaaggctggagagtatacacagaaaatgatcgtccaacagcggaggatatagacgcactatcgacgattaacggcggtactgttgcgaagaatactacattcaatcagaatttggttgtgggtgcttcattaactgctaacttgattcaatcgaatagtgttcttaccatccaacgtagcgcaaaccctgcggaaatgattttctatcgtcccgatattacggcaaccccgtcatctgaagcatgggttttaaacatgtatgcgaaagatggtttgaatcgaggcatgggttcgttgattatttctgctagtactgacggtggaaataaagtatatctgcgggcgaataaagacggttcccctaatacaagtttaacgctggattcgcaaacccaacaggtaacagttgagcaaggatcttttcgcgtaatcggtactacgaatcttggtgtgacgaacgccgcatcaatggcggttagcggtgcggtaactgcgaatacagtaaccccgacaaactgggctaaccatgatgaacgatatatgacgggcattcctcgcggtatgtctggaacaagtttcggtgctgctgttgtaactgaaaagaacgatgttctgtcggtaggcggtaacatcaccgacggtccatatggtaacactacgtattacgggcaggttgtcaactatcgccgtacattgaatagtggtgtttctctggttcagacttactatgatataacatcaacatggattcgtgctgcgacgggttctcctggtgcatggtcttatagtgcgggtgatgctaatggatggagaagaatttatgatacttcgcttcctccgactccggcggaagtaggggcagtcaataaatccggtgatgcgatgactggtgttctaacactggcaaacatatctcaaccacttaaaacacccggcggtggtgttctggctaatgacgggaacgtgtatatcaacaaaagcgggtttgcaggatggattgatgctttattcttgaaaaatacaggtggtactgtaacaggaacaatcaaccagacaggcgggtattttgatacatctgccgaagggagaggttcatgggcttcacaaaacaccgcaaaagctccaattttccaaaccattaacacaacagcaacttccgaatactggcctattgttaaacagtattacacacaagctggtggtgcttggtctatgggtacgttggtaaacactaaccgatttaccgttcattaccgcacgagttcggtagatcggcagtggtattttgacaattcaggtgaatttgtatcatctggtgatattattaccacctcggcaaacggatttcgtatcgcatatggcaacaccggatcatttattcgtagtgacggaaacaacacgtatttcctactgacaaatagcggtgatgtttatggtggatataacaatttgcgtccgatttattacagcaacaccacgggtgctgttacaatgggacatacgttatccgttaatggtcgtattagtcaatctagtagttatattgacaatggaaatttaacattaaacggtagcggcaacggacgcgttgaatttattcgcagtggtgcaaaccctcgcgatatgtatatgttccatgctggtgatgcttctcgtggaaaccgtattgaaatctctgatagtgcatcatatctggtttattttgaacgcaacccttcatccggcattcagttggtaatgaacggtaacggtagctttaacgatgtgtatattcgttctgatgaaagactgaaaagcaatttcagtaagattgaaaatgcattggataaagttgatttgcttgatggtatggtgtacgacaaagcaaatcatatcgggggtgaagaaactacccgtgaggctggtttagtcgcacaacaactgcaagaagtattaccggaagccgttaagaaaggtgttgatggtgaacagaacgagatcttaactgtttcttcttctgctgttatcgccttgctggttaacgcggtaaaagaactccgtgaggaagtcagggaacttaaatcccgctaattaaaagcccttcggggctttttctttttataaatatcataaaagcatttgaggatctaataatggcagatttaaaagcgggtactaccgttggcggtaatactatctggagtcaggcgaacttgcctttgctcccttctggaaacacaatcacatataaaggctttaaaatctacaccgaaaacgataagccaacaaaggcagaaatcggattaggcaacgtaacgaacgatgcacaggtgaagaaagctggcgacgatatgaccggatctctgaaccttacaggaccggatagtcaattaactgttccgtatcgcctcctgatgaaacgagcggcaaatggcgatccctatgtgttgtttgtacgtccagacaacaacccaacaacggtcggttatccatcaaacacacttcgtgtaatgactatcactgctcgtgccgcaactacagcagatccggtttctggtgctcaattggctaacgtattagcagatcagacagcacagggtaacggatcactaacattgcaagcatttgcagccccaaatacaaccacaggcgcaagcggtgcgcgaacagcagagatttacctaaacggcaacgggcaagtatctatgacgggttccggtttaacgataggaatgcagactgttgttagtggtactatttttggtacacaaatggctattaaaggcgattcgaaccgaaacctatacttccaggatgctggcggtaatgagcttggtttgatctatgctgatacaggaaagaacttatatgttcgtactggcggtggtgcatatgcaactcgttttgcatctgatggaactttagttctcgctaaccatctaaccgttcctggtcaggctacatttaatggtctgggtgtgttcaataaccgtgcttctgtaggcgtagattatgattcgcaaggaataaactcagcgattcttcgtgttgaaacaaacggtgatggaaacggggttggtgatggtgttacccacttaggctataaagacggcaacggacgatataaccattatttccgtggtactggttcgacttctatcaacaccaaattggggcttaacgtaaacgtaccatcgtattataacgacgttccacagggcacaccagcgcaatatttcttacctactgttggacagggcgggaaaaactatttgcgtcagttccgaggcggtaacgcggacacaatctggcatgaaactgttcagggtggtgtgtggagactggcaacaggttctacagacggacaggaagaattgcagatttctactgcgggttatgctcgattccgtaacgaagttcaaagcgctacgtctggttctggtggacagttccgcgcggtacaaggaaactacggggtaatacaccgaaatgatggtggtaactactataccttgatcaccaactccggcgatccttatggaacatggaacagtttacgcccgattactatcagcttgactactggtattgtttctataggaaacggcgcgaacattaacggttctgttaactttggcaacgcggtaaacttcaacggaacggtcgaaacaaacggtattggttgtggtacgccaaacggattgggtacgactggtatttctctgggtgataacgatacaggtttcaaacaggaaggtgacggtattctcaacgcctatgcaaatagccagcgtattatgcgatggactactggtgcaactgctaactataaacagttacaggttcagggtgttaacgggccagcattacttctgaataacacagcgactaaccaatcatgttatttgctgattactttggcaggtaacaacggcgcatacttcgggtttggtggtgctgatgataacgtatcggtacacaactaccgactgaatacgaccttacagttgcgtacttcggatctgtatatgaaccgtggtctgtatgttgaaggtaacgtaaacgccaacgatgtgtatattcgttccgatattcgactgaaatctaatttggttgaattgaaagattcattaagcaagattgaacagcttaaaggttatatctacgataagcaatcaaaagatgctgatgatatcgtataccatcgcgaatccggtctgatagctcaggatgttgagaaggtattaccggaagcagtgcgcgaagacatcgacactggtatgttaaccatttcaccttcgggaattaacgcgcttctggttaacgcaatcaacgaactgcgtgaacgtctggaagcaatcgaaaacaaattaggggcttaattgcccctctttcatgaggtatttttatggctattgtaggagtccctggctggatcggttcgtctgcggtcacagaaacagggcaacgatggatgtctgctgcgggtaatgcggttcgaatcggaacaccgttttatatgtctcgaatggcgggacaatcggtatataacatcaactttacggtgtatgagcgttactataacaacgcccgttatcgtggtcagtggggggttggttggtattcaccatattcgaaaccttccggtcatgatgcggttggtggtagttttaacggcaacgcattcggtactgtagttgcagcacaatcaacacctgatatcagtgtaattactattcaaaacggtcctgctgtcaacctacgtcttactatggatgacggcggtgtattcgattttgacaacaacggacgtatacatgatggatatcgtcaatatcaggttgtttcttctcaggcgaccagttggtatgactatctgaacgcccgtacaggtcagaaccgttctggtttggttacgcaacgttaagtaaattcctaaatatattcgggggtcggcatccccgaacttgaggtttaaacatggcactattacaagataaattggcggtgcttgaacgggtaatatcgttcatcatggcggtcaaaacatggaaacagttattcattaaattggttcttatcgtcactattttcattatgttcgtaacatggtacaagtgggatgacttattttcagtctggaaaacatcttcaagcgttatagacgtgccgacgatggagattgaaaaggcaaaaaagtttgaatccgtatccatcgaacagttaaacatagtgcatttaactacgggtgcggatttttcggcaatctttgggttcagacctaagaatgtcaattattttgttgatataattgcgtatgaagggaagttaccgcaacagattaacccgaaaaatctgggtggctatcctatagacaagacatcggaagagtataatagacatataaacgggctgtactatatctcagatattgcaagcccgtatcttccaacaaaagaccttgttccggtagcatatacctttagttgtccttatttcaatctcgaaaactactattctggatcgattctaatggaatggtatatacagaagcccgaagtcgccgatacgaagttgatgatcgtgtgcaatcaggccgcaagaattttaggcaggattcgatgataatttcagtttcaaactactcaaagcccgattgatgaaatcttttactttcgtcatcgggcttttatcgtatatgtcccatacgcgcatgagttcgtaaggtgtcggaacatattcatcgttccagtatccaacattacctatcgtaatgcgccggaaaccagcctctacgctgtgatatacaaagaacccagccttacccacaggggcgactttaaaaccgcgtgtagcggctttcatggcttcgtcgtgtgtcatgatagaatcacttcgcctctgtattgattgtgatagatgtatggacgaacacccagtgggtgattatctatgactaagatcgggtcaagttcgtcgttgttatcatcttctgcaactatatcccagtcggtcgctttctgttcttcaacactggcaatgaatacctggttaatctcaaccttacggtgagaacggcgaatgatcgtatccccttcgcggaacacgatcatatctgggttaatcgggcggtacgcggttttacccgcgcacacttcattaagcatttcttcgtatgtcattataatacctttactcgctgaacgattgtttgtttaacttctttgtattcgttgtgaagtttaggtgtcgctttgaagcgaatcacatcaccctcttcaacaattttgtttccgtagtagataaccacgttaccatctacgttgattttggtcatgaaacgttccacttcggtgtaataagaaacttgggtatatccgagagaaatcactttctcaacaaccccgctcatttccatacgcttaccgatttccccgatgtgctgtgctgctgcgatcttcgcctggcgctctgcttcccattctgcgcggatctcttcacgtttagcgatgtaatccttctccagcgctacgcccatgcagtaagagcaaatagcctgaaatactgggctatcgttgccgttttctttgcactgatcagcccaccacagaatcgtatacatcggcatatcagcaatcacttcacctttacgcttaccgattggcatgatgccctgttccagcagttccaggttttcggtatcctgtacggacagtttaccgcgacgttcaaacagatcgaaatctgcgaagccctggaacaccatctggaaagtatcggtttggttcagacgatccaccatgcgatcgaagtattcacgcgctttcgcttccgctttatctgggtcagtagacaggttgcagatatagttatcagaagtgaattcacctccacgacgctctacacgcagagtgtacatagcgtttttagcgccagaagaaatgaaatatgtcgcggtaactttagtcaggttagtcatggtgaatctccttagtggtttcgtttcgacaaggccaatataacaaaagccctcaaccgaagtcaagggctttttatcatgcgttcgaatctttcataactttatgaagatggatatcaaaaattttccagtatgcttttccgcgaggataaatttttgctttatcaatgtcttcgttgcttccccatgtattgtttgggttacgacaacgattttttgcataatccatgtgccagaataagcgctgcaccgatgaatctgtgcctaatggatcttctttgctgaacagaatttgtgaactcataagaagaaacctgttcgaactactaaatcgatctgtttttccggtatcagtggcgctttatcgtcaacgttgcactgataatacatcccgacatactcatgaggaacgttggattcgctcgcccatttcaggttgtcatctgtacgcggccctaacatgaggttaacgatattgacagcgtgatcctgttctggggtattgttgcatccgttcacataatgtccgtgagcggttttgaggatttcaatgatatcttcgtcggcttcaacgagatacagccccgtgttttctgggatttcctcaagaataatcaaagcggttttcatcacacttacctttatgtttctgcttacgttttgcttctttaagtgctcgcttgcgatcgcggtgagtagaagcgcggttgaaatcatgtttcgctaccaggttgttcatcgaggatataatggcacatgatgttgaatactgacttcgccatacagttttacgatagttaagctatcagatcctttaacaattctgtatttttctggaacaacgcggtcgatttcttttttgacaaagttaagcaatccgaagtcatctatatcttttggtgctttggaaatagaagacaacgatactcgttgacgtgaatcatagtacgaagaaattacaaacatatattattttccttattggggcttttcagccccattttagataattaatccagcagtttgcggatcttatccgcgatacgtccggcgcgggttgcgcttgcggtgtgatcgctttctttggtagccagttcagccagcttacgctgatgttcttcttccgctgctttgcggtctgctgctacctgttcgacctgcttctgatcatgcgcaatacgcgcttcgagttcggtcagggttttgtcaaaagttgctacgatttcgtctacagaacggattttggaaaacagtttcatattcattatctcaattagtatggttggaattcaaagtcaaacagatcatttagtgcgcggttgtattcagtatagttctcaccatccccgaaccgcatctgaatcgcgctttccgctattgtaccagtaagatttgagaaaccaaagaggtttttaatcttatcgtgtgcaacgaagtacagagaagcactatccagcaaggccaccatcgctgatggttcatgttcgcggcgtttgatgcgtaacagagtacggtttgcgccagtcttacggcgttgatttggggctacgtagaatcgaaatactactttacccgttttatcatcaactaccaggtagaagccgtgttctttcaggtcaaccccttcgaacttggtgaagtcaccacgcttcatgtcacctatcttaacagcatatttgtggatgtcaagccttgtcagaattcttttcatttttcttcaccagtttatttcctaatttggtgtttacaccagttttcatattcattgtcagtaccagcaagaagatagggcatgacaaaatcaagatcgttgcgccgaacactaagcgaactaagcgaatcaacaacgtcccgatccatttcatcggtatctctacccacttctgaaccgttgcgagtaccagcataacataacccagattaaatgcaagggctgttgcgataataccgtaaggttttttgaagtatgtctgttcaccgtcttctgtacgtccagcggtaacgttgcctccgttccagatttctttagcggttttaatggctgtttctgccccgctcaagttctgccagtagtcgggggtactctgtaggaatttcataatcgaatcctccgcgcctgaatcgctccaggcgctgttttggggttagtagtgactgaatcccacggttacatcacgcatcacctgataacggcatacacgcatcttagcgttgtcgtaatctgtcgggattgctacaacatcgcgaggattgaccttaacctgaatgactcgcccacgtccaccgccataatgaggcaggtacgattttgcggcaacatgcaaaccgcatgaacaggttcggtttttattctcgtctacctggttacgtggcatttccaccacaacaccaggggagttatcgaacttaccggaagccagatcgcggaagtcttcacgaacacgtttccacgcgtagaaatctccgtcatctgccagttcgatatcattatgcaccatgaacccataaagctgatacacagcatcgcgtgaagggttttccatcaacttctcgaagaagttaaccaggtgctcgtaagggcggtcgttgtacatttcacgaacgatacgttgcgtgatgccgctgtcaaacacgatatctttgtacaggactttatgcccgatgattttaatgttgcctttgctgtaaatcttcaacgcttgcgttgtgtccaacagggtagcaactccctcgatgtctcccttaaccattaaagcgtgtgctttttcgaagttagggtgtgacgaatccgctgtgatgatcttgccgtccagtaccagagtaatgaacgattcagaaccaatcattttagatttgacatctttttgcggaagtggtttcgtcgcttccgtattatacttagcgtgttgctcggtaataacgcgcccgatggttcggacgcttacaccaaattgtttagccagtgcggttttgttcgcgctggtaagaaagccctcatagactgctttcttctgtacatcgtcaaggatcttaacgtttctcattatttccaccgtataaggttaatcaggttcgtcttgatcttatcgtccgtaatcatagtacggcctaaagagtaagacgaattgcgcaacacatacaccaatgcagggttgcgttcttcaaacaaatcaaaggcggtatcaacacgttctttcatatctttcagcattttgtaatgcttcacagacatttcacgaagtaacgggttacgcaccacatttttggatttgtttttgttctcgatagtatcgtaggtaaacttaccatcaagataatcaagcaacaaatacaattctgaattatagcggtttttcaccatgcgatcaagagtcacctccagataatcgcgaagggttcgaacctcgctaccgtgtttagacgagatccaggctggataccagttaggcttcatctttttcaccgcgtcggcaaaacgctgtaccagatagtcatcaagacatttcatgttgctatctggaatgcgactccacagagagtttcgcagaaccataacgcctttcagcccagtaactttcaacagggtcatcatactgctggcaatactacccagtgtatagttcggtgcttctccgtccagtcggctatattcatcaagcccatagaggcgcatagcgtacatttcatccagtttcacgaactgtgctttagtcaggaacagatcatttttctgtaagttaccctggtcatccaggaagtaatgatatgccgtaggcgttttcggacgtggttcagaatcaccagaagatgattcacgcgttgctttccagcgcttgcgatcttcggtgtacgtttcgaattctttggtcaattcactggttttcagtgtaacgatctcagattcatcgaaatagccagtttcaatcaactgacgcacagagtcacttttacgatcggcagttacgaaactgatacgatccgaaccgttcatcatgcagtaaccgatcagatacgggcggagtgaacgcgcttcgttatcattttcaacgatgaacagtttcttctgtcgccacggttggatcatgcgcataacgtcctggcgtttggtggtttccgctttatacttctcataacggcgaccagaacccacacgttcgaatacgcaatctttcccgtcatatgggttagcccagaagccccacacatattttccggttgctgtatcagggtttttgatgcgcgtcagaatttcagccagcgattctttacccacacggaaacggttatcacgggttacgaatgtctgtaacaagctaggcagattattgaaccatacgagtttatcgcgggttgtcttctgctttttatactgttccatcaactcttcatcaaagcgtttgttgattttatccagtcgatccgtaatcactttcttcgtgactttatcaaggctcaactcttcacgcgacggcatgaagtccagcgatcccagagggaaatccagaatatatgcgtaattgctgttacggtagcagtagaacagcgagttttcaaacatatccaggtcgattggatagcaaatgttacccatacgcgcgtatacgcctgaatagtttttagactgataacggatgatcccgcgatcgtctgcttcttttggttgccagttaacatcaatctgaacaccaataaagcgcggacggatacctgtaaacggttcataaacacgcgccgcttctctttcccattctgcgatatcttcaactttcacaggaacggtgatttgaacgccgttaggttcgtctgtttcgatttcgtagatttggtcaacgaaaggttcaccattatccatgtaagccgtgtatgcgcgtttaacgccgtcctggatggattcgatagtgaatgtttcggtgtaacagaacggggatttactacccagtcccagcgccccgatcagttcgtcggtgtcggttttggtggattcgaaataggttgcaaacacctctttaaccatccagtcacttaaccctgtgccgtaatcacggacgatgaaacgcggatcgagaacagttggtaactgaacatcgaacgggttcatgttacccgctaccatatgaccatcaatggcgttactggagatttcgcgaatgattgcgcggatcttgtatttgtagatggttgatgacatgattttgtatgttttcgcactggtagccattttaaacttcgtgcgttcgcctttatcgaagcccgtagtgtgaatggtttgtggtgctaactgacgcaatttcattgtttatatctcacttggtgttgaagatgatgttatcacatgaatatttcataggcttttgatcaagcccatactcaacaggtgtacacatccggtcaaggtattcgtaaacctgttgcttctgacgttcgcggtctttcatatccatgataccgaccacgatagcagttacaaaacatattgcaatagtacacagcacagctattgtaatatattttcccgtttttggtgcatcatatggtttcattgaatcgcctctgcatattgttctggtgtcaatttacgcgctactaagcgccctttggttgctcgtttgtttcttgaaatgtagatgtttgcaatgttgcgtttaccttcctggatctcattgtacatcttttcggtcatattgcactgataaacttcaccgttcggagttttcaggaaaaacgcgtatatgtctttttcgctttcctgaattactgatttctcacggatacggcttttgcatggtgtaggctgtgcgcccaactcgatagctttacgctgccatacgatcccgtgtccagccccttcggtcagagcatgtgcaatttcgtgcatgagagtatctaaaacgttctcgtagatatcttccttaacgtgagaacggcttaattcaattgacttgcgactgtaattgcattgtcccagagtacgcttgaaacgtccgttaattttgaaagaccaatgagataagccatgcttcgccatgatgcttttggcccagatggttatttccatatcgctacgagttttgaacattttatatcctccccaatcagtgaggacactatagcaaaaaagcctcccgcgatgcaagaggctttttgtaaattatttcaatttcttcgaaagttctttcaaatcattgagatattcagttttcggggttgtttcttcccagtatttcagttgcttacgcagttcgttcgcttcgtcttccagcttttgacgttcatccgtggttagatgatagatgttcatcgcaaccaggatttcggcgtggttctcgcaacccgtccacgtagagacaagtttaaccgcttcgctgcgactaagccccttcaacgcgtcaggttgtgcgatcatctggtcaatgaagtcaaccttcgccagcgccttatctaacgcttctttagtctcctggatgcgtttatcaatacgctgttggtaaacaccaatacggatatcaacgaagtctttcagcaacgtttcaggacgctcgtatgaatgcagtttcccgttaaagataacgttgatgttcgggtttgagttctcaatcaatccgaaatctttcaggatcttctcacgggtaagcccgtttgcgtactcacgtttaagggtgatttcgtagcggaaatcttcttttgatagatccttgtagcttacgatataccctttctcttccagcttatccaggatagagatatatttcacgcgatcgtacttgaccggaatctctgtgatcaccagtttggttttaccctggagttcatacttgccgtaaatagtaccgttttcaatgtcacctttgaaatgcgggtatttcagatccagtgtgaaatctttcccgttcaggtaactaacacatccattcagaaccgaaatcggatcgtgtggtggaatgttggtagcgtatgctttcgcgatcccgctgaacccgttaaccagtaccatcggaatgattggcaggtaataggctggcggtacgtgttcaggatcttcatgtgggattgttaaatcctcgtccatatagatagccttgaacagcggagacagcttacatttaatgtaacgcggtgcgccaggtttcttaaccagacgggaaccaaagaacccgtcgcggtcaaaaagcgggatgttattgcaccagtgcgccgccataagagacaatgcctcttcaacggatgtttccccgtggtgataaccatacattgcaacaccgccagcgatagaggctactttctggaagcctgtaccgcctttcgctgcggaatgcacgaagaaacggtgaacgggtttgaacccgtctaccaggtgcgggatcgcacgagaataaattgtgtaaagagcaaatgtaagcccctccacctgtacaacgtctttaatacttctttccatcatttcaccgaaaatttatgttttccgttcacccagtctttacgcggatcggattcatcaccgaaacacagttccagaacgtctttgtattcgtcgcccagtacgattgtatcgtattttaactggtcgcccaacacccgatcgtaatcttctttacgtaaagaacccagccctttgatatatcgtacctctttcgccttatcgcggaacggtgcgaaatcttcaagggagtagaaccatttttcatctttaccgactttcgcaatgataatcggtgtgcggatataacggatctttttcttctcgaacaactcaggccagcggctaaagaacgcaatcagtagggtgagaatatcgcccccgtcaacgtccgcatcgaccatgatcccgatgttgtcgtaagtcatttcggaagagtcgcctggatggagattcaggatcgccatgagttcagacaattctttgtttttgagcacttctaagttactcattccccaggtgttcaacggtttgccacgtagcggaaatgcgccttgtgtctcttcgtttctgcactcgataaactgccccacagcggaatcaccctcggtcagaaacaaagtggtttctaccccgtcagtgtcgatccctgatgccggaacatgttttgcaaccttcgcctttttcgctttcttcttcgctttggtaatggctgcggcttctgctgcctgtttgcgaatcagagcggactcaatgatcggagtgattatttcagaagtatccataatctgtttcgcgatctttttgtagttcagtccggcgtggttgttgaactccccagcggtgttagtcagtttttctttcgtctgactatcaaaagctggtgcattgaagttatgcaaaaacacaaccaaagtcaagcattcttttacacgggctttcgggatctcgatagcgtgtgttttcttgatcatcggttcgagttcggaatagataccgtcgatcatggtgtcaacatgaacaccgccgtttttcgtatccagaccgttaacgaaggatttctgtttgaaaccgtcttctgtgctcgccaagatgaaactgattttgttgtttgtctgggtaatcgttttatcgccgtacatcgcgccatacatcgcgaatttgttcgggaggatatcgccgttatatgtgaatttaacggcagggaaagccactgcaagcgccataaggcgatctttgatgacttcctttgtctcttcgtcgataccgtccacaccgaagatagagaagtcaggggtaaacttaacggttgtcccttgctccttcgtcgggctggtgcggtaatccatgttctgcgccccgtccgtacagttgatcgtgactttgtgtttaccgttggatgtttcgccgataaagatcgcgctgtaacagtttgtcaggaaagaacctacaccgttcatccccattgttacgcggttttcgtcatcgaagttagaaccggatttagccattgtccaggctgcaacaggtttaggaacaatcttcccttccggcgttctcacgtcatcttgtggaataccgcgcccgttgtccgaaatcgttaccagattgtgatcaatcttcacttcgattttgttcgcatatttgaaatcagttcggatcgcttcgtcgatggagttatccaggatttcgttgatgattttcaccaacccttccacgtattccactttgcggaattgccccatgataaaacgttcatgggcttctttgttcactgaacccacgtacatattcggacgtttgcgaatgtgatcgcgatcgctcaagcagaatgattcatccaccttagcgccctttgctggggcttctggtgctttctgcggctcgttatcgtccattaagaaatctaaactcatattcacctcgttattagttctcaggcattatatagggttctatgaaaaagaaaacccctttcggggttttacttgttgtacgggaatccgtctttcaccatctgcggcttatcaaccgttcgtttcgcctcgcccccgcaatcacaatctttcggttcgtcgcggcttgcgatgctggacattttcggaaattctttttcgcacttggtgcatttataggtatatgttggcattaataaatctctgacaatggaataaaacggatcggggttgcggctttgctgaaaacacattgcttgttccctgcaaacatgagatcagtttcgtacaccatacaaatatatccctgattctccaaaatttgccgctcccagctatcgaaccatttagacaacttctgcaatgaagagaagccgaaaatatagctacgataatttttaccatgttttttgaggttacgcattaaacgaaggtcttcgcatggtgcggggtgacgagtctcggagataccgaagtttaaaccgaactcgattccatgaatatcgagatactcatagagatcgtcttcatcaccgacacaacccgtatacggccctaactgtttgcaccaaccatcatatgacgaaaagatagacgctttcaattcaacgcgataaaccaacatgatccgatcctcgtaattgattaactacaagtatcgtaccacttatctaatttcttatcaagcagtttgttgatcacctgtgcgatttctgttgttccgtgggttgtgctcaatttcaggtaaatcacatccagtgcgcacacgatcgcatcaacgctttcttcgacgatatcaccgccgcgttgaggctgaacgagacattcggagatctccccaacctctgcggacaggtggtgaaccacgtcgctaacggttcgttttttgacgctatgagcggtcttgaaaaacttatccagaactacagcggaattttcgcgcgttacttcctcacctttattgacgtggatcgtaatttcagtttctggttctggtgcaacccataccggattgaaaagccctttcatatcgttgaacttgataggaacgggaataccttcaagataaagaatccctgtttcttcatacaccatactgatccggcgtggtgaattgaagtccatcgggttcttacgcaacgcatcatacatacgacgaatcgggtcggcttcggatgccatttgacacacagccattaacatagatttcggggcgtacatatcaccaattttatacttgctcatttacaatacctttatgataaccaacaataaaacagttcacttctggacgttcgccgggaaaatgcacacattgcatgacgcgttcagccatgagttcttcgcccaaataaacagaggttgtttcttcgttgtaatggcaatcatacgaagttttaacactcataccaggcaatccggcaatatgcataaactttgagttcgtgcatggttttccctcgatgctttttccgtttacatcaaacgtcatatgcatttcggttttgctgttctttgggcgtctgctcatttattcacaacctcattatatgttttcaggttccattcatgcacttccggcactttggagtaatgatccaggaatactaactggacttgcataacactagcacgatccatattgaaaaggaagcgttgcggggaagtaatacacagaaaatcttcggtacttcctctgcttgcgctaaactcttttgtttctccgccgtcaaatttagcatatacaggcgtagaaaaatacggggcgaatagttcgcgtttggaatcgtccgtaatcgcactgaaacacacgtctacgagctttccggttccttcccgtctgatggtgagcattgtccctttcgtgcgccctaagacgtttacagagcgcgtagtgacatcaccaaaagcgtttgtgtaactcacagtctccacaaagcccatatcacgacgctgttgtagcattgcttcgtgttgtgcttctgcatcctgttctactactcgttgtgcggcttcatacgccgctttgttcggatctcttgattgccatgcgaagaataaaacccctgcggctatcagtccgaagattgaccaacttgcggtcgctgatagtttcattttaatattccaaaggggccgaagccccgattttagcgaagatagcgaacgtacccgctacggtcgatcgcgttctctgggttgttgaagatattaccgcgaatacccttagcaggtgctttccatcctgcggctttcaggatattgccgtcattgtcgatgaagccagcaactgaacgctgattgaacatttcaccagtttctttgttgcgggtatcctgcacgatacggtgatacttacggcctttttccagaacgaacacagtttcggtgtaatcgctgaaccacatgccagtgttacggcctttatgcatcgcgtccagtaaaggctgtgctgcggctttcagttcgtcaaaagtatacatggtaaaatctcctaagtgtgtttcgtttctatgggataactatatcaaagctatcccatgaagtctttagcaaaaagtgctatttgttaaacccgtttcccttgataccatttcgggaaaacaacccgctcgataaaagttcttcccaggttgaaactatcaccgaacaggagaacaccgaacagcggatcgcgtttgatgtcatttttcccaacagttttcattttcccttcatggatcacggtgtcgcccaccgtgatatccttgatgcttacttttacatgatgcatacgatcacctctgcgagtttagcaggttttgcttctggtctaactttcaacgcatcattcagattcttttcaaccataactactgcgtcgttttcgttgaaaccgttcttaaccaggactttaactactttggcttctaagtttttcatgatgcgttccttttgtctgtttcgtttcgatgtgtgtaatatactgcatatcgaaattcaggtcaatacccaaatcaaagaaaatcgtatttttcttttaatttttcgtaatacgtatcccatgcggcttcgtcgttgatgatctcagtaccgaaccgataagcacgtttgcgcagttcgaaacgttcacgaatgcgctcaacattgattttcactgattccggcgttggttgccaatctgcgcacaaatgacgatgaaacagggagtttgacagcggactaagatcgaaatcttcgtatgtaccgtccatgtattctttaccattacgcgcgaggtattcagcacgtaatgcagcatgacgatcgcgaaggtatcccagcttattgtaaaagaaggttacgtgtccggttcccagcgtatacacagcagggatttttgacaggttgatttttgccttaccggataaaacggcattgggaatgcgagggagttcgcgcagttctgcaatcaggtgttcgttcagaagaagagaaggatcgattgtgttaatacgtgtcatagttgcctccgtttggtatgtgcgcaatatacaaaaaagccccttgcattgcaagaggctattaaaattattttgaaagaggtataagcatctttcgcataccgccgttttgtgtggcatcatacacgcgtttagcatccataagggagagttcaacatggtatgatttccctttcccgtcaaaatcaaacgttaccgtaccgcttgctacgcttacatgagtaaagatgaactcacccgcgaaatgctttcgaaacgctttgtcgtgatccaggaaccattcaaacgcttccccgtgctggtacagtctgacgataatcattgaaactatgatgaaaatcagaactgctgcgacgatcgtaagctctttcatcacttacccctgtttacagattgacggtgtaacgcacggttaacgcgtggcgcttgataaggtttcattttgtacggtgttggatcagagtattcgatccggttaggtaatgaatacatttcaacatttggctgaatccagcggattgagtcgattaacccttgagttaacgcacgaccgaaacctacaccaactaaacataaacgcataatatccccttactgtgccagaatgtgaagccattcacccaaccacacgatcgcctgataagacaaccacaccgcgccggacacacaagcaatcacaccaatgatcgcgaatccgattaaaatgttcaaaccttctttcaaatcaccaaacatgttttatcctcttttgtttcagtccctacaaaataacaaagcccctgcacgaatgcaagggctttttatcataattcgactaactgaggcaatttcagaaccatccctggaaggatatagcttgcattgctaacggttttgcggttcaacttagcgatagactgccagcgctcaccacaaccgtataatttttcagcgattgaatacatgctatctccaggctgaacaacatattcatcgtattcgactttaacgaacgcggggttcatgagaatgtcaaacatctgcgctttcgcttcgttcagtgtttttgcatgtacagttttacctacaaatgataatttaatcatcttttcctcggcagactcaatggatcggtttcttcttcacttgggggttcttccagccccagcgcatatctcaatgaatagactatcatcaaaacatctttcgcgcaatcgtgaattgaattatgcatcacaaaaccatcaagcaaccctttccgaagaggacaggtcgaagcatcacgcgttaacaggcggttttcgatacatgtacgcacatcgcgactattccagaacacggtcggcatatcttcgaagatgtcgatcttgccaaccatcttacgcacgatatcaaccaggataccgcgatcgaattcagggccacgaacataatcgagtgattgccaacggctcacaccgtccgcttttaggtcttcaaagaattgtcgatgtcctgcatagagttccagatcttccggcgacggtttcaggatttgacgggcttcttcgctttgctgtttccaccaggcaattgttccctgatcagcaatacgatcaggctggttacgcaaatcaaatttgtactttcgtccccgtgcaaccagttccgcgaacgttggcgggttgtgtggatcatcaacaaacggaacgtatgagagttcgatcaccttcccgttcggggaagggccaaccgtttcataatcccatacgtaatctacgggtaaatgactcatgccgtcctctgcttgatatattccataaaacaagccagcgccagcgcaacttctgggttgatgtcgatggtttcaaactctttgctttgcaaagtcatcataccgaactgacgcagaccggaattgtagatcgccttttccagacgggtagcatgatctacagcatcgaaaaattcatacagaatatcataatcaatgtgtaaagggatctcgattctgggtatcttcgaaatcaggtcagcaattgcttccgcgtggaggcgagggatctggatagatatatcttttttcatgatattagtgtccatatgtctttatcttcacgaatgtttcgtgccattcgaaggatcagcacgataacgccatattcatcataagtcagttcaatttcttttgcaataggagaccatgaataacttggcccgttcggagaatacagaacatcgttagatttttcaatgaagcgcaaacggtgaataacttcttgcggatctgctgcgctatacatcccgaacatattgaacgcatgtgggtctttttctcgaattttatcgagtgcttccagaattcggggaatgtcttttacaaggataatcaatttcataataacctcaaaaggggcaaagccccttatacataatcaacggtgtaacgtgcgcgggttactcccacatagattaactgcttacacagatcgtaatctgcgaacgcatacgcatcgcgcgtgtacatgtacgcatggtcatacgtgctcccctgcgatttgtggtacgtacaaaccggaagaggcttaacatcctggaacttgtttttaatcgcccagaacgaatgccacggggctttatagcctgtttgctgcttgatgcgcttataagtgctcgcaacgtaggccagatagttgcccagacggtctttcatcaccggatcaacaacaacttgaatctgtgcttcggtttcctcttcgagcgataccgttttcaggagatagaattcaagttcgatcttctcgtcgcacttctccgccttgataacttcccgacgcgggatgatttctaagactcggattttttcgttgttattatacacaatctcggtaaagatctgcccgttcaaccgcatttcctgaactaacggttcctgcatcacgatcacttcatcgagaatgaaaggttctgttgttttgtacaggtgtttacggatcgttgcgttcagcttgtccacgttgtcgttagtgtaagcgaacatgcggttctcgatcaagtcatccggcgttttgacacggcggaaatactgacggaggaagtcaacagcgttagcatgttggaacacacccagatcaccgacagacatcggtttcagcatcttaccatcacgtacagcccgtgaaacctgaataatcgggttcccttctgcctgacgcatgattttatccatacggatgacatcaaagatttcttcatcaaagaacggggagagttcaacgcgtccatcggcgtttaccggacggatctgatctttatcacccagtcccaaaataacagcgttgcttggaatactgcgccggatgattcggaacagatccatatcaaccattgagacttcttcaacaacgaacacgcgacaggtagacagatcaggcgctttctttcctttctgctgttcgaacacacgcagttcttcgttagtcacagggctaatcttcaatgcagaatgaatcgttgttgcgtccattccggtagccgctgctaacacgtttttagcctggtgtgttggggcagttaaccaaataccgctaatccccaaccctttcagagtgttaaagacaaacttaaccagtgttgttttaccaacaccagggccacccgtaatagttgtatgaatggcgttctggatgttgtggatcacgcgatcatgcgcggacttctgatcgtcgctcagatcatcaaatgttaactcgctcataatttgagtaataccccttgaattttcgaattctcaataaaccaacgcatctcttttttctgttcttcggttgctggtagttgctcggttttgcggaagaaactgaaacgcggttcgtccggcgtgtagttcagtttggtttcgtagcacttgcggataaaatctaatttatcttttgcaagttgcggtgatgcaaacagttccggcgttttcccgttttcaacgtgtggaatagtaaagccgtctttgtctttcgtaacaatgatatagtatttgtcaatcattttcgcccctcatagatgacgtagaaaaaacctataacccatagcaatgataatactatcaaagcggcttttctgtcaacaccgttaacgtggaaaacgcaccatccaaagagatacgttatcaccgcgcaaacgatataagacaaagcaaatacggcatgtagcgcggtgagttccattagtagttgttagcccaacgacgcaggttttccgcctgtttcagagcatacagcttgtagatggtttccgcatccagtcccagcgcgaggaacttacacatgaagaagtgccactggtcaatcagttcaaacatgatttccagcttgtcttcttctttcatttctgcgaatacctggctacgcagttcctggtgatttgctttccacggtttccagacaccggaagccgcttttgcaccgcgagacataccgcccagagcggtgtaaagttcgcgggtttcgtctgcgatcgcatcatcttgcagtttcagccagtccaggatctcaccgcacgttttcagttcgttcggacgtggaacccaattcagggtatcagacaggctttgttgtgcatggttttgcaagtccagcatcttttgcagcgggtcaattccgttctgcaatgcattgcggtagaaaccttctaccatttccagatcatcggctttaaccaggtgcgcacagctattaaacacaggagttttatcagtcatatcaatctcattttttcggtgatttgttccacgacttaaaccgaagttttgccgtgagtccagaaacagtattatctttcaaatactgcatgatttcaagtttagttgcgccgtccgtttttatcatttcgttgatatcttttgacggccacgggcatttgtcccacaacacaaccttttcgccagcctcaattaattttaaaaggcggtgagtagtatcagggtgtctcgcttcattgtcaagaacccagacacgcatatttttatacggaacgtcagacagcgccatttgtccgcccgtaatcgcaccagcattatctacaaacaggctatccagcggcccttcaagcaggtagacaggtttcaacggatcgatggtatcttgaccataaactttcgttgagtgttcacacgctttgattgtcatgtattttgcgttggcattgtcacgtaaggcacgtccctggaatgactcgattttacccttttcatcaaagatagggatcaccaaacgcggttcatccttcggtaaagggtatgcgtccgcattcacagagttaaccaggtgttgccattgacgcgtaaaccagaggcggtcatatttgtctttaggtatgtgacgacctgcaacatacttaacgataggg

SEQ ID NO: 36 - DNA, 177756 bp, Unknown
  source: /note="Description of Unknown: M16-9a Bacteriophage Sequence"
ccttcgcatttagggcatacgtgcggatacttcgctttcagttctttggagatctgacgcaaagttttctcgccgccgaacacagcacacaattgctgtaaatcagggattcgaagatcggcgggagtaatcacactaaatttcttcatcatatatttctcacttaaagaattttttaatgaaagagaggaacaatccaccactgaacatgatccagtatcccgcgccgtcaccgttaaacaggacatacacagcgacaccatagcaaaagatttccgcgatattcagtaagtttctcataactccctcctttgtctacaccaggtattttaccagaaagtagattactgtcaacaacaaagttttatcaacccacttatcaccagtcattagtaatcccctacaggttgagaagatgcaacgctcaggatacggaaagagcattcattccatttgcaataagttttcgcacagtgaacagtgcctttcattacaaacccgtttgagaataccagccagtaaagtttcatgattgcctcctttgtttcgacacccctaatataacaaaagcccctgcacgaatgcaagggcttttttcaaatatttttcaacatgtgtagttgaggcggacaatcttttgaagcaatcaggcgatccaggcgtgacataacgcgtctgtagccgtcatactcgaacttgattttgggtgcgatgtaatttacatgtatcgcgtttcgcgtgttcaggctcaatgtatactcagggataacggttcggaatcgtaaagcaatcactggcttttcgtgagcaaccgaatcatccatgttttcgaacatctggacggtgaacgcacaggcaaacactttgccattaatccggcgatatgcaatgacttcctgcataccttcgtttttcgctttcaccgcgtaatacagaacgttacacgaataatgtttagcgagactattaagaatttcactgtagatctcaaagtcttttttgactgacgcggaacgatccaggaatcggtctgcgatgtgatctgtagtcattgaaacctttgtcacataccaatcacttaacgctttactgaaattttggttaacttctctgcgtaagttattgataacatacatcaatcgtgctctgttcataaatcacccattatgtttaaagtattcgatttgacgcagacgtttttccgctgcctctttcgaatcatattcaccaagttctttcgtgcgatcgtggttcagtacaacccacttatcgccgcgatgttcgatgtgctccgtgatgtcttcgactttcttatccagatccagcggttcagcatcttcctggatgatagtcaaatctacgggcaatgtcaacagtcttttaactccgctgatatcttcgatgcgggaatcatacgcgagggttacatgtggtttgtaatcgtcataatcgtatgttgctccagcatccattgcatctttgaagcggctatggagataatcagactccagaacgcccacgatcgtattaccgtatttcgtttcccacttctccacgtcaaccagtcgggcaggttcagagataccggatgcagggaacagatcaaccgtcttacggctatacacaatcgttgtatgcagctttgcagcggaaacaggattctctacacccagaagtttttgcaccttcgcgagcgcttcacaggaagcctgatcgaacttcgcacacatatagatccccgaatcaactacgggtttcgctacttcaagaaaacttttcatgtgtactccaaatgaaaaaggggctttcgcccccagtggttaaacgcctaagcgttaattatgcttttgatgcatcaatcgcttcattatcaccagcgatttctactgttgctggcagaagtgctttgatcgcgccgatcagggcatcaggggatacaccctgcgaaccgtcgatttccagaagaccgcaaatctggcctacgagttgacggtgatttgccagttcttgttctttaccctgaatgatttcgttcaggtcgaatacacgggctttcaggatcaggacatcgttttgaagctgttgggtttggttttgttcagtcattgtttacactcttaaaagattgaatacattaagcacgttacgtttcaaatcgtctaacgtaccattatttaggattgtataatcagtcaagccaggtgtcaaacctttctccgttgaatgattatcttcaataccagtttcacgttcaaggaacacaaagcgagtcccgaacttgctcaggtatttatattcgtgcggttgacgcacatcggtaatgataaagtgatccgcgtaggatttcaacattttttgaatagcaattgaagtccatatagacggatctattttacaaacaatatcagtcccgaacacctgcatcaaacggcgaatcgtccagggctggctgttttcttcgcaaattttatgagcgataacatctgcgttactcatgaagaacccgcgagaacttaattttttgataccgctagaaaacagcgcgtatgcatcgttattggacatcaccagcggggcttcacgatcaccctcatagaatgggttcttcgctgccagcgctcgcaattgcgtgttatcgtgatgttccatagaacgtttcaggatagctttgatttcgtcggctaacgcgataacttcaacattacggaagttatgcacaaccatttgagcaacggtatctttacccgttcgctttttaccacaaataccataaatcatttttgcgttttccgtggagtaggcacgatcacccgtccgtcgatctcaatttccatgtgagcgaagttgaacatcgtcatacaggatacggcttcatccgaatcattggtatacataagctcaagctctccgaggttggagggccaagcgccatagaagcgaaatgtcgctacagtttttgactgcgagttatccaggatatgcaaagccattgcctgttgtggttcactccaacgcacggaatcgaaggtgttaaaatcgacagtaccgagcatccaaaggtaaaccccaagatacgatcgcagttcttcatcaacagcaaaacgaatagtcagtggatcgaactccattgcagatcctgggatcttccctcgaatcattgggttcagtgggacatccgtaattggaatgttgatagcaggtagtgtaacaccctgaacttgtagtttcaacccttttacataatcattgtcaggaatatctaacatgaagttagtaggtgaaatctggttcaggatcatagcagttgtattcatgatgatctccattttatagatatttagatcaagaccgtgagcgaagcgaacacacgaacgaagtgagtgttatgtacgatgtactgtttataatatttatattttatatatagagaaaacagtacattttcgtatactttttatacaatcgttaactatccgtcttcgcttcgcttgacggaactcgcttcgctcgcgatctaatttttagttgatctattcaataaataggtatatcatacctatactttcaaaagagattgaaaacatgaaatcattcaaagaactactttctgaatctgttcagaacaaaaaatttgctaagaccgttgatctggttgaccgtggtaacgctgcaaaaggtcagattggtttcctgcattttgcacatggtgctgattacgatgtgtatgcgccggactcccacgatctcgcttacttcggtaaaggtgttgtccgcctgaaaggtaaaaccactggcaaaactcaggcagcgtatattgactgggcgaaaggcactgtttcattctacagcggtgatcctgctgatgacctgaaatttgacaagccactgaaattcaaaggcgcttccctgtacaaagaggccgaagaaaaccttgatctgtataatcagttggcggaagatttcgaaattgatctgcctctggatgaagcattggtgaaaggaaaggtgtacaagctcccaagtaacgatatgtgcttgctgtataccggacgtaccaaaaccaaagaaacaggtgaatacgccgtgtttacggttgtagatgcctctggtaagcctcgtctggtatcgggtaaacgctttacccaagaatacaaaggcgatgttctgtctaaactggttctcgctgaatcggaagatctgaacgaagccgctaaagatattcgcgaaaaagttattgcggtgttggtgaaacgtgggtttaacgaaaaagacgcagaaaagatggttgataaaaacctgaaagatgcgatgaaggttcgacctggcgcaacccctggaaaactcgcggaaatcgtgagtaccctgtaaaaataaagccccttcctttcggttggggctttttgttaatatctgttccaaactttcttcgcgctgtatggttttcctttggactggaaagcctgtgtaggcaaccaaactgctttcgcccaatcttttggtgcgatctctgcaagtggtgaacgtagatgggctggcaggtaggctttgatcatttgatcagccccgcgcattcccttcacgttgttccagttgattttcagtctggttttgttagaaagtcgatctgttgatccgtagccacgtttcaggagttcttctaaaaactcttgacgtgctcgcggtggcgcatagtgcaagttcagcccgtacagaaccaagttacccgctttcgaacgtcctgaacccaggaaaatgatcagcgggaaccgatcccagtatggcagggtgtctttgtatttcgcatcgtagatgaacgtatacaagcgacccgttgctggtttcgcaaccctgtgcgtcttaatgctggttttgatgaaatcaccaaaccaatcggtcgaatctttctgacgtttcgcagcggttacaccaacagtcattttcttcaaactgttgcggaaatcgtttacgatatcaaccgcgtgttttttgcgatagtcattacgtttgcgtcgggcttcggtttctgctttacggcgttcgatttcatcatcaatctgctgcttatagcggtgcatagactttgtgaacgttgcgtatgcaatcccgttttcgtccgcgaactttttggctgtcatgccttttaattttgcgcgtcggaatttgataccaagttcaacccattcacccagctttcgcttcggtggcggttttggcttgtcttcttctgcgatgatctcgaactcaaaaataaaactcataattccctccgtttagggtatttattgccctttccatccgaacacacgtttcaatgtgtcctctgtgatgatcttgaactcccagcccttttgttttgctgctgcattcgcggctttccatttgtcgatgtttaccgcataagtatacagcgcatcaacaaatttctttttgttgtgaacgttgttgttcgctggcttaggtgggggcaacgtttctttcatcggtttgacttcccaaaggtaggtcacaccgttatccatttcaacatagaaatccatgaagtagcgccgtcgctttccgtctgcgttgctgaaataagggatcacaacctcttcactgttccagcgtttcacatgcgggtttttatcaagccagttcataatatatttttcccagcttgaacgatacgttatctttcgcggatctcccttatatttctgtatgttctggggcataaaagaccccttgtatgtctgtcttccagccattttagatcctaaatatagtaaacattagataggggaaattacaatgttattttcgttctttccaccagttgattacaaaggcacaccaactactgatatctaccgcgattatcgtttttactttaaccgcgtgatcaggaattataagccgcgtacatatcaactgacaggttcattaagacccgaacaattagcggaaacgctatacggaaaccagcaatactactgggttatcctgatgcttaacgataattacgatccgttttacggatggattaccgatcaggaaacggcttatcaatgcgctatccagcgttattcaaaagcaggtggtgaacaggttctttatcatatggatggtaagggcaaccgttattacaatttggttgaagaccctacgaatcccggtcattggtatgacaaaggcgataagaacatgcgttatttgcagtaccagggaacattagtccctgtagatatttatgaagatgcggtgcttcaaaatgaagcaaaacgaaccatcaagattattaacccctctgatattcaatcgtttgtaagcgattatatcaaggaaatggaaaaggcaaacctatgaaatacggtggaaataaatactcccctttctttgagggggtggtcgaagaagtcgatgatcctcgtctactggggcgtgttcaggtgcgtgtattcggtgagcatccggcacagaaacaaaaatctgaaactatcggtattccagttgaggaattaccgtggatgatgcctattcaggatattcgcagcgccgctatttctggtgttggtttttccccgactggtatcacgcgcggtagttttgttatcggttactggcgcgataaatggcaccaggacggcgttatactgggaacctttgcgggtgagtaccgagagaagccggacacccagaaaggcttctgtgacccgtttggtgagtatcctcgttatgtaggtaatgatgtcaacgtactggctcgcggtggcgcagaggggcgcggttcttcgagcgtgattattcgtgatgctaacagttcgttagctgtcaatccagatgatcgcccacttgacgagatcccagaagataaccgtcctgatactggcgggttcactatcgaaaccatgcttaaacaggatgaaggtatccgcacaaaatggtatattgatagtgaaggttatccgactatcgggatcgggcatttgcttatcatggaaaaaacccgtgatactgcgaagattaacgccgcgatcagtaaagcagttggtcgagaagtaaccaatggaacgatcacagcagaagaagtttcaacgctgtttgctcaggatttggcaaaagtccggcaggggatcagcaacacttcaaacgttcgagaagtatacgtgacgttaaaccgtcctcgtcaaatggcaatcgaaaacatgtgcttccagatgggtgttggtggtgttgccaaatttactaatgctctggctgctatgaagcgtcaggactggcaaaccgcttacaacgaactgcgaaactcaacatgggctaaccagacaccaggacgttcttcacgcgtatctaaaatcgtgctgacgggcaacctcgaatcatacggtgttcaggttccagatccagaagggcgttcattgagtgctgcatacaatgctgttgtgttggctgcatcaaacccagaagatccttttgttcctggtgatactcgcgtaatgttcgaggaacctaaatccgcatacgctgctgaatatccatacaacatggtattcgaatcccgttctggacacattcaggaattcgacgatacaccgggctttgaacgttacaaccgtgttcacccagcaggatcatacgaagaaattcgccctgatggaacccgtgttgttaaaatcgttggtgatgattatcaaatcgtcatgcaaggccgtaaattaaacgttaagggtaatttacaggttgttatcgagggtgatgcgttcatttataatatgggtaacgttcaacagaccgttgatggtaacgtgaccgagttcgttcgcggtaatgtaaatcaaaccgttgaaggtgaatatttggggctgattaaaggcaacgcagaattaaccgttgaaaaagatgcaaccgtaaacgtgaatcagaatttaatggctaacgttaaacagaatgcaactgttgccgtaacagaagatgcaacaattaccgcaaaaaatgctctgattgatattgagcaagatttggatattggcgcacgtaatatcaacatgcgagcatcgaataatactttcattgattccggcgcactgactaagatcactggcggaacagtccaagttgggtaatgtatgaattataaacgcatctacaaagaaatcatcgagaacaggagaaataatcctgttagtggaatggttgaagtacatcatatcattcctaaatctatgggtggtgacgattcagagggcaacttgattgccctttcacccagggaacattttgttgcgcattatcttcttgcgaagattcacaacaacaaatctatgtggtgtgcgtactggtttatgtgcaatacccgtgacgtgaaaataacatcacgccagtatgatacagcccgtaaactttcgagcgaacatttgaaaggaaatactcatacgctggggcatactttatcgcaaagtcatcgcaagaaaataggcgatggtgttcgtggagaacgtaacggaaactacggtaaaactttttcggaagagcataagagaaagattgccgaaagtagaagagggaaaccacacgacgaagaatcccgtaagcgtatgattgaagccgctaaacataaagaaaaagttacctgcattcattgtaatcgtgttcttgacaaaggcaattacaagttatggcatggcgacaaatgcaaaatgaaggtaggctaaacatgatcatggattatgaaaccatcattgatgggattatgcaaaattttcagcatccttgcgatgctgagatccccgctggatattacagacgcgttatctggcagggacacacagaaaattaccctgctgttggggtagaatgggcgaccgaaatcatcccgatcggaactcacctgtatacgagttcccctttcggacagaaaagcgatccgcttccggtggtgaactctccaaacgtacccacgaatccagacggaaccccaggggtttctactgacattctggttacgaagattggttattatttcgccagtcaagcggatattgatgcctatatcgcatctatcggggctactaagctcgcgggtaatgactggtacggggcggatctatcaaaagcgaatctgttcaagaaccctggcgaactcgcgatgtacaaggtggaaaactccggtggttacttgctgacttccggcccccgttgcgatcagcgaatccgacaggtatacaaccagactacaggcgcgtttaccagcattgattactactggaatggtaatcgtattgcgtacatgaaacacgacgaatcccccgcacaccagtgcaaatatacagggatgtcagtaaacacgaacgcagataccagcattcctccggttcctcctgctctcccgtcaacgtatggggcgctaccgagtgaagccagattgttttctgctcgctctggattgggctgtattccggcgaccgtggggttcccgtatacgaatatcagcgatgctatgctttccgcgtggaacgagactcgtaaaacgttcaagctggctttcgatatgctgacgggtacaattaaaaatggctctggtatcgcgacgatgtttgacgggctttcaatcgggatggaagaaatcacagcgggtgctctggcattgtcacagcaagcatggcaaaccgcaatgaaggtgttccggcagatcattagctctgcgtttaacatcgtgggtggggcatggagtctgatcaataacttcctcccgactgttgcgatcctgggtgttgcaatcaacatttacgatctggtgtttggtgatagttcggttcaatccctgaaagattctttccaggctctgattgactccggcgcacagacgtatgaaagcgtcataaacgcaatctacggggctataggcagttcttacaactacaccgttgaatatgtcaaggctggcgctcgcgaccttgtagacgcttgtagcgcgttatttgactggtgtttgactatgttccaaaacggttgcgttgctctggtggatttgtacgggcgtatgatgcagatctggtcaatgcctcccgaaacaccaaacccgctttggtctgcggtgctggctatccgtaacatcatgcgacagattaaacctcttgatgtgattctgggcggtaacttcccagggtttacagcaatggatctgtatcagcaagcacaagcgaaagtgaaagcgttcattgatgcatcctatgcgcagatctccgcactgtatgatcaggggcaagaactattcaacaccctgaaagcacagacacaggaaagggattcgattaaacgcaagttcgatcagtacctaaactggatgtgggaacctgtaacggaagcaacaaccgctgcttatcaggctgcacttgatgccgctaacgctgctgtgaatgcgactaaggccgcatatgagggaatcaaagcacagattgctactttgcaagatggtatgaaagacacctacagtatggcaatggctgaactcaagaaactgcctgtaatggctcagattaaccatttcttaggttactgtggggttgcattcgatgacctgttaaaaacgtatgagaacgcgctgacgggcgcacaatcgctatataaaaactttgttgacagttcccgctcgtttaaggacacatgcaaggtgatttataaccagatttgtacgcttgctctaagtaaggtaactcaatacgtaaacaaattactgtcattaatcggactcgcgatcacattcggttcaattagtgtttgcgtccctatggttcaatactaaatacccgataacgaggggtaataatggctactacaaagaaacaaattaatcagatccccgatatctttgtcggggctacttttgacgaaatcaaatctgacttaatcaactggctccgaggtcaggacgaattcaaggattatgatttctccggctcgcgcatgaacgtacttgtggatctgttatcatactgtacactgtacattcagcaaatgagtaacaccgcactgttcgaatcgtttattcgtaccgctgcattgcgtagttctgttgttcaacaggctcaggatttgggctatatgccggactcccgcaccgctgcaaatacttcgatcctgatcactgcgaaaaacccactgaacccaacatcgatccgtattccacgcggtacgaaattcatcggtacagtgaaagaaacaaacagtttcccgttcgtcgtatccgatgacgtggtgatcgttcgtgacaaaaacaataactatgtttcgatgctgaacatcgttcaggggcgtttagtacgtaccgaagtcatctttgatggttcgactatcctgatccgcgatccaaacatcgaccgtagccaggttcgcgttaccgtcaacggcgcacaatgggatgactggacaaacgaaagtatcgtaaacgcaacgggtgcatcaacagttttctatatgcgtgaaactgttgatggacataccgaagtttactttggtgaaggtgaaaccagccaacaggtcgcgggtggtgctctgactgctgattacatcgggggcttgaaacctgcaaacggttcaaccgttgttattgaatatatttcaaccaacggcgaagaagcaaacggtgctgaaaactttgtttacgtggatacgttgacaaacattagcattacgagtattgttgagaacccgactaattcagcggactatgtaggcgctgatggtggtggtgaaccggaagatatcgaacgtattcgcgaactcgcgcctatcatgcgtgagacacaacgccgttgtgttactgcatcggattatgaatcgttcttgtctcaccgtttcggttctgttattcaggcggttcagtgctttactgataaagaaaaacctggctatgcgttcatcgcggttaaaccgaaatcagggttgcgcttgacatctgttcaaaaagaggacatgcaaaactatctggcgaagtataaccttgcgactattacgccgtcgatccttgacccgaactatctgtatatcgtacaaaacatcaaagtaacgtatgatatcagtaagttggttgaatcagaggaatggttgcgtggtcaagtaatcaatgaagttgacagatattatactgataacgttgaaattttcaacaaatcattcagtaagtccaaaatgttaacatatgttgataacgcggacgtgtcgatcattggttcttctgcgactattcagctattgcgtgaacttgataactattacagcgctccgatgtctggtattcacttcttaaaccaggtgaaatcacgttctgttgtttcgaacgggttcaaatacacaaacgctgctggtgattcgtatgatgtgcgttatgcatcaaccgatatgaacaccacaaccggacgtgcaaaaattgttatcggaccattcaaaaacggtgatatcagtatcgcagcctatacaggaaccgattttgataaatatcctggagtgaccgatcgtaataaatattacgaagtcggctatgtggaacactacactgatttcattagtttcgatctgggtgtcctgaacgttccatccgagcgattcagcgctgcttatatcgaactgactggtacaccattggaagagaacattttcacccgtgatggttctctgattgtgtttgaaaacgatctccgtcctcaatatacaacattgacaatgaatccaatcagtcaataattttaacccctgtcatccggcaggggttttttgtttgctaaatatgggatataagtaacgcaaatttggagaaacataatgattaaagcgccgtcaattaccagtttgcgcgttgataaactggctgctaacttcgtttatttgaagtgggatagcgtcggcatggatttttactatgtcgtggaaatggcagaaactcgcggggcaggtggtgttactattccagatgaagatttaacctggttccagttgggttacgcttttttgaatgaatggttttcttccgatgtccagccaaacaatttttataaattccgcgtcatggttacgcacaagggctttgaaccgtctgattgggtttatacagatgaattatggacgttcagccttaacgcctacgcatattcaacaatgcgtgaatttacgccaagtgatgcattcataaacgaaaaattcgcaaagaacaatcagaactacgttaacttcaatacagatgtggtaatggcagcgttgatgaaagaagactttgtgttttctccactttacactgacgtatcccagatcagcgataaaattcttacacaagaaaactatcacgaaatccaggatcatattgaacacgtttgtaatgacattaacagaactttcctggtagcgtcaaacggtttattgtacctgtttgaacgttttcagaacatggcgaaggtgtcaaacgacaaaggacaaacatggcattactacaaggcgtttaacgaccgcgtaggaaaccctgtatcgcgctctgttgcgtatcaaagccgaaacacaacctatgtactgggttacgatcgtatcttctacgggcgcacctcaacggatattcgctggtctgcggacgatgtgcgattctctgctgatgacgttacgtttgccaaactggggaaccagactggccttgatttcgacgtagactcatacaacacgtttgctaaactgcctggtaacgtgtcgaaatatgcagaagcaatggcatgttccgatgactggctttatgtggttgcgaaaaacgttgtgcgtcgtatcgctctgaaacagacaccgatcgacaccgatccgagttctcctacgttcggagaaaagattttcgatacagcaagctatacagttgtccctggaaataataagatcgttgtcaagaaaatggatgtgatgaacgggattctttatgcactcgttacgggtgaagtgaaaaccgctctgcaagatcctacaaaacccgctaacgtggttccgtccgctgctgctggtgtgtatcaatggaaagaagacacgaaaacctttgtgcgcctgtacgggaacaccgagaaagaacgtttttatatccagcatgaatacaccaatatgtcaacgaacggcacggagatttttatttccgtagcaaactacaaatatccaggcacacttcccgatcctgaattgttgatcgagaaccctgcactggtcggtgctgtaaaatatgatctgcgtcctggctatactgccagccttgcgattaactttgcgacgattcgcgctcatatcgacgacccgactgtttggaaatttggtgcgcaggaatactacaacgaggcgaattatagctggttcttccgcgactctgtgcgcacatggatcactaatgataaccgtcctctggtggtgtatccgaaaatcacctacagccttgtaaccgatagtgctggcccttcgtcatcgcttcgtgtgaacaaagaggtatgggatcgcggacatgttacgatttacattaacaacattaagtttaccggattcacgaagtatacgaacggcgtgttgctatataagagttcaggcgaaatcatcgggttctttgaactgagttaccgcgctcgcgataacttaacgattttctggaaaccagacaatacgttattgattgccgatctgattcagcaggaacgcgaaaaaccgtatcaaccggatctgtcacctggtttgattgacccagatttaagccatatgattacgcgctttgcgcctcaaagctatctggatcagcagtatttcgagaagttcggggaatactatttgcagttcgtttcgctgggtgaaaacacctactataacaagctgcttaacctgatcaggaacaaatatccgcgtgagaagaacagcgtagaatatctgtggtcggaagtaaaccgccgtaatatctacctggataaaacgaagcgtgatcaggtggttcgtttctttgaatctcgttgtagtgatttctactcaacgaaaggcatcgaagcaagctataaattcctgttcaaactgttgtataacgaagatgtaagtgtagaaatcgaaagttcgaacactctggaatatgatattctggttcattcaacaaatatcaaccaggatattgtaggccggacgatttacacaccaacagcgagagcaaacgtgacgtatatcgaacgccagtatgatgacggtcaattacgttggtcagtaacgctgcacaacgtgatcggtaacttccttgaagggcaggttgtcaagtctgaaaagactaacttcacgggtactattctgcgtggtgtgcgtggtaagcaaatggcgaacaactcgatcgactacttcaaccgtgggcgttcttactacgtgatgaaaattcgttcgaatctgccagcgtcccgttataaggatgacgttttacgattcgtgcatccggtaggctttggctttatcgggatcaccatgctaacggtgttcatcaactccggtttgtctatgacgcatagtgaaacgatcattgacattcttcgaaattatcgcttcgatagcggttatccgaagtattggcctgatcgcgtagcccgtctggacggtaacggaaaccagacatttgaccttgtaactggtgaagcattgtacggcccgcacccgaaagcgggacaaccgtttgatgttccgccacaatatgacattgatgaaaaaccgctgaatggtgtactgccgtccgcgcgtcgatttgatcaaagtcctctgttcgatagttcagcggttaaatactctcagttccgtaacttagtggaaaaacgattgaaagacgatgcgggtaatcctcgcgatccgaatccaccgactcagagaaaggtagcataatggctcaacaaaacatctaccgtgcggtcgtaactggtaagttccgcacggaaaacatgatgaactttcgcgaaatgatcggggacagccccgatcgtaactcgatttatatgtcaatcgggcgtaccgaacaatgggcggataacgaatccgaccctgaattcgctcccccttatccgaacgatgatacagatggtatcgttgatatgtggacgcatatgatcgggatgacgaaagtaccaggcgaaatgattgatgcaatcgttccgcgtaaagactggggcgatactcgatatccaaaccccaaaatcttttacattaatgacatcgtggttgtaaactccgcgccgtataaccgtactgactacggtaaaggatggatggtataccgcgttgtagacgttcctgatattggctcttgttcaatctccagtatcacgggtaaagttgaatgtgtgcgtattggtggcatttggacaccgacccacgaatcgatcgaacctccacgcggagaagcgaacggtatcgacatgggcgacggctatatctgggaatatctgtatacaattccaccagatgttgttatcaaccgctgtacaaatgaacatatcgttgttccgttccctgatgaacttgaagaagacccggttcgttggggttatgataacgtgatcaaatggtatcctgatatgtacgatttggtgtaccgaatgaaggttcactcaatgcgattccgcgcgtatatggattccctgttcttcccgcaagcctctttacctggcaaccgtgggttccgtcaaatcagcgttattgtaaacccgctgttgaaaaaggcgcaaccatccgacccagaagtaaaagcaacgaggcagtattacacgaaaggacagcttgaacttgactcaggacaaatgatctacatggaaaaccgtcaaccgattattcgttctcctgatcagaccgaagaagtcagtattattttcgaattctaaggaaaccataatggcatatcaaactggtaaaaaattaattgacgtggggcaaatcggcaacccgtcaactggtgacccgctgtatgacggcggtgttaaacttaacgaaatcatcaccaacgtatacaatgcgtttggtgatgtgcgtttactgactgcgaatgatggtgtgggtacaatgttactccacgcgaccggatatttccagaaattaccgcgaacctattattcaggaaacccgattgaactaggttcactgcatgatatggatacctctacagggccaattacggttgtgcttccatcgggtaaacctggcgaggggttctatttcataaatagtaacggtagtatttctgttgatcgtcctgttgtattccgtccgcaagttggtgatggtatcaaaggggttcaggatcaactttacgtgacctctccatatactcagattaaaatctggtgtgtgaagaaagaaggttccgttactacatgggattattctgttgaatcaatgtttggttcaaaaacaatgcctgtagatactactaaactcattctgaaagcatcaccgaccgcaattcctttatttggttatagtgaattcagtggggcgaaaattctcgtgtacgcggagaatatgacaggcacagtcaataaaatggctgaaattcttttgtctgttgaccgtgtcgctaagggcgtgtattcaactgaatacgcagttctcaaaaatagcgaagatgaaatgtacacgcttacgttcactgttggtgcgagtgatattgtttacgcaaacgtacaatccaaaaccgagaatcgcattaaattctcgattaaagcggttgacaccattaaatcagggatcgcagcatgaaacaagaaattcttatcggtaacgtggttgatgacggcgcgggtgattatctgcgtcgtggtggtcagaagactaacgccaactttaccgaattatataataaactgggtgacgggagtatcccgcacccagcgggtgcgtggaaaacgcacacagcgcctacgctgacccctattttcggtgaatcatgggcgctgaataccagcaacaaccgtattacggtaaacctccctaaaggcagtgtaagcgattataacaaggttattcgcttacgtgacgtatggggtaagtgggcggtaaacaacgtccgtatcgtccctgcaagcggtgataccatcaaaggctcaccgacttacaaagaactgtacaaagacctgatggacgttgaacttgtttattgttctcctggacgttgggaatatgttgaaaacaaacaggttgacaaaatcacaacttcggatctggcaaccgttgcgaaagaaacgtatatcgcgactcagggacaaactgacttcctgaacgtgttcggccctggtaactcgtacaacgtccgcgcactggaagtttactatcgcggtaacttgctgtacatcgacgacaagagcgggtttaattcatcaaacagcgattacggttcacctggtgcgagcgccggacaactggtagatctggatggtgtaaatatccgtcttaaaaacccgtgtaacgctggtgacacgcttcaattcgttacctatctggatggtattgctgcatggcgagcgacgtatgaagcgcataccatgcgcgtatataacacgggcgacacagaacaggttagtatccctggtgaaatctgggttggtgatttatcaactaaacgcacgtttactaatgctgaatttgggatcagtccccgaattttgattaacccaaactcgttcgaactactgttgaacggtcgccagcttgttaaagcaggtgatgcggatctcccgacatttgtttgtgagggcgcagaaggttatgatgaaagtagctgtattgcgaactccggcgcatgggttccttctggacaggattacagtctgatttttgttaactccgtggttacgggtattaaatttgctcaacctctggaatcccgtgatgtggtaactattcgctggttcaacaatgatatcggtactgtcatggaatgggacggtgtaggcggtattaaagaacacaccgataagatttacctgaacaacgaagaagaagtgacgctggttaatcagattgaatataccgattataacaacccaacgcagaaaacctcgcgtaaagtagcggatacatttagcggtcgtcttctggatctgcaagcgttctttgatgttattcacccaatcgggacaatctacgaaaacgcgcataatgatgctaacccaggtgattatatgggctttggtatctggacacgttacgcggaaggtatgttccttgcaggttggacaaccgatgcatcggatagcgattttggtctgaacaataacgatctggacggttccggtcaaccaactcacacttctggtggtactggtggcgaacgtggttatgaaattaaaccgatcaacgttccacaaattcagtcaaccgataaggtgttgattaaagatgacaacgggatcattattattggtggctgtcaggttgacccagatgcaacagggccaggttacactaaataccgcgaggatgtattaaaagtaaatcgggggaacactactccagataaactaaaaacgctcccgccttatattactgttcaccgctggataagggtagcataaatgactcagtttatttccaaaacaagggagggggcgaaagtcccttcccgcaaagcagactttttgcaatatgaaatgggtacgaaagaaccgctgattggcggtaaacgtactattggtggtgcaaacgtcgatcagcttcgaaaaggggtagattaccctaacgtacaatcagcaattgatgacctgtattctttgtctcaacagatccccatcaatggggtaatcatgatgacggaagatagccccccttctgcggtgcaacaggtagaatcaattacgtttgatgggacggtttcaaacccagatccagatcaaacacaggcgactattcacgtttatggtttcccgttcgttttcggcaatacaacgaacgcctctaccgtatgtgagacagtctataacaaattcgttgaattcgtcaacgatgaaaaatatttcgatttggttactcgtaaaggtctcaacggggaaattctggaagttcgttttattgattcagttccgcatccggttactaataaaactgaatatggaatttcgatggtaggaacaatcgacgtacaggctaaatctggttacggtacatggacaaagttaggtgaaattgaccttgctgttactccagcagttccgatttattatttcaagcgtattgcatgaggataacaaatgaacaatacaattaaccacgtaagcgataaatccgtttacgtgacatttgatcctgctggtacgcaatggcctagcacgtttaagaacgtacaacaggcattagccgctattgggccgtgggcgcgtactgatgttggattgcctaatgccgcgcctggtgtgcgcggtattgctgctattgcgacacaggcaatgattgacgcgggtactgacacacagacgattgtaactccggctttgctggcgtatcgtttgcaaaaccctcatgcatcacaaaccgtatggggttacactcgttacgcaactgatgtagaatcagtaacagtaacaaacgatctggtttctcttactccgcgctcgttgaactatgtgtttaacacccgtcaggcaaaagaaaacgtttggggttctgcgaaactgtcaacaactgctcaggcaacgtccggtactgatgacactaccgcaatgactccgcttaaagtgaaacaggcaatctctgctctggttccggtacagtcaaacgcaacagaaagttcgtttggtcttgttcagttagcaacagttgcagaagttcgcgcgggtactattcgcgatgggtttgcgatttcaccatacacgtttattcgtctgactgcaagcgaaagtgatttaggtttactccgtatcgctacccaggcagaagtaaacgcgggtactgataacaccaaagcgatcaccccgcaaaaactcgctgctgtgaagggttccggctctactttcggtatggttaaattaacaacagatatcaataccggattagcgaatactgctttgtctgctggtgctaacgtagtaccgagcaacaaaaacagtgcaattactggtggtgcattgtatcagggttcgattagtgctgacaataaataccagacaaagacagatgttgacgcaaatatcccgatcggatgtatgatgcttgcagcgtttaacgccgatgttggtaacttgtttatctgtaacgggcgagcgatgaaccgcaattcaaacccagaactgtttgcccgaattggttatacatacggcggttctggtgatattttcaacttgcctgatatgcgcggtcttgtagctcgcggctttgatggtgggcgtggtttggatgcaggtcgcggttttggtacatatcaggctgatatgtttgcgtatcacgaacatgatctccagatgatttaccagaacggcggtaatcttcctaagagtcaagcagtttatgaactgaaaggcgcagaaaagaatgaccaacgtgttatgcacctgaataacgattacagcaaagcattaggtactggcggaaacgaaacgcgaatgaaaaaccttgcggtcaactacgtaattcgagtacgataaaggggttaatccatgatttcaaaacttaacccgttaccaaagatcccgtttgttgatggtgtccctgcggacaccacacaaacccagatcaattggattgttaacggcgaaactctcgatggtgcaaaaaccaaaaccactaacgagggttctttaaacagatgcggtgttctggttcaaaagaacgcggtacaattagaagcaaatacaactacccagacatcaaaaatcaacgaagttatcgatcaggttaacctcattactgaaaacctcgcggcgatctctgatgatagtgtgatcgacaaactggataaagttgtcgctgatgttgacgtgctgaaagtagatatgtctgctgtacaggcaactacagcaagcaacaccttgaaagttcaggatatcgaaaaagaagttggtgtatgggatgcgtcaaccgatcctaaacatcgtaccattcgaaaggatattattttcctgaaaggtgaactgggtgcatatcctggcttcaacgaaaatggtgatgtcgatccgtcctctactggctccggcgtgaaatacaaggtaatggctaacgctcaggcggtatctatccatgaagcacgtattactaagctggaagatgactgggtaaactcagatgtaggccatttaaccgacgaagttaccgatctgcgtaacgaaatggggccgaagcatttagccactttcgaatctgtgtatgttcgtctgaatggtatcggtggcgatatcactggtattaataccgaactgtcaaacatcaacacttatatcgggcgtacaggctcaggtggttctggtagtatagattcccgcatggaaactgcggaaacgaacattactactctgcaaacccagatgaatgatccggttgttggtgttctgcctcgcgtaatccttctggaaagcgctgttggtaactcacaggttccaggtagtatccgttacgatatcagcacaatgaaacgtagcattagcgatctgaatatgatcgttggtgaaacaagtgatgatggtctgcgcggtgaaatggcacaggttatgaccgatatcggtactgactctcagccaacgagcatgaaaggccgtattctgaacctggaaaacacacagcgcgacgatcaccaggcactgattgatgttaccgcaattgtgggtaatacgtcaactggactcgttgcggctaatatcgcgatgggtaaagctgtttatggtgacgcaaccagttctgatccattcctcaaagatggtattcagaaaacggctcgcgataacaaaactgcgatcggcgttaatactacaggatcagaaacagggatttataaactgatttccgatctgactgcgcgtgttgctgctctcgaagctggcggtggtggtaacgttgaacaacgtctggacgatctggaacagaataaagcctctcacaaggatgttactgatgctctggttccgtatatcacagaagttgaagcggataacaaatacgaagcgaagaaagttccactgtcatttactcaaaatctggtcggtcgtaacgattatatcgagggtgatgatatttctttatctgttaccgttacaggtggtaaactgccttatgtgtaccagtggaagaaaggaaccgcaaatatcgggactgattcaccgagtgtaatgatccagaacatcacaacgagtgattccggcgtatataaagttgtcgtaaccgacgctgaaaataccgtgattacttctgatgaacttgacattacggtatacacggttcctcagttcgatacaaacttgagcgatatttctgttgctgatggtgaaccattgactctggaagtagtgtttagtggtggtaaacctccatacacttacgtatggtataaagacggttctgtactgactggcgaaactggttcttctatcgttaaatctgctacaaccagcgaagatgcgggtgtttaccatgtaaccgtaactgacgcgatgaatagcacaagcgattcagcaacagcgactgtcacggtagcataattttaacaaggggcgcaagccccttttgaggatcatatgattacgaacaatccagaacagttaaaggatgaaattcttcgtcgtctgggcgcaccaatcatcaaaatcgaaatcacacaagatcagatttatgactgcattcaacgcgctttagacctgtatgcagaatatcattataacggcacaaacaaaacgtatctgattttgacactgggcgatgataatccgcgcaacgtgttcgacttgagcaaagagcacatcttcgcgatcacgaaggtattgcgtacaaacatgggttcattgaccacaatggacggtacagcggtttatccgtggtttaccgatttcctgatggggctgactggtggctctctgggtgggcgctgtgcatcgagtgtgtacggtatgaacgcatacggcgcggatatgggctactttacccagatgatgtcctatcaacgctcaatgcaagacctgctggctccactgcctgattactggttcaacgatgatactggtcagttctgcgcatgggggcaggtgaacaaaggtgacattatcgttattgaagcgatggttcgttccttcgttgatgtccctagctccgtaggaagcgtcgcaggatacgctacagcgggttctaacgcagtggaagaccaatccatagccgacatctacgaaaacccgtataacagcgttgtgggcggtgtacgagcgggacagggttcaactgttacgggcggaacgtctgcatataacaaccgatgggtaaaagactactctaccgcactggtgaaagagatcaacggacaaattctggctaaattccaggggatgcaattgcctggcggtgttgctcctgatggtacgcgactgatccaggaagcggaaaccaaactgcaaagtctgcgcgatgaactgatttcgatgtctgacgcagtaccgatcattatggtgtagggggaataatgcaaaactgggatgaaagtttattcgctcagttgtctacgggggaaggggttgatcgcaacttaaaggatcaggtcactaacccgtatgtaaactggtacaaatacaacccgacacaacagctacacgattcactgacagcagaatcaatccagatgaaatcgcctgatatgtattacgtccggcgcgacttcgtgaatattgataagatcctgggcgaagaccgagaatccaaatttacgaagtcatggaaaattgctgcatatattgaatcgtatgccaactatgaaggacaacgagatttctttagtaaatttggtctgagttcaaacgatgaaatgacgctggtaattaaccctcgtttgttcgcacatcaaactgatggtggtattcctgttctgggggatctggtttatttccctatggacaatagcctgtttgaaattacgtgggtagaagccgatccgttctatcagttcggtgatcgtcctcaacgcaaaatcaaccttgcgaaattcatctacacaggtgaagaactggctcctgaattgcagcgaaatgaaggaatccacattgaacctgatgcagaactggatctcgaaccgattcgaaatcttgacgggctggctgatattaacattgaacagtacgaagaagacaaagaatttgaaagagaaggtgatgaattcatcgaatcttttgatgttgtcaacggacgcggttcaccgtttgcaagtctgccataaatacgttatatgggtataggcggaagtctatacccacaacccatacaggaaaataaaaatgtttggctactggtataatagttctctgcgtaattatatcgtcctgatgggggcgctttttaatcacgttcaggttaaaagagtacgcggcgatcaagaaaaatacataaaggttccgatcacctatgcatcgaaagagaagtttctcgcttccatgaacaaactcaactacacgttgagtcaggaaaacgttgcaaagaccgaaaccattttaccgcgcatgaacttatcactggtggatctgcaatataacgcaatccgtaaaaccagtatcgcggtcaaccaaaaaatgacacagttagcaaccccacgaaaaacgatcacacagtttaaccctgtgccgtatcgtcttattttcgaactgggtgtgtatacgcgatatgaagatgatatgttccagatcgcagaacagattttgccatattttcaaccgcatttcaactgtaagattaccgaactgcataagaacgatatcacagttgaccgagacatcaaaatcagtctccaatcggttgcgccggataccacattcgagggcgatgcaaatcaacgccgtcatgttgagtggtcatttatgtttgaattacagggttatctgtacccgcctgtaactgatgttaaaggcgaaatcagaaccgtttacacggatttcttcgctaacatgaacccgttagataaagataactttgaatccgtggatagtcaagccgatccggtagatctgcctatgcaggactacacgggcgaagaatatattcagacgtactcgcacgataagccgatcccgtctggtgatgaacctcctaagccgagggaatgagaatggatgaaaaattagatttgcagcaattgctgaatattgattccctccctggcggcgttgagtctggggaggatgtggttgtttacgaaaaacttgaactggttgacgttcaatcacatccagcagaccggaaaccggatctggaagaggattatacgctcgcgcgtaagactgcgcaccatatgaatcagatgatcatggatatggcgcagatcgcattacacaacgcgaagaactccgaatcgcctcgccacgtcgaggtattcacaagcctgatgaatcagttaaacgtttcaaacattggcctgatgaagattcacaaagaaatgcgtgagattacggaagagactacaaaaccaggtgctgaaaagggcggtggtggtagtgaaatgaatatcgagaatgcaaccgtatttgttggttcccctacggaactgatgcagaaatacggcagtgcatatgaacccaaagagggcttcattaatggtgaagctgtagaggtaaaccctgatggaaatggaaccgacgatcgatccgagtaaggaatcagatcaccctatcggattaatgcatcccaaatatctgaaaaagaaaattgatgaattggggatggagtggacacaaagcgaacacgataaaaaatggtatccgacaacgttcagtgactacctgaaaattaacggcattcaaaaggtcgatattcagtctaaggacagttcgaactttgccacgtacaaaaataaaggcaacaagaaaacccgatataacggcaacccaaacctgaaacgtgcgtatatccagactaaatggacgcaacaaatgttgatggagtgggtgaaatgtcgtgatgatatcgtttattttgctgaaacatattgtgcgatcacccacattgactatggtacaatcaaggttcagttgcgtgactatcagcgcgaaatgctgatcgaaatgcacaaaaaccgtatggttgcctgtaacctgtcgcgtcagttgggtaaaacaaccgttgttgcaatcttcctggctcacttcgtgtgtttcaacgaagataaatatgttggtgtgctggctcacaaagcctcgatgtctgcggaagttctggatcgtaccaaacaggcgatcgaactactgcccgacttcttgcagcctggtattgttgaatggaacaaaggttctattgaacttgacaacaaatgtaaaattggtgcgtttgcatcttctcccgatgcggtgcgtggtaactccttcgcgatgatctacatcgacgaatgcgcgtttatcccgaactttgttgatgcgtggttagcgattcaaccagtaatctcttctggtcgtaaatcgaaaatccttatcacaacgacacctaacgggcttaaccacttctatgatatctggaacgctgctatagaaggaaaatccggtttcgtgccttacacggcgatctggacatcggttaaagagcgattgtatacagacggcgacaacggtacatttgatgacggttattcgtggtctgcgaagatgatcgctggctccagcaaagaggcattcttgcaggaacactgcgcggaattcatgggaaccagtggaaccctgatcgctggttggaagttgtcaaaactcacatggattgatattgatgaaacggaaacgaacttctatcagtataaacgtccagtagaggggcataaatatgttgcggtacttgatccagcggaaggtcgcggacaggattaccatgcaatgcatatcatcgacattacgacgatgccatttgaacaggttgcggtgtatcactcaaacaaaacgtcgcatcttattttgccggatatcctgttacgttatctgaatatgtataacgaggcatggatttacattgagctaaatagcacagggcattcagttgccaaatctctgttttccgaactggaatatgagaatgttatttgtgacagctacaacgatctgggtatgaaacagactaagcgatcaaaagctatgggatgttcgacgctgaaagacctgatcgagaaagataaattgatcataaataacaaaaagacaatactcgaatttcgtactttctcagaaaaaggcgtttcgtgggctgcggaagaaggatatcacgatgacctcgttatgtcgcttgcttgtttcggttggcttacaactcaaatgaaatttgccgaattctgcgagaaagacgatttaagactagccaatgaagtttttgcacgggaacgcgaacagctatacgaagacgcattatgtccggttatcgttacaagcggtgatgaaacgatttcggttggttctcacggtatttcgtttatataaattagaggaaattctataatggctttacaatctccaggtattgaaaccaaagaaacatcggtacaatctaccgttgttcgaaattcaactggtcgcgctgccattgtcggtaaattttcatgggggccagcttatcagatccgtcagatttctaacgaagtcgaaatggtaaactattttggttccccagacaacttgaccgctgactatttcatgagtgctgttaacttcttgcagtacggtaatgatctccgtgtggttcgcgttgtcgataaagatgccgctaaaaacgcaagcgcaattttcaaccagatcaaaacaactatcgcatcacagggttctaactacactgtaaacgatgtgattaaagtaaaatacaacaacgttgttgtagaagaaaacggtaaagtgtccaaagttgacagtaacggcaagatcctcgcggtaatcatcccaagcgaaaaaatcgttgcccgtgctaaacagattggtacttacccagatatttctactggctggactaccgaaattgtttctcagtcttccggtgtttccgcgtctattacgattgacggcatcgaaagcgattcagggatcactctgttgaacctggatattgcaaaagaaacaattcagggaaccgcattccagactcttacccagaaatatcagatcccgtctgtcgtggctctgtatcctggtgaactgggttcaactgttcaggtggagattatctccaaagctgcttacgattctggcgctatgatttcaggctacccttctggggtttccgttaagaatagcggtcgttctgtaatgacctacgggccacagaccgacaaccagtacgcttttgttgtgcgtcgtggtggcattgtacaggaatccttcatcgtgtcaactgagaagaccgataaagatatctacggcgtaaacatcttcatggatgactttttcgctaacggtggctctcagtacgtttacggtacttccctgaactggcctaaaggcttctccggtatccttgagttcggcggtggtttgtcctcaaacgacactgtaggcgctgatgaactgatgactggttgggatatgttcgctgatcgtgaagcgctgcatgtacctctgctgattgctggtgcgtgtgctggtgaaactgtagagatcatgtctaccgtccagaaacacgttatctctatcggtgatgaacgtcaggattgtactgtgtttgtgtcgcctccgcgctcacttctggtgaatatcccgctggcaactgcggttgataacatgattgaatggcgtactggctataaactcagtggtggtgctgttgttgataacaacctgaacgtaagttcaagctatggcttcatggatggtaactataaatatcagtatgataaatacaatgacgtgaaccgttgggttccgctggcaggtgatatcgctggcctgtgtgtttacactgatagcgttgctcaaccgtggatgtctccagcaggttacaaccgtggtcagatccgcaactgtatcaaactggctatcgaaccgcgcacagcacatcgtgacgcaatgtatcaggttcagattaacccggtaactggtttcgcgggtggttccggcttcgttctgttcggtgataaaacactgactaacgtaccgagtccatttgaccgtatcaacgttcgtcgcttgttcaacatgatcaagaaagacatcggtgataacgcgaaatacaaactgtttgaaaacaacgacgatttcacccgttcttcgttccgtatggatacaggtcagtacatgactaatattcgtgcgctgggtggttgctacgattaccgtgtaatctgtgacaccacgaacaacacgccggacgtaatcgaccgtaacgagtttgtagcaacgatctacgtgaaaccgcctcgttctatcaactacatcactctgaacttcgtagcaacgtctacgggcgcagatttcgatgaactggtaggaccgcaagccgtataacgtcaagggggctgaaaagcccccataaataatccgaggttaaaaaatgcttactgacattttacgcgcctttgaatccggtgatttcgcacgtccgaacctgttcgaagtagagatcccgtatctgggcaaaaactttaaattcacgtgtaaagcggcaaccatgccagcggctacagttgaaaaagttccggtaggataccaaaaccgcaaaatcaacgttgctggtgaccgtacctatgatgactggacaatcacgatctataacgatgacgcgcataatacgcgtgacgctctggtagcatggtcaaacatgatgcacggaatgggcgatcagattagtggtgatattccagcgaactacaaaaaaaccgctacggtgaaacagaaaaaccgtaacgatgaaattaccgccgaacataccatccacggtcttttccctactaacgtaggcgaagttaccctggactgggacagcaacaacgaagtgtcaacatttgaggttactttcgcgctggactggtgggaataaaggctataaatacaggggtagcaatacccctatcattatttttcggagttactatgaactttttgggctttggcaatgtacttagctttttcaagaacttcgcccgtgaggacgaattggatcttgaacagcaattaaaaaatgatacaggttcggtcgcgcctcctaaaaataatgatggtgcttatgaaatcgaaactgatctgactaatcagaaatacgcaagcgtattccagcagttttattctggacaagatccggcgattcagaacaaagaacaattaatcaatacatatcgcggcatcatgtcttacccagaagtagaaaacgctgtttctgaaattattgacgatgcgatcgtgaatgaacagggcaaagatatcattactttggatcttgccaaaacagattttagtaaggcgatccaggacaaaatcgtagaagaatttgataacgttctaaatatctatgattttgataacatgggtgcgcgtctgttccgtgattggtatgtggattcccgtatctacttccataaaatcatgcataaagacgaaagcaaaggtatccgcgaactgcgtcaacttgatccgcgttcgatggaactgatccgcgaatctatcactgaaacccttgatggtggcgtgaaagtattccgaggttatcgcgaatttttcgtgtatagcgctcctaaaaatggctatacatacaacgggcagatctaccagcataaccagaaggttaaaatcccgcgctccgctatcgtgtatgcgcattctggtctggaagattgcagtaacaacattatcggatatctgcaccgcgcagtcaagccagcaaaccaattgcgtttactggaagatgcgatggtcatctaccgtatcacccgcgcacctgaacgccgtgtgttctacatcgatgtaggtcagatgggtggcaacaaagcgacacagtacgtaaataacatcgcacaggggcttaaaaaccgcgttgtgtacgatgctaaaacgggtactgttaagaaccagcaaaacaacctgtcaatgacagaagattactggttaatgcgtcgtgacggtaaagctatcaccgaagtagacacgcttccaggcggtgcgaacttctctgatatggatgatatcaaatggtttaaccgtaagctctatgaagcactgcgtgtgccattaagccgtatgcctcgcgatgatgggggtatgcaaattggtggtggtggcgaaatcacccgtgatgaactgaaattcagtaagtttatccgcacactgcaaattcagttcagccctgtgctttccgatccgttaaaaactaacctgatcgcgaaaaaaatcatcacagaggaagaatgggaagaaaacgttagcaaaatttccttcattttccagcaagattcatattacgcggaagtgaaagatattgagattatggaacgtcgcctaacgttgatgtcacaggttgaaggtgtagttgggaaatatgtctcccataaatacatcatgaaagagattcttcgaatgtctgatgaagacattgacgaacaagcgaagctgatcgaagaagaatccaaagaagaacggttcaaaaatcccgaagaggaagaggaaaacttttgatgaaagaatttatcgaagcaatcaaaagcggtgatctggtggaagcgaagaagcaattctattccatcatggaagaccgtaccgaagcccttcgccaagaaatgcgcgttgaactcgcggaagctgtacgcatcgaaggtgaaaccgacgatgacgacagcgatgacgatgacgacgacaaaggcggcgatgataaaggcgacgacaaagacaaaaagccgtctgataaaaaagacgacgataaagacgaataagaggtgtaaataatgcaactcgaactcgaagaaatcagcgtcgaagatctcgaaccccatttaaccgaagcgaaagcccgtgttgatgttctggggatcgatgacggcactgtgaagatcatcgaaaatttggcggtcaatgaacctcatttagccctggctatgatgtccattgtcgagggtttgagtttagatgaagtcattgttaaacacgtagattcgcgcggtaatgtggaacgtaaaaaagaccgtaaaacccgtgaacgtaatgcgtaccaaacaactggtttaactaaatctcaacgtcgccaaattgcgcgtcgtgcgctaaaaacaaaacgtgcaaacccttctattacaacccgcgcacagcgtaagcgtaaaaaagcgctccgtaaacgcgccgcattagggctataaatatgaatgaatcccaactcaatgaaaacggcgatatgctgctaatcgaggaatggggtttaccttgtgcggatatttccgattcgattttagaatcggtcggtgagtcgaaaaaagacggtaaacttcggattgaaggtattttcctccaggccgaaaaagttaaccgcaataagcgactgtatccgaaaaaagtattagaagaagcagtaaacgattatatcagaactcaggttaatacccgtcaagctctgggtgaaatgaatcacccgccgcgaccgaatgtcgatccgcgtaatgcttgcatcctaattgaaaaattatggtggaaaggtaatgacgtttggggtcgcgctgttgttgtcgaaggtgataacggtgatggggataaactcgcggcgttaattcgcgcaggttgggttccaggtgtttcttctcgcggactgggtaaactttccgattctggaaaaggttacggtatcgtacaagaagggtttaaattggcggtaggcgttgatgttgtttgggggccaagcgctccagatgcttacgttaagccgattaccgaatctcagtcaagcaaaacgcttgttgagaataatagtgctgatgatgacgctttcagaaaactctctgaacgtttgaaaagtctatataaataatatcatatcaaacaggaaacttagaaatgcttaaagaacaactgttggcagaagcccagaacctggataccccagttgagttagacagcattttcgaatcagttgaactttctgatgatgcgaaagcaaacttcaccactgtattcgaacaagctgtaaaagcaggtgctgcgaaactcgctgaaacccacatcgcccagatcgcggaacgctccgatgaactggttgaagcccaggttgccgaaaaagctggcgaaatcgaaaataaactgtacgaagatgcgaataaatacttcgaccacatcgcgcaggaatggctctctgaaaacaaagaagctgtgtcccgtgatatcaaggccgatctgttcgaatctctggtaatgggaatgaaagaactgttcgttgaacacaacgtagttatcccagaagcgcaggttgatgttgttgcagaactcgaagatgaactgaccgagaatcagcaggaagttaaacgcctgttcgaagctaatcaggctcaggctaaagagatcgccaacatgaaacgcgataccatcgtttcagaaaaaacaaaagatctgactgaatcgcaaattgaaaaggttcagaacctgatcgaaggtttggaatattccgacaagttcgaatccaaactgaccgcaatcgttgaaatggtagcgactaaagcggaaaaacaggttgaagagagtaccactactcagacaaccactaaagatgactttgttccggtgaatgaaaatacacctccagcagagaaatcgaagatcaataaatatgtacaagcggctaaagccctttcctaatcttataaggtaagaaacaatgtctaagaaaaacgaattgatggaaaaatggaacgatcttctggaatctcaggaaggtttaccggatatcgctaccaaatccaaaaaacaactggttgcagcaattctggaaactcaggaaaaggatgctgatactgatccagtatatcgcgacgaaaaaatcattgaatccttcggcggtttcctggcggaagcagagatcgcgggtgaccacggttacgacgcaaccaacattgcctctggtaaatccagcggtgcaatcaccaacatcggccctgctgtaatcggtatggttcgccgtgcgattcctaacctgatcgcattcgacatttgcggtgttcagcctatgactggccctactggtcaggtgttcgcactccgtgctgtatacggtaaagatcctctggctggcggtactcctgcaaacgttcgtgaagcattccatccgatgttcgctccagacaccatgtattctggtgaaggtgcaaacaccgcgtttgctgctatcgcaactggtgttgctatcgcttccggcgctatcgttaagcacgtattccaggaaactggtatcgcgtacttccagaacgtgacctccggcaacgtaaccgtaactggtgctgatgctgctgctctggatgctgctgtaatcgcagaaaacgagaaaggcactctggctgaaatttccgaaggtatggctaccagcgtagcagaactccaggaaaacttcaacggttccagcgctaacccgtggaacgaaatggctttccgtatcgacaaacaggttatcgaagctcgtagccgtcaactgaaagcacagtattccgttgaactggcacaggatcttcgtgctgtacacggtatggacgctgacgccgaactgtctgcaatcctggcaactgaaatcatgctggaaatcaaccgcgaaatcgttgacctgatcaactacaccgcgcagattggtaaaactggtttcacccagaccgtaggctctaaagctggtgcgtttgacttccaagatccagtagatattcgcggcgctcgttgggctggtgaaagctataaagctctgctgattcagatcgacaaagaagcgaacgaaatcgcgcgtcaaactggtcgtggtgctggtaacttcatcatcgcttcccgtaacgtggtttccgctctggctcgtatcgacagcggcatcactccggcaggtcagggtctccagaaaactctgaacgtagacaccactaaagcggtattcgctggtgtactgggtggcacttacaaagtgtacatcgaccagtacgctcgccaggattacttcaccgtgggctacaagggtgataacgaaatggatgctggtatctactacgctccatacgttgcgctgactccgctgcgtggttctgatcctaagaacttccagccagtaatgggcttcaaaactcgttacggtatcggtatcaacccgtttgcgaactctcgctctcaggctccggcagatcgtatcacctctggtatgatcagcaaagaaatgtgcggtaaaaacgcatacttccgccgcgtgtgggttaagggactttgatcctaagttgttgaaaaacaacgactttttaaagggaaccttcgggttccctttttgtttatataaatagtgaaaacatttgaggctatattatgaaacatatcatttataaaataacaaacaccatcaataacaaaatatatgttggtgctcactcaaccgaagatatcaacgattcatacatgggttccggtattgcaatcaaaaaagcgcaaaagaaatatggtatggaacatttcacaaaagaaatacttcatgtatttgacacccgtgaagaaatgtatgagaaggaaagggaaatagttgatattgaattcataaatcgaccagatacatataatgctggtattggtggtaaaggtgctccaatggcattgattggatggagtgatgaacaacgcaagctgatttctgaaaatacttcgaaagctatgcaagctccagaaatgcgcgaacgcctttcaaaaatcaaaacaggaaagaagcaatcggaagaatccaacaggaagcgttcagagactatcaaagctatgtataagggttctgcattcgacagaaccggatctaagctcacagacgcgcacaaggccaaaataagccgttctgtgtcgatagatggagttgtttatgcaagtggttctgatgctgctaaagcgttggggctttctcgatctggccttgattaccgtttaaagagtgacaaatttcctgaatggaaattcgttgcataaataaacaatatactccctataaattcaggaaccaaagaaatgagtgataaacactacacaattcacaagttgatgcgtcagtcttcgcttccgtctggtaaacgagaaaaagttatcaacgaagcaacaggcacgaccgacatcaacgtacagaacacgcgcccagaactggtttctttgactcgcgcggttaacaacctgatctatcatgaactggttgctgtacaagaaacagaactccctgttgcaacactgttcggtgttcgctatcgcaaccctaatggtgatatgactttctccagtgctgcaacctattcaggccgaatctctggacgtacagacatcgacgaaatcgatctgactaaagcctacgttaaaggtgatttgttcaagcatgacggcactgacgttgtttatgaggttatcgcaccgattaccctgaacactctggatactgacaaagacaccgcgatcatgaaagctgtgttccaaagcaaaattcgtctggtgagtgaagccgctgacacttctaagtatgaaaccagcgaagatatcgcgtcaacctccttccagatggatcgctggaatattccggtacgctcgcgtaagtttaaaaccgaaatgacggttgaactgatgcaggatttggaagcgaaccagttcgaagctgatggggtgatcgaagacatcctgggaaccgtggcaagtgaagaagtcaacaaagacattattcaaacactgatcaccgtttccaaacgttacaacgtcgatggactcgttacggatggtatttttgacggtactaccgcatacaccgcgaaggatgctccagcattgggtcgtatcctgtatcaattagcgtgtgaaatggggcaggaaatgaatagaacgacttcatttgatgctacctacgtcctcgcaacagcgcgtgttgtaggcattctggctgcgtctggttggatgcacgaaaccgacgaacaacacccactggcaacaggtaagctgaacaacggttattatgtctatacagacaccaacagcccgttcgattatatgctgactggttgcaaatatgatctgggtgatatggatcacgtaggctctctgttcttcgctccgtataccgaagctgatgaagcaggttcaatcaaagtatccgtagatccggcatccctgcaaccgaaagttgctattctgatgcgttacggtctttccgtgaacccatacacagcagaaagcgaatccgatcacctgatcaaaggtgatgattggtctgctcttgcaggtaaatctaagctgagtcagatcgtaggtattaagttacctaaactgggttaacaagttttgttttgagaagaccattatagtaataaagatctataaggtcaaacgagcgaagcgagttttcacgaacgaagtgagtgatgggtaagtacgatgtactgtttataatatttatattttatatatagagaaaacagtacatttccgtatactttttaaccaacattcactcactacgttcgttcatgtactcgcttcgctcgtagatttgacttcttgatctaactggttataatgttactttgttttgaggtgatacatggctgaactaaaacttgaagatctacaggctgaacttgaagaggatatgcgtattgatccgttgaagttacaaagcgaatcagcagacattccgaagatttggtcaaaatggcttcgataccattcgaatgctaagaaaaaacttattcaactccaggcgaagaaagaagcgattgtaaaagatcggttactgttctacactggtagacacgaaagcgaaatgaccgatgtcatttacactggttcgggtgaaatcaaaattgctatctccggtgatcctaagaccgttgaagttaacaagctgatccaatacttcgaactgattgcagagtttaccggaaaagcgctggatatcgttaagaacaaaggctactccatcaaaaacatgttggagatccgtaaacttgagagtggtgcataaaatggcagaagaatttgattgcaaatgcgttgtgtgcaaacaaccgatgaactcccgtaatacggcgtttgtcaatgaagctggcccgatctgcggtgtcgtatgtttgcaatatctcaacgaaaggaatgatcgcggtatcaatgaagccgacgatctgaacgaagttcaaatgttgctgtaggtgtgaatatgaaagactattcaaaaatcgactttaacgaagtatttcgtttgctgggattgatggaagaatgtgtgaccagggttcatgcacttcgaatttcgtttgaaagcggttgtatcgaagacgaacgcccagatttatagcagtaaatagatgtgtaccccttgtggggcttgggcttaccgtgtggcgtacccatttgcgccgtccgatagaatttactttcggcggggtgattggtaagataccttcgagtaaaggccagttaattgtaattcagaatagtacagcactgaaataaaataaatgtacgtgtcggaacaaacggtttccgaaattaaaaagccccttcctttcggttggggctttctttttaaaacttctcttcttctccggtttcaagttcggctttcagttcttctcgtcgtcccttgatcgcgtcacgcattgaaatgtcatcggatgctgcaacctcgacttctttcacgcgggtgttgtaatacttttcaagttctttcaaaccttctagtgtccggcacgaagcaaccttattcatgaaatcatcaatcgctgcttcgtttacgaatgtagtaaaacttttcattttggcctcttaaatttctacctgtttgatcgcgtagtcgaatcgttcttcattgtagatccgcacacgttccatagcatgtttcataccgtagtttgtcgcactgtatttatttttggctgtcttagactttgacagcgtagccaggttatcaacgatatcccatacagtagcgagcgctttcgatccgtgcttacgaagtacacgaccgatagactgtttcaccacaacagcagatttgcaagggtgcgcaaaaatgatgtggtgtaggttcttgattgagatacccgtactcagtaccccgatcgaaccgatgacgattaaacctttcgtcgattccgcgattttcttcatttcgttacgatcgtcaatgtctgtatcaccattgaccaacaccacgttatcgtaaaccttgctcaactgctcgtacagccattttccgtgctctttgtaccggaacatcacaaaggcgttttcgttcttctcacgggctaatttgagcgctaattttagaatccacgcgttgcgccgtgtgtggctggttacgtacttgatttccgtctggtagtccgcacccttcaattttttgacctcttcttctttgtatcgaaggaagatcgtgttaattttcaggttggtgacttgtccatcatccatcaaacgacgcgtatcaactggtttaaagactttgccgaacgcaccgatgtattgcatcatgttcgttttcccttctttcagggaaccggataaacccagtttgaagatacattgatccatcgtgtcgataatctttttgatgctcatgcctgttgagaggtggcattcatcaaccatcaaacacatgaactgttggaaccattcggcaggcattttaaccgctgattgccaggtagaaacgtaaatcagtgcattactgtttttcgctgtaccggaacggatacccagcattgccgatttcgggaacaaacgatagtttgcaatgtcctcgatcatttggtcaacaagtgcggtagtcggaacgatgatcaacaccttcccgctgtaatgttccagacaccaacgagagataagcccctgaatcagagatttacctgctgatgttggcaggttcagaacaccgcgacggttcttgataccgtggaacacggattcgcgttgataccagtacggatcgatctgtttgtcgccgtcataaaccggatgttcgctaacccacttgttaaaatcttcttgcgtgatatcctcggtttcgtggatctttggatcaacccagattgaatacccgcgtgattctgcgaatttggataccagataggctaacccatacgggagtttcccgttgtagtccatcaagtaaatgtaaccgttccatccaccatatttgtatttggcctgatactgatagcctgggggctggaagctgaaatagtcacgcagttcatagacaatgtttggttctgcctgaatctgtacgtggcttgtgtttaaaaatttgacttcaatatccactatgattaccctatgtacaaagtatatacgtatttatgtcataaatattggataaacacttggagataccaatgaacattgattacgaaaaagttgatgggttccgtaccctcgacgcaaaagaacagaaaggcgcgttagctgattacgcaatgactgtgtttgctgttaagctgaacaaacaaaaatccttcgataacatgctggcggatctggttgctgctttaccggaagatgaagaaaaaccggaactgctgatcgattcccctgaaccggaaatcgttgcatataaaggtgaggtgactatgggtgaacctgtcatcgaagccccgaacgttcccgatgtggttattgatgcttctgcggattttatggagtacgttaaagaggtcgcgccggaagtagccgatcaaatccaattagtacctgatgtcgtagaagctcctgtaagcgcttctgacgagtccaaaggcgaactggtatggttggaagggtttagcccgacaatcttcatgatggggcgctctgcgagttctaacgggtattatacctgtccgtggtggatctatgactggattaaacaaaccccagactggtacaaagatcctgatagctgtccacatgcaagcgcaatcgacacaatcaaatcacttgcgttctatatcgtgcgcgatggtgaagttcgtgttcgcgaaaccagaaatagccgattcgaaacatttaagttttagcactttttgctaaaaaaacttattgactcataccctcgtttaaagtatatttgtactcgaaggcgggggaatggctctcgcagtgaagaaggaaagcaaaatgaaaaacgaaatgatgaaaaacgcttattacccagttctgtttgtttgggctgatggtaaagtgaagaaagtagtcaattcaaatgctccttactatactgttgaagaagcactgcgccacgcttacgaagctgattatcctgtccctgctgaacctggttatgctcgttggaacggttcaaaatgggttgctgatacctgggacaactacgaagaagcaaaaatggaatgcgatcctgattatgtttctcgccaaatggaagcgcacatgattgcagaccgtcgcctggataacgaagctcgcggtttctattaaaattcaaagggggctacgcccccttttttgtaggtaaaatatgactgaattaaatcacgaatgcctgaaagacttatcagaaggtaaagagatcggaaacgtcatcttccttgatatcgacggcgttctaaataatatgcggtgcatgaaatttggtgagcatatggacattgaatgtgctcgacacctgcgccggatcgtaaatcatgcgaactgtgatattgtcatttcctctacatggaggatcggcaacacaacccatactctacgggaaatcttctacccgtggggattgtatcgcatcattgggaaaacctgtacgaatctaacagaccgacaagcaggacgcggtgatgaaatcaaagcatggatcgacaccttcggatgtaagaattaccttatccttgatgacgataccgatatgctgccggaacagagtgaacatttcatcaataccgatgggttcgtagggctgacagaagaacaatccacttacgcgatccgtaatgtgttcggtgtaacaaacccgttctgtcctgaatgcaacggctatgggcgcgtgaaccaatatgataaatgtccgtcttgtgacggcaaaattttacttctctaaatagagaaaaactaagaggttttgaaaatggctacagaaaaatggactacggtacacccgatcccgtggcgtaacaccagctttacctatctgccgtggtggatctttgatatcatcgtggctgcgaatgctgcaagcgaagactggcgtgattatgccgaagaaaaatacgcgaaagaattcgacacactgaaacaggcgtatattgattacaccgatgttgatttcatcgaatcccgtaacggttatctgtataagctgagtgattttactcctgctgatcctgtcgtaacaattacaccaaaaaccgctcctgctgatttcaaagtaggtgatgcggatctggctgcaactgatctgtttaccatcgatccttctggtacagaaatgactctgagtgttgactcttccggtcatggttctatcgttggtggtaaacttcatgcggttagtgaaggtgatgttgtcgtaacagcaacctctggatctgttactgcaactctgacggtaaacgttaaacctgcaccataataacaactaagaaggtaaaaatgctactatttgaattcaatgatgtattcgcaaaattcagcgacgcaatcgaagccaaatttggcaaacgcccacaaaacatgacagatgcagaatatgaagctgctgtatcgtccctggttcgtacagatttctatgaaaaactggcgatcgaggtgttgggttgggatatgatgaaatggggcatgacctatcgcgatcgcgaagtcggttttattctcgtcaacgaagcaaaaagcccgtcctgggtgaatagtcaaaaaatcgcgtacatggataaagtatgcgcacagatgggtattgtacgtttagacttctggacttgtcgggatctgaacgaactgaaagcccacgcttaccgttgccctctgatctcccgcaatgataagcatcgtcaagcatgggatagcgcagggaaatatcgtagtgttttcctgaacgacgatatgaacatcactattcaggatgttaaccgctcctttgcggattacacaccataaacaaaaaagggaaccgcaatggttccctttcttttatgcaatttttctgatttctttcaatgcttcttctttgctaccaacgaagagaatcgctttacctccggcttttctgaatggcaacacagcttttgccctgtcatcaatcagtatacctttgtccgcatatgctgctttctctccgctgcttttggtgtagtggaattcaggcagataaccgaacaccttcatcaacgcttttcttttttgttctgctaccgcatcggaattgtatttccctacgctggttaagatcgcaacctgacctaaagttctcaaatgacagaacaggtcgatgccctcttgtaatggttccagattttcgtagaagtcagtttgtgatatagcctgtttcgcttttttcaattcttcttccggcattctcgccgggtcaccgtacatcggaacaaaagaaccttcccagttgaacagtacaccatccatatcgaacaaaaactttttcatatcaattcctcggtttgtgtgtgcatcatattcatatatgttcctattgtcaaccccatgtatcagttttcggtgcgtatgctgcaactttcgccactaactctttatcaagctgatcaatggatttctgcggctttccttttgccttaactttgatgtagttagacttaacgacaaacataccgcctttgtcagatttcttgatttcgctgtcaatgcctactttgttgaagctgatccagatatcgccgtccatgtactgtttcagagagtcgcccatattcaggatcttcgccatagtgagcgctgccccttcgtgggtatccatgaggatttctttaggcactacacgatcgcgtttaaggttctgctgcatagcaatatgaacatcgttcataacccaaacgatatggatattttctttctgataacccagcgtttcaacatcacgggcgatacttgccagcttgctcatgctttttagggttacgtcaaagatcagatttggtttacggtcttccggtgctgctgcgatacccgcgtacacacgcgcctggtttttgttggatacgttgaacacgtccgcgatcacatgatgcagtgttgctacgttgtctgggtttttcaggttcatggttttgacatcgtgaccagttttcgctttgatctctgctgccagtttggtactacccatgaccaattttttgagtgcgtcaacgtccagtgtgataccttcgatgcctaacagcttttcgagggtgaaccctttaccagaacccgcaccgccagccaggatgactacctgaccaaatttaggataagccttaccgccgaaggtgatcagcgcttcatcaaggctcgtaaagtctttgaatgatttcatcttagaactccaggtgtttatttaaaagtatttattgacacggtttatgagtgcgtttatagtgcaattgttcgacggataagccggaagaactttaaccataaggtaacaattatgaaaaatgaactgcatgaattcatcaacgccgctgttcttggcgaccagtcaaaatataaagcccgtcgcgataccctgattgacgatttctgtaatttcctggggttcaagcgctggcataccccgtctatgcgtccagattgtgatccaaaatgggattacttcaaatggagtgatcgcgatcgtggttacgtcgataacgtccgcgtaatgtctttcaaccacttatacgcaaattcaacaattgctgttgctaaacgcaacgattcgacttatccgaacgggtggagtgttgctaaagtcatagaaacacttcttcaactgcgtcgcgaatataaatcagcataccgtgtcaatcccaatcctatctataatgaatggcaaatcgtcgcgaaatacctgctgaacatcacctattctattttctgtcgcttcgggacaaaagagattggatttggctctcatgatataattgcagaagcacgtcaccgcatgatccatgcaatcctgaaaattcaaaactctggtgggcttgttcttgctgcgttctgtgatgaaattgtttactacggagaacaggtcgaagttgatgatgttcaccacgaaaaattcaaaagatttgtattcgggcaatataacagctattcatatggaaacgatattcgtgtgatgaggcacccgcgcattatgttggatatggaagggtgggaaccaggtcacggaattggtgatgccgaaagccaacgtgaacgccgtgttcgttcagttgctaaaactcgcgaattgatgacaggtagccttactgattacctgttcagaacaaaagaagacgttgaaaaagaatttgttgacttgtcgggcgaatagcgataagctgtaatctctgaaaacaaggagataaccatgaataccattcactgccgcaaagagttcgttgagttctatcacggatcatgtactgctgccggaatcgaaagcatgttgttgcctccttgtgattctgatattctgtctgaaaaaggcagaaagaaaaatctggatcgtgttttcttcactgctgatatcgggctggctcgtatctatgctggaagggctgcacgttcaataggtggtgatccggtactttatcgggttgtgtgtccggtagatgtggtatgcatgaacgatgacaaaggcgcaagcgtttatcatgctgcatgggctttctgtgaggaattatgaaagataaggtgttagcgtatctcgttttcttgctgggatatcgcgttgaagtgatgggtggttattcttctttgtatggggatttaaccgcgatctggatggttgcgttgggggttatgtttacctttatggcgatctgtattgcgaatgaggctgatcaaaatgcttgaattttatcctgctggttgcaagtcaaatccgcctgatgcatcgttccaatcgtggatttattttcacagggaactaaacgacatcatcgaaagtcagtggaaagaccatcctgaacgaagtgcccccgatttagtcgatagcgtaacagatgtacgcaccctggaaaaagggctgtatgattgtctggttcagggaatggtgtgtaaattgattttgtggtatgctccgatcggttcagatctaactcgcaaaatcgcccgtggctatatcatgacgaaacgtgagtttgaccagatctggaacgaacccgactgtttcgaacgcgaaaaatacgaaaatgaggttagttgtatatgaaactatttcatgttgtatatggtggaatgaaaaacatcgacatcgccgcgttatctgctgggatgctggacgaactcgaagcacagatcgggaaacgattcaaagccagtatcaccgaaacgcaaactttgtttgtcgatcaccctgcggatatggaaaaccttgtcaacactctggatgatctgatgatcccgtgtgctgatggttggaacgaagcatccggtgttcatgtagttgtaacttttgttcttaaaaatgttgacagcagaaatgccgaagtgttagagtttattcgtaaaattgattctactaaaggaaagtaactatgaaaatcgttcagcgtaatatcagcgaagttagccagcaggaaaaagtacagattcatttcaaattcaatgatctgaaactgggctatgcacagatcgcccgtgagcacatgctcgataacggcgacatttacgtgattgttcaagaaattgagcgaattcgtgctttccgcgcagaaaatccaaaagtgaaacatgttctgcgtcgtgtgtacatcaataaacatcgtgaagaacagcgcaagcctaaactcaaagctaaacgcgatccgcgtccagataacaaacgtaaagcaatcaacggcgctatggcgctggcgttccaggaagcgggtttggcgtaaggggtttatatgtcttcaatgatgaatcgctggtcgggcgtgataacttcgactatcaaaaaggatttggtgaaggttgaagcaaaaccaaagccagtagaaccggaaaaagttcaaactatggtatcactcgatcctgctgagttagaacaccgccgccgtgcaaagcaaattgaattcgatctgcgtgtcgctcgttcatacaacagtaaaaacgatgatgcgcgtaaccgcaaccttcaatttgctctgacgttaagcgactgggcgaagctaatgagtgaacccgtatgttcttactccggcagaccgtttagcaacaaaggcggttgctctgactcccgaacaatggaacgaatcaacgcttctctgggatacacggttgaaaacacgatcgcagtaaccagcgccgcgaatagcgagaaatcaaatctcgatgcgtttatgaagggttctgtgatccttccagaagtaaaactgaaactgttacgcaaagctgcgtatcaaattgaaaaacaactgaaaatcaagggttaattatgtttgtgaaatattcttctctgactaaccattatgaaggtaaattcatcaatggtgtgatcatgaatggtttgactggtggcgtgtgggtagcgcgtgaaaagatccacggggctaactttagcctgatcacttcggacggtatcaaagtcattccggcaaaacgtagcggtgaaattctccctgctgaacagttctacggttgcgaacccgtagttgcgaaatactccgaacctgttcgtaagatgtgggaaatgatctctactgcgcgtcagttaagcggtgagtatagcgatgaactggtgatccaggtatacggcgaattcgcggggcgtggtgtccagaaagatgttgactacggcgaaaaagatttctacgtatttgatatccgtgttaatggcgaattcctccctgataacgttgttgcaaattacgctgttgctgttggcctgaaaatggctccactgctggcatacggtacgtttgacgagatccgcacactgcctatcacctttgattcggtggttaacctggcgaactccggtgcgatccctgcaaagaacggtgttgaacctgagttcaaaaacttcatgacgctgaaagatggtgaaggtgagaacatcgcagaaggtttcgtgatgaagcctgttcaacccgctttcatgccgaacggtgaacgcgttgcaatcaaatgcaaaacgacgaagttcacagagaagaagaacaagcaagcgaaccgcttcgatgctccttctgaactgtcagaaacagacaaagtgaagctgaacgaattcacctgctacctgactgaaaaccgcgtgaaaaacgttctgtccaaaattgacagcgcgaatctcaccgctaaagatttcggtcgcgtgatggggcttacggtacaggacgcgctagaagaaatcgaacgtaactacgggcctttcctggaacagttcgaaaatccaacgctggcgaagaaaaccttcactaacgaagcgtcaaatctggttcgtgagaactggggcgcaatcctgaacaatgaattttaaaactgttctcgaaaacgcaaaaacggctaccctgatcggtagccgtgaaccccctgaacgtatcgcgagcatagccataaagattggacgtgctttaagtgatcgggggatcttcgcttactctggtggtgctcctggaatggatagccatttcatgtttgactactcaccagaaagacggcgtataatcctccctgagaacggttttaacgggttgtattctaatggtaaggatatcatcgactatacagaatacgacacgtacaaagccgctgacgaagcgagaaaggtagctggacacttcgacaaccaaagcgaatggacacaacgccgatacgctcgcaattcaatgcaggtattaaccgaaaacctggacaaacctacagattttgttctattctgggcggtagagaaagatttttgtgttaaaggtggtactgcgatcgctgcaaggcttgccagattgtataaagttccaacgttcaacctttggaatcaaaacgttctggatgaagtctgcgatactttagggattaacactaaacctcctactctggattttctctggtgataactcccgaacaatcacgtaattacgaacgcctctctgttgaagaggcattaaaaaaggcgaaacataatggtagaaatcaatggaatcggtgtgaacgtacaggcgggaagcgggacatcgtgggtcaaacgcgaaacacaagatgatccccgctgtggacgtagcccgacactggcggaacgtgcgcgtaaactggttgatgaaatcaacgcgaaaatggtcgaagcatcccgtaaagacatttccgagtatgtcctgaaatatccgactaaacaagcatatacctttgatatgaaacgttttatcggtaaggttatggatcaggaatgtaccgaaaaagcatatgcggatctgggtgaatggctggcggaagaagggtttactttcgatacccagcgcaaccgacaagctgcgttactcaataccttcgcgggttcgcgtcgtattaccaactttagcgatcctaagcgtgacggatatagcgatctgacttattacatcacctggtgaaaataattcgaaaaacttgttgacgggagttatgagtgtggtaatatagctcccgtagacaagacactaacctaaaaggaaaacatcatggaaatcaaattagtacctacttgcgctggctactgcttggcactgaatggtgtagcacacaacggtaaaggcttacgggctaacgttgaagcaatgctgaacgaactgggtgcggtttatgaatatgatgacgttgcaaccagcgttaaaatcataagccttgaaaaagatggtgttaactgtgcgggtttggtgggattgctacatcgactatagcgacaaccgggtcttcttactgaccagcaaataaggatcgaacatgagtgaagcagaatatattgatagctggggtggctatgacgatgacgacgatgatttttgtggtcataatttacgtcgagaaactctaaggcttttgcaacaagcaaatgcgccgaagcaagtcaaaactcctgttaaatattccgatggttcgattcgaactgaaacggttgtcaaagaagtaaacgggcgtgtcattacgtccgagcggcagaaggacatcaaacaattgtacgatgttgcaaaagccgctaaagtaggaaccatgatcacctgtcctacgtgcaaagagttgcacaagaagacgacatatcataaggtgttctgctctaatggtaaaaaatccaggaaagactgtaagagtaaatactggaacacgatccatccagaacgtttggatcgtatcttttaaatcaaaacgtggagtacgtttaaatgaaaacttttaatgaactgaatagcctgatcacctcaactgattcctacaaagtgtcccactggttgcagtatccacaaggcactgatgcagcgatgttctatattgaatctcgcggtggtaagtttgatgaagtagtaaccgctggcgttaacttcgttgcgcgggttcttgctgaaccaattaccatgaaacaagttgagttggcacgggtactttaccgtaagcactttgggaaagagattttcaactacgaagggtggaagaagatcgcagaactgggttatgtccctgttactttccgtgcgatcccagaaggtacggttgttccggttaaaaatgccgttgcgactgtgtacgccgaacatgaattctcatggttggctgggtggctggagacaatgacgattcgcggtatctggtatccgtcatctgtagcaacgctatcgcgtgagtgtaaaaaggttctggctcattaccttgatatgacttctgacctgactggtgaagcatataacatcacactgggtacacgtctgcatgatttcggggcgcgtggcgcgacctctgctgaatctgcgggtattggtgggctggcacacctctataacttcatcgggactgataccgttgaaggtatgattatggcaatcagtctgtttgctgactatcaaactctgtttgatgaagttgaaaacgtcgaagcaatcggtgtttcaattccggctcgcgaacattcgactacgatttcctacggtaaagagaacgaagacgaagcatacaaaaacagcatcgaaatgttcggtacagggttctacgcttgtgtgtacgattcctgggactacaaaggcgctgtagatcgcatcgctgaatataaagagcaaatcattgctgcgggtggtactctggttgttcgtcctgattccggtgatatgattgataacatcatgtacaccctgcgtaaactgggcgaaatcttcggttacaccgtaaacagcaaaggttacaaagttctgcataattcagttcgaatcatccagggcgacgagatccacggacctgaaacaatcaaccgtgtgttaagttggatggaagcgaacaagtgggcgagtgagaacatcgcgttcggtatgggtggcggtttgctgcaagaagttacccgcgacactcaaaagtatgctgaaaaactgtgcgctatccgcgtgaatggtgtgtggaaaggcgtttacaaatgcccgaaaggttccgaatggaaacagagtaagaaaggtttgctgatgaccatcactaacggtgtggaattcaaaacaatcgacactctggaaactgagattcctgacgggtggcgtgatgcgatgattacgtattacgacaacggtgtattaaacacctccgatacagtaggggttatccgtgagcgagcaaggatttaatatccgcgccaacgataacggatcggtagtcttctacaacaatcagccccttgtcgctcgcaaggggcttttttgtaagttggtgggctacgggttcaagttggaacaggtggacaacgcgacactaaaagaggttgttcgaattgcttatctactgaaagataaaaaagatgaacaccgtgctattgcaatgcttgagaaactaggcgaaaattattgcttcgtggtgaatcgtgggtataagtacgaaacgatcgccttatttgagaaaggacttggtgaattatgattaccacaattaaagaaggggttgacctccatttaggcgactccgtaaagctgattaaacagcttgaatctggttctgttgacttgaccataacttcgcctccgtatgacaacttgcgccattataacggctctggtgatgtctggggtgaacacgtatggaaagagttgatatcggaactgtaccgcgttaccgcgcctggtggtgtggttgtgtgggttgtgggtgacgcgactatcaacggtagtgaaacgggtacatctttccgtcaagccttgtacgcgatcgaacaaggttttcggttgcatgatacgatgatctatcacaaaaccgctctaccgaagaaccataaccgatacgaacaggactttgaatacatgttcgtgtggacaaaaggcgcaccaaaaacattcaacccaatccgcattccgtgtaagttccctgaaaaggaaaccgcacgacaaaacagctacttttccgaaaccaacgaaaagaaccgttcagcccgttccggtaagaaacgtaaacctgttggcaaggataaaattaagggtaatatctggtattacgctgtagggcgcaatcactcaacgaaggacgagattgcattcaaacacccagcaatatttcctgaacaactggcagaagatcacattaaaacgtggacggttgaaggggacttggttcttgatattttctctggttctggtacagttatgaaaatgtcgatactaaccaacagacggttcaaaggcttcgaactgatggagaattattatcacgattctattcttcgtgttcagccatacgttaacaatctggaatcttttctatgagttatttgggtgttatcccgtatacaggtaacaaacaatcgctattgcctgaactcttcaagctgttccccgaaagaagttcatacatgcgtttcattgattgtttttgcggtggccttagtgtgtcgttaaacgtccctaaacccgttctaagcaacgattacgataagacgctgattgatatgtatgagcgtcttaaaacgcttcctgacctgtctccggtgcgagaattgattgcatcaaaggggctggggaaagacaagaaagaagagtatttgaaattccgtgatgaatacaaccagaacaaagatccgttatggctctatgtcctgatcctgcattcattcagcaacgttaaccggacaaacgacaaaggcgacttcaacgctaatttcggatgccggacgctcaacgatgcaacagtaaaacgctttgaacatttcaaaaagaatgtgaaaggcattgagttttccagtggttcattccgtgacattgatatctgtgaaaatgatttcgtgtactgtgatcctccgtacctgatcaccgatgcagtgtataacaagttctggaacgaagatcgcgaacgtgagttatatgctttcctggatgaactgcacagcgaaggaatcatgttcggactgtccaacgtgactcaccatgccggaaaacaaaatgatatcctgattgaatggatgcagaaataccgcgttcataatctggataaaaagtatctgttaggccagcataccgactcttacgagcaaaacaaaacgcaagaagtctacgtgtgcaactaccagaaacgcgacgtaaatacattccctttaacactgaacgatttaatgtaggttaacatgtttaaaatttatggctatatcccttctgtgtataactgcgctccatgcctgaactcaaagcgcttgctggacgcgaaaaaacatccgtatgagttcgtgtctgttgcggattccgtggaagacggtaaacctgtactgaacgaagcggtgatcgatgaactcgaagcgcttgttggtacgcgccggatgaccatgcctcagattttccatgacgggaaacatgtaggcggattcgaccaacttcgtgagtacgtccgcaccctgtaataaataatgacaccttactgaatgttgttattatgctgacgaaacgaattaccaaaaaagactacccaactatcaagcaagctctctttgaaaaacaggggggctgttgtgctatctgtaaacgtcccctggagggcgagatcgagaaacatcaccttgaccatgaccatgctttagacggcgaaaacgccggacgtgtgcgcggcctactttgtaacctatgcaacggtacagaaggtattgtgaagcacaaattcaacagatccggtctggtgtcccgtgatgtcgattacatccagtggttagagaacttgcttgcatatctgaaacaagactattccgaaaaccgtattcatgacaaattcataccagataaggtaaaatggttttcaagacttaccaaacctgatatgattgccgaaatggtttctatgggcttcgagtacgccgacaaagacgaacgcaaagccttaaccgcgaaatatagaaagcaattaatgaaggcaacgaaatgaaagtagaaaaacgcgacggtaaaaacgtcgatttcgataaagaaaaaatccgtattgctgtagaaaaagctggcggtactatgacggatgctgatgccgcaatcatgctggttcagtacaatcagatccgcgatggtagcgcaatgaagatcgcccgtatccaggaactcgttgaagaatccctgatgaaaacgaacccagcggtcgcccgtgcatacatcgaatatcgccacgatcgcgatattgcccgtgaacagaaaagtaagctgttcaaagatatctccggcatggtgaatctgtccaacaaagagatcaccaacgagaacgcaaacaaagacgcacgggtattcccgacacagcgtgatttgctggcggggattgtagcgaagcatttcgcccgtaatcatatccttccgaaacatatcgtagaagcgcatgactccggcgacatccattatcacgatctggactatagcccgttcaccccttacactaactgctgtctggttgacctgaaaggtatgctggagaacggtttcaagatgggtaacgctgatattgaaccgcctaaatcgatcggtgttgctaccgctctcatggcgcagatcaccgcacagattgcctctcaccagtacggagggacaacctttgcgaacgtggataaagtgctggctccatacgtcgaaatgacattcttcaaacatctgcgcgatgctgaacattacggcatcgaacactataatgaatatgtgtatgcgattgaaaagactgaaaaagatgtgtatgatgcgttccagtcctatgagtatgaagtaaacaccctacatactgccaacggacaaaccccgtttgttaccatcactttcggtactggtacgagcgattatgaacgcatgatccagaaagcgattctgaaaaaccgtattcgcggcctgggtaaagagggtattactccggtattcccgaaactggttatgttcatggaaaaaggaattaaccttgatccagaggatcaaaactatgacatcaaacaacttgccctggaatgtgcttctaaacgcatgtacccagatatcattagttcagctaacaaccgtgttattactggttctagcgttcctgtatctcctatgggttgtcgcagtttccttagcgtgtggcatgatgataacggtaatgaaattcttgatggacgtaataacctgggtgtggtgacaatcaacctcccacgcatcgccattgaagcggaagcgcaggaagaagaagacgcacacgacgcattctggcgcatccttgatgaacgtctggaactgtgttttgaagccctgatgactcgtatcgaaagcctacgcggtgttaaagccagtgttgcgccgatcctatacacagaaggtgcttttggtgtccgactgaaaccggatgatgaaattctggaactgttcaaaaatgggcgtagctctatcagtctgggttatatcggactgcatgaaacgctgttgatgtttggttcaggccaacacccatttgatcgtatcggctcccagaaattaggccgattgatcattgaatatctccgcgctgcaaccgaagcatggaagaagaaaacagggtatggatttagtctgtattcaaccccagcggaatcgctatgccatcgcttctgtaagctggactttgagaagttcggaagcgtcaaaggtgtcacggataaaggctggtacacaaacagtttccatctggacgttgatcgcaaggtaacaccgttcgagaaaatcgactatgaagccgattatcattacatcgctactgctggtcatatcagttacgttgaattccctgatatgaaaaacaacctgcaagccctggaaaaagtctgggattatgcgatggaaaaactggactacttcggaactaaccttccggtcgataagtgttttgtatgtggctctgatgacgagttcacgcctacagaagacggtttccactgcaaacactgcggtaatcaagatccggctaaaatgagcgtcacacgccgtacatgcggttatctgggtgctcctgctgttcgtggattcaacgaaggtaagaacaaagaaatgatgcaccgaactaagcatcaaaattaatcaaaaagccccttgcgaaagtgaggggcttttgttatattgcacataccgaaactatgaggtattgaaaatgatgtactggacaaaagactattttgaatttcgcgatgaagaaagttttgggactgtataccgcaatttagctttgcgtggtagtcctctgtcgcctaatcaactttcatctgtcttgtttcctatcaaggtaacgcactgcgatcggaaaggtgtcaatgggattgttgatgccaatggcacaacatggtattccgaagattcttatctgtttgataacgaggatcgcggattctttaaaaagtttgtcgcgcttaaacctgctgttgaaaaagccgacgcgcaacaactgctggattgttctcacctgctggggcgaatttacgtagatggtaagctggtgacgaaacctggcgatctggaaaaattcttgcgtaaggcgcgggaaactaccctgaaagagaccgaaaaacgttacgatactgcaaccgccaatctacagcgtttgtctggtgaactgaaagttctacggggtgaatgatgaccgggataatccttgataccttgtttccctcccgtgtacgtaggcgcgtagaacgggaaaaccgactcgaagaaatccggttcaataagttccttgaggacaagaagaagcgcgaagacgagaaacacccaaacgcaaaaatggctgagggtgtatcgaaatgttctgtcgggcggttctgggttgaaaaggattatcttgacctgataggtgctattgcccctggtgttacgctggaggacttctcccgcgctactgggcgttcgtatactggttgtatcaaccgcttgcgtatgctctctatagtggtgcgtagtgcgcatttcggctatcgtgacgttatccgtccggtgatcccagtaagcagattaaaattttatatggcgggtggaaaaagacttgacttgaccaacgaactgtgtaaaatcggttatatcagagaggggaaagttgttaaagcccctgaatggttcaccaatcaatttgaaatcaaataaggtaaaattatgttcaagaaaatcgtagcattcgtgactggtaaagttgaaactgcaattgaacaaaacacttccccagaagaagcctggcgcagtgctgcacgtatcctgatcaaagagatcgaccgtctgcaacatactcgcgtttctgctgttcaggaaatcgtgaagttgaaaaagaaagtcaaagaacacaaagatcttcattctggtaaagagtcggagatcaaaaaactgctggcggcggggcaggaagtgtccaacagtcattatgttctggcgctgcaacaccgtaacatctggcagggcttgcagacgaagatcgaagaactggaagggatgaacaaagagattgatctctctgtcgttgaactggatcgcaaactggctgatgtcaaaatcaacctggagatcatcgaactgaacaagcaaaccgaaagtctgggtctgactgtaccggaagacgtgatcgccgctgtaggccacacctccgtaagcgtcgataccatcgtgacgaagattgatgtgttgctgggtggcaaaaatgccgcttccgtaacctccgctgacgttagcgcttacatcgactccctgaacgcgaaataagaggaaggggcgaaagccccttttttgctatgtacgattacactattgaacgtgatcgcggtgaagaatggttgatttctcgtgcgagaaacttctatgttaaacttcctaaaaactttcatactttaccgaatgatgatactgatcgcttattgagaattctcgtagatgggaatgttccacagcgagtttttcaggaaatggttgatcatgcgtgttctgaatgggataaaaagtattgcgaagaactgacgcatgatagtatagtaaacagcaaccttaaagacgcttacgaacgaagaagtgtatatgacatttacgaaaaagagaggaaagaaatgatgttcgaagacggcaacagtgcatttaaaccagcacgtaaaacgtatccagactggcgcaaacagtacgcagaacagttatggcacattgacattcccgaagcgctcatgaaagcgattagccctgcggttgactactattcaggctggaaagatgaatatgagttagaagtcggttcgtttaaggcgcacgtcatcaaagcgaccagaattcttgatttcgttgaagctgttgcgtcgtgtgatatcgttgaagatattcgtattccgtcaatcaacgtttcgcggtatagttctcctggtaacattcgcggggatcgttatgcgaacctggcaagcactacggataagctgaactttcacaaaatcaatgaaaaaggatttgatggttgtgttctgatctcaatggtggttgtcacgacgcaaggcgaatacaagctgatcattgattgtgacaaagcggctcgtgcaattcccacaatcaaacaatgctttggtgaagatttcaaagtattgatgaaagcccgtgcgatggaaaagttcatccattcgtgcaaaaagaacgtgctggagaagtatgatccggcgctcacatacaccaaaattgataaagatctggtaggtgatttatgctgattaacaaagcgcagtgcaaagcgattaactttctgctgcacgaactgattgaaaacggtatcagatttgaattcgttgatccgattaacggtgatgatcgtcatctgctccgctgggtgtctggtagcaatccgctggattcagtctcccaggttgtagagtctgcgcataacaatatgccttgtcgtgttctgttgggtagcgttaacgcctcaacatggaatggatctgatgcttattatgtcggattcaaaaaagagttgacggaagacgaatgatgttataatatgcccctgtagacaacaaactataggggctaaatcatgaaaatcaaaaatactgctactgaaaatctttgcaacgaaatcgcggtgacttactggaaagaaggtcacgtaaaagcaatgaaggattttcaacagtggtgtgatacccagaagttagccaactgggaatacgccgtaatcgtggaacggatcaaagaactgatccttgagaagaaaggcactataaaatgattcaactgaaattagacacccaagcgctgaacaacctgttcccagaaggaacacaagcgcgaatggatctgcaagccgctgtcatcaagaatgttgttgacagcgttatcggtaagcgcgtaaccgaagaaatcgaaaacatggtgatcaagcacgtcaatttgatgatgccagccaatcacgaaatcgaaaagattgtgcataaagagtttgctgattacattcagaaacgctatgcatacagcaatgttttcgatatcaattcaggcggcatccgtcagatcaaagaactgatcagcgaacacgttaagaaacagtgtaacgacctgctggattcaatcaagctggaagcaatcaacgatgcaaccaaaaacctcaaagcggacgaagaagcgtttatggctcgtgtaaccaaaaacctcgaagtaacggttcgtcaggaaatcgttaagcgcgtgaataatgaattcccgcaaattatcgacgaagcgatcaaagcccgtttgttcccagaggcgaaaggctgatgaactttgaccgcatctataacatggatgtggttaacggtaaaggaatccgtgtagtgttgtttgtgactggatgcaatcataaatgcgaaggttgctacaacaaatcaacatggaatccccgcaacggtacaccatacaccgaagagactgaaaacgagttgattaaactcctttcaaatccccatgtggacgggttgacgcttacaggcggcgatccgttttaccgcaccaatcatccaacgctcttaaaactgcttgagcgcgtccgtgcgacgtttcctgataaagacgtgtgggtttggacgggatacaccctcgaagccttacagagcgatacagaacgttctaagctgttaccattcattgatgttctgattgatggacggtacgaaaaggatcaaccgactaagaaaccgtttcgcggttcggataatcagcgaatgattgagttcaaaaagaattccatcgaaattaaaaatatcgcttgacctggttggtggttctgttaagatatccacgtagcataaatttaacccaattgagagataatatcatgatcctgaatttcaaaacccgtaaagaagcccgtgactattgctggaagtggtcgatcccgctgaaaaacatcaccaaaggaagtggttcacatccgtggacggtgagaaccaaagaaacccgcttcgaaactggtaaagattacaagctggttgatgtcgaaggtttcactgacaacggcaaaaacattgcgaacagtgttcaatcaaaacagatccaccaattactgaacggtgttgtaaacatcgcaagccgtaacggtgatcgctacaccttcaatgctccggcaggtgttgctatgaacacccttcgtgcatgggaagcgaaatacttcacagaagttgctccggctaaagccccagcgccaaaacgcgctaaaaaaccaaaaccagtaggcaaaccgtctgttgcacctgcaccagcgaaaccggatctggattctgaactggatggtggtgttaacctcgctccggcagtaaccgaaccgtctgttgctaaacctgctgcaccacagccagcgctcgtagaagcgatgcctggttgttttgttgccgaccgtccgtatgttctggtagatgaaccaggtttcctgcgctctcacaccgcgaacaaacgcattgtgcaacacatcaaaaacaacaacggtgttctggtgttttcgaatgttgacggcgacggtgacgcgacaatcacgcaagatcgtagcctcccgtttgtgatgcaccgtgagcgtaaattcttccgtgaactgggtactggtaatccggcaaacactccagcagttcaggcggttgatatttccaaacagcaacacgatcaactggtcatcgctgctgcacaggcagtagaagacgcactggcagaacaccagaaagcgatcgaagttgtagcgcagaaagctcgcgcagttcgcgaagccgccgcaaaacttgcactgctggcaaataagtaatataattcgggggtgcttacggcatcccctttttatttgaggtaatcatggaattattcgctggaaaaacttacggtttaaccgtatcccctgaaatctttgcagagaaaacctggaaaacaggtatcgcaaacatcattcgtgaaaaaggttacgtgacgattgatcgcacctcgatcggtgagttcgaagaccgcgcgtttatcatggacggtggttacgaatatgaactccctgcatcactatggaaatggttcaaggaagtaacgccggaagagggtgaattcaccccagaagaacctgaagaggttaatctcggtaacggggtcgagactgaaaatggtatgcgtatcgcaacgccggaagaggtttccgctggtgtcactggttcggatctgtgcctgatggatatccctaaattcacgtatcgccctgtacaggaaaatcctttgcgtgatctccgcatcgatccatcatttggggctaacctggaaacgttgagcatcgcaccgatgccagtacgtaaatctgatgcaatgcttcgtttcgccttgcaacatgttttcagtggtggtagcatctatcaaatcaacatggaatctgaactgaaaatgcaggaagaccagattgcaaacctgttcgatctgcacactcaattaaccgctgttgaaaatatcgaaaaactgttaggcaaagagaaaaagcgtattttgcaggatctcaaaccatacgggaagaagaatgaaagtcgaaatatacggaatccccgaaagtcttcataactgttacgggtgtatacaagcacaaaagctgttgacagaaaaagggatagaatatacattttatcccgttctgaaagaagcgaaaaacgatctgggctttgaatacgatcgcccacgtatcgaagagttagcaaaacgggtaaggcaacgcagtttagcgtttcaatacccgcgtatttttgtcgataacaaacttatcggcggttatctgcaattgaaacaacttattggtgattaaatgagccgtgaaattttactccctgctgcaaatgctgttcatgctgaaacaatggaatacatggagaaattcgttgaacgcgataacaccgcgatcatcactcctactcacctggacgcgctcgaagatcgtcttcataagcagattaaagatcaatttcctgaaaaggttagccgcaacttcattcgtcaggaaatcgttgcaatgatactgaaacattacggcgttgaaatcttcggtgtcgaaccactgaaaccgaagaaagcacgtcaaatgcctaaacagatcaccgacgaagcaatcaagaaataccagaagaaatacgctaagaataaatgatctttaatacgattgaatgtgttccttcaagcggtaaaacaaaggcgattctgaaccatatcaatcaaacgggcgaaaaagcaatcatcgcttcgatttccatgatgttatcaaaacagtcttatgactattacatcaaccaggtaaaaggaaaacgggcggtgattgtggacacggatcaccgaaccaaaagaaccaataacgatgcgctgcgtgaagtagtcaatgattacgatgtgatctttatcactcatgcagcactcaaaaacattgatgactttgatttgtataaggatttttccctgtacattgacgaagttcctgatttggttgcgttcgaaagtctgcgatttaatagcaatatcaagcacatacgcgagatttgcttgccgtttagttgcaatgccgatgatatcgttgatttaaaacttgacgaagaaaaacgagaactggttacacgattagcctatgatgggcttcgtaaacgtgatgatatcgcaatgaagatgttcccgctttaccgtgctctgttaggggctattccggtgaagatgcaatgtagcgattcgggatatgtctgttacttcgtagaggatcatgacgtaagccagtggaagttcaaaaatgtaaccattgcttcatccaacatcaaagacacgattacagggaagatcctgcaaacgtttcatgatgtggagttcaaagattcaccgcttcaaaagctggttgactttaagcaatacaaaaacactgggcgcatacatatacatgtgctcgcagagggggattattcgcggtatacgggcgatctctctcaatctgggacgacagtatacactcagattaaaaaacgcgtggaggcgcttttagggggcgaacagttcatctattgcaccaacacatacagatcgaagtttagcgaggggcaggaaatcccgtataactcgcacggattgaacttctattcaagttatactaacgtggtggcattattcagttacaacccgttaccctggcttcgtcaaatgttgcgagcggttgcggtgtcctctggacttgaagaggaagaattagttgatgcttatgttgtcagtaaatattacgaaccagcctttcagttatgcgctcgttctgatatccgacacaacaacagcaaaagaaagattaatttatttgtgcctgatatgcggttagcgaaatacatgaaggaaaaatattttcctgatgccattatcgaaaccacagaagcagttcaaacgaaaaggcaacgcaaatcatttcaaacccttttccaaatgacggacaaagagaaaaacgcttttacgccatacaagaaaagaaacaaattagattatgcgaatcctcttcatcacgcgattgttaaagattggctgaacaattaccgtgagaaaaaggcgacttgagggtcgccttttttgtttataaatatcagtattgaataagataaaggaaaacgataatggtagctaaatcattccgcgccacaagtggccttgatgctgctggcgaaaaagttatcaacgttggtaaagcatcacgctctgtgttgagcgacggcgtgaacgttgacttttttaacgaatttaacacgatccaacaatacgattctacccgtggttatgctgcgtttatggctatcatgtacgcgcgtcgtatttggtacgctcgcgcagatattccatcaccagcgggtgctttcgatgaaacaaaatggatctcaacccgtaacgatccaaaatgggtatataacaacgtaacgagcactgacggtctccctcttgaatccggtacgtacttaatggctgatggtcgtttctctgaactgacctatattctgccagatgcccctgttgagggtgatattatcaccattaaagacggtggcggtcttgcaggggttaacaacctgttagtacgttcaaacacccgtcagatccgtttacgtgatattcagtcaagctcttatcgactgactcacccatatataaccgttgcgtttatttttaacggcaacttatggcgtgttgctgaaatgcgtgataaccgtgattcgcagtttgttaatgcgactggtttaaccgctttccaaatgcaagcgggtatggtaacattccgtaacagtggaacgggtaaaattacgttgcagttgcctcgttacgcaaatgatggtgactcaatcacaacttacgatctggatcgccttgcttcggtgaacgttgcgactctgcaagtttatcctggtagcggacacacgatcagttatgacggtatcaataacgtaccctctgtgacttcacagcgttccggttatggtattttcatgttcgatcaggctaataaccgttgggttgtttatgacggtgatcagcgcgttcgtctgcgtcgtatcagtgatgacctgaacatgttgccgaacgattacgtgttcattactcctgttgctggtagtcctccaactgtgcgtaacgttacgctgactcttccgcaagatgttgccgaaggtgatcgtgtgtatatcagtatgtacatgatggggaaaacgcagaactgcacgatcaaagttaaagatggttccggtgaaaagatccgcaccaacaaaaacatgatgcagttcccacagcgtaaggattatccgcctaatgattggttcagtgttgacactctgactttcaatgccgatactgactatcttccatacatggaattgtcgtatctgaaagatacgaaagaatgggtagttgcacagtatcgcccgatcattgaacgtgtcgatccaacaaaccgttctcgtctgggtgtgattgcgctggctacacaggcagaagtaaacaagaaccatgaagatacgccgtctgatgaactggcagtaaccccgcgtacactggcgaataaaacctctactgaaacgcgtcgtggtatcgctcgcctggcaacaactgcggaagttaaccagaacacgacagcaaccttccttgatgacgtgatcgtgacgcctaaaaagctgaacgaacgatcagcaaccgaagatcgtcgtggggtgctggaaatcgctacccaggcagaaacaaacgctggtactgatgacactaccgcaatcacgcctaaaaagctcgatacacgccgcgcgaccgaaaccttagcaggtatcggaaaactcgttacaacgggcgctacgacagcggagggggctttacgtggggatgctggtactaacgtctacaacttcaataacggtgttgatctgatcaccccgaaatcattgaacgagaagacggcgaccgaaaagtcaaaaggtctggttgttctggcgactgaaaacgaagtggtaactggtgctgctgcgggatctgcttcaatgccgatcgtagtaactcctgaaatgctgcatcgtaaaacgtctactgaaacgcgtatcggattgattgagatcgcaacccagacagaaacaaacacgggaactgacgatctccgtgctgtaacgcctaagaagctgaacgatcgtaaagcgactgaatcacttgatggtattattgccctcgctaccactgcggaagttgcagcaggtacggtaacgaataaggcggttgttccggttaagctgaaagagttcttcgacgttacaagtcatgttgcggttgctaccgatgacggtttaactcagtccggcactatctggacaacgattaacctggggattgcgtctgctactgaaacacagcgcggtactttacgtgttgcgactcagggtgaaactgatgcgggtcttctggataccgtgttcattacgcctaagaaactgcaagcgaagaaagcgacggataccgccgaaggtattattcgttgtgcgactaacgcggaagcgggtgcgggtactgctactaacctggcaattactccggctaccatgcagttcttgaacggtactgatccggcgtggggtgcaacgacaaatcgacgcggtgcggtgtttatcactaccaaagcaaacactttcatcggtgataatctggttggttctactcaggccgttgacgattatcttgaagatttctatgctgtatcgcctcgcggtctgaactttgctctgcaaaacttcttaccgaaaatggcaacggcgcagaatagtttgagtctgggcggtgtggttgctgcaagctggatgcgtcgtgatgcaaaccagacggtaactggaaataacacgtttaacggtacaagcaacttcgttggtaacgtaaccactaacggaacactgacggctaacgctgcggtaacggttaacaacaccgtaaccacgaacaataacattaaccagtctgcgaaagcaaacactgtttatgcaaatactgttctgagtggtgaggctgcgggaaccaaaaacttgcttcgtacattccgtggtggcgtggcggatacgatctggcatgaaactgttcagggaagcacgtatcgcctggcgacgggcacaacggatctggttgacgttctgacagtaggtgatgtcggtaacggcacaatggcgtattccggtacgaacattcgtctgaatggtaaagctctggctaacatcaacacggcgggtgatttgtttgttgcaagtacagcaacgcctacggtacaattacgaaccgctgcaactaatggttggaacggtgtaacaatcagtaatgacggcggcacaaccactgcaaccgtgatcaacacccgaaactttacccagcatcttgacagtacctatgtcaacgtagcgggtgatactatgactggtgcgctgtcagttagcgtaaacggtacgggtggacgctttaccagtgtgagcggtacggcacatgttcaggcgggtgatttctctgggaacgtccagaaaatgcgcttaactggcattgacgataaggtattgactgagttcaacatcaatatcaccgattacaacaaagcgatgatcaacggaaacctgatctatcatgcaggtcgtaaaccgactccggcagaaatcggggcggtggcggtagcgggttcaaccgtcgatactctggttgtacgtaactatatcaaaatcggtaacgtgaaaatcttcgcaaacccagcaactaagacttgtgaatttgtgtgggaggaataatttaaatggcgaataacgaatttatggcgttattcggccctgatagtttcacggcgagtgtgttttcagaagcaaacgccgtgaaatatcgccttgttgtccgtggaacgaataacgattctgcggtcaactcggttgaggtatctatcaatggggctgatattattaaccgaaacgtacagcgcggtcgagggattaaccttgctgtaattgacggtacgagtttggctttgctggatttcaaaacttttgatatgtatggtgatcctactacgaatgggactgcgattagtgattacctatctacacttccagcaaacagaattgtatgtttctatacgttcgatgctataaaatctaccgatgcgtttttgagttatatgcgcacaatcggatcagttgcatggcctgaaacacgattctttaacacgccgtcatcatcaacaaacaacccgcaccgttcatcctattcagcaatctattcatccacgatgaaaaagatctgtatggaaaacttcgtaggtggttctggtactggactcaaagacaacacgacgagttttgttgaggttgtattcgatgaattcagtgatatcggggtaactggtattcctgaaagaatggttgatgatgttcaggtatatcagaacagtggcagtgcttacggcttccatttatatgggatgtgggatattggttctactgttttcttgggggacatctttaagttcactggtgatgtttattgctcgcaagaacttcgcaatgctggcggcgaatgttatctctatatgtggacacagaacgcctctggtcaatggatatcctctgcggtactgcgaacaactgggttagctcctgatgaatggcattctctgtcaggatatttcactatccctacggacgcgctaaacgtgaagatgggatgtatggtatatcactacccgtctaccgtgaaagtggggcttgctcagtgtcgcaatgtccagatcagtaaagttccacgaatcgaaaccgatcgcaacggggcggcaattggtgtaaatggtatcaggatgcaaacgctttccgaagttgatgatgctggaacccaaaacccgattgataaattgctttctctgcctgtttcgcctactggggttattagtgacaagaaaatcagttcgcataactttgctgaacttgattatattgtttctgatccggttgaatacacttcgacaaatacagcggagtaccagttcaaagaatggactgctacccagcaagcggcggtaacgaaagcatcactaagcagttacggattaaaagctggtgatacgatccgtatgcaatgccaaatgaaacgcgatgcaaatgcgattgctaacaataaaggcgcatatattgtaatgcagttctgggacgcgaataatacgtatatttcagggatcaacatgcgtgatgttggtacgatcccgaacgtatattcattctacaaaaacgaaggggttattcctgctggtgcggttacgtttgatttcggtttatatcgttatccaaacaacacaaacatcggtacgatatccgctaaagacgttaatttgtcaatcgtgagataaaggggcgaaagcccctttttcataaatacagtcattacaggagaaatttttatggctgatttgaaattaggtacaacgctgggtggtgcgggtatctggagtgcttctaaccttcctctattgccctctggtggacaattaacgtataaaggctggagagtatacacagaaaatgatcgtccaacagcggaggatatagacgcactatcgacgattaacggcggtactgttgcgaagaatactacattcaatcagaatttggttgtgggtgcttcattaactgctaacttgattcaatcgaatagtgttcttaccatccaacgtagcgcaaaccctgcggaaatgattttctatcgtcccgatattacggcaaccccgtcatctgaagcatgggttttaaacatgtatgcgaaagatggtttgaatcgaggcatgggttcgttgattatttctgctagtactgacggtggaaataaagtatatctgcgggcgaataaagacggttcccctaatacaagtttaacgctggattcgcaaacccaacaggtaacagttgagcaaggatcttttcgcgtaatcggtactacgaatcttggtgtgacgaacgccgcatcaatggcggttagcggtgcggtaactgcgaatacagtaaccccgacaaactgggctaaccatgatgaacgatatatgacgggcattcctcgcggtatgtctggaacaagtttcggtgctgctgttgtaactgaaaagaacgatgttctgtcggtaggcggtaacatcaccgacggtccatatggtaacactacgtattacgggcaggttgtcaactatcgccgtacattgaatagtggtgtttctctggttcagacttactatgatataacatcaacatggattcgtgctgcgacgggttctcctggtgcatggtcttatagtgcgggtgatgctaatggatggagaagaatttatgatacttcgcttcctccgactccggcggaagtaggggcagtcaataaatccggtgatgcgatgactggtgttctaacactggcaaacatatctcaaccacttaaaacacccggcggtggtgttctggctaatgacgggaacgtgtatatcaacaaaagcgggtttgcaggatggattgatgctttattcttgaaaaatacaggtggtactgtaacaggaacaatcaaccagacaggcgggtattttgatacatctgccgaagggagaggttcatgggcttcacaaaacaccgcaaaagctccaattttccaaaccattaacacaacagcaacttccgaatactggcctattgttaaacagtattacacacaagctggtggtgcttggtctatgggtacgttggtaaacactaaccgatttaccgttcattaccgcacgagttcggtagatcggcagtggtattttgacaattcaggtgaatttgtatcatctggtgatattattaccacctcggcaaacggatttcgtatcgcatatggcaacaccggatcatttattcgtagtgacggaaacaacacgtatttcctactgacaaatagcggtgatgtttatggtggatataacaatttgcgtccgatttattacagcaacaccacgggtgctgttacaatgggacatacgttatccgttaatggtcgtattagtcaatctagtagttatattgacaatggaaatttaacattaaacggtagcggcaacggacgcgttgaatttattcgcagtggtgcaaaccctcgcgatatgtatatgttccatgctggtgatgcttctcgtggaaaccgtattgaaatctctgatagtgcatcatatctggtttattttgaacgcaacccttcatccggcattcagttggtaatgaacggtaacggtagctttagcgatgtgtatattcgttctgatgaaagactgaaaagcaatttcagtaagattgaaaatgcattggataaagttgatttgcttgatggtatggtgtacgacaaagcaaatcatatcgggggtgaagaaactacccgtgaggctggtttagtcgcacaacaactgcaagaagtattaccggaagccgttaagaaaggtgttgatggtgaacagaacgagatcttaactgtttcttcttctgctgttatcgccttgctggttaacgcggtaaaagaactccgtgaggaagtcagggaacttaaatcccgctaattaaaagcccttcggggctttttctttttataaatatcataaaagcatttgaggatctaataatggcagatttaaaagcgggtactaccgttggcggtaatactatctggagtcaggcgaacttgcctttgctcccttctggaaacacaatcacatataaaggctttaaaatctacaccgaaaacgataagccaacaaaggcagaaatcggattaggcaacgtaacgaacgatgcacaggtgaagaaagctggcgacgatatgaccggatctctgaaccttacaggaccggatagtcaattaactgttccgtatcgcctcctgatgaaacgagcggcaaatggcgatccctatgtgttgtttgtacgtccagacaacaacccaacaacggtcggttatccatcaaacacacttcgtgtaatgactatcactgctcgtgccgcaactacagcagatccggtttctggtgctcaattggctaacgtattagcagatcagacagcacagggtaacggatcactaacattgcaagcatttgcagccccaaatacaaccacaggcgcaagcggtgcgcgaacagcagagatttacctaaacggcaacgggcaagtatctatgacgggttccggtttaacgataggaatgcagactgttgttagtggtactatttttggtacacaaatggctattaaaggcgattcgaaccgaaacctatacttccaggatgctggcggtaatgagcttggtttgatctatgctgatacaggaaagaacttatatgttcgtactggcggtggtgcatatgcaactcgttttgcatctgatggaactttagttctcgctaaccatctaaccgttcctggtcaggctacatttaatggtctgggtgtgttcaataaccgtgcttctgtaggcgtagattatgattcgcaaggaataaactcagcgattcttcgtgttgaaacaaacggtgatggaaacggggttggtgatggtgttacccacttaggctataaagacggcaacggacgatataaccattatttccgtggtactggttcgacttctatcaacaccaaattggggcttaacgtaaacgtaccatcgtattataacgacgttccacagggcacaccagcgcaatatttcttacctactgttggacagggcgggaaaaactatttgcgtcagttccgaggcggtaacgcggacacaatctggcatgaaactgttcagggtggtgtgtggagactggcaacaggttctacagacggacaggaagaattgcagatttctactgcgggttatgctcgattccgtaacgaagttcaaagcgctacgtctggttctggtggacagttccgcgcggtacaaggaaactacggggtaatacaccgaaatgatggtggtaactactataccttgatcaccaactccggcgatccttatggaacatggaacagtttacgcccgattactatcagcttgactactggtattgtttctataggaaacggcgcgaacattaacggttctgttaactttggcaacgcggtaaacttcaacggaacggtcgaaacaaacggtattggttgtggtacgccaaacggattgggtacgactggtatttctctgggtgataacgatacaggtttcaaacaggaaggtgacggtattctcaacgcctatgcaaatagccagcgtattatgcgatggactactggtgcaactgctaactataaacagttacaggttcagggtgttaacgggccagcattacttctgaataacacagcgactaaccaatcatgttatttgctgattactttggcaggtaacaacggcgcatacttcgggtttggtggtgctgatgataacgtatcggtacacaactaccgactgaatacgaccttacagttgcgtacttcggatctgtatatgaaccgtggtctgtatgttgaaggtaacgtaaacgccaacgatgtgtatattcgttccgatattcgactgaaatctaatttggttgaattgaaagattcattaagcaagattgaacagcttaaaggttatatctacgataagcaatcaaaagatgctgatgatatcgtataccatcgcgaatccggtctgatagctcaggatgttgagaaggtattaccggaagcagtgcgcgaagacatcgacactggtatgttaaccatttcaccttcgggaattaacgcgcttctggttaacgcaatcaacgaactgcgtgaacgtctggaagcaatcgaaaacaaattaggggcttaattgcccctctttcatgaggtatttttatggctattgtaggagtccctggctggatcggttcgtctgcggtcacagaaacagggcaacgatggatgtctgctgcgggtaatgcggttcgaatcggaacaccgttttatatgtctcgaatggcgggacaatcggtatataacatcaactttacggtgtatgagcgttactataacaacgcccgttatcgtggtcagtggggggttggttggtattcaccatattcgaaaccttccggtcatgatgcggttggtggtagttttaacggcaacgcattcggtactgtagttgcagcacaatcaacacctgatatcagtgtaattactattcaaaacggtcctgctgtcaacctacgtcttactatggatgacggcggtgtattcgattttgacaacaacggacgtatacatgatggatatcgtcaatatcaggttgtttcttctcaggcgaccagttggtatgactatctgaacgcccgtacaggtcagaaccgttctggtttggttacgcaacgttaagtaaattcctaaatatattcgggggtcggcatccccgaacttgaggtttaaacatggcactattacaagataaattggcggtgcttgaacgggtaatatcgttcatcatggcggtcaaaacatggaaacagttattcattaaattggttcttatcgtcactattttcattatgttcgtaacatggtacaagtgggatgacttattttcagtctggaaaacatcttcaagcgttatagacgtgccgacgatggagattgaaaaggcaaaaaagtttgaatccgtatccatcgaacagttaaacatagtgcatttaactacgggtgcggatttttcggcaatctttgggttcagacctaagaatgtcaattattttgttgatataattgcgtatgaagggaagttaccgcaacagattaacccgaaaaatctgggtggctatcctatagacaagacatcggaagagtataatagacatataaacgggctgtactatatctcagatattgcaagcccgtatcttccaacaaaagaccttgttccggtagcatatacctttagttgtccttatttcaatctcgaaaactactattctggatcgattctaatggaatggtatatacagaagcccgaagtcgccgatacgaagttgatgatcgtgtgcaatcaggccgcaagaattttaggcaggattcgatgataatttcagtttcaaactactcaaagcccgattgatgaaatcttttactttcgtcatcgggcttttatcgtatatgtcccatacgcgcatgagttcgtaaggtgtcggaacatattcatcgttccagtatccaacattacctatcgtaatgcgccggaaaccagcctctacgctgtgatatacaaagaacccagccttacccacaggggcgactttaaaaccgcgtgtagcggctttcatggcttcgtcgtgtgtcatgatagaatcacttcgcctctgtattgattgtgatagatgtatggacgaacacccagtgggtgattatctatgactaagatcgggtcaagttcgtcgttgttatcatcttctgcaactatatcccagtcggtcgctttctgttcttcaacactggcaatgaatacctggttaatctcaaccttacggtgagaacggcgaatgatcgtatccccttcgcggaacacgatcatatctgggttaatcgggcggtacgcggttttacccgcgcacacttcattaagcatttcttcgtatgtcattataatacctttactcgctgaacgattgtttgtttaacttctttgtattcgttgtgaagtttaggtgtcgctttgaagcgaatcacatcaccctcttcaacaattttgtttccgtagtagataaccacgttaccatctacgttgattttggtcatgaaacgttccacttcggtgtaataagaaacttgggtatatccgagagaaatcactttctcaacaaccccgctcatttccatacgcttaccgatttccccgatgtgctgtgctgctgcgatcttcgcctggcgctctgcttcccattctgcgcggatctcttcacgtttagcgatgtaatccttctccagcgctacgcccatgcagtaagagcaaatagcctgaaatactgggctatcgttgccgttttctttgcactgatcagcccaccacagaatcgtatacatcggcatatcagcaatcacttcacctttacgcttaccgattggcatgatgccctgttccagcagttccaggttttcggtatcctgtacggacagtttaccgcgacgttcaaacagatcgaaatctgcgaagccctggaacaccatctggaaagtatcggtttggttcagacgatccaccatgcgatcgaagtattcacgcgctttcgcttccgctttatctgggtcagtagacaggttgcagatatagttatcagaagtgaattcacctccacgacgctctacacgcagagtgtacatagcgtttttagcgccagaagaaatgaaatatgtcgcggtaactttagtcaggttagtcatggtgaatctccttagtggtttcgtttcgacaaggccaatataacaaaagccctcaaccgaagtcaagggctttttatcatgcgttcgaatctttcataactttatgaagatggatatcaaaaattttccagtatgcttttccgcgaggataaatttttgctttatcaatgtcttcgttgcttccccatgtattgtttgggttacgacaacgattttttgcataatccatgtgccagaataagcgctgcaccgatgaatctgtgcctaatggatcttctttgctgaacagaatttgtgaactcataagaagaaacctgttcgaactactaaatcgatctgtttttccggtatcagtggcgctttatcgtcaacgttgcactgataatacatcccgacatactcatgaggaacgttggattcgctcgcccatttcaggttgtcatctgtacgcggccctaacatgaggttaacgatattgacagcgtgatcctgttctggggtattgttgcatccgttcacataatgtccgtgagcggttttgaggatttcaatgatatcttcgtcggcttcaacgagatacagccccgtgttttctgggatttcctcaagaataatcaaagcggttttcatcacacttacctttatgtttctgcttacgttttgcttctttaagtgctcgcttgcgatcgcggtgagtagaagcgcggttgaaatcatgtttcgctaccaggttgttcatcgaggatataatggcacatgatgttgaatactgacttcgccatacagttttacgatagttaagctatcagatcctttaacaattctgtatttttctggaacaacgcggtcgatttcttttttgacaaagttaagcaatccgaagtcatctatatcttttggtgctttggaaatagaagacaacgatactcgttgacgtgaatcatagtacgaagaaattacaaacatatattattttccttattggggcttttcagccccattttagataattaatccagcagtttgcggatcttatccgcgatacgtccggcgcgggttgcgcttgcggtgtgatcgctttctttggtagccagttcagccagcttacgctgatgttcttcttccgctgctttgcggtctgctgctacctgttcgacctgcttctgatcatgcgcaatacgcgcttcgagttcggtcagggttttgtcaaaagttgctacgatttcgtctacagaacggattttggaaaacagtttcatattcattatctcaattagtatggttggaattcaaagtcaaacagatcatttagtgcgcggttgtattcagtatagttctcaccatccccgaaccgcatctgaatcgcgctttccgctattgtaccagtaagatttgagaaaccaaagaggtttttaatcttatcgtgtgcaacgaagtacagagaagcactatccagcaaggccaccatcgctgatggttcatgttcgcggcgtttgatgcgtaacagagtacggtttgcgccagtcttacggcgttgatttggggctacgtagaatcgaaatactactttacccgttttatcatcaactaccaggtagaagccgtgttctttcaggtcaaccccttcgaacttggtgaagtcaccacgcttcatgtcacctatcttaacagcatatttgtggatgtcaagccttgtcagaattcttttcatttttcttcaccagtttatttcctaatttggtgtttacaccagttttcatattcattgtcagtaccagcaagaagatagggcatgacaaaatcaagatcgttgcgccgaacactaagcgaactaagcgaatcaacaacgtcccgatccatttcatcggtatctctacccacttctgaaccgttgcgagtaccagcataacataacccagattaaatgcaagggctgttgcgataataccgtaaggttttttgaagtatgtctgttcaccgtcttctgtacgtccagcggtaacgttgcctccgttccagatttctttagcggttttaatggctgtttctgccccgctcaagttctgccagtagtcgggggtactctgtaggaatttcataatcgaatcctccgcgcctgaatcgctccaggcgctgttttggggttagtagtgactgaatcccacggttacatcacgcatcacctgataacggcatacacgcatcttagcgttgtcgtaatctgtcgggattgctacaacatcgcgaggattgaccttaacctgaatgactcgcccacgtccaccgccataatgaggcaggtacgattttgcggcaacatgcaaaccgcatgaacaggttcggtttttattctcgtctacctggttacgtggcatttccaccacaacaccaggggagttatcgaacttaccggaagccagatcgcggaagtcttcacgaacacgtttccacgcgtagaaatctccgtcatctgccagttcgatatcattatgcaccatgaacccataaagctgatacacagcatcgcgtgaagggttttccatcaacttctcgaagaagttaaccaggtgctcgtaagggcggtcgttgtacatttcacgaacgatacgttgcgtgatgccgctgtcaaacacgatatctttgtacaggactttatgcccgatgattttaatgttgcctttgctgtaaatcttcaacgcttgcgttgtgtccaacagggtagcaactccctcgatgtctcccttaaccattaaagcgtgtgctttttcgaagttagggtgtgacgaatccgctgtgatgatcttgccgtccagtaccagagtaatgaacgattcagaaccaatcattttagatttgacatctgtttgcggaagtggtttcgtcgcttccgtattatacttagcgtgttgctcggtaataacgcgcccgatggttcggacgcttacaccaaattgtttagccagtgcggttttgttcgcgctggtaagaaagccctcatagactgctttcttctgtacatcgtcaaggatcttaacgtttctcattatttccaccgtataaggttaatcaggttcgtcttgatcttatcgtccgtaatcatagtacggcctaaagagtaagacgaattgcgcaacacatacaccaatgcagggttgcgttcttcaaacaaatcaaaggcggtatcaacacgttctttcatatctttcagcattttgtaatgcttcacagacatttcacgaagtaacgggttacgcaccacatttttggatttgtttttgttctcgatagtatcgtaggtaaacttaccatcaagataatcaagcaacaaatacaattctgaattatagcggtttttcaccatgcgatcaagagtcacctccagataatcgcgaagggttcgaacctcgctaccgtgtttagacgagatccaggctggataccagttaggcttcatctttttcaccgcgtcggcaaaacgctgtaccagatagtcatcaagacatttcatgttgctatctggaatgcgactccacagagagtttcgcagaaccataacgcctttcagcccagtaactttcaacagggtcatcatactgctggcaatactacccagtgtatagttcggtgcttctccgtccagtcggctatattcatcaagcccatagaggcgcatagcgtacatttcatccagtttcacgaactgtgctttagtcaggaacagatcatttttctgtaagttaccctggtcatccaggaagtaatgatatgccgtaggcgttttcggacgtggttcagaatcaccagaagatgattcacgcgttgctttccagcgcttgcgatcttcggtgtacgtttcgaattctttggtcaattcactggttttcagtgtaacgatctcagattcatcgaaatagccagtttcaatcaactgacgcacagagtcacttttacgatcggcagttacgaaactgatacgatccgaaccgttcatcatgcagtaaccgatcagatacgggcggagtgaacgcgcttcgttatcattttcaacgatgaacagtttcttctgtcgccacggttggatcatgcgcataacgtcctggcgtttggtggtttccgctttatacttctcataacggcgaccagaacccacacgttcgaatacgcaatctttcccgtcatatgggttagcccagaagccccacacatattttccggttgctgtatcagggtttttgatgcgcgtcagaatttcagccagcgattctttacccacacggaaacggttatcacgggttacgaatgtctgtaacaagctaggcagattattgaaccatacgagtttatcgcgggttgtcttctgctttttatactgttccatcaactcttcatcaaagcgtttgttgattttatccagtcgatccgtaatcactttcttcgtgactttatcaaggctcaactcttcacgcgacggcatgaagtccagcgatcccagagggaaatccagaatatatgcgtaattgctgttacggtagcagtagaacagcgagttttcaaacatatccaggtcgattggatagcaaatgttacccatacgcgcgtatacgcctgaatagtttttagactgataacggatgatcccgcgatcgtctgcttcttttggttgccagttaacatcaatctgaacaccaataaagcgcggacggatacctgtaaacggttcataaacacgcgccgcttctctttcccattctgcgatatcttcaactttcacaggaacggtgatttgaacgccgttaggttcgtctgtttcgatttcgtagatttggtcaacgaaaggttcaccattatccatgtaagccgtgtatgcgcgtttaacgccgtcctggatggattcgatagtgaatgtttcggtgtaacagaacggggatttactacccagtcccagcgccccgatcagttcgtcggtgtcggttttggtggattcgaaataggttgcaaacacctctttaaccatccagtcacttaaccctgtgccgtaatcacggacgatgaaacgcggatcgagaacagttggtaactgaacatcgaacgggttcatgttacccgctaccatatgaccatcaatggcgttactggagatttcgcgaatgattgcgcggatcttgtatttgtagatggttgatgacatgattttgtatgttttcgcactggtagccattttaaacttcgtgcgttcgcctttatcgaagcccgtagtgtgaatggtttgtggtgctaactgacgcaatttcattgtttatatctcacttggtgttgaagatgatgttatcacatgaatatttcataggcttttgatcaagcccatactcaacaggtgtacacatccggtcaaggtattcgtaaacctgttgcttctgacgttcgcggtctttcatatccatgataccgaccacgatagcagttacaaaacatattgcaatagtacacagcacagctattgtaatatattttcccgtttttggtgcatcatatggtttcattgaatcgcctctgcatattgttctggtgtcaatttacgcgctactaagcgccctttggttgctcgtttgtttcttgaaatgtagatgtttgcaatgttgcgtttaccttcctggatctcattgtacatcttttcggtcatattgcactgataaacttcaccgttcggagttttcaggaaaaacgcgtatatgtctttttcgctttcctgaattactgatttctcacggatacggcttttgcatggtgtaggctgtgcgcccaactcgatagctttacgctgccatacgatcccgtgtccagccccttcggtcagagcatgtgcaatttcgtgcatgagagtatctaaaacgttctcgtagatatcttccttaacgtgagaacggcttaattcaattgacttgcgactgtaattgcattgtcccagagtacgcttgaaacgtccgttaattttgaaagaccaatgagataagccatgcttcgccatgatgcttttggcccagatggttatttccatatcgctacgagttttgaacattttatatcctccccaatcagtgaggacactatagcaaaaaagcctcccgcgatgcaagaggctttttgtaaattatttcaatttcttcgaaagttctttcaaatcattgagatattcagttttcggggttgtttcttcccagtatttcagttgcttacgcagttcgttcgcttcgtcttccagcttttgacgttcatccgtggttagatgatagatgttcatcgcaaccaggatttcggcgtggttctcgcaacccgtccacgtagagacaagtttaaccgcttcgctgcgactaagccccttcaacgcgtcaggttgtgcgatcatctggtcaatgaagtcaaccttcgccagcgccttatctaacgcttctttagtctcctggatgcgtttatcaatacgctgttggtaaacaccaatacggatatcaacgaagtctttcagcaacgtttcaggacgctcgtatgaatgcagtttcccgttaaagataacgttgatgttcgggtttgagttctcaatcaatccgaaatctttcaggatcttctcacgggtaagcccgtttgcgtactcacgtttaagggtgatttcgtagcggaaatcttcttttgatagatccttgtagcttacgatataccctttctcttccagcttatccaggatagagatatatttcacgcgatcgtacttgaccggaatctctgtgatcaccagtttggttttaccctggagttcatacttgccgtaaatagtaccgttttcaatgtcacctttgaaatgcgggtatttcagatccagtgtgaaatctttcccgttcaggtaactaacacatccattcagaaccgaaatcggatcgtgtggtggaatgttggtagcgtatgctttcgcgatcccgctgaacccgttaaccagtaccatcggaatgattggcaggtaataggctggcggtacgtgttcaggatcttcatgtgggattgttaaatcctcgtccatatagatagccttgaacagcggagacagcttacatttaatgtaacgcggtgcgccaggtttcttaaccagacgggaaccaaagaacccgtcgcggtcaaaaagcgggatgttattgcaccagtgcgccgccataagagacaatgcctcttcaacggatgtttccccgtggtgataaccatacattgcaacaccgccagcgatagaggctactttctggaagcctgtaccgcctttcgctgcggaatgcacgaagaaacggtgaacgggtttgaacccgtctaccaggtgcgggatcgcacgagaataaattgtgtaaagagcaaatgtaagcccctccacctgtacaacgtctttaatacttctttccatcatttcaccgaaaatttatgttttccgttcacccagtctttacgcggatcggattcatcaccgaaacacagttccagaacgtctttgtattcgtcgcccagtacgattgtatcgtattttaactggtcgcccaacacccgatcgtaatcttctttacgtaaagaacccagccctttgatatatcgtacctctttcgccttatcgcggaacggtgcgaaatcttcaagggagtagaaccatttttcatctttaccgactttcgcaatgataatcggtgtgcggatataacggatctttttcttctcgaacaactcaggccagcggctaaagaacgcaatcagtagggtgagaatatcgcccccgtcaacgtccgcatcgaccatgatcccgatgttgtcgtaagtcatttcggaagagtcgcctggatggagattcaggatcgccatgagttcagacaattctttgtttttgagcacttctaagttactcattccccaggtgttcaacggtttgccacgtagcggaaatgcgccttgtgtctcttcgtttctgcactcgataaactgccccacagcggaatcaccctcggtcagaaacaaagtggtttctaccccgtcagtgtcgatccctgatgccggaacatgttttgcaaccttcgcctttttcgctttcttcttcgctttggtaatggctgcggcttctgctgcctgtttgcgaatcagagcggactcaatgatcggagtgattatttcagaagtatccataatctgtttcgcgatctttttgtagttcagtccggcgtggttgttgaactccccagcggtgttagtcagtttttctttcgtctgactatcaaaagctggtgcattgaagttatgcaaaaacacaaccaaagtcaagcattcttttacacgggctttcgggatctcgatagcgtgtgttttcttgatcatcggttcgagttcggaatagataccgtcgatcatggtgtcaacatgaacaccgccgtttttcgtatccagaccgttaacgaaggatttctgtttgaaaccgtcttctgtgctcgccaagatgaaactgattttgttgtttgtctgggtaatcgttttatcgccgtacatcgcgccatacatcgcgaatttgttcgggaggatatcgccgttatatgtgaatttaacggcagggaaagccactgcaagcgccataaggcgatctttgatgacttcctttgtctcttcgtcgataccgtccacaccgaagatagagaagtcaggggtaaacttaacggttgtcccttgctccttcgtcgggctggtgcggtaatccatgttctgcgccccgtccgtacagttgatcgtgactttgtgtttaccgttggatgtttcgccgataaagatcgcgctgtaacagtttgtcaggaaagaacctacaccgttcatccccattgttacgcggttttcgtcatcgaagttagaaccggatttagccattgtccaggctgcaacaggtttaggaacaatcttcccttccggcgttctcacgtcatcttgtggaataccgcgcccgttgtccgaaatcgttaccagattgtgatcaatcttcacttcgattttgttcgcatatttgaaatcagttcggatcgcttcgtcgatggagttatccaggatttcgttgatgattttcaccaacccttccacgtattccactttgcggaattgccccatgataaaacgttcatgggcttctttgttcactgaacccacgtacatattcggacgtttgcgaatgtgatcgcgatcgctcaagcagaatgattcatccaccttagcgccctttgctggggcttctggtgctttctgcggctcgttatcgtccattaagaaatctaaactcatattcacctcgttattagttctcaggcattatatagggttctatgaaaaagaaaacccctttcggggttttacttgttgtacgggaatccgtctttcaccatctgcggcttatcaaccgttcgtttcgcctcgcccccgcaatcacaatctttcggttcgtcgcggcttgcgatgctggacattttcggaaattctttttcgcacttggtgcatttataggtatatgttggcattaataaatctctgacaatggaataaaacggatcggggttgcggctttgctgaaaacacattgcttgttccctgcaaacatgagatcagtttcgtacaccatacaaatatatccctgattctccaaaatttgccgctcccagctatcgaaccatttagacaacttctgcaatgaagagaagccgaaaatatagctacgataatttttaccatgttttttgaggttacgcattaaacgaaggtcttcgcatggtgcggggtgacgagtctcggagataccgaagtttaaaccgaactcgattccatgaatatcgagatactcatagagatcgtcttcatcaccgacacaacccgtatacggccctaactgtttgcaccaaccatcatatgacgaaaagatagacgctttcaattcaacgcgataaaccaacatgatccgatcctcgtaattgattaactacaagtatcgtaccacttatctaatttcttatcaagcagtttgttgatcacctgtgcgatttctgttgttccgtgggttgtgctcaatttcaggtaaatcacatccagtgcgcacacgatcgcatcaacgctttcttcgacgatatcaccgccgcgttgaggctgaacgagacattcggagatctccccaacctctgcggacaggtggtgaaccacgtcgctaacggttcgttttttgacgctatgagcggtcttgaaaaacttatccagaactacagcggaattttcgcgcgttacttcctcacctttattgacgtggatcgtaatttcagtttctggttctggtgcaacccataccggattgaaaagccctttcatatcgttgaacttgataggaacgggaataccttcaagataaagaatccctgtttcttcatacaccatactgatccggcgtggtgaattgaagtccatcgggttcttacgcaacgcatcatacatacgacgaatcgggtcggcttcggatgccatttgacacacagccattaacatagatttcggggcgtacatatcaccaattttatacttgctcatttacaatacctttatgataaccaacaataaaacagttcacttctggacgttcgccgggaaaatgcacacattgcatgacgcgttcagccatgagttcttcgcccaaataaacagaggttgtttcttcgttgtaatggcaatcatacgaagttttaacactcataccaggcaatccggcaatatgcataaactttgagttcgtgcatggttttccctcgatgctttttccgtttacatcaaacgtcatatgcatttcggttttgctgttctttgggcgtctgctcatttattcacaacctcattatatgttttcaggttccattcatgcacttccggcactttggagtaatgatccaggaatactaactggacttgcataacactagcacgatccatattgaaaaggaagcgttgcggggaagtaatacacagaaaatcttcggtacttcctctgcttgcgctaaactcttttgtttctccgccgtcaaatttagcatatacaggcgtagaaaaatacggggcgaatagttcgcgtttggaatcgtccgtaatcgcactgaaacacacgtctacgagctttccggttccttcccgtctgatggtgagcattgtccctttcgtgcgccctaagacgtttacagagcgcgtagtgacatcaccaaaagcgtttgtgtaactcacagtctccacaaagcccatatcacgacgctgttgtagcattgcttcgtgttgtgcttctgcatcctgttctactactcgttgtgcggcttcatacgccgctttgttcggatctcttgattgccatgcgaagaataaaacccctgcggctatcagtccgaagattgaccaacttgcggtcgctgatagtttcattttaatattccaaaggggccgaagccccgattttagcgaagatagcgaacgtacccgctacggtcgatcgcgttctctgggttgttgaagatattaccgcgaatacccttagcaggtgctttccatcctgcggctttcaggatattgccgtcattgtcgatgaagccagcaactgaacgctgattgaacatttcaccagtttctttgttgcgggtatcctgcacgatacggtgatacttacggcctttttccagaacgaacacagtttcggtgtaatcgctgaaccacatgccagtgttacggcctttatgcatcgcgtccagtaaaggctgtgctgcggctttcagttcgtcaaaagtatacatggtaaaatctcctaagtgtgtttcgtttctatgggataactatatcaaagctatcccatgaagtctttagcaaaaagtgctatttgttaaacccgtttcccttgataccatttcgggaaaacaacccgctcgataaaagttcttcccaggttgaaactatcaccgaacaggagaacaccgaacagcggatcgcgtttgatgtcatttttcccaacagttttcattttcccttcatggatcacggtgtcgcccaccgtgatatccttgatgcttacttttacatgatgcatacgatcacctctgcgagtttagcaggttttgcttctggtctaactttcaacgcatcattcagattcttttcaaccataactactgcgtcgttttcgttgaaaccgttcttaaccaggactttaactactttggcttctaagtttttcatgatgcgttccttttgtctgtttcgtttcgatgtgtgtaatatactgcatatcgaaattcaggtcaatacccaaatcaaagaaaatcgtatttttcttttaatttttcgtaatacgtatcccatgcggcttcgtcgttgatgatctcagtaccgaaccgataagcacgtttgcgcagttcgaaacgttcacgaatgcgctcaacattgattttcactgattccggcgttggttgccaatctgcgcacaaatgacgatgaaacagggagtttgacagcggactaagatcgaaatcttcgtatgtaccgtccatgtattctttaccattacgcgcgaggtattcagcacgtaatgcagcatgacgatcgcgaaggtatcccagcttattgtaaaagaaggttacgtgtccggttcccagcgtatacacagcagggatttttgacaggttgatttttgccttaccggataaaacggcattgggaatgcgagggagttcgcgcagttctgcaatcaggtgttcgttcagaagaagagaaggatcgattgtgttaatacgtgtcatagttgcctccgtttggtatgtgcgcaatatacaaaaaagccccttgcattgcaagaggctattaaaattattttgaaagaggtataagcatctttcgcataccgccgttttgtgtggcatcatacacgcgtttagcatccataagggagagttcaacatggtatgatttccctttcccgtcaaaatcaaacgttaccgtaccgcttgctacgcttacatgagtaaagatgaactcacccgcgaaatgctttcgaaacgctttgtcgtgatccaggaaccattcaaacgcttccccgtgctggtacagtctgacgataatcattgaaactatgatgaaaatcagaactgctgcgacgatcgtaagctctttcatcacttacccctgtttacagattgacggtgtaacgcacggttaacgcgtggcgcttgataaggtttcattttgtacggtgttggatcagagtattcgatccggttaggtaatgaatacatttcaacatttggctgaatccagcggattgagtcgattaacccttgagttaacgcacgaccgaaacctacaccaactaaacataaacgcataatatccccttactgtgccagaatgtgaagccattcacccaaccacacgatcgcctgataagacaaccacaccgcgccggacacacaagcaatcacaccaatgatcgcgaatccgattaaaatgttcaaaccttctttcaaatcaccaaacatgttttatcctcttttgtttcagtccctacaaaataacaaagcccctgcacgaatgcaagggctttttatcataattcgactaactgaggcaatttcagaaccatccctggaaggatatagcttgcattgctaacggttttgcggttcaacttagcgatagactgccagcgctcaccacaaccgtataatttttcagcgattgaatacatgctatctccaggctgaacaacatattcatcgtattcgactttaacgaacgcggggttcatgagaatgtcaaacatctgcgctttcgcttcgttcagtgtttttgcatgtacagttttacctacaaatgataatttaatcatcttttcctcggcagactcaatggatcggtttcttcttcacttgggggttcttccagccccagcgcatatctcaatgaatagactatcatcaaaacatctttcgcgcaatcgtgaattgaattatgcatcacaaaaccatcaagcaaccctttccgaagaggacaggtcgaagcatcacgcgttaacaggcggttttcgatacatgtacgcacatcgcgactattccagaacacggtcggcatatcttcgaagatgtcgatcttgccaaccatcttacgcacgatatcaaccaggataccgcgatcgaattcagggccacgaacataatcgagtgattgccaacggctcacaccgtccgcttttaggtcttcaaagaattgtcgatgtcctgcatagagttccagatcttccggcgacggtttcaggatttgacgggcttcttcgctttgctgtttccaccaggcaattgttccctgatcagcaatacgatcaggctggttacgcaaatcaaatttgtactttcgtccccgtgcaaccagttccgcgaacgttggcgggttgtgtggatcatcaacaaacggaacgtatgagagttcgatcaccttcccgttcggggaagggccaaccgtttcataatcccatacgtaatctacgggtaaatgactcatgccgtcctctgcttgatatattccataaaacaagccagcgccagcgcaacttctgggttgatgtcgatggtttcaaactctttgctttgcaaagtcatcataccgaactgacgcagaccggaattgtagatcgccttttccagacgggtagcatgatctacagcatcgaaaaattcatacagaatatcataatcaatgtgtaaagggatctcgattctgggtatcttcgaaatcaggtcagcaattgcttccgcgtggaggcgagggatctggatagatatatcttttttcatgatattagtgtccatatgtctttatcttcacgaatgtttcgtgccattcgaaggatcagcacgataacgccatattcatcataagtcagttcaatttcttttgcaataggagaccatgaataacttggcccgttcggagaatacagaacatcgttagatttttcaatgaagcgcaaacggtgaataacttcttgcggatctgctgcgctatacatcccgaacatattgaacgcatgtgggtctttttctcgaattttatcgagtgcttccagaattcggggaatgtcttttacaaggataatcaatttcataataacctcaaaaggggcaaagccccttatacataatcaacggtgtaacgtgcgcgggttactcccacatagattaactgcttacacagatcgtaatctgcgaacgcatacgcatcgcgcgtgtacatgtacgcatggtcatacgtgctcccctgcgatttgtggtacgtacaaaccggaagaggcttaacatcctggaacttgtttttaatcgcccagaacgaatgccacggggctttatagcctgtttgctgcttgatgcgcttataagtgctcgcaacgtaggccagatagttgcccagacggtctttcatcaccggatcaacaacaacttgaatctgtgcttcggtttcctcttcgagcgataccgttttcaggagatagaattcaagttcgatcttctcgtcgcacttctccgccttgataacttcccgacgcgggatgatttctaagactcggattttttcgttgttattatacacaatctcggtaaagatctgcccgttcaaccgcatttcctgaactaacggttcctgcatcacgatcacttcatcgagaatgaaaggttctgttgttttgtacaggtgtttacggatcgttgcgttcagcttgtccacgttgtcgttagtgtaagcgaacatgcggttctcgatcaagtcatccggcgttttgacacggcggaaatactgacggaggaagtcaacagcgttagcatgttggaacacacccagatcaccgacagacatcggtttcagcatcttaccatcacgtacagcccgtgaaacctgaataatcgggttcccttctgcctgacgcatgattttatccatacggatgacatcaaagatttcttcatcaaagaacggggagagttcaacgcgtccatcggcgtttaccggacggatctgatctttatcacccagtcccaaaataacagcgttgcttggaatactgcgccggatgattcggaacagatccatatcaaccattgagacttcttcaacaacgaacacgcgacaggtagacagatcaggcgctttctttcctttctgctgttcgaacacacgcagttcttcgttagtcacagggctaatcttcaatgcagaatgaatcgttgttgcgtccattccggtagccgctgctaacacgtttttagcctggtgtgttggggcagttaaccaaataccgctaatccccaaccctttcagagtgttaaagacaaacttaaccagtgttgttttaccaacaccagggccacccgtaatagttgtatgaatggcgttctggatgttgtggatcacgcgatcatgcgcggacttctgatcgtcgctcagatcatcaaatgttaactcgctcataatttgagtaataccccttgaattttcgaattctcaataaaccaacgcatctcttttttctgttcttcggttgctggtagttgctcggttttgcggaagaaactgaaacgcggttcgtccggcgtgtagttcagtttggtttcgtagcacttgcggataaaatctaatttatcttttgcaagttgcggtgatgcaaacagttccggcgttttcccgttttcaacgtgtggaatagtaaagccgtctttgtctttcgtaacaatgatatagtatttgtcaatcattttcgcccctcatagatgacgtagaaaaaacctataacccatagcaatgataatactatcaaagcggcttttctgtcaacaccgttaacgtggaaaacgcaccatccaaagagatacgttatcaccgcgcaaacgatataagacaaagcaaatacggcatgtagcgcggtgagttccattagtagttgttagcccaacgacgcaggttttccgcctgtttcagagcatacagcttgtagatggtttccgcatccagtcccagcgcgaggaacttacacatgaagaagtgccactggtcaatcagttcaaacatgatttccagcttgtcttcttctttcatttctgcgaatacctggctacgcagttcctggtgatttgctttccacggtttccagacaccggaagccgcttttgcaccgcgagacataccgcccagagcggtgtaaagttcgcgggtttcgtctgcgatcgcatcatcttgcagtttcagccagtccaggatctcaccgcacgttttcagttcgttcggacgtggaacccaattcagggtatcagacaggctttgttgtgcatggttttgcaagtccagcatcttttgcagcgggtcaattccgttctgcaatgcattgcggtagaaaccttctaccatttccagatcatcggctttaaccaggtgcgcacagctattaaacacaggagttttatcagtcatatcaatctcattttttcggtgatttgttccacgacttaaaccgaagttttgccgtgagtccagaaacagtattatctttcaaatactgcatgatttcaagtttagttgcgccgtccgtttttatcatttcgttgatatcttttgacggccacgggcatttgtcccacaacacaaccttttcgccagcctcaattaattttaaaaggcggtgagtagtatcagggtgtctcgcttcattgtcaagaacccagacacgcatatttttatacggaacgtcagacagcgccatttgtccgcccgtaatcgcaccagcattatctacaaacaggctatccagcggcccttcaagcaggtagacaggtttcaacggatcgatggtatcttgaccataaactttcgttgagtgttcacacgctttgattgtcatgtattttgcgttggcattgtcacgtaaggcacgtccctggaatgactcgattttacccttttcatcaaagatagggatcaccaaacgcggttcatccttcggtaaagggtatgcgtccgcattcacagagttaaccaggtgttgccattgacgcgtaaaccagaggcggtcatatttgtctttaggtatgtgacgacctgcaacatacttaacgatagggtgattttctggcaacgtgtccagacgttcgcagaactgcaattcaggaatatatttcttttcttccttcggcggttcttcgtgcgtctgttttaaatctttacgatccttgaaagattccatcaaatacgcggtataatcatccgggtaatagtctttcagaaacacagaaaacggcttgctgtagttgcagttaaaacaaccacacatcatgtgtgtgcctcgttttgacgggaatatccagaaacgttttttgtgcttatccttcatggagtcgccacaaatcggacaacgggaatggatactgaattctccaccccgtcgaacgatttcgctttgtggtaatgatcccatgatacgagttgcgaactctatatcaagatacatgtttacctctatcggctaacttctttctctgtgccgtctaaagtgattttccattcatagaatatcttataaaacggataaggtctaggaatatcaacacccgatgatgtttttctttcgttcgtgtacacgatcgctgtgtcgctcatgtacttgatacggataggaaaccaggtgtaattgttcgcagtaacccagatccgataattcaatggcggtaatggtttcattcttcactcttcatgattttacgtttgcgtttatgcggacgtgtagaacccagaaccttcggccctttgttcgtgatcgcgcctgtagtcacacccgaagcaatattatccacacttccgcctgaatcacctgcaaccatttcttcgttgagtctttcgcgaagttctgggaggttcatcatgatttcttcgtgatcttgctcggtcaggttccagcggctccgtaacgagtcataagcacttgtaaggttcatgaacccagacatataaggaaccgcgtttaaacggcgcttgatgtgtctcacagagcgatggaatggggaatatgcttccagttcttccttcgttttcgggtttttcaatacttccccttgaccgtcgatgatacccagcttgtaagccgtccattcagtccagggctttttcagtaggcgaatcattcgcacactgtaggttaaatccatgtttttgattaattgatcgctcatagtctttactctattgtgaaagtgaaaaggttttgcgcgggttctggctccggttcggggaattccatacagacaacttcacacatcggtttcacgcctttccattcttccagataatatccggtatcaatgccgcaacctggttgcatttcaaggccagtttcatcaagaaactttttgcatttcgatgttgtcgttgattcgtcctgttggaaataacgccgtccagagtaacgaaaattcgcggacatctgcgggagaatgaacgtacccgcacgggcaatctgtgaagcacgttcaatcactttatattcaaattccgcgcccgtatacttacccttaaaattggatgtctttatcttgccgaaaggaggattgctgatcgccatatcaaacagagtatcaaactccgtcgttaacgcgtctgcgttaatccaggtcgcttccggtacgatacgcttacccaacttatagtatgtatggtttaactcaacacagacgatttcacgcggtttggcgtacatcatcatatgaatcatcgcgaaggatagtccaccgatacccgcgcacaggtcaacaacgcttccactggtacaagcatcaatagtgaaatcgcgagcaagtccgatcggggtaaagaatgcacccagttcagagttattcgtaaatgcaccttcatggaagttttcgataatgaataatttttcgtcgtaggttagcgccttgtcagactccaccagatccattatcttgttgtgttgcttcgtttccgctttcgttaactttgccattgtcccagctatacagtaatgttgattcattagggtagaattcccacccgtccacgtatccggtttcccagtcagtagtttgttcaaaaccacagatccattcgtacacacctggcggcagttctacggaatcaggaagcccgatatcttccgcactgcgtccacactcaaaaaatgcatcgtgaatgaacggacgagataataccgtaacataaccttcatcgtcaacagctacgatccagcgcgaactgtgaggactatcgaacttcggttcttcttcgtctgcatcagcttttatttcagccttacaaaaatctaaattcatcatttcactaaaccttctttaacgccctctttcatggctttcagaacaccgataaaagcgtctttgccaccgatagcgccgatgataagcatcaggacaccaacacaacccgccaaaccgattctgaacaggttccatgcaaacgggatagccagaagcaccaaccacgggaacggaaatcccataagtgcgtttagaaccagtaagataaaagcgattgcaagtttcatgatgtcctcctttgtttgtttagaataaggtatcacctttcgtgaaggattgcaatacctatagatacaaaaaagcccctttcggggcttaatttttatgctttgttgataagataccgaagaacgtttttggcctgaacttcgttacagcagagtttgaattctgggtcgattgggaggaagccccagaggaaatcaacgctaccttcaacatctgctttcccacttttcagcatttcaaccagcaaacctctgtttactacgctgttcactactgcatcgaaataacccgcgctgaaatccagttctgggttcatcacttcgtcgtatgggttgttcagtaagttcatttggtatctcctttaatccgtttcgttgtctacgggagtcatattatcacaatcataactcccgtcaacccctaatcaggattattttgcgttttttgcaatccagagagtcagtttagggaatacatttgccattgccaccacaaacagcacccagaaagccagcttaatcacaccgatcacgatcagaggtgcaaacacaagccaccatgaagcatttgccataaccccgattgctgccagtttcagagacaggaggatcaggaacacaataacgagaatctttttcatttcactatacctttggagggggccgaagccccgttaaaattgaatgtctgtactgtttgctacttcggctaacttactgcttcggttagtctcggcttgttttaccatagcaccttgtgcttcttcaagcgttttcggcatctgacgacctttataatcagattggaacccgatatcgctgttgtcggtatccatccagcgttgattacccttgcgcacttcgagtttgaagtggttaaagtggttcttatcgccgtaacgggatttgatctgcttgaacaactgcaatccctgatcagctaactcgtcggtctcaatcacagctaacataaagtcagcggtagctggaagaccagcagattcggcaacgtcgcccatgctgatatcagaagcatcccacgcggcgcgggtagtctgcgcaccagtccacattacggtattcgtttcaacagccaaaccgcgaagttcttcggcaatcgctttaaccaggatgtatgtgttttccgccccgcgtacacgggtagaagcacagatccccaggtagtcaacaataatcacatcaggtacgaaactcttcttcaatttaagctctttaatcagcgctttgaagtggttcgcgttcgcccctgctgttgggtattgcttaacgattaaacgcccgaccttcgactgtttgaggcgttccatacggttcttatagtccgcataggtgatgtttccgttgtcgatatcgtccatcgcaacatcaagcaggttagcgtcaatacgtttagaacaaacgtgttcagccatttccatactgatatacaggacgtttttacctgattgcaggtaatcagcagcgagagaacaaagccccagagatttaccaacgttaacaccagccattaagatgttcaatgttccacgttctgcgccgcctttagtaatggcgttcaggatcgggatattgaaagcaatcttcatcgctttggactggtaaagcatccagcgtttttcatagtcttcgaagtaatcatgaccgaccgaactatcgaagctaatcgctaacgcttccgccatgatgtcagggattgccccaacgtcagggattttgttgttgcgttcgccagcaggtttttcagcattcgcctggatctcaattgcacgggacagagcgcgatacattgccttgtcacgacaataggtttccgtttctttcatcaaccattccagatcttccggcgcatttttcatgctgcggatcatctttttggtatcttcgtagactacatcactcaggctctttttgtccagagctacttctaaagcagtttgtgaaggaatgctgttgaattcctgtacgtgcttatccatcaaatcaaagagaatctgcgcgttcccttcgaaatattcacggcgtaaatggggccacgcctgaacaaaatacgtaccattaaaaaccagatttgaaaatattgtttcgacgatcattattacctcttaaaccagattagcgaacatctgaaagaaattatacagctttactttcaacgccgcccataaggtcttttcaggctttgggagattgggcttgatctgcgcgtagattgcatcgtgaaccagcggaatcagtttttctttgtcttcgtccggcgtactaaattcgactttcaggccgttatcccaatacaccttatggatgtacactaagtgtgcaacatcgttttcatcgttgatcaacagttcttgaataacgtcctgcattgcttcatcaagaatgttttttgttttttgttcaatgtccatgattcacctattaaaagggggcaaagcccccagttgtttattactcttctgacatatccacatcatcagggatatcgtcatcgagatcaaatttatttgacggttctacttcatcgtcagaataaagatcttcgagtgctgccccgtcagtgatctctttgtcaggaatacggtacttatcctgaatagcatcaaggaatggttggtgagtgaacagaggtttccagaactcaatagagttggtttccgattcacgccatttcttttcttccagttcaagttcgcctgtttccgtgttcaggaacgcacgaccgcgccagcctttcgttggagtctgaacgaagttcatttccatagccagatccagaagaccagagaacatactgataccgccctcataggtaacatgaagcgggaatttggatttctctttcacgaaacgagatttctcgatgttcatgatgaagtcataaccgacaacttccgtaccttctttcacctgctgtttgcccaggatgatcgcggtgtctgcggaatacatcagaccagtaccaccggaaatgactttcttgctgtacatttcttgtgtgtcgtatgtgtgacagatacacaccattggaatatccagatccgccaggtaaggcgtaaccatacggaacatacctttaagtgctttagcgcgggtcatgtcctgtttgtcgttgtcagacagggcatcagccagttcttttttactcgcggtgttgcctacagagtccacgaaaatgatcactttgtcgccacgttccagcgcgttaagctggctcacaacgtcatttcgaagttgctcaactgtcgtgatacgagtatacaccacacgatctgggtcaacgcccattgatttcaggtaagacttagttacgcctttctctgaatcgtagaacagacacacagcatcctcattcgctttgaggtacgccgcaaccgtcaccagccccagattcgatttaaagtgttttgacgggccagcaaacagagttaagccggaagtcagaccaccatcgaaagcgccggacagcgccaggttcaggatcggtacacgggttcgagttttggtgatgttattgaaaacatcgctttcagatagaattgacgcagattgactattcgagtttttgatcagttttttcaggagtgctttattagacatttatttttccggtttatatacacgcataatattttcctcacaaatttatataaatggggcatttctgccccgtcaggtcttaccagtcatcaccaaacagagtgttcagggatgcgcgtttttcgtaatcaattttacatgcttccgtgatgttttgcaacgggctaatcacatgtttttcaaataatccgccgtagtctacccacttcaaaatatcttcttcgatctcagttggtaaacgcgtaccggattgccatgcaatgcaatcagcttgccacgggtttttatctcgcaacggcagaaccataaccttttcaccttccataatcggggtgattccttgaataccctttgtatggcggttgaagaacagaacgcctttgatgtggtttggtgtccctttgattgggtatccaaaatcatcacgatattttgagatattgttagcagatgatacaccagctatttctcggtagtcaagtgccttatactcttcctcaaatactttgaagtgttcgtgtaaggattcttcaccttcttgcaggatgcgacggatcgcttctttcaagaactttttaaccgctgtcggtgtactactgcgctgggtttccattcccatgatctttaatttaggcttctcgtaacgggttccttcggagtcccacacgttagccgcatatcgtttctttgccgtccagaaactacccagacctttcgatcccagtggtggcccagaaatgatttcgcgatccataaacatcagatgttcgacgttgttcatgtactcacacagttcgcggtagcccttatcaatgataggttccatgcgttctttactgaacttatccaggaaatcaacccaatggttgttatccctgaacttgctttcaccgccgactttcgcgatcacgttatccatacaaacataaatggagtcggtgtcacagtagcgcacgtatgcgtaatccgtggtgttgcacagttcgttaaggtattcgttaaccttacgttcaatccactgaatagccaactgaccgaacatggtgatcgcgcttgcgtttcgaatatcgaagtaccggaagtgttcattacccaacgcaccataaagggagttgatactgattttacggttaagctgtgcggtgtttgcttgtgcgatcttcttctcacaaactttcttcacggctttaagcatttgcttagacagcgttttcagtacagcttttgattcatcactgaaatcttcgtagaactcgaaatcagggttgatcatttgattgtgcgcgtccgtcaggtgttcaagttcgtgcttaatcagttcgagatttcgctcacccgccatcattcgttttttccacgtcttacgctgatcaaatactttcttgatctcgaccggaatcacgcctttaacatcgcgtcggaacatccacccgttaggagagcagctaaattcatcgctagggcgcggcgcagtcttattgatgtattcgtgcatcggacgcactgcaaagctgttagcgattgtctcagggcttatattcacctgtcggatgatagatggatacagactggttaagtcgaacgatacaatgtaacggtatggagcgacaacaggatctttaacgtatgcaccatcatactgcgttttcgtgtggcgtttattttctgggattactttcttctcttcacgcagagagttgtaaatgatcgcgtcccacgttttaagcggagacataaccccagggaagtttattttcgcatagtacgctacagacagaaccagttcgataaagttgcgtttcccgtcgatatccaacacgcggataacgtcaacgatgttatacgtgatgtatttctggtgatccgcttgacgcagttcagacagtgaaccttcgtaatcaactttgtttttgcctgtttcgaactcagcgattgcgcccagagcgtaagacggttgcggggtgaaactgaatttcttatagagatccattccatccatttgagaaacgccgtaaatctcgtatcccagttgttcattcccataatggtcggttgttgtcttcgcagtcactttcccgaacgggctgaaatgacgaacaacgttttgcccgaagatgttcaggtaacgggtgatgatatacgcgatatcgaatttgttcgagttccagcccgtaacaataacaggtgtccgctctttccagtctttgatataagccgacatcagcgacttttcggtctggaatgaacggtaaacaattttcttcaaatcttcttcgctgatctctttttcggtatcaactttcgacgctacccactcgtctaacccgccctcgaccagatcatacacaaagaatttatcttcaacgctgtcatagtgggtgattgcgtcgatagcatattttgcttcgcgtggatcagggaattcaggcgcggtaacttcgatatcaagtgaagcaatgcggatcttgtcgcgatcgtattcgatttcctttctgtaggaatcggagatatacgccagcctgaaatcatccatgcctagcgcttccatgcctacatctttcattcgctgcatccagttttttgcttccttgatgctttcgaagttctttttgatgcaggtcttgccgtaaatgtcgcgatatggcgagtctacacccgccatagcgtgttgaaacattgtaggcgcatattttgttttgcgaacctgttcgcgtccctcagagtcaatgaagcgctcgtagatgtgatcgcccatttgctcaacggatagataaaattcattcattacggttttctttctccgtgtttaatcgtgacaggaatgataccccagccagcttgatcagatcaagcgagcgttgcgctaatttgtgatagcgttgggtgtcaggccgatttagttgttcaaccagcacggtatattcttccatgatgcgggtatagaacttagggaagtgatcccgcgcgtatgcgtaggtgcgcagatcagagagattgcaagtaagagacagtttgatgtcttcgctatgcagacggttgatcaagtgatcaccggattcaatagctttgatgatttcttcaatacgaattttcataatttagtcctcacaagtggtgtacaaccaatataacaaagcccctgcatttctgcaagggcttttgattaatgtccgatccggtacttgtatttcaaagtccattcagctttttgtgcgtgagtcaatacgcggaagttgttctcttcggagaatttcagatccggcgtaaggatggaaaccataccccactcttccagaagtcgcgcaatgttattgcggcgcagttcgtcatcttcggtcatgtcaacctggcgaccgtccagcttcaacagttctttgaagtgtacgataaaataacgcccttgtttctgtaggatgtggcaagactgccacagcattttctttttgttatttgcgatcccgatacgggtcagcgtttcgcgaattttcaggaaactgtcatcgctggacagtttaatttcgagcatgttcatacatcaccatttctttattagttgttcaacctttttctggtcggttttatttttcacaacatcagccaacacagataaagcaactttcatatttttccgcttccactcgtccagtttttcaagctgtttgagttcttcgtaatattccattgctatacgtgtatttacaccgtatcgtttttggagaacatgaaggataactttcatttcgttatcttcggtgagtttagcccacgccccgaaccgcttacctttgcgcaccgtatgcaggtaataatcaaagtgcgcctggtctggtaaaccggaaccgatcatattcatcgtgtatgcaggtatcagcgtttcgatatgctggctcattgcattgtcgatgaaaaacttatcgtatgaatcaagggcagagatccgtaatggtgtcttcccgttgttcagttcttcgagcaccataaacaaggtgttttccttgtctttggtgtactctttcacaagttcttcgatcttgtcccagtctttagaacgccaggccgcttcatgttcgttcagttcttcttcatcgagaaaagcagccagtgacatttttaagcctcccacgcgagggtaagcattaagcccatgaacaggtattgcaggtgaatctctttgttcactgccagcccgtactgtgcgttgttttcgcctactgcctgaatgagtgcaaccttagattcgttggtgacgatcgggtataccgcatccagaagtttagccaggaaagtttcatactcaggcgcgtacttgattgcttcggctcgcagtgctttgaagttcttcgctttaagcccctcaatcactggtgtgatgtccgaaccaacaatctcagacagaataccagcatcaattttgccacgcttagaatagaacccaagagctttaacgatggatcgcgcgtctgggtagtgcttcttaacgaatccggcgatcacctgctggtcatattcgattttctcgatttcgaggataccgaaacaacgtttgatcatttgcttcatcagttcaacgcgttcttccttcgacggggaaccgaacttgactaccggacagcgggagatcagcgcagggtgaatcccgttgatgttgttcgcggtaatgataacagtaacgttcttgctgtacgcttcgataaagctacgcatgtgcttctgtgcttctgccatgccagggcgatcgaattcgtcaatcagaatgattttaccgcctttcttctgcgtcatagaggacgcgtaacgatccagttcgttacggatgaagttcacaccacaatcggaaccgttgacaaacatcacttccgcatcaacttcgttagccagaaccagcgccagcgttgttttacccgtacctggggaatcagaaaccagagtcatgttgtcgatgcgtccagacttgatgaagccgcgcatcgtcgctttatcagcagcagggagaatgcattcatcgatcgtcgtcgggcgatagcgctgatcccatgcgaattcttcgggagactgggagattttgccgtatttggtttcgattaactgtacgttttcactaagttccataatattaccttcaattgattatcaaaaaggggcttaacgccccttgtgtactactttgtttatcttacttgaactggctggttgcttcaagtaccactacatacgcaacgccgttttcggacgagaatttcgcagcgccgcgagaagagatttcaactttgtaatcgctgttgatgaactgcatgttgtcaatcttcatatcgaagttgaacatgttatcaccttcgtaatcgcccacttctacagagaaggttgactgactttctttacttttcgcggtgattaccagcttgccgttgattggctcaacagacaggtcggtcagtttcatcatgcgtgacgctttgatcagtttttcgaaatcgttcgcgctaatctggaaaatcagatccgcaactggcatttccagacgcttcttaggctgtacgattgtggttggatcgcttgaacgctcaacgattttcattttctcgccacgaatgacgatttcgccagtggacaggtcgtgagttacttcggcatcagtgcctacaacgttcagcatgttcaggaatgagttcagatcgtagatacctacatcttcgtcaattacgtcagaaattgttgcttctgcgtaaactacgctgttgatggatttcgtcataatgaacgaaccctttttcagcattacagacgggttgatctgggagaagtttttcaggatgtcgatcgtttgtttagagaatttcatattcaacctatagttttcaattaggcaaaagtgccgttaatcagggattctacaacgcgatccgccgcattgtcaaggaattctttgcttttggactcgttgattttcgtacccgcttcgcgagcgtcgtgaatcagtccggtatgtactgcgcttactgcttcgtcgatccgtttgtaatgctcaaagcgttcagcttgaggcatcgcacggaaaatctctttgatgttttccggcactttacctacccaggatttgcgaacgttgttcagatgcgctacatatacgttttgttctaaattcatatctacctcaaactttcaaattgggggctttcgcccccgtaagcattacagatccagcagtttatccaggtcgtcatcaccggaaccaccttccaggtcaaacggaggggtgttgtcatcttccggtacgcttccgcctacgttcagttgacttacgccaccagattctttagcacctttggactggttgccattatcgaagtttttcagttcgttgtcaaatgagttcagttctgaatccagatccgcaccagcgcttgcgccagcacccattgcagcaccaccgaatactttggtgaacttcgcggtcagttccgcagttggtttgaactggtctggagcagtgattggacgcagatcgctcataccttcgaagatttctttctgacgcgcttcgtcttcgatgcctttgattgggccaggaacaccaaatttgctgtcgtcgtagttaggccagtcgcctactttcttcgcggtcagggtgaagttagcaccaccaaacggacaagttacagcgatacctggttcatccagatcagggttgccagcgatagcagcggtgatcttatccatgattttcttgccgaaacggaacttaaacactttaccttcgttttccggcgctttcggatctttaacgaccagaatgttagcccagaaggattgtttacgcccaatcatacccagcagtttatcagcttcgccgcctttattggctttggctttttcgaacagatcgttgtcagagatatactgacatacaggacaaccatcataatcgccgtgggtagacggacagttttcaatgaaccactgattgttctttttgaacgagtgattcaccaggcgaacaaacgccagttcgtcatcagagcggttaggcaggaagcgaatagtcgcagaaccgtttttctgtgcatccagagtgagtttccactctttttcatctttctggaagccggaggaacctttcagagcggcgacttgttcttgcagtttggttggatcttgacgtttaaagaatgacatatgttatttctcgtttaagttaattaaagtttgtttcattaagtttcggtattttacgatttcttcgttactgatttcaactaattttctgtatgcgtttagttttttactaaattcattccagacgaaatccgttgcgatttcatcgtgtttatttatgatgtctaaaaacgagtcgaggatcaagaatgattcataagaaatcaccccagactgtacgagtttgctgatatacgaggttgatgatttgacgctatacttaaacaccgttgagaggggaatacctttcatgcgggaaaattcatacaggttttttacatcgtccacgaaaatattatcaattcgcctcaacttgcctatgtattgacgataaaacacgatcgtatcttcgtctacatccccgacccagaagtcggggttagctaccatattgcagagtagtataagatatatttctttgaatgtaaacctttcggctaactttgcgaaaaaatatctatcctttctcttttggaacgcttgttcagtgatctttatttcccatttgtacttgatcgcgtcatacttcccagcaaagtgatttttcatcaccagatacagtttgtataccgcgatcggtttcaaacgggaattagcgtctgaactgtcaaacggggttttaaatttcacatgaaatcatccagtgtttgcgtcgtcgcgtggtctttagccacagaaggacgcagcagattgtttttaatggcttcgtcgctaatcttgtcgatgatcgctttcggtactgttttggacagcatagcataatcaatgctgttttcgtccatccattgtaacgtagcttccatgtaggttgccccctcagaggcaaccagattttcgatatacaagccgacttcggttttgtttccgatttcgctcatattacgccttatcgatcacatcgtacagttcgataagttcgttgttctgttcttcgaacgcggtacgtgcctgttcgtgatacagtttgaacagcttgccgaaggttttaccgtcgataccataatccgttttcgctttggatttgatgtctttgaaagaaccctggaaatgttcgatctgagttttcacgttcgacgcttctttgatcagttctttaaccgctttagcgatgtctgggttttcttgcagtaattctacactcattttgttacctcaaaagtcacttagtttttcatacatacgggtgagtttgcattccatgaagtatttctccatttttgctttgttcccgatttttggagcattatacgcttcttcgattgccgttgcaacatctttcggaataaaatcaaagtcgcgaagttcttcgttttctctgtatcggatcgcccactcttcgggcatacccacggtcggatcgtccgcttccagccaggcttcgagttcagcagccctgatttgtggggcgcgttctccttcaaccttcgtaacaatatagtcatttcgcattttaatgcaagcgatactatcttttttatcgcccttgatgatcttcatgcgcaaatcgttacgaggtgaaccatatttcggtgtaacccatttcttttgggttggcgaccactgacgcacaccctgatatttttgaagggctgcaaagtcaccatcagcagaaacgatcaggacacgtttaccttcggataccgctttacgcgtcaccacaccgatcacgtcatcggcttctgcgaagtcaacgcggatacctttgtacggtaaattagcacggatttcatcgtatgtcgggtgaaggaaaccattcaggcgatcccagtcccaatcagatgcttcttgttccatttttcgtttctttttgtagtaccaggctttacttctgcgccaatacttgttatcatcaaaggctagaacaatttcagggtactcgcctttgaatttaaccacattgtgacgaatggtgtcaagcactatgtgacgaacaatttgttggttgatgtcattctggtctttcggcttgaagttgttcatcaacgttgctaccgaaaggtttgaaatatctatacacatcacatcaacaggatcatcgtcattgctcattaagctgttcaggttgaacatacttgcaaatgaagacatttcaatacctcgttgttgttgaatgaaactgattatagtgatcactttttcaaagtcaatagatcatttcaaaaatctgagcgaagcgaaggacacgaacgtagtgagtgtctatgtactgaatgtacgttttaatatttttatattttatatatagagaaaacagtacatttccgtatactttttaaccaatttaactatccgtttcgcttcgctcacggaagcgcttcgcgctgattttattaaataatatagattggaagtaggtttgaaacacctgattcaatcggctataatgaatgtattcaatttggagaatataatgactacaaagatttatgcagataatgataagctgtatccagttatgtgtaagtggaaacagcaaatccgtgaaactggtgatcgtaagatgccggatgaactcggtattgcgattatgaacattgctcacggtttggcacgtcgatacaacttcaaccgttattccgaagactggaaaatggatatgatcgacgatggaatttcggcaacgatttccggccttcataactttgatgaaaccaaatatacaaacgtctacggttacatcaacaaggcttgctggcaagcgtttgtaactcgtattctctacgagaagaaagagaacgcgaagaaatacaaatacttcctggaacatgtctatgacagcgatgatactgatatgaccacgatagccgatgaaactttcattcaggatatccatgacaaacttaatcagtatgaagagtccgcgaaaaaacccaaagataaaatcgaggttgtggacgaatcgccaacattggaaatgtttctatgaaaattaaaattgacctgaacaaaattttagcagatgctaacgacgaaattgatctgcttccttaccttgtgaaattagagttgcagaacgtcggggttccgattatcatcgaccctacagatgtacgagatccagacttccagatagcagaaggtcgtctggactatgtaataaacgccgaaacaatgatcatggagatcacctactatgaacgtgcagcatgaagtaatcgacgaagtacaccaaaaatcagcgctggatcttcgtgaagaagaactggaatccatcaagggtacacgcattgaacaggaagccctacgcaaagcacaaaagttcatgcggaagaacaaagcggaatggaagcgactgcataaacacgcagagaacgcactcttcgaaggtaacaaagagcagtacgtatacgcgatcaaaaagatgcgtgatatgctcaagcaaccatacaacgatgaactgattgaaacgatgtggatcacttcgaaccagcagttgaaagacctgttcatcatggcttctgaaaaatacggcaaataaaccccttcgggggttttgaggtttatatgaactatgttttaattggggatacccatgccggacttcgccaggataacccctggaacgaagaaaacctgtatacggtattcaaacagatcgtagagtattgcaaagaacacgggatcacgcgcggcttccatgctggcgacttcttcgacgttcgaaaagcaaccacacaaacgacaatgaattttgttcgtgaaaagctggttcctcttctgattgaggcggggatcactctggatgttcttgtcggcaaccacgattgtcaatttaaggacaaaatacgccccaacgcgccacgcgagatactaagtcaatacgaatgctttaatgtcatcgacgaaccgaccacggttgatttaggtggcggaaattcgattgacctgatcccgtggatttgtcaggaaaacagccagcgtatttttgactacatcaaacaatcgaaagctaacttttgtttgggacacttcgaactgtctggttactatttctacaagaacagcaaagccgatcatgggctggaacctgatttcttgaagaagtacgatcgtgtttactctggacactatcaccacgctaacgagggtgataacgtgttttatatcggtacgcctctgactatgagcgcaaacgacgaagacgaaacacgcggattctatgtgttcacgggcaagcctgaattgactttcatcgctaaccctgtgtgtcaccatcgccggatcatgtatccagcacagaaagatgttgatctcgaacagttccgcaactgcgcggtgcgtctgattgtcagtgaaattgatcaggggcttgcaaagttccaaaccaaaattgaagaaattgcctatgaaatcaatatcatagacaaagttcaaacagattcggatgtcgataccgactttgaaatcaaaaccgttcgtggccttatcactgagtatatcgccaacatgcagatcaccgacgatgaaaaagaggaagtgaataagctgatcagcgaactatacgcggaggtgtcaagtgcatagccgttatgatgaatatttcggggaaaatccccgatattctcacctgttgcgtatgttgggaatgaaacacatcatttccacatccgacgaagcaggggaaaccagcgcagtttgtttgaccatcatgaagggtgcatggcattcatcacgaacatggtcaatattcatgcttgatacactggacgacgatactctatcatatagtattgattcatcagttgttcaaatgatcactgaattatgtgaacggattttaaatgaaactaaacttcaaaaaaattaagtatcaaaatattctgtcggttgggaacaccccgatcgaactggaatttgatacggcaaagaaaaccctgatcacggggaaaaacggtggcggtaaatcgacactgatcgaggcgttaacctatgccctgttcggtaagtcattccgcgatctaaaagtcgggcagttggtgaacagcgtcaacaaaaagaaatgcctggttgaactggaaatcgaatacgggaaagactcgtacaaagtggtgcgcggacaaaagccgaaggtattcgagatctggaagaacggcgagaagttgccggaagactccgcagcgggtgattatcaggcacagcttgaatctatgctgaacatcaaccttgtgggcttcaaacaggttatcgttctgggtacagcgggttacactccattcatggaactgaaaacccccgaacgccggaaactggttgaagatttgctgtctctgtccgtcatcagtgaaatggacaagttaaacaagtcatacattcgcggtgttaatcagcagttggatacactctcaatgcagggtaatcacatccagcagcagatcgcaacacaccagcgcttcattgacgaacagcgagcgaaagcaaaccagaacaacgcccgatacaaagagatctacgatagccacgtagaaaccgcaaagaacatcaaagcacagcttatgcagttgcaagcggagattgcggaatcggtgatcactggagaagaccggacggaagatatcaacaaactccgtgacggttattctcggctctcaatgactgtagaacagtttaaaaagctggaggtgatgtatcagaaaggcggtgagtgtccggcctgtaagcaagcgattaaacccactcctgagcgtatggcggagatcgcagagaacatcaaagcgggtacacagcgtttaaccctgatcaaaaccaaacaggacgagttacaagggatcatgaatgacttgcttcaacagcaacgcgcactcaatgccctgaaaaccaaatatgaagccctgaaaggtacactgcaaaacgaagttgccaacgctaaacgcgcacaggcgatcatggaacaggcaagcgcggaagtagtcattgatgaagaacccgtgaagcagttgcaacagcaggaagcagaactgaacgaaaaacgacaaggctacgtcaaggaaaaatatattcgtggtattgttacggatatgttgaaagattccggcgttaaagcgagcatcgttaagcgttatattccgtacttcaacaaacagatagcatattatctggatctgttgggtgctgattatcagttcactttagatgacgagttcaacgaatcgatcaaatcactggggcgcgatgatttcagttatgcgtcattcagtcaaggcgaacgcgctcgcatcaacttgtctattctgttcacatggcgtgacgtgacaagtaaagtatcaggcgtggatctgtctctgctggtacttgatgaatgtttcgacggcccccttgacaaagacggctcttttgctgtaaaaggattgcttgatggtgttaacgggaatttgattgtgataagtcatcaggatttagatccagaagattttgaccgacacatcgttatgtcgaaggtcggtcgattctcgaagatggaaatcaagaagtcttaaacttgcagttgtcaaaatgccatcgtttcatattggtggcatcaccaactttagcgcaatgggggcaagttaattgctcccttttcttttgtgtttttctgtctgggttctgagtacaatatggaatatgactgttcaagtaatgcactgtcgattctgtaccgcaatgaggacaagaaccgcgctccgatactacgttgctgtttttatgtgctcgcatgactcctgcaaatgcattcactttcccttcattgcctggcttgtgcttgcagttgtcgaagtgccagcggttcatattacctactaagccggacgtattgcaatgaggacacgtaaccctgttctgttgaagtttggcctgtctcatgcgtaagcgtgtctcttcgctgaactctttttgtttctgggcttcaagtgctttctctttcaaccatccatagcggcggtttgctgtacgcgcagacgatcgagaagtaccgactgtaagcatgttagcagcataaattagtttatggttgcctggatacatcttaactaatagcagatgtgctatgaagtgttgacgtgctgacagttcaaccagattttcgggatcgtccgatcctcccatacattttggaacgatgtgatgtttctctttgtattctgcatccgttccggtagtcatgagttgttcgtaaatcttatgataattcatgatgataaatcctgtttgatagtccgctagatacccctatttaggaacatgattatgttagaaagagagtttgaactgataacaaccccagaaattgagaggttttatctccacaacgagttacacgaaacgaaacatgtagttacaatggcagatgttgaggaagcattcaaggataaccccattgaattgacccgcatcaagaacaataaatcttcggtgtggttcctcgaaaaaatctattgacagcaaaacataaataccttaaagttgcccgtgtactgagttacatgggcttttattttgaggaacggaaaatgattaacgaacaaatgtcacacagcgaagcattgaagattttgggcgctactggcgacgaatctaaagctgaactgtcaaaactctttaaacgtgcttctctgcgcaatcaccccgatcgtggtggtagcactgaactcatgcagaaaatcaaccaggcgtatgacgttgtaaccaaaacaaacagcgctggtaaaacttacagtgatgttcgcgcagaacacgcagcaaacaaaaaagcatgggaagaaaaatttgcagcgtatttcgtggttgcgaaaaactatttcagcacgaaattcaacgcgcaagagttcgcggaatacttcacgaaattcaccggacaaccaacaacctatactcagtcaatcagcgaagttcgcggtcatactgttcacgcaacctatcgtttcacttctggtgatgcgttctttgacttctctttctcttgtcaaccgcctaacggtcaaggtttagcagcgccggacgcgtccgcactgggtagcgtatcagttaatactctggttctggttggtacgaagaaacacaaaatggcaagccgtgattaccaatggggcaagaacccagacaaaatcacgccggaaagcctgttccctactaagaaactggaatccatctttagcccgactaagaaggatctcaagttcaaacgcgcggactacatgacatcctttgcccgtatcctgggtgcgaaggttagcggtaacgatgttattgttgatgttggacactataaagttcacttctaccgtcacgtattcatgcgtaaaggcgcgtatgtgttccagtatgttgttgacccaactgtgaacaaattcaaacctgctgaacgtctgaaaggtactatgctggaagacgaagacggcgcgtgtttggatatgatcatcgacactttcaaagaaatgcagaaagtgaaaccagacgcaagcggcatcgcagcggtaatcgaccggatgaacgcagagtttgcagcggggcatcgttcagcatcttttgttaaacgtaccgcacagcaagcagcagcgccagcgccggaagagaaaccaaaacgcaccgttaaccgcatcaataaagatgactatttcaacgcactgaaacaggcgggggcaacattccgcagtaactacggtgagtttgataacggcgcgggtttgactttccacttcaaacgcgagatcagcaaccgtaaaggtttctggagtttcagcagctttgatttcatgcactccggtcagaaacatgttgaatggttgaaagatatcgacattgacgaggatagcaaaggcgcaagtatcggtttgttggttgataccctgaaacaacttcgtggtgttgctgactggtacacagcccgtaagatcctggaaggtatgcgtgataacttcaaggctggtaaattctccgcacctcatgtgaagaaagaagccgaacagaaacgcactgaaacgcaagctaaggacgagttaggcgcacagcctacgaaaccacaggcagcgaagaaagaatccccagcggttgataaggcgcatcaggcacagatggatcgtgagaaatcacagatgaatgcaaccattcgttctatgctctctgccctggttaaagccggacgcaaagacacaccggaagaaatcaaaaaagcagttgatgaagcaatcgctctttggcgcttgaaacactaactggttatgctataatgggaactgttgaaaagcagttcccttttttatgaggtgagtatgattattcaggtatcggttcagggcaacactctgacagtaacaaattccattatgaccgctatggctgcatgtcgtgatcatgtgatgtcaaaccctccggtaacggaaattctggaaattgatgtatgggaagacggtgtgatcgaagaatcctttggtttcactccgttagaggaagatttacgcaaaatggaacaatggctatggcaaactgtaccccaatgaaactaccaaaacacacaaccctgttaacccgcgaaaaacttcattcggttgaatggagtccgttagatgtgatggttttcgatctggaatccaaaatcattaacgcgcatgttaacggattgagtatcttttctgttgaatttgaaaagattcgcgggtacaatgaagcctgtaaagacaaattgcgcgtcatggttgaagctatgggctacatcgtgactattgaagacaacaaaatgtggatcgcgctatgagcaaagtaaaagcagttttcgccgttggtcatgatatgtacgaagtggactatgcgtttggttatgaacagggtttaccgtggggccactgcaaagaggatttgcagaacttcaaagcagaaaccgcagatagcgtcctgatcatgggtgcgaacacttttacttctcttcctggtaaattgccaggacgaattcactgcgttatgtctggttctggtagtttcctcaaaaccaaaaaaggcgatgttgctgattacgtcatccacggcggcgggttgtctgctgcaatcgacgtaatgaaagaaacgcatccagatcgtgatgtgtgtctcattggcggtaaggggttgcttctggaagcaatcaataatacactggttgacgaagtggttgtgacgcacatttacggacatcacactttcaatgcgccagcttttaaacgtgatgtttcgttcacggttcctgaattctgtgaagcggttctgaaatatgaactgactgatttcaaaattcagcagatcgaatcaaacgaacgcgtcagaaaaattatcgtcgatcgacatacgaaaaaggcataaaatgaaacaatatcttgatatcgtcaacacagttctaacacacggtacggaatcaaccgatcgtactggtgttggtacactgcgcatcttcgggatgcaagcacgttggaacctcgcagaaggtttcccagcgactaccagcaaacagctattcttcaaaccgtgtaagcatgaattacaatggttcctgtctggttctaccaacgtggaaacactgcgtaaaatgacgtggggtgaagatagcgataagcggacgatctgggacgataactacgaaaatcaggctaaagcgctgggttatacgcatggttatctggggccgatctacggacatcaatggcgttcgtttggtgaggaagggttttatgatggtgttgatcagattaagaaaatcatcgaacaactgaaatcaaccccagacgatcgcgggatcatcgtttctgcctggaacccgatggatctggatgatatggctttgcgtccgtgtcactgtttcttccagttcgtcgtaatcaacggcaaactgtctctacagtggtatcagcgttcagttgatgtcttcttagggttgccgttcaatatcgcctcctacgctctcctgacgcatattatcgctgatatttgcgggtatgaagttggcgatctggtttggactggtggtgatgtccatatctacaaaaacgcagtagaacaagcgaaagagttgttgaagccggaacgcgcaccgcttccacttccgaccctttatatgccgaaggtaaatagcttacttgatttggatcaagaattctttgactccatccatttgaaagactataatcaccacggctcgctaaaagcagctatggcagtataaacaaagggggcgaaagcccctttcttaacaaggtaagataatgagtgatattaaaacagtagtgaagtcttctggcgtaagtcaaacgttcgaaaaagaaaaactgttcaaagtccttaattgggcgagtattggaagaaatattgatgttaacgcattccttgaaagtgtcgttgacctgcttcgtgatggtatgactaccaaacagatccaggctgtagcgatcaagtatgcagcggatcgaatctccgcaaaagaacctgactggcagtatgtagcggctaacctcgaaatgttcgcccttcgtaaaaccgtttacgggcagtttgacccgattccgttctacgaacacatcactaagctggttgaggctggaaaatacgataaagaaatcctgacaaaatggactccagcggagattgattatctggaatcgaaaatcaatcacgataaagattttgaattttcgtatgctggcgttcagcagttgatcgggaaatatctgttgcaggatcgcacgtccggcgacatctacgaaacaccacagtatgcattcatgctgatcgcgatgtgtctgcatcaggacgaaaaacacgctgataaaatcagtcatgttgttgacttctataacgtgatttcggatcgtaaactgtcattgcctacgcctattatggcgggtgtgcgtactcctacgcgtcagttctccagttgtgttgtaatcgaatcgggtgattctctgggttctctgaacgctgttacgtccgcgatcgtgaagtatatctctcaacgtgcgggtattggtgtcaacgccggacacattcgcgctatgggttctaaaatccgtggtggtgaagcagtacatacaggcgttatcccgttctggaaacacattcagacggcggttaaatcctgttcccagggtggtgttcgtggtggtgctgcaaccctgtattatccgatctggcatcttgaagttgaaaacctgctggttctgaaaaataaccgtggcgttgaagaaaaccgtattcgtcacctggattatggcgtacagcttaacgatttgatgtataagcgcttaatcaataacgattacatcactctgttcagccctgacgttgcgaacgatcgcctgtatgacgcgttctatcaagcggatcagactgagtttgaagaactgtataccagtctggaaaaagacccaacggtacgcaagaaacgcatcaaagcggtagatctgttccagttgcttgttcaggaacgcgcacagaccggacgcaactacattttcaacagtcatcacgtaaaccagcagggtagtttctctgttcctgttcgtatgtcgaacctgtgctgtgaaatcgcgatcccaacttcaccactggatgacgatgataaactggctggcgaaattggactgtgtacgcttatggcgatcgttctcgataatgccgatataagcgaattcccagcccttacacgcatcgcagtacgcgcactggataacttgcttgattaccagaactaccctgttgcagcggctctgaaagctaaacagcgtcgttctctgggtgttggtatcaccaactatgcatcctggctggcaagcaactattgcgactactccgaagcatatgccggaaacgttcatgagttgatggaagcgtttcaatttaacctgctggttgcctctatggaactcgcacaggaacgcggtgcatgtggactgttccacgaaacgaaatatgcacaagggctgttgcctattgactggtactgcaaaaacgttgatgaactggcatcacctgtgtataactgcgattgggaatggttacgcggtgaaatcaaaaaacatggcttgcgtaactcaacgctttctgctttaatgccttgtgaaagtagctcgcaggtaagtaactcaaccaacgggattgaacctccgcgcggccctgtgagtgtgaaatcttcgaaagaaggttcattcaatcaggtagtaccaaaccaaaataatcagattgacttctatgattatctctggacaatggcaaaacgtggaaacaaaggttatctgtcgcacgtagcggttatgcagaagtttgttgatcaggctatctctgcaaacaccaactatgatccggctaacttcccagatggtaaagtgaaatctgaaatcatccttgaagatctgctgtatgcaaactatttcggcatcaaaacgctgtactaccacaacacccgcgacggtgcaggtgaggaagaagcggaagattgcgaaggttgcaaaatttgattcaatgccccttcgggggctttttataaggtaaatccatgttaactgtaatgaacacaaacccagatcacaaacacttagaacagcctatgttctttggtgaggatacgggcgtagcacgatacgaagaacagaaacaccgtgtattcgaaaccctgactgaaaaacaactgtcattcttctggcgaccggaagaagtggatctgtctatcgaccgtatgcagtacgcgaaaatgccggaacacgaaaaaatcattttcgattcgaacctgcaatatcaaaccctgctggataccattcaggggcgcggcccgaacctggcgttcctccctatcgcttccgatgtctcaatggaaacgtggatcgaaacatgggcgttcagtgaaacaatccatagccgcagttatacgcacattcagcgcaacctacacatcgacccgtcgaaagagttcgataaaattctgcgcaacgaagcgatcatgaaacgttcggcttccatgacaaaatactacgatgatctgatcgcagaatgtcacgaactgaaaaacattgtgctcaaaatcgaaatgttaacgtcccacggatatccagacgaatcgatcgcagagtacgagaagaaacgcaaagagcaaatgcgtaaatgcaaaatcgctctgtatctgtgtatgcacgctgtcaacgctctggaagcgatccgcttctatgtgtcgtttaccttcacgttcaactttgccgaacaaggcaagatggaaggtaacgcaaagatcatgcgtctgattgcccgtgatgaagcacttcatcagaaaggcactcaaagcaagatccgactctggcagatgggtaaagatgacccagaaatggcggaaatcgcttaccagtacgaagaggaagcgacaaagattttcctggaagtatatgaacaggaaaaagaatgggctgaacaccttttctctatcggtgatgtagacggcgtatccctgaaaagtacgatcgcctatatcgaacacctgacagatcagcgtatgcgcgcggttggcttgcagtctccatttaaaccaacgccgaacccgtatccgtggatgaacaaatggttgaagtctgacaacgtacaggtagccccacaggaagtagaagtgagttcttacctggttggcaacctcaacaccgagatcagcgacgaagcctatgcaaaatggcgacaaaaatacgcgtaaggacataacatgattgatgcgattcccgtttatacgggagtccatcacaatctatacgcatacctggcgggttgtgttgattgtgatggatggattagtgaaaaaggaaagaatggttatctggttgggcttacacagcatattcaactatgggatgatatggttagcattcaatctgatttgattaacgatggtgttgatgcaaaattatatgaaagaaccagtagaacaggattaggtaatacgttgatgtgcaacctaattattcaaaaatcatcggatctcttgattctgttaccgagaatcattccataccttcgatttaaaaagcaaaaagcagttgacgcatattttaatttgtgtaaacattcagatcttaatgcaagttcatccgataatgatatgaaaggaagtaaacgaaagtattggaagccggaagaaatatccgaactaattcgtttacattcggagggttacaacaacccagcgatagggattaaaatgaatcgttctaccgattcaataagtcataagttgcatcggttgggtatcatgagaaacgaatgatggaatcgaaagtttatagaatgtctcttgacaaatgcggtcgaatagaccgcagttttatcaagtgtggtgagttaagaaattgcgtttactgtattgaaatcgacggcgtgatcgtgtatgttggtaaagcaaaagacatgtggaagcgattagatacgtacaggaattcaaaatactggagggaagcaaaccccagcaacattttgaaaaccgcacgtctggaaatggcaatcaaaaaacgtaagcgtgtgaatctcattgtgacaacacacgacgaaaacacatatcataattttgaaataaacatgatccgaaaaattaatcctgaatggaataaacagcactatgacaaagctaaccaaaaaccagaaaacactcttcaaccaattaatgaagttgtgtaacgaaaccgaatgcttttactttattgaccaaaaaaccgtaatgcaaacccacgttcgcattttcaactatcgtatggcaagttacagcgattggttgaaacctggtgcgctggaatgtcgcggcattatgtttgcaatggatggggaaacccccgtaaaactcgccagtcgccctatggagaagtttttcaactatgccgaggtaaaggcatgggaagcgctgaaagcctctcctgtgacgattggtgaaaccgtagtggatgtgatgattaaggaagatggttccctgatctccaccttctgtgattccggctatctgggcgttaagtctaaagcatccgttcaatctgaacaggctatggacgctatgagcgtgatccagactaaccgcgcattgttcgaccgcctgaccgaactggttaacgatggtttcaccgtcaacatggaatacgtcgcaccgacaaaccgtattgtaattggctatcaggaaccagcagtggtgatcctgaacatccgtaataacgacacgggcgaatatgttgattatcaggatatcttcgcagatggtgtattacgtccgttcctggttgagcgcgagaaaatcgaaatcaccgatctggatgcattcattaccgaagcctacacgaaagaaggtttcgagggttacgtaatcaaaactgataaaggttttgtgaaagcgaaaaccaactggtatgtaaaccttcaccgcacgaaggatagcatcaacaataacaaagatctgttcttaaatattgttgaaaataccgtcgatgacctgaaacaaatgttcctcgatgatatgtacgcactcaagaaaattgacgcattcgaaacgttattccttgatagtctcaatcgtctgactgcaaaagcattccaggcaatcgaagacacgaaaggaaaatcacgcaaagactacgcgatcgccctgagcgctgacttaacccctgacggtcgtatcatcttcgggcctatgatgcgttatttcgatgataccgataagcaaaagctggttgataacatcgttgcattaatggcgaagaactacgaacagtttataccggaagaatataaatgacaaagtgctttggcgctggaagcacaacgttagaagaagagaaagcagggatcgattccctgcttctttacgttgacgttttcccagaaaccggaaaaattttttggaataacaatgcagcaaaacagaatcagggaaaagaagctggttctattatgagcaaatcaaaaccttacgtgagaattcggcacggcgatagaaaatatttaagacatcgcataattttctattactgtaatggttatctgcctttgcttattgatcataagcatgggttggaagctggggatggtatagaaaatctacaggaatcagatccgcttcataatatgctgaaaagaaaagctaaatcaacacctaaaacggttaaatccaaaggtgttgattacagggcttcgcgtggaaaatatcgagcacagataaagatagacgggaagcaaaaacacatcggttactatgataccgaggaacaagcatcaatagcttacgaggaagcgttatatgaatatcaaaaacgtattgggtacgtttaatataagttcgtggatatggcctgtaatagttgctggttcgttagcagggcttttgtacatgacaatcacgctgaaaagtgaaaacgatcaattggctaaagatatcaaagagttacaggctgatatcaaaaaagtcaaagagacaaacaacaccaatacggtgatctatgtcgaacagaaagcgaaggatcagcagttggtcaaggatgccggacgtaaagatctgctgttcaagaaaccaggactgatcgaaatcaagatcaacaagtccttcgaagagtatatggcggagtacgacaaatgaaaattgcaacgttagcccttgttctgggcgttctgttggtcgggtgtgctgagaagcccccagaaaagattttgcctacgctccccgctaaggtgaatccggtgaatgtgaaatggaaagtggttgcagaagtccgagagattgacggtaaaaaataccttgtcatgccttatgacggaaacccatacgttgccctttcatatcccgattcgttaatcttccgtagctggatgaatgacgttaagcgtcagaaagaccagacagataacattctgtgtaccgtgggataccctgagaaatgcaagtcaaaataatcaagtcatttttccgtgacataaccgaaggaaaggtttatgatgcgaagaaggacaaagaaggtctctggatcgaaaatgactggaaccgtgatatgtggctcaatctaacgaatgagcataacaaagaactgattgaatatgagattgtgaaatgaatctgtttattactgtaggcgtaccaggtagcgggaaaactacatgggcgaaagaaaaagcgcgtcaactggggaacactctgactgtttcccgtgacgatatccgcaaaaccctttattgtgctggcggtgatctcactggctatcgcttcaccgaagagaaagaactgtttgtttgccgtgtgcaagaagatacagttcgtaatgccctggcgagtgggaagaacgttatcgttcacaatacccatttacaccaaaaagatcatgatgtgtggcgagagatcgcgaaagagttcaatgctgatttccatatcgaatggattgatgccgatatcgtagaactcctgaaacgcaaccataaacgcggtgtgaatgctctacctgtttcccgtgtctgggcgatgttcgaacagtaccgtaaactccgtggctgggttccggctatgagctatgcagatccgagcaaaccgaaatgcgttatcttcgacgttgacgggacattaaccaaagttggacaacgtagcccgtatgacttcacgaaggttatcaacgatccgcctaaccctcctgttcaagaactgttcaggatgtataaggccgctggttatgcctgtgttgttgtgtctgggcgtgagggtactgcacagtgcgcacatgataccgctgcaagcctgatcggatacgatgttgacctgagcgatggtatctacatgcgcgaagaaggtgatcatcgtcacgatattcacgtaaaagagcaaatacttgttgaaaagattctcgataagtattatcctgttcttgcagtggacgacagggatacaccagtcgggatgtggcgaatgaacggtatcccatgtttccaggttgattacggcgacttctaaaaaacagttgacagtgagtgcgggtgtgataagatacccgcacaaacaaaggagaatattatggttattcgtgaaaatgaaaatgtgatggttgaactgggtgatcgtgttaaagttgagaatcctgttgaacttcaactgaaactcaaccagttaggccagcgcattgctgataaaattcctgctggttatacagtgaagattgtccgcgatggtcagttctccttccttctgggtattttgagtcaacgtaacatcgttgaacagcagttcgggattcagtggaatccggtaactaaattcgtaacatgggcgggggtattatgagcgacaaaatcagaaagattcatcaggcatggttatgtactgaaccaacgatgcttcgttatggttgtgtgtttgggttggttgataatgatcctcaacaggacattgcaacaagtccggttgttgaatatgcgattccgtcgaacaaatcgtttgttgaagtagtgacacgttcaggtactacgtatcacatcgttaaccctgataacgatttcatcaaagacattctgaaatatatggatgaccgatgaaactacttcacatgatccgtgctattcaacacagccaggcttctcgatgcatatcgacccgtgttggtgcggttatagtaatgaacgggcgtgtggtttcgcagggttcgaataatacggttgattctgattgccgttgtgctgatcataacgagcatatgctgaatgacgaaggtaaactgaaagcggttcaccgtcctgagcattcagcatggtcaaacgataatgagatccacgctgaaatgaaagcgttgctaagtgcgcatactaatggtattatgcttaacaacgcagagttgtacacaaccgcttcgccgtgtccaaactgcgcaaaacatatcgaatggtatgcggcaataggcgctatcaaagcggtgtattacctcgataaatacgatcgtggtaatgatgaatggatttcacgcttacagaaatatggctgtatcgtggaacaaattaaacgggaagagttagaacctcatgttaacttttccagattagtgtttaacaacaatgagtaaagaaatgtctgaactgaaagtaaaagcatccggcgaatatgtgatcatcgaagctactgcgcgtccgcagggttccgaaatcaaatctgaatctggcatcgtggttggtgtacgccagcacggggaacaacctttctatggtaaagttgtttctgtaggcgcagatgttccagaagaagtggcagaacgtatcctgggtaaatatatcccgctgccaagcgctcacatggcgaatgttcctgaccctgatctggttgcgggttacatttccgaaaaagaagcaaaagagaaggaaacgaaatacgtttccgcacattacaaagcaatccaggcaatctacgagatctaaaaatggctaaatcaattcaagcaattatcgctgatactgtcagcaagtccaaaaaactgttcgacaaaggcgaaattctggaagcccccgcgcgtattgacgtaatggcagcaatgatcattgacgcgcatcagggtaaactgaaatcccgtgccgatgaagtcatggcgtacatcgtccagttcgaagacgtatgtaaatacgcgaaagatgttgacccgctggttcgcgaaatttatcgcaagcagttctaaaaattccggccctttagctcaataggttagagcgagcgactcataatcgcgtggttactggttcgagtccagtaggggccaccaaatacgcaggtatagttcaattggtagaatatctggcttccatccagaatgttgagggttcgagtccctttacctgctccaattcgggtgcgtagcgcaatgccgttaaatggttcggaatatgcaacctttctcacggagaaggctctgttggtatccggtaataggttccccggaatgcggggtgaagtaaagaaacttccagcccacaaatttaaaagagaaaaaatatgaaaggtctccaaaagctgtttgagttaaccccaaaaattcgcgaaatcgtcgctgcatcaactgaaaaagaaatcaacggtaaattgatgaaactgtttaccgaagaaatcactgatttcgataaagaatatcgtaaagcgttcgatgcgtattctgttgatggtttctttgcatcaccgcaggtgaatagcaaacatgaatatcatcgacgattctttgactggtcgatcgtcaatatcgttcgtcgaactgatatcgaacctacgaaccatcagttgatctctatggattcttctgtgttctttatccagtatcttattactggtggatttaaagcagaaggtattccgttctgcaacgaagctctggaagaagaattcgcagaagcgtataagtatatcaaagcagttcgttaatcaacaggctatcttcggatagccttttttctggagaagcacatgcgctttttaaaatacgcaagctggtttgtactggttccccttgatattctttctggtgttctggctattctgctggctccttttgtggttccgttctacagtgaagaaaccggacacttacctaaagggttccgttggatggaaacattcgataacccgatcgatggtgatggtggacatatccggcgttgggctaacatccggtatcacttaggcgatctgggtgtgtatgcgcaacgtgtaggctggttgtggcgtaacaaggcgtacaacttcgcttatcacgtcttagggcgtgaagcacaatcagacttcgcctggaagggcaacccgaaaacagaaggtggttccgatccttcgcgtcacggttatctgttgatgtggaatgattcggcatgggggctttatgtcttcaagccgtggcttaaagtcggaaaggttcagttctgcttacgcgtgtattgcgggtggaaactgaaacaggaagtaactgaccctaacgggctggatcgtgcaatgctggcgttccatatcaacccgttacgttattatgtcgtagaaaggtaatacaatgaaagcatatcagattttagaaggtttacacactggtacaatctacctggaagaaggtaatgatgttcgtgtgttggtatccaaaaccctcgaaatggattcagtgatcggtaaagctcgcgttgctccattcgcaaaacgtgaagtcgatattgaatttcaacccactgttaaagtggaaggtggacaacacttaaacgtaaacgtgttgcgccgcgaaactctggaagatgctgtgaagcatccagaaaaatacccgcagttaacgatccgtgtgtccggctatgcagtgcgtttcaattcactgactcctgaacaacagcgcgacgttatcgcccgaacctttacagagagtctataatggcgattgaagacgtacagggctataagccccattcgaaagaaaagatcgacaaagtaaaccgcatcaaggccgcagaagttgccctgggcgaaatcttcaaagaactggatgaagagtattcaagtgattacgcggtatcagataccaattcattcactacagaagaactcgatgcgatgcttgaacgtatccatcaaatccaaaaggcgaaagaccgactgaaagaagcctctatgtgggcgtgtcgtgcggtgttccagcccgaagaaaagtattaaaaatcaagccgttgccgaaaggtagcggcttttttgtttttatgcaaaataatgcttgcgctgaatcgtgagtgtggtaaagtacacacatcgaaacgaaactgaggatgacattatgaaaacttacaacatgaaagaactggtttgcttcaacactcgtcgtgaagcccgtgcgtatgttctggctgctggtaagaatacctctgctgtaatcgacctgggtactgataaagctgttggcgcacgttgggctgctgttgtggttatcgctgctcctgtgactcctgttaaaactctggttctgggtgcgcgtaaagccgaaactctgaaaaccagcacttgcggggcgggtggtgttcataatgttacggtcattcgaaaaagatcttttaatcgagtcggtgtatgaaggtatacggggaaaacagaaagaacaatctccgaagagattgatgtaatcaatgaatttctatgtagaccatacgttaagagagttattatgaatattggtagtggtgattcatacccatcatgcgcattgagcaacttcgccccgcatccgtttacgtttgacggggtagaatgtgcatcaatggagggctttttacaaagtctgaaattcagcaatccagatatgcaagcgcatgtgtgtacgctggttggtaaagccgccaagttcaaaggcaagaaaaagaaatggtatcgcgatcagaccctatactggaagggtatgccgattcaccgtgaatcagaagcgtatcaaatcctgattgaaaacgcgtacaatgctcttttcctgaatgacgggttccgccgtgcgctggctgcaaccggaaaaagtaccttgactcattcaatgggaaagaataagatgaatgaaactgtgctcactgaacgtgagtttgtccgaaatttaacccgattgagagatctgttatgataggttataaagattatgatgaaagagtagaatgcgcgttcctgttcaaaggcgcgattaacccgttggcattactccacgcacagggtgctttgagttctaccctgattattggtgttatctacaaagcgggtgtgtattacgttaccatcggcgcgaacaacattaacgtgatcaacagctacgttgaaaaatgtaagctgaaagatattgtgttcgataaagtcgaaatggatgttcctggcttcgacgctgtttatatgtacaagggttgatgatgggttacgtggtttatttcgattgttcggatcttgatccgttcgttctgcaacaagcaaagaaatatcatcaagatatcactggtatcagtgtcacgaacgatgatatgctgtgtatcgaatttgattattatcgtacatttgagcgtgacaaattccttgcggatattgaagcgtttaagagtacccttttctttgatcgttatgaggttaaatcttgaaaccagttattcttaccgacattgacgggatcgccgtaaaatggcaaagcggcctcccgttctttttgtcaaaacacaacatgccgaccgatatcgcgctggatatggttacggatgaaaagttccgtgatatgaccgaaatctttgggtgtgatcaccaactggctaaaatcctcatggaagaatacaataacagttcgtttattcgctatctaagcgcgtatgacgatgcgttgattgtgatcaaccgtctgaaagtcaaatatgatttcgtggctgtcacggcgctgggaaccactcctacggcaagccttaaccgtattgcaaacctgaacacgctgttcccttctgcattcaaagaagtgatggttgtcgggcatggtgaaaccaaagtacaccgctacctggaagcgaaagccaaatatggcaatcgtctggtttgcttcgttgatgatcttgcggtaaacttaaacgaatgtcataacgtcatcagtcagttgccgttattccatatgttgcgtggtgaacgtgaaaccccgtggtcgcctcaccagtcagttaaatcatggtttgaaatcgaagagaaattaaatgatcttacagattctaaatgaactcgcttcgactctgaaaatctcagagaaggaagcgatcctgaaacgtaatgcaggtaatgatctgctgaaagagattttccgcattacgtacacgaaacagattatgtttcacattaagaagtttccgcaggtggacggtaagccaggcacaaccccgctatcgaatgctatcgcggatttgatgtctgatttggcaacgcgaaaatatacgggcaacgcagcccgtgatcgtctgctggatatcgtatcatcggtgaacgagaatgatcgcgaagtgcttcgccgtatcattaaccgcgatctggaatgtggtgctggtacaacgttaccgaaccgcgtatggaagaaactcattccagaacagcctcaatgcctcgctacgccgtttagtgagaaagccttaaaacgtattcgcttccctgcttactcgcagcttaaagccgatggtgcgcgttgtatgtccgatctgttagagaatcagatccgcaaagcaacccgcgcgggaaatgagtatgaaggtttggtgaatctggacaaggatctgaaaaagattcgtgaatatctgggttatgatgttgtacttgatggagaactgatttatgtccctgctgaaaaaactgctgtcgttccttcaaacagcgttccatttagtcttgctgggtttatgggcgatgacgacgattctgtttctgaccttgtggcagatgttaggcgggaagctaccgagaacgagacacaagcggaagcgaaacgcgaagagggcaacgggattgtaaacaaatccctgaaaggtactatcagcgacgaagaacagcgcaatatcgtttatgttgtctgggatatcgtaccgtatgaagtatactatggcgatgctccgagtgttcaaccatattgcgatcgtttctctatcctggaaggtgcgctggctggctctggtgtaacatcggttaagttgatcccttctatcctggtgcagaactacgcggaagcgaaaaaggattacaacaattaccgcaatgacggtaaagagggttcaatcctgaaaaacgttgatttcaaatggaaggattcacgcgttgcggatcaggtgaagttgaagaacaaaaccccgattgaactgcgaatcatcgacgtgtacgaacacaccaaagaagctcataaggtcggagggttcgtggttgaggacttatcaggagaagccagaacaaacacaggttccggtctgactgatacggactaccgatacgatgaagacggtattaaccgcgtgtacatcccgttagaagaacgtggtgaactggatcgcgaatacatcatggcgaacaaagatgactatatcggcgctatcgtcgaaatggaagttgacggactccagaagtctaaaacgcgtaagaagggcgaacctgagttcagtttcttcttgccaatcatcaagaagatccgacgcgataagaccgaaccggatgatattcacgttatcttcgctgatctgttttaaatagcactttttgctaaaaagccccttgcatgagtaaggggcttttgttatattacaaacatcgaaacgaaacagacaaaaggaacatcccatgcaaatcactaaagaactcgaaggcaaagtaatcgttctggtaaatgaagaccgtttggcacaactgggtaacggtggtgaaaaactgccagcagacgcactcgaaagcctttctaaaatgcgcgtgatgcgtgttactgacggttgggttacttgtctgcctctgaacgacgaagacaaagccgtatacgatgcacaagcggattcatgggatatcgaagtacctctggtaaacatcgaagttgaagagtgctacgaaatcgaaaaataatgcttgcttactgggtaatgtagtggtacattacccatatcgaaacgaaaggagaaacatcatgaaaattatgcacactgcaaatcaacttcaaaacggcaactacgctatccacgatgctatcggtgcgctggttggggtttatcttcatggtatcaaactccttgaagtaagtgggaataccttttatggtgttgaaaacatcgaagcagcgatggaaattatcggtgacctgaaatgagtaagaaactcgaaatattcgaaactatcagcgaagaccctaatcatcgctggtgctgtgcgaaaactggttttgatgctgcatggggtgatactccagaacaggcgcgtaaaaactgggaacaccaacaattgttttttgcctgtcgggttcctaccaattatgaggggagtcaattgttagcatgaaaaataaagaatatgacccaatagaagttaaagagcggttatcggtagcaagaagattccttgaatctatcgaccctgataaacttggaaaatgccctgatacgatttgccttaattgtgggcgatccgtaatggttggaaagtgctgtgataatcagaatatcgttatcatggacaggaaagaagtttcaccggaagtgtgggatcggattcaagagatcatcaaaaacccacctgaaccgacgaaacgtttacgcgaacttatgagcaggaaaccacgttatgaaaaatgaaccaagtaaaactatccgcctgatccgttgggaagggcaagaaatccgttatgaagacgacgaccgcgaattcgtccatgaaatgcttgcgcataatctgggattcaaaaacgccgcactggtgatgatgcaacaaaccagcgatgaagacacctggcaatgcgtcattctcgatctggacaaaaacaaggaatacaccgaagatgaactgtttgcgctcacagagaacgctacagcgcgtcagaagtgcttcatgatcgatatgcctcgcgagaactacgagaatatcaagaaagcccgtaaacagaacaagaacaacgtgttcgacctgttcatgggctatcatgaagaaactacggcctaagcctcacttgttttgctggtgtcgttagtagccgctgccacctgtacacattccaatgtttgcaggtggaaatcttttgatacgtcgcggacacattcaacgatcagatacttccctgaatattcatcccctaacacctcaatcaatgcccccactttaacatccattcgaccctgattgatatcaaaccgaatacgtttttcatagctggataacgtctgacacttcacagcctggaacggttgaccctgtttgtctgggttctggaagttgttctcatataccgcgtttctgttcatggtgatccatgcgttttcaatatcggtactcgcaaggatatcactatacagttttttatccgtcatcgagaaactaaagaaacttgcatcccctaacagggtagtgttatccttatgggtaatgtattcacctttcgtgaataccaaagcgtcacctaaaaacgggttacttacgttgaacttgtaagcctttaacggggtttgtgcgaggatctccgtattgcttttcataaagataccggaaccatcttcccacagataacagaagtcagacgaatctacgctctgcccgttgtcacggatgtaatcaaacacggtttcatacgtcccgctcaggcaagccggaggaatacgcacgtttgatgcgtcgatatgcggcgtgatcaacttcatatcgttatacagtgccgtcatgcactctgtaatcgtctgtacggcgttgttactgaacgaacgggaaaacttacgacgaaacaccgtatgcaccggagaaaggtttaggcgcagtatagagcggttcatatcatcggtttcgacgtttgaatacagaacaccgtagtaatgctgttctaacgtttcgttatactggaaggatacctgaataatcggtttttctgtcaactgatagattaactggttatcatagatctgcatcaatgtttcagaagtaccgttaatgatggttttctcactcattgagacaagggcaggtaacaattcaagatagacgttatcagcgaacttttcatatgttggatataatttaaccgacacgacgcggtttataactttactggacattagacatcctccctttatattctatttactaaatagtaaatatcgggatacttgaggcgatcatgaaagagaagaaaaacacacttgataaatttatggttacgcgtttaaacatcaagaacagcaaaaataaagtagtcacgttgcctactggtgaacaggttacgatcccccgtctgggctatcgtcatttcacccagattaaagcaatgaaagacccaatgcagttgcttgagtatatcatcaaagagattcaaccgcgcgaattaaccgcagcagaaaccgaattccttttgattcacctgcattatcacaatgacgataaagcaatggcgatactgaaagagatcggtattaatctggatgatatgaaaatcagcgaagctaagtatgaacatacttttgataaccttcgattggtcttcaataaaccgaccctaatgctggatgatctggcattactgcttaaagaagcgtatgacaacgggaagccgatcgaactgacggacgaaaaccgtattcaattaattaactgcctgtatcgttatgaatatgacgatgtaaaacgtggcgtactccaggaagtctatattgtgcatgaggggaaaaccattaaagggcttaacatcatcggtgaatgataatggctagcaatccatattttaacgaagaacaacgtcgccggatgcagaatccaccaaaaccacaggcgcaaccgactgttcgtaagatccaggcaacgttagataaagattcgatgcgcgagttaaaggatatcaatgataatacccttgaaaccgcgctgaatacactggacatcaaagacagtgtgaaatcctttgaggatcgtttcaaagagaaattcgctggcttccaggaacaatacgaacaggatcagcaaccacttgctgaacagttgcccgattttgttgggccagcgcgtccaccatcattaacagacaacagcacaaccagtgttgataactccgtcagtgtatcgaaccagcataacccatttgcgaaaatcgaaacatacaccggaacgattgcagaagcaatcaccaagtttatcgaactcgctgaaaagaaaccagcccccgcgccggaacctgaaccagtaccggaagaggaaccggaggtcgatcgggacaagaagaagatccgcgataaggataaagacgagaagaaattcagcaagaaagtattgtctttgctgggtgcaatcaaggataatacatccggtcttctggctcgctttatcggttattctctcgaagcgctggcgaagtttgcaaaatggactctgattatcggtagtatcgtatttgcgatcgacgtactgagtaaggttgttcagaagtggttccaggatattcttgcagagggtgaagcctcgaaagatttgtttggttcatacttcgggaatatcaaaacccttgctgagaaaatcaacgaaggtctgcaaaacttcgatatgagtaatttgggcgaatcgctgaaaaacttgttccttgaaccgtttaaggttctgggcgataccatcaaaaccgcaatcacggaaggtatcggtaatctgatttacgctctgggtgaatataccggatctgaaacgattaccaacgccggacgcggaatgaaagtatcagcactgcgcgacaaacaaaaatacggtcttgaaattgatcccgatgatctgattctgctgaaacaacaggagatccaggatcagaatgataaagtggttgaggcacgttctaaggttgtcgaacaggttaaggctacccagggcgcattctcatatagtttcggacaacaaacagacgcacagaaagcattgtctaagcaattggaacagatgcgcgatcgtgtggctatcgaagaaaagatcaccgaagagaagaagaaagaactgaaagcattgcaggaaaaccccgcactgttaaaagctgaggttgataaagagaataccgctaaccgtaagcgcgtggacgaaaccaaacagatcgaagcagcacaaaaggctgagaagccgaaagcggaaaatgatttcgatcgtggtgatcagattcttgataaagaaaatatcaccaacgaagacaagaaagcaatggagaaaattcttgaatcactcgaagagaaaaacaactccaagaaacttgacgaagacgatagcgaacgattccgctcaatgcttgaccagtggcagaacaagatcgccgcagtaccggaaagcagtgcaagtattgacaagcaaccggaacctgtgaaatcacctgttcagcctacaacgcctaacagcgttcaggtcaacaacaaaacagtaaacaacacggttcagcattcagtacaacgaactgaccgtaaaccattgattgcattagcttaaaggaaatttaaatgaaaattacagtattgcaagacactgtacaatcatttgctgaaatcaaaaatgctggcatcccctctgggggtgctgcaacaactaaaaacgcgttgactcaaccgatcgtaacagcggaatttccttcccaacgtgcagcaggtattgataacgcttataatgcatcaagcctgtataataacggcttgctgttcacagcatatgatttcacgggtggacttgcaccaggcagtaaagacaactaccgctcattacgtcaggcagcacagaacgcgcaacagatccttagtgctaacactgggaacgttcgatacaaacaggttttgaatacccgtactatgggtacacttaaccccatttgtcaaatacttttaccgcgaagcctgaacgataacgaagtgaactcacaccgttatcaggatgcaaccgatagtattgttgctaaaggtttatcccgtgcggtatcaaacgttatctggggcgctgtagaatccgtttctggtggtattctggcagaccgtagggaagcaatcgacatcggtactaaagcagcgtttcaaggctctgataagcgcacaaagatgtattacaatacattcgttatcgaaagccgttatgacctgctggaactgattaaaatctattacctgttcacggtgctgggttatggtactacttcgggcggtactccagcagaattagccggactggttaagcaagcgtataattccagcgcttcgaaggttgcaaacgtttttgcaccatcaacaaaccagacgacagcaagcgatttcaacggcagtatcggggatcagattgttgacttcgtatcgaacgttgaagttattaaatcgcctcctgtgtggtttattcgtgacttccagacaggcgacagtttgcggttccctcattccacgttcgggccagcaggtattaccagcgttcgtttcgggcgtacaatggacaacattgtaaatacgttgagagaatcaccgaacaccccgatcgcagttgaaatcgaaattcagtttatggaactgatcgatatgcgtcaggattcgatttttgatacgcagtattaagggggaacaatgttctatagcgtagatgaatttttgtcaggaatggcaaatagagactttcagcgaagcaacttgtttagtgttgtattcgcaaccagtccagcatcacgcattctcgacagcacgatcgggagtatccgcgatactttaatagatggtactatgagttccattaacgcgaataacccgaacgagttcatgaacgctattacagggggcgtaagcaagctattcagctatacggttgataaagctattatgtccctgaacaaaacaggtttcagtaaaatcatgggggcgttaagccctcgtttaattacttccctgtttggtgatagtgtttacggacagatgctaacagaattccgtgacaaaatgatgtataatatggggttgagcatcgttggtgttcagttgcctggtaaaacactgggttatgaatacgtgtataatggcggtgtaccccagatccgattcacccgaccggagaatggtgaattatcgctaacgttccgtgtggattcagaagcgcgtaacctgaaagtattcaacgaatggttatcagctattcgtgatgatgtctcaggccagttcgcattcattgatgaagtatcaagcgcgatccaggtaaacttacacaatcgcgatggtgtcccgcacagcacgtatgtattccagaagtgtttgcctgttaaagtcagcaacccagaactgagttatgaaagcaataacgaaatctggacattcactgttgactttgcttataaaacaggctggcttgttgaagcagataaagaaggttgggacggattcaaacaatcacttatcgaaggtgcagcaattgccgttcgtggtgtggttacaggacaataaggggcgaaagccccttttgaggttaaaatgattgatataatccgcgtaaaactccctggtggagtgaagcgattccctatgtttaccgtgcgcgatcagttgagtttcttactcacaagcgcggacatggaagggaagacgctcacagaacagcaagaaatgctggatgaaattttagatattctgtatccgggttattcccgcaccgaacaggaaaacattttcactaaggtgtattgcgtatcgttcggtaagaacgcaatcaagatccgaatcaaaggaagcaacggacaatcagaagcattcatgcatgtaactgattacgttttgcaaaatgaatatgcccttgatgattcgcttactctgggattcaaattcccgaaacatcgtaacaacagtgaacaattattccttgaatgtatccagtatgtcaagcaggacggcgaaagatacgaatggaatgcattagacgaggacacaaagaacgcgatcctggatctggtgtctattgaagatatggaaaatatcgttaaactgttacgcaagtcctgtcatgttaccgtgcgtgatattgagttcagcgacttattgacactgtacaaaatcctgttcaacaaatcagaactgaatgagttcttcaaaaccaactatttgttaaataagaataccgtacagattgaacctataatgaatggaagcccgatggaacgttcaatttacgttgcattactggcggaagacttgaaacgaaaagagaatgcaaatgcgtaaacatacaccccgacatatcccaaaatataatgtgacttatcgcccgttaaccattggcgatcttgatgacacggataacttcattattgaaggtgatgtgttcaagcatcagcgcgattatgtttacattatggctctgttcgacagtatcaacaaagagactgtagatctccaaatcaaatgccctgaatgcggggaactgattaagtttgtgctcaatcgtcatcatatcatggtggatgaatacgaagaaaagctgtacggcaatgagatcaagatttcagtcgaaccacaccgcaccggaaaggaagagttacccgaactgattaagtttgtagtcatcgacggtgaacaaatcttatgggatgactgtaaagagtcagagaaagaagccgttctggatagtatcgactatccggtctttaaatcaataaatagcgctctggataagccagcaatcgttgcaaacattccggtaaggtgttcgtgtggctacgagcatatcgttgcactgagaggcttagaggcgtttctaaaggtggttggataaaatgggtgttaaccttcgcttactgtacagcgatatcgatcccaacttaacaaaagactggaacaatgacgtaaccgcctcgaaaggggcggcagcggtaaagaatagtctgatcggtatcgtaacaacacaaaaaggcacacggcctttcgatagcaactttggttgtgagatcggggaacagattttcgagaacatgaacccgctaacagcggaagcagtaaggacttcgattgtctccgcgatccgcgcatacgaaccccgtgtttacaatctggatgttgaagtgattccgcagtatgacgaaaacgcaatcaccgtgacgatttactacagcatcattgatgaaccggaagaagtagaaagaatcaaactccagctatcatcctcataacaaaaagccccgaaaggggcttttcttattccatcacgatccagcccattagctgttgatatcgcaattcgaacggggtgatgaaagagcggttattgataaccttcgtcccgttataggacttaatcacttcctcaccacgaagcacatattcgtatacttcgtccatagtgtcgtaacgcacttcttcgacttcgaagcagaagttggaatattcaatcattccgatcttgttcgcgtaacggcgttcgatgcagccctgtttttcaatctgagtgatcgcagtatcaatgaactgcgcaagtgcttgcatgaaattaccacattcgacttcacgacccccgcttgagatagccaggtaaacgcggctcaatccatcattgccgatgtaaccgatacagtcaccgccaatatagacagaccagactttacccatcggccccatacccatacgattctcactacgagaaacacctttcagtaacagtgccatgataccgccgcgaacgtaattcattttcatgataagccccttattttttcaggttgattaaccaagatggttgggtttctaaactaaccgctttccaagcatatgcaacactataaccggaatacgtctgacatacaacagcattttcatttaaatatttcactttgtgatctgcctcttgttcatccagggcagcacacacgatattcttttcatacactccgccgtttggctggataatggtttcttcaatcagataaacgctgttcatgctaattccttctcgattgcttcgatgatgtggagaacgtaaccgttcagttcttttgctttatcagcggcttcaaccataccgtaacgaggaacttctaaaacgttcgcaccttcgagcaggttgctttcgatgtctacgattacgtagctctcaccgattactgcgccttttctccagtcttttacgaacttcaccattttagctttcatgttctcgttccttttggctgttccgtttcgatatgtgtaatataacaaagccctcacgcgaacgcaagggctttttgagttaatgcataaaagatttgacgtacttcacgatttcttcacgacacatatcgaccggagtatcctctgcaatagcagcatgacagaagatttcaccatccagccagaacgatagcatgtactgaatatcccgaccttcgttttctttctggtgtttcttgatgcgatcaaatgcatcatccatgctttcggtagctgtaagcatttcagattcacccgctacagcagccatttccccagcttcatcactgaattcgctttccagttcttcccagtatactatcgttatcatggattaccccaaacagattttacatttacagagaggacattccgcctctttaacgcgcaagcgctttgttgctgttcgcttcgctgtgttgtgatcatacacatgcaaacagcggtaacagatcaccaatcgtttagccgtcataaccaccaccgcaacgaacatcaccttcaatgaacagttcgcggttatctctcaggagattgtatttcttttcgagttccggcccgaatgcgtccgcgtcgtcataccagtcatagttataacttccggtttcatcgtcgtattccggttcgtcgccgcgctcattgaagtgaacgattttaacatcatccagattcagttctttcagcttgtcccaaatgcgggttatttcgacgctattacatccgaacgcttccagtgtgattgtaccgtcatcgtgtatttgaggcgaaccccagcgaggacgagtatcatcaaacatatccatcagagattcaacgtttgactcaccgtaaatctttgcaacttcctgttctttaccagggcggacaagtccgatcccgataatgaaactactgcttgagctattgctcacgaacccagaacgaatcttcatcgtcttgcctcatatttcgcgttctccgcgattttctcatgatacaggttgtatgacaacaccagcgggatacaagctactataagcccgatgaccgccagttgatattcgcgtttatcgaacgccataaatgcgatcgtggctcccagaataaacacacctaatgcaatgatgaagaataatgtcattttggcagggtatccatttcacgagattttgctttcaggatgtcaatcacagtagtcatcgcctgttctacatcaccatcatagtgaatcaggaatgttttgtgaagtcccatgatcagacgattgatgatataagccatttctgacggtaacagtttaccattctgtcgattgtacttctcaaacaagcggtagagttctgcgctattgcctggcttctcgatgctaaaattatgcatcccggacagaataccatccagatacagaacagttttgttatcactgcgcaggtgtccgccaaccttgtagtagttgctgaatacatacggcttttcgcggatatcttcgatatcgaaatcaccatgatcttcgatgttgccaacatgggcgaagaaatgatgatcttccagttcgagaaggattgcaccctttttgtaagggaatccgactaaatcaatctgccagccattttcaccgacaaatacatcatcaacaaccacgaaatccggcagcataggcgcgtatgcgtggttcttttcgttgttttcacgataggcttgtggttcggacaggtacaggatatcgccttttacaacttcaccccagaatacgttacgtgacatattattttcctcaatatgccccctttcgggggcggtcattgttagattttgacttctttttcttccaggacgatttcacattcgaatgatgtggtttcccagactttccagaaatcggatggaatattatcttctttcggaagaatatcttttgcagcgatagaaactttggtttcttcgaagtccagatccgcgaaccatgcatgggctactacaacaccgtacattacgcgacttaaacgggcattcagtttacggacttcctgaatcgttgcctttgtctgcttatcaagatactcgactacctgatctttgtcaagcgcatccagttcagatttcacctgatcgtaagcccacaggataatcaggtcgccgttgttcagtttcttcttaccttcttcacgcttcgcgacggtagccgctacagcaggaagggaggaaacacccttgattttcacgttcagttctttcgacatgtaaacatcagtcgattctgtgcgctcaaccttcggagagaacccgtaatcacgaataccctgttcagacagccattcacccgcagcctcaccaaagcgctgtttcagcccttctgcgttgcgcagtccgatcgcgttgtcacggaagaacttcataaccttctgacggcctttcaggatttccagacgcacgttatcagtcacgaactctttaccgcttaacccgcgagtcatgccacggttaaccagaggcagagaggtaaagtctaccagaaccgacatacgatcatcaccgattttttccagcggcttgatagtcaggccagaagcacgaaggtttttcagtgtcggaatatcggtttccagcggcagaactttaacgttcacgataccatctttaacgatggtgaagttacgcacctgcttagtttcgactttttccggcagaccgaattctttctgtttgctttctgggatagtcacatacccttccagatccgtgttgatggaaatgttcggacgggaactgttacccaccagatgtttaaccgatactttggttgtggtttgggtaaatttcggtgtccagacttcatgcgctaccatttgcgccgccagtgctttacgttcttctggggttgcagcgtttgcgatctgttcggtcagttgatccagtgtatcatcttctttctgtacagtctgacggcctgtgcggttatacgcccagtgctcagaagacaggtcgatcactgtgtcagtttgtgccagcagttcgagcgcatcaaccagagtgaacgcgttttcgtctggaaccatgttgtaatcaataccatcaacgaaacgctgtgatggatctacaacagcctgtgcaatcaggtctttcgcgttggagtagtcctgtttggtaaagcagttgtcatacgctttgatcagacggacatcacccagcttttgaagcactttccatgccagatcagggttcattgtgtgcagtgcatgataaagcacgacatacagaacttgctgttcgctggcgatgttcggatcgaatccgtcaacatcattaatcgcgttttcacccagcgcccagatgtttttgatgtgttctggaaccagcacaacaccgtttgcagcgttcaggacatacacgcgcccttcgtccaggtagatcgcatgggtagcatcagcaactttgacttcgatacgcgcggaagtctgcgcggtgatgatttcgttaaatgctggttcgtatgcgtcgaaaccttcaacgaatttgtgcaatgcgttggttgcttctgccattttttccagcagaggacggtttacataataaccgtattccaggaacgcgatactgttgaaagtcagtggcagaaccgcacacgctttcagaatatcatcggtacgccagcagttatcataaccgtctgtcaggaagatcaggctgttcaggttgccgttttcagattgcagatcggtagcgatttccgcagccagattcaacggctcaacaaagccagtacaacccgtaggtttcaggtaacggtcgatagccgcgcagatgttagacaggtcagagacattgctaaccttctcaccacggaacaccgtgccgtaatcgcctttgctggagaagtacaggatcgaaacggtgtcatcctgtttaaccagactcgccaggtttgctttcaggtgtttacggatcttaggcagttcgttgtacattgaaccggatacgtcacacacgaaaacgtggtttgtcggggttggcttcgatacagcgtttttgaattcgatatttgtgattgacatttaaattttctcgtatttgaatttttctaaaatttcgttaactttattgcttactgcttcgactgtacgatcacacccgaacttacgcgccaggagttcaacgtattcatccatcgtagtgagtttggattctgcaacgtcaaacgcaagcgcatacattaccggattccatacccgaacgatttggagagtatactcgttcagttcaaatcgttcaagatattttcgcaaagaaaatacatcaaacggtgcggggcgatcctggctaaaggggatcgactcccctaatgcatagcgaggcataacaacacaaacttctgttttcagtttattatccatcagtgatgactctttgatgtgtgttcaaggttacggaagatgtttccatgttccagttgagttccgatcgggccgcattcatcggagtacgtgaattcatagataaacacgccgtcctgattgccgaacttcgtgttgtactcttcatacaaccacattttgatcagagcgtctttctcttctgtgtccagatcgtaccagtctcgcccgtcatacgcaagcgcaatttgaggatttgaacggtaacggttttccgcgctttcttcggtttcccagtcatagcgcttatcgtcgtagaacgattcaaagctattacccagatgaccgcctaagtcacgatgaacgtgattgaccacttcttccgctgtcaacggcggatcgtagtaaccacaatcagggacgcaatcacccatcatttcgcgcaggttgtcgatatcagtcggatctttcgggaaccggacgatgaaactacttgatgaactgttgctcacaaaaccagaacggattttcattttacatcctcaaattgtaagttttctttggttgcgttcgcaatggctttttcgttgttcagtgttactatgcgcagacgttcgccagtaaagccgtcgcattcagtgatactcacccagtcaaaagatttagccatttcaatcgcacgttccagcgatacggtagaaccgaccaaatcactaaatgtatagtaatcttcgcttaaactttcaacagtataaattttcatgatactttaccctttgtttcggatttcaggacgatgttactgtaaggatcttttgctaccagttcccacaggtcgccaggatgttccccgctacggtagacggatgaacggatgatttcgttaaacttgctcagggcttcgtctatgtcgtcatacccgcatttgagaggcttacggttgcaacgaatgaagaacatttcgttggtattctccccgcgttcggcgtttttaaccttcataccgcctccattttaccaatgacttcttcgtatgtcacagggttaggttcatagccgttagcgcctattgtatcgcctactctgtttcctactaaagaagcaaccgcaactttcttgccgtctttccacgcagtgaaatgcagattatccgcaacatacgggaaggtttcgtgattgttcaccgcgtcgatgcagtccataacggtatcagacgcgcagatcagattaccaggttcataatcaaccaaacattcaacagtgtaaatcataataatttcctcacgaaaaagcccctttcggggcttgattaatcagtgtccgaacacaccacgaatagactctgcgaacgcgtacagttcagggtttttcgctttcactgtttcgatttgttccaggatgtaatctggtttgtatttcgcaccgaaccagcagtaagagaaagaacgatcccacatgaacacgttgtagtattcaccgttacgcacttcaaccatcacgtaacctggattagaacccagcgggtaatctttcagtagattgaatttcgcaccagcgccagtacatccgttaaacaggtcattaaaagtcatggtatgttccttttcagtttcgtttcgttaaagctaagataccactatcaactactggatgcaaacacttttttgaagaattttgtttccggtctttctttgtacggacgcattaccaaatctttaccgtccagcacggttggcttaccttcgagttcgatcaggatgaagtttcctttatgatacttcaatacgccctggctggcagaccattcatcattatcccagtggttgtaatgccattcaacaacggtatcgatcgggatttctggttgatttctcataatactttcctaatttgtttcgctatggcttcaatcacgggtattgaaactgaatttcccgcttgacgatatgcctgttttttactatccggtatgataaatgaatctgggaacccttgcaaacgaaaacactcacggggagtaagtcttctggggttctttccttcctgcaacaccagacattgaacgccgtccttgtaatactgctgggtgatagtcccagtgtgcgtagaatcgcttgtgacggcctgataaccgaaacccttaccgtttgccttatttcgttccttacgctctctaaagcccttccatgcgttatctgacagggtgaacgaatcatcagcatcttcgaggatgtcgcctactcgcgtaggggtgcgcgggggaaccggaaacgaaaagaatacgtcatccagaaagcagacaataaacacgcgttcgcgtctttgaggtagtccgaaatcctttgtgttcaggcgttgatagaatacgttgtatccttcggcctccagaagcccgtaaatcgttttaaacgtcttccccttgtcatgggttagcagttcaggtacgttctcaaagaacagcacacggggctttttagcgcgtataatgcggaggatttcaaagaacactgtaccgcgcacatcttcgaatcccagtttcaatccggctttactgaacgcctgacacgggaaccccgccagcaggatatcatgatccggtacttcgttttcatcaatctggaacagatcaccttgtaggttatcattgccccagttttcgatatatgtttgctgtgcgaacttgtcgatttcagacgttataaggcattcgacaccgccgaatgccttatcaaatcctaatcgaaccccgcccacacccgcgcagaggtcaattattttcatacgtcaaaatcaatctcgtcaattttgtatgagttttcgtcaatgtccgcccagagggttacattaacatgtttgctatcttcgtacaactgacgaccatcaattccgcccgtgtaattgctttcggtacgttcagtaacttccaggcggaggctatcgcgcatgatctgaacaacagcctgttccagtgtaaccgcgtctgggtttttggtatcgcccagtacaacatctttaacgttcaaaataatatcagtcattagtgccactccgttttaataccatgtcggtatgcgtcaatccccagcggggtaatcagcaaccatgctttcgaattatcgtgatagcccgttacccttcgagcgtaacctttttgaatcagggcatcacgccctgatttgctgggtacgtcatcgaaatctaagtctagcaccttagttgcatatccgtaaagtttatacagaacatcaatttcagcgccggacaatttaggatacatcatttgtaataccccacaacatgatcgcggtatacgcgttcgatgaaatcgttccagaattcgcggtcaacttctttcggatatgttgaaatcgctgcaagccgttcgacttcgcccatgacttcttccagcttttcctgtacggttgcgaacggtacgccgccagctttaaccagtttcaggaatgcgctatcaggcagaggataaacgatatcaccatctttgtaaatctggatcaactgcataccaccgcgcaacgcgtgacttaaagccttccagtcgatgccgttgttggcttctgcttgtcgtgcgcgttctccgtattcatcccagagtttgtacactgacttacgcatttcatcggctttgatcgtgaactggaatttacgccccagcacttcatagaagtcctgacaaccagatttcattgtcgtgtcggtaacgaatcggcagaactcgtttgtagggaaacgattcttgatgtcagacactttcacttcacgcgtatagcgtttcatatctggtgtgaattcctgaataccaccgatcgtttcggtttctttcagtacatcgacaacttcgcgcagtgcagccaggcgagaacctttcacaccatattttgcggcttgcttgcgaacataaccgaacaggccagttagttcagtggtgtaaaaacgccagcggttagcgcggatatactgccagatttcagagttagcgatcagcttgtcatccgaagcgtgaagcatatcgagcgctacggtatcaccatcacacgcaaggctgataaacttagtcagactatacaactgacgatcaacgtcgtctacggtgtttttagagcttttatcgcccgtgctggtgtcgatagtctttggggctttccccaggagaatatcgcgcgggtgcgggagaaagatccctttatagtctttatcgcttgtcggtgtgttcagtccatacaggtgagaaccaaacacggtttccattacagttttcaaaatttaacccccagggtttttgcgataccgcgcagttcagcggtagtgatttcaggaacaacaacagcgtgagaaccgaactcttttcggatcttttcactcagttcagcacgatactggatttctttgtatactgcttcgctgcgatacatataaaatccgccccagcccccactaccagaagtcaatccagtcttacgatcgactttctcgatgttccagcttttcaaatcagcgtctttatcagtggatgcatacagatattgacgcgcaacctttagaacgtgaaattcgcgagggtttgctgttttacgggtattgtataacctttcgccaggatcgtaaagggtatcacccactttcacatcagttaaatctttcggattcatttcattttccaacgttttgacttttcacagtagaacaccggaagacgggccagaactggcttcactacgtcttcccctgtgttcgtgttatgaaccacttcgattgtaagggattgcccttcggacggccttacaatgtccagttccaagatctcacgattaccctttgtattgatttccgctacgtagtaatcgtgtccattgatgtttacgacatcacccataataacgctaattgtttgaatcatgagtatgcaaacttaattttaacattcagggaatccagcaggattgaatcacgcccatcaatgacggttaatcccttgtatttgctatcgtcttcgctcttacgggagtatacgcgacaaaccagagaaccatcctgtgctatgtattcaacatggtattcacggcgttctgacgtaaacacatcaccaacaacaaccggacgatcgacattctggcgtttagtcccttcgtaggacagtttgccgttgccgtctacggcgcattcaatgcccttatgtgtgacgctcgcaacagtaacaggctctacagttccaccgatcagcattgccggatctttggttcccagtttcatcaccagtgtttgacggatattatttgacatcggttctgtaacaaacacataaaccatatcgtttttatcacgcgcaacagattgcaaagtgaaattcttcgtacctacagaaccagtatgattgattcctacacgattaccgggttccagcgacatacgacattttacatcagagataccgctaagggttgctactttcatgatttaattccttcaaagtcttcattagatttccaatacacgttgaagttacggcaatcgtggtcggaagtcaacgtatatttttcttttgttttctcgtcggtgatcaccatcgtttcattctcgatcgagtccacaccatagacgaatactttatcaccgcgtttattcaggaacgcttcacctgtttcaaccaactgccagcagttgacgggtaaaccacccgcacagatcggacggtttacgaggcagtaaggacgtttaatcatttaaattcttccattgcataggaagtaagatctttgaaataccttgcggtgttgccttctgggttgtttgtaatctccatcaggataacagcaccatcaactcctgctttcttagccatgaatgaaatggcttcggtagcaataatcgttgctttcataacatcagctttagaaacgttgatcgtattcatttttcttccttttcattattcatgcggtatgtgtatataatacaaaagccctcacgcgaacgcaagggcttttttaatcttttatcagagtcccgtgaaagctacaacgatttgatagtggtcatcgaagaattccccttgtcgttgtacgacctcatgtaagggcatccagaacgcctctaacgcatcgtcagaaccgcccataatgcggggcagacttccatcattgttaggctctaacttgatgtactgcgccacagtcggttttgagaagtgtacggaacgcttcggatgatcgaacagcatcgaattacggattgaaccacggataaccttttcaggaaccttgatccgtacctcttcgagcagttcgcggatcgcacaatccaggaacgtttcatttgcgtttttgtgtccgccgggaagggctaacgcgtctttacctggggcgaacttacgacgaattaccagcaggtgattgttgcacacaaccacactatcacccgtgcaacagtttagcgcgtcggggtatgggtagtttttgaatttctccaattcgctttcccatttctcgtattcgtagaataaacgccagaacgtgtcttccatcatccatttgtcgatataatcaacggttgcttgaggaacaaagcgcaacagtttcttatcccacccgtttttatggttaaagataatcggacgcagatcggttgctgatagatccttgccgttaatctggacaggtggaactggtacgtgtgtccatccgaacgctttaagccagtatgaacctgcatctttttcgtaaccgtagatagcgattttgtcgcctttggtttccctgatagcagtacgaacagaggttttccatttctcttcgttgtaaagataatctggaatgtgctcaaactgaacacgaacaacatcttcgatcgggaagttagcgtttaaccatgagaagatcatggtttgacgctcacgcgccgtcagcgggtttaaaacgttagggtaagcatatgctgaacccagaaggatgtaaacgatctttgcttctccgagtgctttacgcaccattgctgcatgaccattatggaagggttggaatctgccaattacgacagctttatcaaattgtttcataacgtgctccacgtttaaaggttaatcataaaacagacgcaatcaccaatacaccaagaaaaccgccaataaagccgaagaatagcgaaatgaagatagtaaggatgatctgttttatgttcattatagtattctcgttttaggagtcaagcccccaagagcgggggctttaaaaccttatttacgagaatcgaaaatcactttaccagcgtaatcagaacccatgacagtttgaggtacaccgccctgatatttgtccgcgatggtctgctgaacatcaagttctttccagcggatcatttctggggtgattgtgcgttgcagaatggcgttcgcttcggcttctttcttagccgcatacagacgggcatcagcatcacgctcgttagcctgtgcagcattgctacgggcttctttgtcggcaattgcctgaacaactgcctgttgagcgatttgctctttacgtgccagttctgctttttctgcgttcacctgttcttcacgaattttcgtgttttcaacctgcttcttgatcgcttccggcaggtcgatatcctgcaagaatacctgtttcacggtgtaaccgtaaggacgggcatactcttcaacttcctgctggatcgcgatctgtagctggctttgaacttctgcattatacagatcctgtgctttcggtacagatttaccgaactcacggacagttgacagaagtttttcagtcacatatttatccagcgcctgatcctgactacccgcattgatacggttgatcggggctttgctaccatcgaactgtaacatcacggtcatatccacagtggatttgaatttatcctgggacggaacctgcaatttgtcaaacttcattgcgatgtctttggtgttgaacacctcgaaatcagccagtggatttaccaggtggaaaccaggcagaacaggcttcggtgaaactttacccatgaaggtttgagtttttaccgtaccatcctgaacgatagtgtacgagttcggaaccagccacagagcggcgattacgcccagagcgatcagtgtggttttcttcgggttgtttacgatagtgtttaagttcatcattatttccattgggtttatgtttcaattcgatagttattctatcatcactttttcgcttgtcaaactctttttaagaaagttttgtcagcttgtaaatcgtttgatagcacaagcctttgatctcgtccaggacgttcttcaatgaactatctactgaatcatagatttcgttggcttcatcggctattttacggagatacgcgaccgtgtcaagcacattttctgtttttaatacgggtttgtatcgaccagtaatgcctatatggatttcggtgaatttatcaaccaaatcctgcatatcttcgtaaaacccttcaaatgctttatgctgtgaatatgaaccagtcgcaaaatgtgcgctgtgcatataggttacagacattaagcaagtgccaataaaggcatcaattttactcgcggtatcgcgttctgttacttcgttaaacgtctgcatcttcatcccttatgaacgatgaatagcggcgaattcacttgcaacccgtagccctaaacgtttacattcgggttcggatttacattgcttctgctgccattttcgttccatgtaattatagaatagttcgctggtatttacgctgggagggatggtgtcaagatatacctgtagcgccgcgttgatgtagtaatcgaactctttggcgactacggatctatcatcagcatgtgatgacggagacaagattaacaaaccaaacatcagcgctttagatatgcgtttaatgttcataagcaattctctacgtgcttacggatcaacaatagatccgttcctgtatatatttatagcaaaaaaggggcgaatcgccccttatgtaaaattagtctaaaaatacatcaagttatctcataccagcataagctacgctcaaaagcgcggatcttatttgcgttctcgatattttcatcccatccaattacgccagctttcatccggcgtaattcctgacgcattttagcgcgtactttcgaatcaatctttttcacagcgattgaaagcatcgcggagatatcacgatgagctttgttaccgtcgcgattcaggtttttatcgaaccggatatatgcgcaacctgatttgtgtttccagttggttgtataccaacgtaaaccatcaggactttccccgtgctgtgcataatactctgaaaatgcttttgtctcttcgatctgttcgatggaggacttatcacggactggaacatatttcttacggtaagtacggctcatagtgttctcctttgtttgtctgaatacaccttaacagttcagaccaacattatcaagaagtttttcgtgataatgtttgcgacagagcgaaacgtatttgtcttcggctccgatctcaacctgcgccccttcggttacgaagttgccttgtgcgtcgatacgtgcaaccgtagttgctttgcgtccacagtgacacattccgcgcagttctcggatctcgtctgcccaggccagcaaccagtaagaaccctcgaacagattcaactggaaatcagtacgcagaccgtaagccattacagggatttcgagttcatcaacaacgcgacacagatcgaaaacgtttttcttcgaaaggaattgcgcctcgtcaacgaagatgcaagcaattttattccggcgctgaatgtcccagaacagatccatatcaggcgcaatcaattcacacttttcgttcagcccgatacgcgaactcactgtgtttgatgtgcgggtgtcgattgctggcttatagattacaacacgcataccgcgttctttgtaattgtgcgcgtccgtcaatagtcgcgcactctttccagcgttcatggatgcatagtgataatacagtttagccattgacacgctccacaaacttaatatgattctggaatttaccctcaccttcatggtttttgcatgttttgtttgaacagtatatccaccaatcccactcgtcgtaagggggtttgtcaatgttcatgacgcaaatcaaagggaaatgacaatcccgacaacgaactttttctataatgtgtgcgttagccaattgtaaaccacccgttacccatgagttttttgttacgtcgcgcaagatgctctttgatttccggcatctggatagcaatatcatactcttctttcgtcatggtatgatttgcacaacccatacacccgcacacctgcgcgttacaccaacggagtgttccgtatgtcgcaatcaccttcattgctttagctttgattttgtcagtcatgattataaccgcccatttcgctatcttgtgctttatggatatcaagataccacatgttgattttgcttttcagttcgcccatttctttatccagtccttcatcaacaagacaaagaatgtcaaccaccgttttacgctgtgtgatgttgattttgttcgctttcatggactgcgccagcgcttcacaggttttcaccagtgcggcgcgttgtcctttgattgcggcgatccgtttgttcgctttcttgatcgcccgacctgctttgataggatcaatcatgataaatccgccttacgtggatcaaccgatggatcgaagtgaacgacgatgatcgggtaatctcccgtacactcgtcaataatggcgctaatacgcagccaatcacccccagcaagccccgcaccgataagaggggtaatgataggcaatttctcaggaaacgccctggcgcgttctactgcgctcacaaagcatgaccggattgcatcataatccacttgtgggccagtaccccagaatttaaactgagtgtatgcattgaagacaatctgaccttcttccgtcatgtagatggagttagtgcctaacttccgctgatcgcctttcatagtcagtgcatcaattttgaacgcaccagggattttgtgcttcacttctttagcaatacccgcgcccatgttgcaataacagttacacccatgaatcaagtgtacttttcgtttcaggaacaactctacagcgttccctttgatttctttaataatcattttcatcacctgtatagtggcggtaagccagcacagccagccccgcgatcacaaccacaacacacattaagatataacctgtgttcatttaaattcatcgtcccatctttgccacgcttccaactcgtcatcatatacagggaacgagctttcgtttggctttttaacgtaataccagataatgattgcagcagcaatcacacacccataaaagatcactaatcccaacatcagtataatcctataccagcgttatattcttcaaccaggtaagtacggagtttttcacaacgttcattatttggcgctttggtgcagaggttcatcatcggttcagactgcaaaaactcacgctgtttaaccagcttctgacgcttgaagaggtgcgcattttcttcgccccatacataagccgcgtccagttgttcagcgattacctgttcacataccgcaacgtctttaatgtcgcgatggttgcagagttcagccagtcgaacatcagcatgagcaaagccagcaaacagagtgagtaacagcgcaagttttttcatcgttttaccttagtatgaatcgttttcgataggggtataataatgggtttcgcagacatacgcaagcactgatcgcaaactatcgctttcaaattctggattttgattgagtttcagactccaacccgtgaagcacatccagcgttcttctgcaacgtcaaaggctaaccaatacgtgttgaactgtgaacatgtatgttcgaagatatcgaatagtagtttaccgccgatcggtttcacatatggtttcacgcgttgaagcgatttcaggactgtttcgaggttactgcgatcctcattcatcgcgatacggagaatatgctgattggtttcttggttatatccatcaatccccagacccatatcctggaagaacttagtcgcatcatggaaaatctctcgtccgctgttcggggaattgatgtagaactcaatgcgttgttttggagtcatcgcgcggacacgggaagcggttttgtgatcgatctcgtctttgacctcctgacgggctttcagcaacccgttcagcttttcctgatagggttttacaatcgctcggatttcgtcgatacgttcatcaataattgctaactgctgttccggtgtcagtttagtttccatgttaagcccctacgcgcacaaagcgatcttcaattgcatcattaacacattcgtaaatgctaacgtcattcgggacgtgcttacgaatacccactttcacgatatccatgatctctttgttgctaccccacacgttcaggttgaagtaaacgccaccgctatgaattgtgttgttgccaacatcaagatacgtatcttgactttcgcagataaacagtttgcgtttttcttctccatatgcgaagtagatactgaacgattccatacgatgacgatcgaccgtgatggtttccactttaacctttggatctttgttcagttcatctaacacaccctgaatgatgtgcagcatgttcggcttgatgatagtagggtgactggtaataactcgatgtgatgtgctcataatttaatcctcaatagttggtacacacataataaaaaagcccctgcgaaattgcaagggctttttatcagataatgcgtttttcttctaacagcttcgcggtatggttaaccatgcgagcgtaatcacgggcttctttctttgaatacttgaatcccgcgttgtaactcgccagcgcctttttcaagtcgcctttgtggtaatcaagccagtattccagttcgtgaagtgcatacttggaaccaccccgaagggtttcgagcttattgattactacgcgtttggaatatgatttatccattcgtgcggacgcgctacgggctgttacttgaaaacaaccataagcatgatgattctttttgcctttccctacgttctcacatgcgcgagactcgatccaggcaatagccgctaaatgatatcccaaacgtttcgatgtttccgattcaactggctttgcagttttgcgatcgtactcatttccgatcctgaaagcgtactccaaaacctttttctgctttggtgtaatatcatccaattccttaacatagctgggggcattggctggcgctttcttcattactgttgcttgttgtagcggtaaagttgacttcacagcggggagtgtttggataaactctcctaacggatcagtcgccgcgttgccagaaaaagagcataagaaaatgctggcagcaaagataattttcttcattgtaatacctatttgtaacaagagagggctatgataccctcgtcttattatttatgcaacgattttacgctgttttgcttcggtcagttttttctcgatgaattcagcaatgttatagtttgaaatcgaaacgttcggatcgtacagttctacgatttcatcaaacgatacctgaaccacatgtttaaagtgaacactccagccagtcgtaaagatttcgctgttgtcgaacccgcaatcagggctgaacatggcgcggtatttgtatccgctgtaatctttcaaacgattcgggctgtgtgcgtcactggtgatcaggaatttcccctggtgagtctcaaccacgaagaaataacccagacgttctttgttgtccagcatcgtttcgaacttgcggttgttatcttcacggtcaacgcgagtttggatcttcttccagacctgttcatattcaggccaatcatgctcgacaacaaccccttttatgggttctttgccttgctctttacgatagcgatcaattttattcactaccgcagagagaagcagtttgtcgctatcacttaacgccgcatcaatatctgcatatttaagcactgcataacgttcttcgcgtttcatactactacatccttatcacagactggacaccggatcacacgatacacatcacgaccgccagtgtaatcagtagataccttttctttgacatcctgcgcagtgtatgacagaacagcaccacaacgacaggtagtttgttttggggtaatgcttacaacttgaaccataataacctcacaagaatagtttcacttcgctaccgcatttcgggcagacgatatgttttttcacgatgtaatcagcagcacggaagaaaccgttgtagaacacttcgtttttcttctgtacatcagacagttcatactctaacccacttttgcagttagtgcaaacggtaattagctttggactaacaataacgctgatcatgtatacctcacgaaaaaggggccgaagcccccttgattaaaagttctcttcgacgaatgcagccagtcgcccacgatatacggtatccaggatcacatgacttgaatgaccgtactctttaagtttttcaaccgcatacacaaagccgttgttaacagcagtgtttcgcgggttgtcaatctgtttaatattcccgcatagtatcagaagggtgttctcaccgcaacgggaaatgatggatttgatttcgtgattgctcaagttttgacattcatcaacaatcagaaccgaacctttacccggatcaggatgcccgattgagcgcccacggaagtaatacaggctagggaactggacaacgtttttctccagcagcccttctacatatttgtcaacttccggttgatccttaaacagaatgttcaggctcgtaatacatggttctacagcaggacgcagtttttcgcccagagtaccaggtaagaacccgatttcgcccgacagaggactatccgatttaacatacatcaggtttgcaaagtgtccggcgttaaccaggtgcattgcaccagcaacagccagcattgttttacctgaaccagcagcgcccatgatggtcaccacatcggtatttttatccataattgcatcaatgaatgacgcttgcagtgcatcgcgaggctgaattgttttcatcagcttacgcttcatcgcggattcgtgtttgattggtaagagttcaagctgatactctccagcagccactacacgccctacaagttcaccatccgatagaatgtattggttcgggtaataatcgccgtcaggaagcgaggaatagcttatttgggctacttcgccaacatatcctaacacctcgacatcatcccagaatccagggatatcgacataaccagaatacaacacatcgctatctttcagcgagtcatcgcccgtgtattgttcaacaggacatcccttagacatcgcgatcaacagcatgttaatatcgcgggtgatcagggttgcgttttcctgcatacaggttgcaatgattcgcgcatcttgtttatcaagcgggaactcttctgaaccgatataatcaacgatgcggagtttcacgctttccggcagtgctgggttcgtcaggttcaacgaaacccctgtttgggtaattgcttcgtacttctgccccaggattactttagacaggaggcggatcgccaatcgtgcttcatgagcggttcgctctttgcttttcaggtgatccagttcttccattgtcgcagaggtgataatgatttcagtacccgcctcaacgaatgagaagattgaatatgggttcgagattaaaacgttggtatctagaacatatttcatagaagttttcctgttaattgcggggtacgcggattcgcaccccgcgcactgcaattacatacccaaacggataatatggatatatgggaacgggtgaagatgacttgaacgcatacacaaggtcagcgtttttgccagttcaaaccgttcgtcgatcgtcgtgtcacattcatcgaaaatcaggttgattgcctgatacttgatggtctgaccacgaaagattgtccgcaaatcctgttttttggaaaggaggatcacgttatcatccccgcgatcgataccatttccgattgcttcatccatcgccatttgtttcgtacaagcaacgtagatattcagtgtccctttcgactgcttgatgatatcgaaagccgctttggttttacccgacatccggcccatatccagcgcagtttcgaagatagacacaccgccgcattcttgcccccaacgcccatcaatgattcgcgcaaggtgcaggttacgtgactgctttacagcgtcaacatagaattgtgaaatcatgttgtcgccttatgcaagttcaacgtgtggtgcgtcgataaatttcgtttcaatcggaaggtttggatcgttcttccagttgataccgtaacgcagttttacgccctgttcatcagcggcttgtttcactgcattcaggacaggcaaccacactttcgggttagtctgccagccagcagggagaacgctaggatacagatccacagcatcaccagtgatgtgttttgagttcatggtctgggaaacacccttgcggacgttctcgcgctgttgctctacggtgcgcagaccttcgcgtacaccaaaatcaacaggcgagagttccaaagcacgttttaccaccttaaccagttccggcttcacgccttgcaggttgttcaggcttttctgactaaatttaaacatacatacctctttatgaaaataccctatgggctacacagggtatttacggtttaagaggcgcaacgttttacatgtaaccccaaattgcatcttccgcgcgatcgcgtttccagcgaatcgtcatttccagcgaatcgtcatttcaacactctcctgtttgtcatcaggaggaagtttatcattattgatttgttcaatatatgcttgcgcatctgcttcgctacggaacaacgcatggaaattataatggttgcgcccagttacgttacgatcatccagagagaattgacctttattttcccaatcatcatacacagtgattccgttaacaaacagccccagcccacgatgttcacgcgggaagccagtgatgatatgttttcgacccatctgtgccttttcaccagtgatactgattacttcgtacaggattgcgccaggtttgatatctttcaggacagcacgtttttcaaaagcgttcataatgtattcctcacaattagttttcatatacagattaccacaatctgttttgatgtcaacaaggtctatcgtttttatttgggaaagttaacgtgaaaaggcgatcgtgtaatgcttcgatccgttcatacgcttgtttcaggatcgtcttatcttctgggttcgttgtctcgatgcagatcagttcgtccgagtcgatagcgatcacatcatccatcagtgaagcgaatacgttcacgtcagggtgagtcaattcctttatctccgcttccatcccgtcatgctgggataacagttcgatgatatcgcgctgtaaatctccctggtacgggaatccggtttgaagatggttgataattctttctgctttggtcatatttcacctacaaaaaagcccctttcggggctgggattaaatgtctttgcactggcaaacaccgtatttggtgaaaggcttgtcaccgctcaggtaagaccagatatcgcaagcctgttcagcggtttcgaagattgcagcatcatagaagccgtgttcttcgttaccatctttattgaggaacacaggaagccagctttgcggtttgaagcagtcagtaacaactacccaaccttctttcgctttcattgcttctttgttcgcttcaaccatttccagcatttcgttcagtaagttcattttaatccccttgtttatctgtttcgttgtctacgagagagatattatcacaacggggattagtgtcaacagttattcgaaacgaattgtgctatttttgaaaaacattccagagcacacagatcctttgatctgcttgccgttcacaccagttgcttcgaatccggttgagtatgtgtctttttcagaacatgcaaaccacttgtaacccgtgaactggatgttcgtataaccctgtgcttccaggatacgctgtgcctctttctcgtcagtacagcttgactgcaagaacacaacaacgacaaccatcaaaatacacacaacaattttccacataatttatactcttttaaggttagttttgctggcttcgatccagcttacttggttagatccaatatcacccagacatacagttgtatgactaaatgtgttcggtaaagaaacaccatcaggagataacaacaaatcatgtacacttacgctggttgcatacaaataaccaccggacgtatacagtgtttttatgaaatcatatgaatcgttgggccacttgaaacggtatttctggttccagagttcaacttcatgcacatcatattcatcgaacaggggatcgttgccctttgtcgcttcgtaaagcgcaccgcgccattcaactaaatccgcttcgatatcacttacacaaaactcttcttttgcgctaagtttatcaagcatcatttcaatagtgcggatagccatgcttaattcacgatcgagtttcatacaataccctcttcttcgagcacttcccagatcaggcgatccaggtgcatcaggttccacataacggagtcatacgaacccagcgagcgggagtaaatcactccccatgaacgataagccttttggaatgattcagcactgttttcatcgtgcggcatatcgtcacccgaagcgatcagcagtttcagaaccatcaggctattgagcgcctttggcgtgaattcttgttcgcttaacttcatcgcgtaccgttcgatgatcgcgattgacttcggatctttaatacgcccatctgtacggcgcgttttaaacgcgctcattaattcatcaactacggcggtacacttcatatgcttcatccttttcctgtgcagacatccgattatagcggatctcttcgcgctgttcaacttctctcacggcttcggctttcttctcagcagtgagtatgtgatgaactacagcgtttcggattccccagagatattcaatcatctgcatatcttcaacggtgtgatagcctttcgcatcacattcaaatacaatttcatcgcgttctgccattgccacctgtgcggtagaaggacaaataaccattccagagtatttttcaatcaacgattccagtgtacgcggttttgctggaatgtcaatagataccggaaccattcgcatcgttgaatcattatgggattgataaatcatcagaatgtaatctccgcaaactgcattctacgctcaatcgcatggatagcgttatcgcgctgttctttgttttcatatccagcccaggtaatcggggttgaacagatcaggtgaaaagtgattgctgggtgtctcttcccttcaacaacgattgttgcatcatcttcgatccaggttacgtgatccagattcaccggatagtttcttacggtaacagtttcaccaaccaaaagcgacacgtccagaatatcacgatcgcggacatatgatttaatacgagatacgattaacattatttcaactccactgcatatacatcggtttcaggggctttgtgtacgcgcatatctttaccacataccgcataagccggacagttacgacaaccgttatgatccttgttgccagtcagttctttacggaactgttttgttttcgggtgttcccagatatccttcacaaaatcttcggcttccagaacatccagaccttcttcccagccaccttcaacccagcgttcggtaaacgagcaagggaagaactgaccacgttcgttgatgtaagagctaaacatcgtcgcttcacagtcttcggcgtattgcttgtactgttcgaagttcgggtgtccctccatcgcttcaacgaaagcgggggctgaacagctatcgaatccaaatcctacaccagaatcgaggcaatattcaacaagttttttatattgttcgcgggtaacggtgtcccagttcttaccgcgtcctttttgtttcagtcccaggaacacgatcgcgtttacttgtttcaggcgcggatcattcttcacggcatcaaccacgttaaacgcgtcatcataggttttcgagctaaccatgaagtgaaggttgatttgctgttgtccggcttctgtcaggttcgctactgagtcgaaagcgacatcaaaaccagcgtgtttataaaccgataccgcaacagccccagcaaccgccgctaaacgcgctgcaacgtcttttgatacgtcagcaatggtaaggttcggcacaatgcctttagaacgcgcatacgccatcatatcgaacatatcagggtttgtttgtccctgtgcatcagcaccgagggcgcattgagtaagccagggcattttgtcgatgatttttttgaagttggcaagatccatgttgaacccgttcgggttattggacttgtagcagaacccgcagagtttacccgctggcccgttgcatttggtagtgatctcgatatcgagaatttcggggaatggtgcgtattctggatcgtgggaatatgttgcaccccagcgagcgaattcaccagtatcaacgttgaaattatagttgtagaacttcgagcgagcgaagcgcatattgccgtgttgatagatgaacagggacggcgctttgatgctggtaacgatatcgacagatttcataatataattctcaaaatttaacgtgggattggaagacagcgcgagcaaggctttcattgtcgaacggtatcgactggtgtttctctttgctgtcaatattaacgcgccagaactcactcgaaccgtttttggtggagtaatgcatcagcgttaccgttttattcttttccaggaaagtacgtttgtcaatctctgttttgatttcgtgctgcatcattttacactccgtttcagtttacgttcgtcagccagttcttttttgtacagtttaatgtacttcccgttaaggatgcgaagctgttggaaaactttgttacacaaagcacgttttgctttgtattccggcgtattgcggattgattcgatcgtcatacccatttcgtttttagggtaagcgcttaactccgcgccgatctctctgtaccagttgcttaactgatcacgctgtgctttgtactcttcaaaagttaacattataactgatctccgtaatctttcgctgcatcttcgggggttgcatccagtcggtaaagctcaacggctaacggactgggtttgatttcgcggttcaggatctcactgataccgcgaaggaattcgatataaggacggaatctcatttgatacgtaccgcgttaaaagcctggttgcgcagttcataagcctgttcaagctgttcagtagtgaacagagggctatcggtattagtggtgaaactgcaaatggttttgttgtcggcgttgacttcttcaacaacgatttcataaccccatgccccgctgtactcacatttcacgttccggtacttgatgtaaaccgctgcaatatcttcttttttgtagttccggcttttgtagatgatttccatgatatcctccttcgtttcgatgtgtgtacaataacagatcagggttatggagttttagcaattcgtgctaattacagtagcatttccatttgcaacagaacgctccagggattcggcggtaacagaaccattgaccgatattgcttgaccaccaccagacattcacgccgtcagttttgaattcgatgttcaggtagttactgaaaatatgtttcatgttattccccttatgccattttcttagcgattttccatgcggctttgaacgctggaacatcttcaacatcaacccagaaaccagaaccgaaaccatcgttgtagcaagggcaaccgtcgcagtagttttcccaggtcatcactttaccaccaacagaagcaccagtttccatcgcacgtaatgcatcttcaactttttccagtttttctgcattgtcgtcataaatgatgaagtaccatttgccgttgtattcgttacccagtttgattgcttcgcgaacaagtttcatgatgatttcctttttgtctgtttcgtttcgatgtgtgtaatataacaaaagcccctggcggttgcaaggggctttttaaacaaaaagtgctattttgtttcttcgaggattcgaaggatttcggcgcgggtgatcggatgttttgccagctcacggatcgcgtggtcaacgtgtatcttacacatcaaaaacttctccccgcacttgtcgcatgttgcatacatatcgccatgtatacgcccgatcccatcggttacggaatgatgcatccaggcgtaaggagttccccgcatccatccggtagcaacatgtttacattctcgttttcgtccgaacatattaccacccgttaggattgcggaaatgtgtttgccagtagcgcagttgttcgcggttcatgttttggttatcaatcaccataccctgaatcatctgcaacatcatgcgggtttgattgacatcctccaggctcgctatacgctgttttaaggctttgttttcctcttctaactcaaccatacggttgtatgcgttgacgcgctccagaggcatatcagggcgctctttgaggacacgggcgcgggatacttcgcattcgtgatttgctttccagtgcgcagcttctgattctgctttttgcttgtctcgaagcgcgagtgacagatcgctaaccagatccagaaccgtttgcggatctacggtttccagatattttccgagaccctcttcccagcttttaatctgtgtagggctgtcgccatatggaacaccatatgagaacgcgcgtttatactctttgcccctgaaaccatattcctgatttccctggatgctcatattttcaacgagagtccacttactacccatcatagaagaaatcgaacgggctgatttttcaatttcttcaagtttttcacttgttactttcattttgtactccacaaatcatattgtgcgcgaaggatagcgtaaaggctaccgatattgattgaatcgaccggacactggaacatatcagagcgcatcatattgaactcaatattgttctgttcaacgaagttaccgatcattgatgtccagcccatcaccaggttatatccgtcttcggataacccgtaagccaggttaaccctgatacaacgcttatcagccagttctacgctgatacagttacttgaatgcatggaattgcatggaaatttgttaggaaacttacggaacatctgggtaaggagtttagccgtttcaatgttgatcgcgcgttcctgatccctttgcgcctggttgtcatgacggcgattcagatacttttccatttttgggttgagattcacatgttgcataatatattcctcacaggtttaaagcgttcttttccggttccattacatgaactgcatttcggagatcggtcgctatcatatcgccccgatccgttacatgcaacacatttccgtaatttccagccatacacgaaccgcatgtaataatcggttcgtgcggccttgcgttcgtggaagttcatactttgttgtaaacctgaaccagccacatttcgatgttcggcgcgtaagtaacgtttaccatcggcatagtgcggtatttgtaagcggctttgtacgcatcgagttcagtcggaacacagaaagagaaaccgttgtcataacgttctgcattagaaacttcacaaccaactacagcggcaatgtttttgttcatgttcatgatgttttcctttctctgtttcgtttcgatgtgtgtaatataacaaagcccttgcattgctgcaagggcttttttcactttaatcgaatttttctggcaactgatctacaattacctgagtttgatggatttcttcactcaatttatcgcggtaatgaaccagttcacgggttctggatgctgaatagctaatgattttatcagcggtagcggtgtaaccgtaaccagcacatgcgatttccagttttgcgttatcgccattcggtacgcggatatgagcataggtcagcaagtttttaaccgcttgtaacagttcatgatcttctttaccgatgataaactgatttggttctactgaatcaatgttcagttcttcgtctttgttcattttgcagccttatacatttcaaggacgcggttcatatgctcttgtgattgaggcacacccgcgaagttcagtttgatgaagaattccagacgatcctttttggtgcattcatccagccccagggcaggtaatgaaatgttttcaaaggctcgctgttcgtgtcgtggcatttcgtcccagaacaaacgggaaccgtccggcataggaatcccaatttcaccttcgtagactttgataatcgtcgtcaggcgttgtttaccgtcgatgacttctacccagtgagtttcgttgaactggctatcaaccgcgatcgcgatgataccgcaagggaaaccactgatcagggtagtcagaaacgcatcttgctctttctgcgtccacacataggggcgctgataagatggattcagatccagatctttattcttccaccaatgcagataactcccaaccatgatcgcgtgatcgcgactgcgaaaagttaactgatcgcggatacggttatgaaccggaatatcatctttagacatgattcaccacccaacccaacaaaccagtattgatagccgcaacggtaaggcaaatcacagccaacacccgcgcgttatgaactttagttttcagttctgcgatctcctgatccttttcactttcgaactcgtcgcgggttccatagtaaccaggatcagcagcggttgcgatacgcactttgtctgtttcgaataatgttgattttccatgatccggcccaaccacacccagaataccatcacggtcggtattgacaattccgtgcgttccggctttggcaaacttaccatccttaacggttactacacgatcgccagctttgtaagtcataatatatcactctttcacgttttgttgtaagaactctaacagctttccttcggcctgtaaagcataaagtttattcaactttgcgatgttttcaaagtctgatttttcgctgaacgaccagacaccatcatcggaaaccagcgcacctattgatacgccagtttcaggatcacgcgtcaacgccagccccaggggatgtaggatatctttattgattttccagatcaaccccaattgagataaggtgttgaaatcaacgtgactcattaggcatcgcaccgaatgacagcagccccatacgatgatcgttatctgattcaccagtgctgaattcaaattcttcaccgctgatactgatagcacggaaaccatctttcaggtacggcaacagatacagagggatcagcatcatttttgaatcgtcatcccacttacggaagcccaggtttttcatttcttccagagtcaggtcatttggatcgactggttcgaaatcaggggaagcgtaaaggcgtccaggcagatcgcgaatatttttcacggtgaatgaatcaccccatgactgatacgcgataggttcagcggcgcgggttgcggtagccagaaggatcatttggcagatttggaaagtagttgcttttggtttcatgatgtatatcccacaagtttagtcagtaaattccccatagtcttacgcgcatgatcgcggatctggctatacggaacatatttgaagtcatccatttcagtaatggttcgaccatttttaacgaaggttgaagcacaaacacatttttctgcttcggggtaattattacccacatatacgaataacacaagctcttttttactcgtataatcaatcagacccaggctcaacagttcgtgttgttcaactacaacgcccgtttcctcgaagcattcacggatagcagcattgatcggggattcgcctttttcgatatgcccctttgggatgtcccaatgaggcgtttcggttgcgtggcccattaaaacgctgccgttattcaggaagagaataccagcagaccgttccattactgtgctccgaacttacgatcgtatgctgccagcgctttatctgctgcatcaactgcctgagtgtgtttgttagcggatttctcgctgaacacttcgcggtaaatggcaacccagagggatcggcgggtctgttcgctttcttcattgacgcgagaagccgcaaaagcgttatgttctttgatcagttgtgcgaattcagcatcatgatcaatggtttgttgttgaatagctgtagaagtcataattcacctatttctttcagttcagttttgagtttttcgagggttgattggtactgaatgccgttcacaatgtcgttgcgtcgggcataatacagcgtaccagttttgtttatctctgccaacacttctttatcgagtttatcaggttcattgctaaatgcaatcctgaacatttcttcggcgttcggcgcgaatccgttacagaacgtgataccgagtttcggatcgaagaatatcagggatactttattcactttttccataatgttcttcgtaatcctcgcattctgggagataggtttcgcagaacatacacagcgtgaagaatgtaggctggcgaattccgatattatcgggtaagtacatccagaacgtgttagcaaacacgatgaacgttttcaggttttcaacggttacggtactgataccgtcataaccggattgagtaattgcgcgttccaggggaacagggtattgctcgcagtagttggcgtaatgttcgcttgtcaccagcgcattagccgcttttacgagatcggtaattttcattcaatatatccccaacgaatttttacgttatcttctgacgccggacttgtaggagtcgggtacggatagctttgcgcttcccacagataaacaacagcatgttttgtcaattcttcgataacttcatcgaaagtaccgacactggtttgtaaaggcaacgagaaaggtttatcgttggtttctacttgagcgattggcccatctaccaagataacacgaaccgttgtgtgctcagacatatgagcatagattttgtttttcatgcgggtacatattccactttgacaggttttgcgataaggcgttctttagtgaagccttgcccgttacagatatcacaaacgtaactgatatcttccatctgatcaacccatccagaatccggcaagccagaaggatatgtgttgacacgtttgacttcaaaccctttaccttcgcatttagggcatacgtgcggatacttcgctttcagttctttggagatctgacgcaaagttttctcgccgccgaacacagcacacaattgctgtaaatcagggattcgaagatcggcgggag

SEQ ID NO: 37 - DNA, 178580 bp, Unknown
  source: /note="Description of Unknown: M16-3-2c Bacteriophage Sequence"
catatcaactgacaggttcattaagacccgaacaattagcggaaacgctatacggaaaccagcaatactactgggttatcctgatgcttaacgataattacgatccgttttacggatggattaccgatcaggaaacggcttatcaatgcgctatccagcgttattcaaaagcaggtggtgaacaggttctttatcatatggatggtaagggcaaccgttattacaatttggttgaagaccctacgaattccggtcattggtatgacaaaggcgataagaacatgcgttatttgcagtaccagggaacattagtccctgtagatatttatgaagatgcggtgcttcaaaatgaagcaaaacgaaccatcaagattattaacccctctgatattcaatcgtttgtaagtgattatatcaaggaaatggaaaaggcaaacctatgaaatacggtggaaataaatactcccctttctttgagggggtggtcgaagaagtcgatgatcctcgtctattggggcgtgttcaggtgcgtgtattcggtgagcatccggcacagaaacaaaaatctgaaactatcggtattccggttgaggaattgccgtggatgatgcctattcaggatattcgcagcgccgctatttctggtgttggtttttccccgactggtatcacgcgcggtagttttgttatcggttactggcgcgataaatggcaccaggacggcgttatactgggaacctttgcgggtgagtaccgagagaaaccggacacccagaaaggcttctgtgacccgtttggtgagtatcctcgttatgtaggtaacgatgtcaacgtactggctcgtggtggcgcagaggggcgcggttcttcgagcgtgattattcgtgatgctaacagttcgttagctgtcaatccagatgatcgcccacttgacgagatcccagaagataaccgtcctgatactggcgggttcactatcgaaaccatgcttaaacaggatgaaggtatccgcacaaaatggtatattgatagtgaaggttatccgactatcgggatcgggcatttgcttatcatggagaaaacccgtgatactgcgaagatcaatgccgcgatcagtaaagcagttggtcgagaagtaaccaatggaacgatcacagcagaagaagtttcaacgctgtttgctcaggatttggcaaaagtccggcaggggatcagcaacacttcaaacgttcgagaagtatacgtgacgttaaaccgtcctcgtcaaatggcaatagaaaacatgtgcttccagatgggtgttggtggtgttgccaaatttactaatgctctggctgctatgaagcgtcaggactggcaaaccgcttacaacgaactgcgaaactcaacatgggctaaccagacaccaggacgttcttcacgcgtatctaaaatcgtgctgacgggcaacctcgaatcatacggtgttcaggttccagatccagaagggcgttcattgagtgctgcatacaatgctgttgtgttggctgcatcaaatccagaagatccttttgttcctggtgatacccgcgtaatgtttgaagaacctaaatcggcatacaacgctgaatatccatacaacatggtattcgaatcccgttctggacacattcaggaattcgacgacaccccaggctttgaacgttacaaccgtgttcacccagcaggatcatacgaagaaattcgtcctgatggaacccgtgtcgttaaaatcgttggtgatgattatcaaatcgtcatgcaaggccgtaaattaaacgtcaagggtaatttgcaggttgttatcgaaggtgatgcgttcatttacaatatgggtaacgttcaacagaccgttgatggtaacgtgaccgagttcgtgcgcggtaacgtgaatcaaaccgttgaaggtgaatatttggggctgattaaaggcaacgcagaattaaccgttgaaaaagatgtaaccgtaaacgtgaatcagaatttaatggctaacgttaaacagaatgcaaccgttgccgtaacagaagatgcaacaattaccgcaaaaaatgctctgattgatattgagcaagatttggatattggcgcacgtaatatcaacatgcgagcatcgaataatactttcattgattccggcgcactgactaagatcactggcggtactgtacaggtaggctaaacatgatcatggattatgaaaccatcattgatgggattatgcaaaactttcagcatccttgcgatgctgagatccccgctggatattacagacgcgttatctggcagggacacacagaaaattaccctgctgttggggtagaatgggcgaccgaaatcatcccgatcggaactcacctgtatacgagttcccctttcgggcagaaaagcgatccgcttccggtggtgaactctccaaacgtaccaacgaatccagacggaaccccaggggtttctactgacattctggttacgaagattggttactatttcgccagtcaagcggatattgatgcctatatcgcatctatcggggctactaagctcgcgggtaatgactggtacggggctgatctgtcaaaagcaaacttgttcaagaaccctggcgaactcgcgatgtacaaggtggaaaactccggtggttacttgctgacttctggtccccgttgcgatcagcgaatccgacaggtatacaatcagactacaggcgcgtttaccagcattgattattactggaatggtaatcgtattgcgtacatgaaacacgacgaatcccccgcgcaccagtgcaaatatacagggatgtcagtaaacacgaacgcagataccagcattcctccggttcctcctgctctcccgtcaacgtatggggcgctaccgagtgaagccagattgttttctgctcgctctggattgggctgtattccggcgaccgtagggttcccgtatacgaatatcagtgatgctatgctgtctgcgtggaacgagactcgtaaaacgttcaagctggcttttgatatgctgacgggtacgattaagaacggtaagggcattgcgacgatgtttgacgggctttcgatcgggatggaagaaatcacagcgggtgctctggcattgtcacagcaagcatggcaaaccgcaatgaaggtattccgacagatcattagctctgcgtttaacatcgtgggcggggcgtgggatttgatcaagaatttcctcccgactgttgcgatcatgggtgttgcgatcaacatttacgatctggtgtttggtgatagttcggttcaatccctgaaagattctttccaggctctgattgattccggcgcacagacgtatgaaagcgtcataaacgcaatatacggggctataggcagttcttacaactacgccgttgaatatgtcaaggctggcgctcgcgaccttgtagacgcttgtagcgcgttatttgactggtgtttgactatgttccaaaacggttgcgttgctttggtagatttgtacgggcgcatgatgcagatctggtcaatgcctccagaaacaccaaacccgctttggtctgcggtgctggctatccgtaacatcatgaaacagattaaacctcttgatgtgattctgggcggtaacttcccagggtttacagcaatggatctgtatcagcaagcacaagcgaaagtgaaagcgttcattgatgcatcctatgcgcagatctccgcactgtatgatcagggacaagaattattcaaaaccctgaaagcacagacacaggaaagggattcgattaaacgtaagttcgatcagtacctaaactggatgtgggaacctgtaaaggaagcaacgactgctgcttatcaggctgcacttgatgccgctaacgctgctgtgaatgcgactaaggccgcatatgagggaatcaaagcacagattgctaatctgcaaaatgggatgaaagacacctacagcatggcaatggctgaactcaagaaactgcctgtaatggctcagattaaccagttcttaggttactgtggggttgcattcgatgacctgttaaaaacgtatgagaacgcgctgacgggcgcacaatcgctatataaaaactttgttgacagttcccgctcgtttaaggacacatgcaaggtgatttataaccagatttgtacgcttgctctaagtaaggtaactcaatacgtaaacaaattattgtcattaatcggactcgcgatcacattcggttcaattagtgtttgcgtccctatggttcaatactaaatacccgataacgaggggtaataatggctactacaaagaaacaaattaatcagatccccgatatctttgtcggggctacttttgacgaaatcaaatctgacttaatcaactggctccgtggtcaggacgaattcaaggattatgatttctccggctcacgcatgaacgtacttgtggatctgttatcatactgtacactgtacattcagcaaatgagtaacaccgcactgttcgaatcgtttattcgtaccgctgcattgcgtagttctgttgtccaacaggctcaggatttgggctatatgccggactcccgcaccgctgcaaatactgcgatcctgatcactgcgaagaacccactgaacccgacatcgatccgtattccgcgcggcacgaaattcatcggtacagtgaaagaaacaaacagtttcccgttcgtcgtatctgatgacgtggtgatcgttcgtgacaaagacaataactatgtttcgatgctgaacatcgtacaggggcgtttagtccgtacagaagtcatctatgatggttctacgattctggttcgagatccgaacatcgaccgtagccaggttcgcgttactgtcaacggtgctcaatgggatgactggacaaacgaaagtatcgtaaacgcaacaggcgcatcaacaattttttacatgcgtgaaactgtggatggacataccgaagtttactttggtgaaggtgaaaccagccaacaggtcgcaggtggtgctctgactgcggattacatcgggggcttgaaacctgcaaacggttcgactattgtaattgaatatatttcaaccaatggcgaagaagccaatggtgcggaaaactttgtttatgtggatacattgacaaatatcagcattacaagtattgttgaaaacccgactgattcagcggactatgtaggcgctgatggtggtggtgaaccggaagatatcgaacgtattcgtgaactcgcgcctattatgcgtgagacacagcgccgttgtgttactgcatcggattatgaatcgttcctgtctcaccgtttcggttctgttattcaggcggttcagtgctttactgataaagaaaaacctggctatgcgttcatcgctgttaaaccgaaatcagggttgcgcttaacctctgttcaaaaagaggacatgcaaaactatctggcgaagtataacctggcgactattacgccgtcgatccttgacccgaactacctgtatattgtacaaagcgttaaagtaacgtatgatatcagtaagttgatcgagtctgaggaatggttgcgtggtcaagtaatcaatgaaattgacagatactacacagataacgttgaaattttcaacaaatctttcagtaaatccaagatgttgacttatgttgataacgcggacgtgtcgatcattggttcttctgcgactattcagctattgcgtgaactggataactattacagcgccccgatgtctggtattcacttcttaaaccaggtgaaatcacgttctgttgtttcgaatgggttcaagtacacaaatgctgctggtgattcgtatgatgtgcgctatgcgtcaacagatatgaacaccacgaccggactcgcgaaaatggttatcgggccattcaaaaacggtgatatcggtatcgcagcctatacagaaaacgattttgataaatatcctggagtaaccgatcgtgataaatattacgaagtcggctatgtggaacattttaatgatttcattagtttcgatcttggtgtcctgaacgttccatccgagcgattcagcgctgcttacatcgaactgactggtacacctctggaagagaacattttcacccgtgatggttctctgattgtatttgaaaacgatctacgtcctcaatatacaacgttgacgatgaatccaatcagtcaataatttacaacccctgtcatttggcaggggttttttgtttgctaaatatgggatataagtaaaacgcaaatttggagaaacatatgattaaagcgccgtcaattaccagtttgcgcgttgataaactggctgctaacttcgtttatttgaagtgggatagcgtcggcatggatttttactatgtcgtggaaatggcagaaactcgcggggtaggtggtgtaactattccagatgaagatttaacctggttccagttgggttatgcttatgtaaacgaatggttttcttccgatgttcagcccaacaatttttacaagttccgcgtcatggttacgcacaagggctttgaaccgtctgactgggtttatacagatgaactctggacgtttacccttaacgcttacgcatattcaaccatgcgtgaatttacgccaagcgatgcattcataaacgagaaattcgcaaaaaataatcagaactacgttaactttaatacagatgtggtaatggcagcgttgatgaaagaagactttgtgttttctccactttacactgacgtatcccagatcagcgataaaattcttacacaagaaaactatcacgaaatccaggatcatattgaacacgtttgtaatgacattaacagaactttcctggtagcgtcaaacggtttattgtacctgtttgaacgttttcagaacatggcgaaggtgtcaaacgacaaaggacaaacatggcattactacaaggcgtttaacgaccgcgtaggaaaccctgtatcgcgctctgttgcgtaccaaagccgaaacacaacctatgtactgggttacgatcgtatcttctacgggcgcacctcaacggatattcgctggtctgcggacgatgtgcgattctctgctgatgatgttacgtttgccaaactggggaaccagactggccttgatttcgatgtggactcatacaacacatttgctaaactgcctggtaacgtatcgaaatatgcagaagcaatggcatgttccgatgactggctctatgtggttgctaaaaacgttgtgcgtcgtatcgcactgaaacagacaccgatcgacaccgatccgagttctccaacgttcggagaaaagattttcgatactgacagctatacagttgtccctggaaatgataagatcgttgtcaagaaaatggatgtgatggatggtattctctatgcactcgtaacgggtgaagtgaaaaccgctctgcaagatcctacaaaacccgctaacgtggttccgtccgctgctgctggtgtgtatcaatggcaagaaaacacgaaaacctttgtgcgcctgtatgggaacaccgaggaagaacgtttttatatccagcatgaatacaccaatatgtcaacgaacggcacggagatttttatttccgtagcgaactacaaatatccaggcacacttcccgatcctgaattattgatcgagaaccctgcactggttggtgctgtaaaatatgatttgcgtcctggctatactgccagccttgcgattaactttgcgacgattcgcgctcatatcgacgacccgactgtttggaaatttggtgcgcaggaatactacaacgaggcgaactatagctggttcttccgcgactctgtgcgcacatggatcactaatgataaccgtcctctggtggtgtatccgaaaatcacctacagccttgtaaccgatagtgctggcccttcgtcatcgcttcgtgtgaacaaagaggtatgggatcgcggacatgttacgatttacattaacaacattaagtttaccggattcacgaagtatacgaacggtgtgttgttgtataagagttcaggcgaaatcattgggttctttgaattgagttatcgcgcccgtgacagcttaactattttctggaaaccagataacacgttgctgattgccgatctgattcagcaggaacgcgaaaaaccgtatacaccggatctgtcacctggtttgattgacccagatttaagccatatgattacgcgctttgcgcctcaaagctatctggatcagcaatattttgagaagttcggtgaatattatttgcagttcgtttcgctgggtgaaaacacctactataacaaactgctgaacctgatcaggaacaaatatccgcgtgagaagaacagcgtagaatatctgtggtcggaagtaaaccgccgtaatatctacctggataaaacgaagcgcgatcaagtggtacgtttctttgaatctcgttgcagtgatttttactcaacgaaaggcatcgaagcaagctataaattcctgttcaaattgctgtataacgaagatgtaaccgtagaaatcgaaagttcgaacactctggaatatgatattctggttcagtcaacgaatattagtcaggacatcgtaggccggacgatttacacaccaactgcaagagcaaacgtgacgtatatcgaacgccagtatgatgacggtcaattacgctggtcaatgactctgcataacgtgatcgggaacttccttgaagggcaggttgtcaagtctgaaaagactaacttcacgggaactattctgcgcggtgtgcgtggtaagcaaatggcgaacaactcgatcgactatttcaaccgtgggcgttcatactatgtgatgaaaattcgttcgaatctgccagcgtcacgatataaggatgacgttttacgattcgtgcatccggtaggctttggttttatcgggatcaccatgttaacggtgttcattaactccggtttgtctatgacacatagcgaaacgatcattgatattcttcgaaactatcgcttcgatagcggttatccgaagtattggcctgatcgtgtagcccgtctggacggtaacggaaaccagacatttgacctcgtaacaggcgaagcattatacgaaccacaccctaaagcggggcaaccgttcgatgttccaccagaatatgacgttgaagaacaaccgctgaatggtgtattaccttccgcgcgtcgatttgatcaaagtcctctgttcgatagttctgcggttaaatactctcagttccgtaacttagtggaaaaacgattgaaagacgacgcgggtaatcctcgcgatccgaatccaccgactcagagaaaggtagcataatggctcaacaaaacatctaccgtgcggttgtaactggtaagttccgcacggaaaacatgatgaactttcgcgaaatgatcggggatgaccccgatcataactcgatctatatgtcgatcgggcgtactgaacaatgggcggataacgaatccgatcctgaattcgcgcccccttatcctaacgatgatacagatggtatcgttgatatgtggacgcatatgatcgggatgacgaaagtaccaggcgaaatgattgatgcaatcgttccgcgtaaagactggggcgatactcgatatcctaacccaaaaatcttttacattaatgacatcgtggtagtaaactccgctccttataaccgtactgattacggtaaaggatggatggtgtatcgcgttgtggacgttcctgatattggttcttgctcaatctccagtatcacgggtaaagttgaatgtgtgcgcattggtggcatttggacaccgacccacgaatcggtcgaacctccacgcggagaagcgaacggtatcgacatgggtgacggctatatctgggaatatctctacacgatcccgcctgatgtggttattaaccgatgcacgaacgaacatatcgttgttccgttcccgaatgaactcgaagaagatccggttcgctggggttatgacaacgtgatcaagtggtatccagatatgtatgatttggtgttccgaatgaaggttcactcaatgcgattccgtgcgtacatggattccctgttcttcccgcaagcatctttacctggcaaccgtggattccgtcaggttagtgtaattgtaaacccgttactgaaaaaggcgcaaccgaccgatccagaagtaaaagcaacggggcagtattacacgaaagaacagcttgaacttgactcagggcaaatgatctacatggaaaaccgtcaaccgattattcgttctcctgatcagaccgaagaagtcagtattattttcgaattctaaggaaaaccataatggcatatcaaactggtaaaaaattaattgacgtggggcagatcggcaacccgtcaactggtgacccgctgtatgacggcggtgttaaacttaacgaaatcatcaccaacatgtacaacgcgtttggtgatgtgcgtttgttgactgcgaatgatggtgtgggtacaatgctgctccacgcgaccggatatttccagaaactaccacgaacctattattcaggcaacccgatcgaactgggttcattgcatgatatggatacctcaacaggcccgattacggtcgtgcttccatcgggtaaacccggtgaagggttctatttcataaatagtaacggtagcatttctgttgatcgtcctgttgtattccgtccgcaagttggcgatggtatcaaaggggttcaggatcagctttacataacctctccatatactcagattaaaatctggtgtgtgaagaaagaaggttctgtttctacatgggattattctgttgaatcaatgtttggttcaaagacaatgcctgttgatactaccaaactcattttgaaagcatcaccaacggctattcctatgtttggatatagcgaatttagcggcgctaaacttctcgtatacgcggaaaacatgacaggcacagtcaataaaacagcagaaattctgcttgccgtcgatcgtgtggctaagggcgtttattcaaccgaatacgcagttcttaaaaatacagaagatgaaatgtatacgcttaattttactgttggcgctggtgatgttgtttacgcaaacgtgcaatcgaaaaccgaagatcgtattaaattctcgatcaaagcggttgacaccatcaaatcagggatcgcagcatgaaacaagaaattattatcggtaacgtggttgacgatggcgcaggtgattatctgcgccgtggtggtcagaagactaacgccaactttaccgaattgtatgataagctgggtgatgggagtatcccgcatccagcgggtgcgtggaaaacgcataccgcgcctacgctatcccctatctttggtgattcatgggcgctgaacacaagcaacaaccgtattacggtaaaccttcctaaaggcagcgtaagcgattataacaaggttattcgtttacgtgacgtatggggtaagtgggcggcaaacaacgtccgtatcgtccctgcaagcggagataccatcaaaggttcaccgaactacaaagaactgtacaaagatttgatggatgtcgaactggtttattgttctcctggtcgttgggaatatgttgaaaacaaacaggttgacaaaatcacaacttcggatctggctactgtagcgaaagaaacctatatcgcgactcagggacaaactgacttcctgaatgtgtttggccctggtaactcttacaacgtccgcgcactggaagtttactatcgtggtaacttgctgtacatcgacgacaagaacgggtttaatgcatcaaacagcgattacggttcacctggtgcgagcgccggacaactgatcgaactggatggtgtaaacatacgtcttaaaaacccgtgtaacgctggtgatacgcttcaattcgttacctatctggatggtattgccgcatggcgagcgacgtatgaagcgcataccatgcgcgtatataacacgggtgacaccgaacaggtaagtatccctggtgaaatttgggttggcgatctgccgaataaactcacattcaccactgctgaatttggtatcagtccgcgaattctggttaacccgaactcgttcgaactgctgctgaacggtcgacagcttgttaaagcaggtgatgcggatctcccgacatttatttgtgagggcgcagaaggttatgacgaagatagctgtattgcaaactccggtttgtgggttccttctggtcaggattacagtctgatttttgttgattccgaggttactggtattaagtttgctcaacctctggaaactcgcgatgtggtaactattcgctggttcaacaatgatatcggcactgtaatggaatgggacggtgtaggcggtattaaagaacacaccgataagatttatctgaataacgaagaagaagtaacgctggttaatcagattgaatacaccgattataacaacccgactcagaaaaccgcgcgaaaagtcgcagaaccgtttagtggtcgtcttctggatttgcaagcgttctttgacgttattcacccaatcgggacaatctacgaaaacgcgcacaacgatgctaacccaggcgattatatgggctttggtatctggacacgttatgcggaaggaatgttccttgctggatggactaccgacgaagcagatagtgatttcggtttgaacaacaacgatctggatggttcaggtcaaccaactcacacttctggtggtactggtggcgaacgtggttatgaaattaaaccgattaacgttcctgaaatccattcaaccgataaggtgctgattaaggatgacaacgggatcattattatcggtggttgtcaggttgatccagatgcaacagggccaggttacactaaataccgtgaggatgtattaaaagtaaatcagggtaacactaccccagataaactaaaaacgctcccgccgtatattactgttcaccgctggataagggtagcataaatgacacagtttatttccaaaacaagggagggggcgaaagtcccttcccgcgaagcagattttttgcaatatgaaatgggttcgaaattaccgctgattggcggtaaacgtaccattggcggcgcaaacgtcgatcaacttcgaaaaggggtagaataccccaacgtacaatcagcaattgatgacttatattctctgtctgaacaaatccctattaatggggtagtaacaatggcagaagataattcaccgtctgcggttcagcaggtcgaaagcattacgtttgatggtactgttcagaacccagatccagatcagacgaaagcgactgttcatgtttacgggttcccgtttgtttttgacaacacaacgaacgcatcaaccgtatgcgaaaccgtttataacaaatttactgaatttgtgaacgatgaaaaatatttcgatctggtaactcgaaagggtttaaatggggagatcctagaagttcgttttattgacgcggttccgcatcctgtaacgaacacttccgaaaatgggatcagtatggtaggcacgatcgacgtacaggctaaatctggttatggtacatggtcgaaattaggccaagcagatcttccggttactcctgctgttacggtttactatttcaagcgtattgcataaggacaataaatgaacaacacaattaaccacgtaagcgataaatccgtttacgtgacatttgatcctgctggtacgcaatggcctagcacgtacacgaatgttcagcaagcgcttgcatctatcggatcatgggcgcgtactgatgttggcttgcctaatgccgcgcctggtgtgcgtggtattgctgctattgctacacaggaaatgattgatgcaggtacagacacacagacgatcgtaactccggctctgctggaataccgtctacaaaaccctcatgcatcacaaaccgtatgggggtacacccgttacgcaactgatgcagaatcagtaaccgtaacgaacgatctggtttcattaacaccgcgttcattgaactatgtgtttaacacccgtcagtcaaaagaaaacgtctggggttctgcaaaactgtcaaccactgcacaggcaacgtctggtactgatgacacgaccgcaatgactccgcttaaagtgaagcaagcaattgctgctatggttccggtacagtcaaacgcaactgaaagtaatttcggtttggtacagttggcaacagttgccgaagtccgcgcaggtactatccgtgacggtttcgcaatttcaccatacacgtttattcgtctgactgcaacagaaaccgatttaggcttactccgtatcgctacacaggaggaagtaaacgcgggtactgataacacaaaagcaattactccgcaaaaacttgctgctgtgaagggttctggctctgcatttggtttggttaaattatcaacagatgtcaacaccggattagcgaataccgcgttgtctgctggcgctaacgtagttccaagcaacagaaacagtgctatcactggcggtgcgctgtatcagggttctattgttgctgacaataaataccagacacaaagcgacgttgaagtaaatattccgatcggttgtatgatgctatctgcatttaactccgactatggaaatatttttatctgtaacggacgcgcaatgaaccgcaacacataccctgttctgttttcccgtatcgggtatacatacggcggtgctggggatattttcaacctcccagatatgcgcggtgttgctgctcgcggtttcgatgctggacgtggattagatcctggacgtggtttcggtacttaccaggatgatatgtttaaatcccacgaacaccagttacagatgatctatcgtaatggtggtaatcttccgtcatccgaagcaatatacgaattgaaaaattcagaaaagaacgaccagttaattatgcaactgaatccagcatacactaaagctatggcaactggcggaaacgaaacgcgaatgaaaaacgttgcagtcaactatgtaattcgagtacgataaaggggttaatccatgatttcaaaacttaacccgttaccaaagatcccgtttgttgatggtgtccctacggacaccacacaaacccagatcaattggattgttaacggcgaaactctcgatggtgctaaaaccaaaaccactaacgagggttctttaaacagatgcggtgttctggttcaaaagaacgcggtacaattagaagcaaacacaactacccagacatcaaaaatcaacgaagttatcgatcaggttaacctcattaccgaaaacctcgcgacaatctccgatgaaagcgtgatcgacaaactggataaagttgtcgctgatgttgacgtgctgaaagtagatatgtcttctgtacaggcaactacagcaagccacactctgaaaattcaggatatcgaaaaggaaattggtgtatgggatgcaacaaccgatcctaaacatcgcacgattcgaaaagatatcattttcctgaaaggtgaactgggggcgtatccaggcttcaacgaagatggtgatgttgatccgtcctctactggctccggcgtgaaatacaaggtaatggcgaacgctcaggcggtatccatccacgaagcacgtattactaagctggaagatgactgggtaaactcagatgtaggtcaattgactgatgaagttacggatctgcgtaacgaaatggggccgaagcatttagcaacgtttgaatcagtttatgttcgattgaaccatatcggtgacgatatcactggcattaacaccgaactgtcaaacatcaacacgtatatcgggcgcacgggtacaggcggatcaggtagtattgattcacgcatgaaagcggcagaaacgaacatcgttactctgcaaacccagatgaatgatccggttgttggtgttctgcctcgcgtaatccttctggaaagcgctgttggtaactcgcaggttccgggtagtatccgttacgatatcagcacaatgaaacgtagcattagcgatctgaatatgatcgttggtgaaacaagtgatgatggtctgcgcggtgaaatggcacaggttatgaccgatatcggtactgactcccagccaacaagcatcaaaggccgtctgcttaatgtggaaaacacacagcgagacgatcaccaggcactgattgatgttaccgcaattgtgggtaatacgtcaactggacttgttgcggctaatatcgcgatgggtaaagctgtttatggtgacgcaaccagttctgatccattcctcaaagatggtattcagaaaacggctcgcgacaacaaaacagcaatcggtgtgaaaactgctggctctgaaacaggtatctataagctgatcgctgatctgactactcgcgttgctgctctcgaagctgctggcggtggtggtaacgttgaacaacgtctggacgatctggaacagaataaagcctctcaccaggatgttactgatgctctggttccgtatatcacagaagttgaagcggataacaaatacgaagcgaagaaagttccattgtcatttactcaaaatctggtcggtcgtaacgattatatcgagggtgatgatatttctttatctgttaccgttacaggtggtaaactgccttatgtgtaccagtggaagaaaggaaccgaaaatatcgggactgattcaccgagtgtaatgatccaaaacatcacaacgagtgattccggcgtatataaagttgtcgtaaccgacgctgaaaataccgtgattacttctgatgaacttgacattgcggtacatacggttcctcagttcgatacaaacttgagcgatatttctgttgttgatggtgacccattgactctggaagtagtgtttagcggtggtaaacccccgtacacttacgtatggcataaagacggttctgtattgactggtgaaactggttcttctatcgttaaatctgctgcaaccagcgcagatgcgggtgattactatgtaaccgtaactgacgcgatgaacagtaccaacgattcagcaaccgcgactgtgactgtaactactcgtccggctctggcgtttacaacggatcttccggcaacgaagagttacacaacaggcgataatatggatttagccgttgttgttactggtggcaaaacaccatatacatacaaatggtttaaagatacggttgaagttactggggaaactggcgcaagcctggctacagtagcagaagcgggagtatataaagttgaagtgactgatgcactctcaaccaaaattacctctgctgaatgtactgtgacggtagcataattttaacaaggggcgcaagccccttttgaggatcatatgattacgaacaatccagaacagttaaaggatgaaattcttcgtcgtctgggcgcaccaatcatcaaaatcgaaatcacacaagatcagatttatgactgcattcaacgcgctttagacctgtatgcagaatatcattataacggcacaaacaaaacgtatctgattttgacactgggtgatgataacccgcgcaacgtattcgacttgagcaaagaacacatcttcgcgatcacgaaggtattgcgcacaaacatgggttcattgaccacaatggacgggacagcggtttatccgtggtttaccgatttcctaatggggcttactggtggttctctgggcggtcgatgtgcatcaagcgtgtacggtatgaacgcatacggtgcggatatgggatactttacccagatgatgtcctatcaacgctcaatgcaagacctgctggctccactgcctgattactggttcaacgatgatactggtcagttctgcgcatgggggcaggtgaacaaaggcgacattatcgttattgaagcgatggttcgttccttcgttgatgtccctagctccgtaggaagcgtcgcaggatacgctacagcgggttctaacgcagtggaagaccaatccatagccgacatctacgaaaacccgtataacagcgttgtaggcggtgtacgagcgggacagggttcaactgttacgggcggaacgtctgcatataacaaccgctgggtaaaagactactctaccgcactggtgaaagagatcaacggacaaattctggctaagttccaggggatgcaattgcctggtggtgttgctccagatggtacgcgactgatccaggaagcggaaaccaaactgcaaagtctgcgcgatgaactgatttcgatgtctgacgcagtaccgatcattatggtgtagggggaacaatgcaaaactgggatgaaagtttattcgctcagttgtctacgggggaaggggttgatcgcaacttaaaggatcaggtcactaacccgtatgtaaactggtacaaatacaacccgacacaacagctacacgattcactgacagcagaatcaatccagatgaaatcgcctgatatgtattacgtccggcgtgacttcgtgaatattgataagatcctgggcgaagaccgagaatccaaatttacgaagtcatggaaaattgctgcttatattgaatcgtatgccaactatgaagggcaacgagatttctttagtaaatttgggttgagttcaaacgatgaaatgacactggtaattaaccctcgtttgttcgcacatcaaactgatggtggtattcctgttctgggggatttggtttatttcccgatggacaatagcttgtttgaaattacgtgggtagaagccgatccgttctatcagttcggtgatcgtcctcaacgcaaaatcaaccttgcgaaattcatttacacgggtgaagaactggctcctgaattgcagcgaaatgaaggaatccatatcgaacctgatgcagaactggatctcgaaccaattcgaaatcttgacgggctggctgatatcaacattgaacagtacgaagaagacaaagaatttgaaagagaaggtgatgaattcatcgaatcttttgatgttgtcaacggacgcggttcaccgtttgcaagtctgccataaatacgttatatgggtataggcggaagtctataccctcttcgaagaggattttatgatatacgcaaaacttaaagaatggttgcctcatgatctatacgttgagtatgttgatatcataaaggcttctccaaaaactgaacacacagaaaaacatcatatattaccacgttctttatttcctgaattcgaacacgaaccggaaaatttagtagaacttgatataatgaagcatttgatggcccacaggacattagcaaaaaccaatgatcctaaaatgattcttgcgttcttcatgatgttcacctatgaacacaaacgctattcatcgttatctgaacaagaacagcagttcattcttgaagaaaagacaaaggcgcgaaaagcaatgcgcattgttaaaaaagaacagatgaaaggcaaacatgacggtaaaaacaacccattttacgggaaaaaccataccgacgaattcagaaaaagaattggtgctgttcataaaggaaagaagctatcaccagaacatatagcaagtctcgttgctgctcacaaaggcaaaaaacgagaaaaggtacgatgcccccattgtgggataatgtgcgccgctaatacagcgaagcgctggcactttgataactgtaagtctggacgcgtccagcagggggattagaaaatttttggatactggtacaatagttcgctgcgtaattatatcgtcctgatgggggcgctttttaatcacgttcaggttaaaagagtacgcggcgatcaagaaaaatacatcaaggttccgatcacctatgcatcgaaagagaagtttctcgcttccatgaacaaacttaactacacgttgagtcaggaaaacgttgctaaaacggaaacgattttaccgcgcatgaacttatcactggtggatctgcaatataacgcaatccgtaaaaccagtatcgcggtcaaccaaaaaatgacacagttagcaaccccacgaaaaacgatcacacagtttaaccctgtgccatatcgtctgattttcgaactgggtgtgtatacgcgatatgaagatgatatgttccagatcgcagaacagattttgccatattttcaaccgcatttcaactgcaagattaccgaactgcataagaacgaaatcacagttgaccgagacatcaaaatcagtctccaatcggttgcgccggataccacattcgagggcgaagcatcacaacgccgtcatgttgagtggtcattcatgtttgaattacagggttatctgtacccgcctgtaaccgatgtcaagggcgaaatcagaaccgtttacacggatttcttctctaacatgaacccgttagataaagataactttgaatccgtggatagtcaagccgatccggtagatctgcctatgcaggactacacgggcgaagaatatattcagacgtactcgcacgataagccgatcccgtctggtgatgaacctcctaagccgagggaatgagaatggatgaaaaattagatttacagcaattgctgaatatcgattccctccctggcggcgttgagtctggggaggatgtggttgtttacgagaaacttgaactggttgatgttcaatcacatccagcagaccggaaaccggatctggaagaggattatacgctcgcgcgtaagactgcgcaccatatgaatcagatgatcatggatatggcgcagatcgcattacacaacgcgaagaactccgaatcacctcgccacgtcgaggtattcacaagcctgatgaatcagttaaacgtttcaaacattggcctgatgaagattcacaaagaaatgcgtgagattacggaagagactacaaaaccaggtgctgaaaaaggcggtggtggtagtgaaatgaatatcgagaatgcaaccgtatttgttggttcccctacggaactgatgcagaaatacggcagtgcatatgaacccaaagagggcttcattaatggtgaagctgtagaggtaaaccctgatggaaatggaaccgacgatcgatccgagtaaggaatcagatcaccctatcggattaatgcatcccaaatatctgaaaaagaaaattgatgaattggggatggagtggacacaaagcgaacacgataaaaaatggtatccgacaacgttcagtgactacctgaaaattaacggcattcaaaaggtcgatattcagtctaaggacagttcgaactttgccacgtacaaaaataaaggcaacaagaaaacccgatataacggcaacccaaacctgaaacgtgcgtatatccagactaaatggacgcaacaaatgttgatggagtgggtgaaatgtcgtgatgatatcgtttattttgctgaaacatattgtgcgatcacccacattgactatggtacaatcaaggttcagttgcgtgactatcagcgcgaaatgctgatcgaaatgcacaaaaaccgtatggttgcctgtaacctgtcgcgtcagttgggtaaaacaaccgttgttgcaatcttcctggctcatttcgtgtgtttcaacgaagataaatatgttggtgtgttggctcacaaagcctcgatgtctgcggaagttctggatcgtaccaaacaggcgatcgaactactgcccgacttcttgcagcctggtattgttgaatggaacaaaggttctattgaacttgacaacaaatgtaaaattggtgcgtttgcatcttctcccgatgcggtgcgtggtaactccttcgcgatgatctacattgacgaatgcgcgtttatcccgaactttgttgatgcgtggttagcgattcaaccagtaatttcttctggtcgtaaatcgaaaatccttatcacaacgacacctaacgggcttaaccacttctatgatatctggaacgctgctatagaaggaaaatccggcttcgtgccttacacggcgatctggacatcggttaaagagcgattgtatacagacggtgacaacggcgtatttgatgacggttattcgtggtctgctaagatgatcgctggctccagcaaagaggcattcttgcaggaacactgcgcggaattcatgggaaccagtggaactctgatcgctggctggaagttgtcaaaactcacatggatcgatattgatgaaacggaaacgaacttttatcagtataaacgtccagtagaggggcataaatatgttgcggtgcttgatccagcggaaggtcgcggacaggattaccatgcaatgcacatcatcgacattacgacgatgccatttgaacaggttgcggtgtatcactcaaacaaaacgtcgcatcttattttgccggacatcctgttacgttatctgaatatgtataacgaggcatggatttacattgagctaaatagcacagggcattcagttgccaaatctctgttttccgaactggaatatgagaatgttatttgtgacagttacaacgatctgggtatgaaacagactaagcgatcaaaagctatgggatgttcgacgctgaaagacctggtcgagaaagataaattgatcataaataacaaaaagacaatactcgaatttcgtactttctcagaaaaaggcgtttcgtgggctgcggaagaaggatatcacgacgacctcgttatgtcgcttgcttgtttcggttggcttacaactcaaatgaaatttgccgaattctgcgagaaggacgatttaagactagccaatgaagtttttgcacgggaacgcgaacagctatacgaagacgcattatgtccggttatcgttacaagcggtgatgaaacgatttcggttggttctcacggtatttcgtttatataaattagaggaaattctataatggctttacaatctccaggtattgaaaccaaagaaacatcggtacaatctaccgttgttcgaaattcaactggtcgcgctgccattgtcggtaaattttcatgggggccagcttatcagatccgtcagatttctaacgaagtcgaactggtaaactattttggttccccagacaacttgaccgctgactatttcatgagtgctgttaacttcttgcagtacggtaatgatctccgcgtggttcgcgttgtcgataaagatgccgctaaaaacgcaagcgcaatttttaaccagatcaaaacaactatcgcatcacagggttctaactacactgtaaacgatactattaaagtaaaatacaacagcgttgttgtagaagaaaacggtaaagtgtccaaagttgacagtaacggcaagatcctctcggtaatcattccaagcgaaaaaatcgttgcccgtgctaaacagattggtacttacccagatatttctactggctggactaccgaaattgtttctcagtcttccggtgtttctgcgtcgattacgattgacggcatcgaaagcgattctgggatcactctgttgaacctggatattgcaaaagaaacaattcagggaaccgctttccagactcttacccagaaatatcagttgccgtctgttgtggctctgtatcctggtgaactgggttcaactgttcaggtggagattatctccaaagctgcttacgattctggcgctatgatttccggctacccttctggggtttccgttaagaacagcggtcgttctgtaatgacctacgggccacagaccgataaccagtacgcttttgttgtgcgtcgtggtggtattgtacaggaatccttcatcgtgtcaaccgagaagaccgataaagatatctatggtgtcaacatcttcatggatgactttttcgcgaacggtggctctcagtacgtttacggtacttccctgaactggcctaaaggcttctccggtatcctggagttcggcggtggtttgtcctcaaacgatactgtaggcgctgatgaactgatgaatggttgggatatgttcgctgatcgcgaagctctgcatgtgcctctgttgattgctggtgcgtgtgctggcgaaaccgtagagattatgtctaccgttcagaaacatgttatttcaatcggtgatgaacgtcaggattgtaccgtgtttgtgtcgcctccgcgctcacttctggtgaatatcccgctggcaactgcggttgataacatgattgaatggcgtactggctataaactcagtggtggtgctgctgttgataacaatctgaacgtaagttcaagctatggcttcctggatggtaactataaatatcagtatgataaatacaatgacgtgaaccgttgggttccgctggcaggtgatatcgctggcctgtgtgtttacactgatagcgtttctcaaccgtggatgtctccagcaggttacaaccgtggtcagatccgcaactgtatcaaactggctatcgaaccgcgcacagcacatcgtgacgcaatgtatcaggttcagattaacccggtaactggtttcgcgggtggttccggcttcgttctgttcggtgataaaacactgactaacgtaccgagtccatttgaccgtatcaacgttcgtcgcttgttcaacatgatcaagaaagacatcggtgataacgcgaaatacaaactgtttgaaaacaacgacgatttcacccgttcttcgttccgtatggatacaggtcagtacatgactaatattcgtgcgctgggtggttgctacgattaccgtgtaatctgtgacaccacgaacaacacgccggacgtaatcgaccgtaacgagtttgtagcaacggtctacgtgaaaccgcctcgttctatcaactacatcactctgaacttcgtagcaacgtctacaggcgcagatttcgatgaactggtaggaccgcaagccgtataaagtcaagggggctgaaaagcccccataaataatccgaggttaaaaatgcttactgacattttacgcgcctttgaatccggtgatttcgcacgtccgaacctgttcgaagtagagatcccgtatctgggcaaaaactttaaattcaagtgtaaagcggcaaccatgccagcggctacagttgaaaaagttccggtaggataccaaaaccgcaaaatcaacgttgctggtgaccgtacctatgatgactggacaatcacgatctataacgatgacgcacataatacgcgtgacgctctggtagcatggtcaaacatgatgcacggaatgggcgatcagattagtggtgatattccagcgaactacaaaaaaaccgctacggtgaaacagaaaaaccgtaacgatgaaattaccgccgatcacaccatccacgggctgttccctactaacgtaggcgaagttaccctggactgggacagcaacaacgaagtgtcaacctttgaggttacgttcgcgctggactggtgggaataaaggttataaatacaggggtagcaatacccctatcattatttttcggagttactatgaactttttgggctttggcaatgtacttagctttttcaagaatttcgcccgtgaggacgaattagatcttgaacagcaattaaaaaatgatacaggttcggtcgcgcctcctaaaaataatgatggtgcttatgaaatcgaaactgatctgactaatcagaaatacgcaagcgtattccagcagttttattctggacaagatccggcgattcagaacaaagaacaattaatcaatacatatcgcggcatcatgtcttacccagaagtagaaaacgctgtttctgaaattattgacgatgcgatcgtgaatgaacagggcaaagatatcattactttggatcttgccaaaacagattttagtaaggcaatccaggacaaaatcgtagaagaatttgataacgttctaaatatctatgattttgataacatgggtgcgcgtctgttccgtgattggtatgtggattcccgtatatacttccataaaatcatgcataaagacgaaagcaaaggtatccgcgaactgcgtcaacttgatccgcgttcgatggaactgatccgcgaatctatcactgaaaccctcgatggtggcgtgaaagtattccgtggttatcgcgaatttttcgtgtatagcgctcctaaaaatggctatacatacaacgggcagatctaccagcataaccagaaggttaaaatcccgcgctccgctatcgtgtatgcgcattctggtctggaagattgcagtaacaacattatcggatatctgcaccgcgcagtcaagccagcaaaccaattgcgtttactggaagatgcgatggtcatctaccgtatcacccgcgcacctgaacgccgtgtgttctacatcgatgtaggtcagatgggtggcaacaaagcgacacagtacgtaaataacatcgcacaggggcttaaaaaccgcgttgtgtacgatgctaaaacgggtactgttaagaaccagcaaaacaacctgtcaatgacagaagattactggttaatgcgtcgtgacggtaaagctatcaccgaagtagacacgcttccaggcggtgcgaacttctctgatatggatgatatcaaatggtttaaccgtaagctctatgaagcactgcgtgtgccattaagccgtatgcctcgcgatgatgggggtatgcaaattggtgggggtggtgaaatcacccgtgatgaactgaaattcagtaagtttatccgcacactgcaaattcagttcagccctgtgctttccgatccgttaaaaactaacctgatcgcgaaaaaaatcatcacagaggaagaatgggaagaaaacgttagtaaaatttccttcattttccagcaggattcatattacgcggaagtgaaagatattgagattatggaacgtcgcctaacgttgatgtcacaggttgaaggtgtagttgggaaatatgtctcccataaatacatcatgaaagagattcttcgaatgtctgatgaagacattgacgaacaagcgaagctgatcgaagaagaatccaaagaagaacggttcaaaaatcccgaagaggaagaggaaaacttttgatgaaagaatttatcgaagcaatcaaaagcggtgatctggtggaagcgaagaagcaattctattccatcatggaagaccgtaccgaagcccttcgccaagaaatgcgcgttgaactcgcggaagctgtacgcatcgaaggtgaaaccgacgatgacgacagcgatgacgatgacgacgacaaaggcggcgatgataaaggcgacgacaaagacaaaaagccgtctgataaaaaagacgacgataaagacgaataagaggtgtaaataatgcaactcgaactcgaagaaatcagcgtcgaagatctcgaaccccatttaaccgaagcgaaagcccgtgttgatgttctggggatcgatgacggcactgtgaagatcatcgaaaatttggcggtcaatgaacctcatttagccctggctatgatgtccattgtcgagggtttgagtttagatgaagtcattgttaaacacgtagattcgcgcggtaatgtggaacgtaaaaaagaccgtaaaacccgtgaacgtaatgcgtatcaaacaactggtttaactaaatctcaacgtcgccaaattgcgcgtcgtgcgctaaaaacaaaacgtgcaaacccttctattacaacccgcgcacagcgtaagcgtaaaaaagcgctccgtaaacgcgccgcattagggctataaatatgaatgaatcccaactcaatgaaaacggcgatatgctgctaatcgaggaatggggtttaccttgtgcggatatttccgattcaattttagaatcggtcggtgagtcgaaaaaagacggtaaacttcggattgaaggtattttcctacaagccgaaaaagtcaaccgcaataagcgactgtatccgaaaaaagtattagaagaagcagtaaacgattatatcagaactcaggttaatacccgtcaagctctgggtgaaatgaatcacccgccgcgaccgaatgtcgatccgcgtaatgcttgcatcctaattgaaaaattgtggtggaaaggtaatgacgtttggggtcgcgctgttgttgtcgaaggtgataacggtgatggggataaactcgcggcgttaattcgcgcaggttgggttccaggtgtttcttctcgcggactgggtaaactttccgattctggaaaaggttacggtatcgtacaagaagggtttaaattggcagtaggcgttgatgttgtttgggggccaagcgctccagatgcttacgttaagccgattaccgaatctcagtcaagcaaaccgcttgttgagaataatagtgctgatgatgacgctttcagaaaactctctgaacgtttgaaaagtctatataaataatatcatatcaaacaggaaacttagaaatgcttaaagaacaactgttggcagaagcccagaacctggataccccagttgagttagacagcattttcgaatcagttgaactttctgatgatgcgaaagcaaacttcaccactgtattcgaacaagctgtaaaagcaggtgctgcgaaactcgctgaaacccacatcgcccagatcgcggaactctccgatgaactggttgaagcccaggttgccgaaaaagctggcgaaatcgaaaataaactgtacgaagatgcgaataaatacttcgaccacatcgcgcaggaatggctctctgaaaacaaagaagctgtgtcccgtgatatcaaggccgatctgttcgaatctctggtaatgggaatgaaagaactgttcgttgaacacaacgtagttatcccagaagcgcaggttgatgttgttgcagaactcgaagatgaactgaccgagaatcagcaggaagttaaacgcctgttcgaagctaatcaggctcaggctaaagagatcgccaacatgaaacgcgataccatcgtttcagaaaaaacaaaagatctgactgaatcgcaaattgaaaaggttcagaacctgatcgaaggtttggaatattccgacaagttcgaatccaaactgaccgcaatcgttgaaatggtagcgactaaagcggaaaaacaggttgaagagagtaccactactcagacaaccactaaagatgactttgttccggtgaatgaaaatacacctccagcagagaaatcgaagatcaataaatatgtacaagcggctaaagccctttcctaatcttataaggtaagaaacaatgtctaagaaaaacgaattgatggaaaaatggaacgatcttctggaatctcaggaaggtttaccggatatcgctaccaaatccaaaaaacaactggttgcagcaattctggaaactcaggaaaaggatgctgatactgatccagtatatcgcgacgaaaaaatcgttgaatccttcggcggtttcctggcggaagcagagatcgcgggtgatcacggttacgacgcaaccaacattgcctctggtaaatccagcggtgcaatcaccaacattggccctgctgtaatcggtatggttcgccgtgcgattcctaacctgattgcattcgacatttgcggtgttcagcctatgactggccctactggtcaggtgttcgcactccgtgctgtatacggtaaagatcctctggctggcggtactcctgcaaacgttcgtgaagcattccatccgatgttcgctccagacaccatgtattctggtgaaggtgcaaacaccgcgtttgctgctatcgcttccggtactgctatcgcttccggcgctatcgttaagcacgtattccaggaaactggtgtcgcgtacttccagaacgtaacctccggcaacgtaaccgtaactggtgctgatgctgctgctctggatgctgctgtaatcgcagaaaacgagaaaggcactctggctgaaatttccgaaggtatggctaccagcgtagcagaactccaggaaaacttcaacggttccagcgctaacccgtggaacgaaatggctttccgtatcgacaaacaggttatcgaagctcgtagccgtcaactgaaagcacagtattccgttgaactggcacaggatcttcgcgctgtacacggtatggacgctgacgccgaactgtctgcaatcctggcaactgaaatcatgctggaaatcaaccgcgaaatcgttgacctgatcaactacaccgcgcagattggtaaaactggtttcacccagaccgtaggctctaaagctggtgcgtttgacttccaagatccagtagatattcgcggcgctcgttgggctggtgaaagctataaagctctgctgattcagatcgacaaagaagcgaacgaaatcgcgcgtcaaactggtcgtggtgctggtaacttcatcatcgcttcccgtaacgtggtttccgctctggctcgtatcgacagcggcatcactccggcaggtcagggtctccagaaaactctgaacgtagacaccactaaagcggtattcgctggtgtactgggtggcacttacaaagtgtacatcgaccagtacgctcgccaggattacttcaccgtgggctacaagggtgataacgaaatggatgctggtatctactacgctccatacgttgcgctgactccgctgcgtggttctgatcctaagaacttccagccagtaatgggcttcaaaactcgttacggtatcggcatcaacccgtttgcgaactctcgctctcaggctccggcagatcgtatcacctctggtatgatcagcaaagaaatgtgcggtaaaaacgcatacttccgccgcgtgtgggttaagggactttgatcctaagttgttgaaaaacaacgactttttaaagggaaccttcgggttccctttttgtttatataaatagtgaaaacatttgaggctatattatgaaacatatcatttataaaataacaaacaccatcaataacaaaatatatgttggtgctcactcaaccgaagatatcaacgattcatacatgggttccggtattgcaatcaaaaaagcgcaaaagaaatatggtatggaacatttcacaaaagaaatacttcatgtatttgacacccgtgaagaaatgtatgagaaggaaagggaaatagttgatattgaattcataaatcgaccagatacatataatgctggtattggtggtaaaggtgctccaatggcattgattggatggagtgatgaacaacgcaagctgatttctgaaaatacttcgaaagctatgcaagctccagaaatgcgcgaacgcctttcaaaaatcaaaacaggaaagaagcaatcggaagaatccaacaggaagcgttcagagactatcaaagctatgtataagggttctgcattcgacagaaccggatctaagctcacagacgcgcacaaggccaaaataagccgttctgtgtcgatagatggagttgtttatgcaagtggttctgatgctgctaaagcgttggggctttctcgatctggccttgattaccgtttaaagagtgacaaatttcctgaatggaaattcgttgcataaataaacaatatactccctataaattcaggaaccaaagaaatgagtgataaacactacacaattcacaagttgatgcgtcagtcttcgcttccgtctggtaaacgagaaaaagttatcaacgaagcaacaggcacgaccgacatcaacgtacagaacacgcgcccagaactggtttctttgactcgcgcggttaacaacctgatctatcatgaactggttgctgtacaagaaacagaactccctgttgcaacactgttcggtgttcgctatcgcaaccctaatggtgatatgactttctccagtgctgcaacctattcaggccgaatctctggacgtacagacatcgacgaaatcgatctgactaaagcctacgttaaaggtgatttgttcaagcatgacggcactgacgttgtttatgaggttatcgcaccgattaccctgaacactctggatactgacaaagacaccgcgatcatgaaagctgtgttccaaagcaaaattcgtctggtgagtgaagccgctgatacttctaagtatgaaaccagtgaagatatcgcgtcaacctccttccagatggatcgctggaatattccggtacgctcgcgtaagtttaaaaccgaaatgacggttgaactgatgcaggatttggaagcgaaccagttcgaagctgatggggtgatcgaagacattctgggaaccgtggcaagtgaagaagtcaacaaagacattattcaaacactgatcaccgtttccaaacgttacaacgttgatggactcgttacggatggtatttttgacggtactaccgcatacaccgcgaaggatgctccagcattgggtcgtatcctgtaccaattagcgtgtgaaatggggcaggaaatgaatagaacgacttcatttgatgctacctacgtcctcgcaacagcgcgtgttgtaggcattctggctgcgtctggttggatgcacgaaaccgacgaacaacacccactggcaacaggtaagctgaacaacggttattatgtctatacagacacaaacagcccgttcgattatatgctgactggctgcaaatatgatctgggtgatatggatcacgtaggctctctgttcttcgctccgtataccgaagctgatgaagcaggttcaatcaaagtatccgtagatccggcatccctgcaaccgaaagttgctattctgatgcgttacggtctttccgtgaacccatacacagcagaaagcgaatccgatcacctgatcaaaggtgatgattggtctgctcttgcaggtaaatctaagctgagtcagatcgtaggtattaagttacctaaactgtgttaacaagttttgttttgagaagaccattatagtaataaagatctataaggtcaaacgagcgaagcgagttttcacgaacgaagtgagtgatgggtaagtacgatgtactgtttataatatttatattttatatatagagaaaacagtacattttcgtatactttttaaccaacattcactcactacgttcgttcatgtactcgcttcgctcgtagatttgacttcttgatctaactggttataatgttactttgttttgaggtgatacatggctgaactaaaacttgaagatctacaggctgaacttgaagaggatatgcgtattgatccgttgaagttacaaagcgaatcagcagacattccgaagatttggtcaaaatggcttcgataccattcgaatgctaagaaaaaacttattcaactccaggcgaagaaagaagcgattgtaaaagatcggttactgttctacactggtagacacgaaagcgaaatgaccgatgtcatttacactggttcgggtgaaatcaaaattgctatctccggtgatcctaagaccgttgaagttaacaagctgatccaatacttcgaactgattgcagagtttaccggaaaagcgctggatatcgttaagaacaaaggctactccatcaaaaacatgttggagatccgtaaacttgagagtggtgcataaaatggcagaagaatttgattgcaaatgcgttgtgtgcaaacaaccgatgaactcccgtaatacggcgtttgtcaatgaagctggtccgatctgcggtgtcgtatgtttgcaatatctcaacgaaaggaatgatcgcggtatcaatgaagccgacgatctgaacgaagttcaaatgttgctgtaggtgtgaatatgaaagactattcaaaaatcgactttaacgaagtatttcgtttgctgggattgatggaagaatgtgtgaccagggttcatgcacttcgaatttcgtttgaaagtggttgtatcgaagacgaacgcccagatttatagcagtaaatataattgtagggcaagggcatgtttaccgatggatgcattttcataatcggataaacctaatggcctatatggaatgcaacatatattcgtgattgggatttttttctcaacctggaacctttatgctaacagtgtgcaacggcacgaactacgattgactaccccgcaaatatacgattgcatgttgcggcgaatgtgtcacagtaccccttgtggggcatggctggctgattaatcagcttacgcagtttagaatagcggtgacgacaccgcgttaaaaatcaactatgcttcaaaattaaaaagccccttcctttcggttggggctttctttttaaaacttctcttcttctccggtttcaagttcggctttcagttcttctcgccgtcccttgatcgcgtcacgcattgaaatgtcatcggatgctgcaacctcgacttctttcacgcgggtgttgtaatacttttcaagttctttcaaaccttctagtgtccggcacgaagcaaccttattcatgaaatcatcaatcgctgcttcgtttacgaatgtagtaaaacttttcattttggcctcttaaatttctacctgtttgatcgcgtagtcgaatcgttcttcattgtagatccgcacacgttccatagcatgtttcataccgtagtttgtcgcactgtatttatttttggctgtcttagactttgacagcgtagccaggttatcaacgatatcccatacagtagcgagcgctttcgatccgtgcttacgaagtacacgaccgatagactgtttcaccacaacagcagatttgcaagggtgcgcaaaaatgatgtggtgtaggttcttgattgagatacccgtactcagtaccccgatcgaaccgatgacgattaaacctttcgtcgattctgcaattttcttcatttcgttacgatcgtcaatgtctgtatcaccattgaccaacaccacgttatcgtaaaccttgctcaactgctcgtacagccattttccgtgctctttgtaccggaacatcacaaaggcgttttcgttcttctcacgggctaatttgagcgctaattttagaatccacgcgttgcgccgtgtgtggctggttacgtacttgatttccgtctggtagtccgcacccttcaattttttgacctcttcttctttgtatcgaaggaagatcgtgttaattttcaggttggtgacttgtccatcatccatcaaacgacgcgtatcaactggtttaaagactttgccgaacgcaccgatgtattgcatcatgttcgttttcccttctttcagggaaccggataagcccagtttgaagatacattgatccatcgtgtcgataatctttttgatgctcatgcctgttgagaggtggcattcatcaaccatcaaacacatgaactgttggaaccattcggcaggcattttaaccgctgattgccaggtagaaacgtaaatcagtgcattactgtttttcgctgtaccggaacggatacccagcattgccgatttcgggaacaaacgatagtttgcgatgtcctcgatcatttggtcaacaagtgcggtagtcggaacgatgatcaacactttcccgctgtaatgttccagacaccaacgagagataagcccctgaatcagagatttacctgctgatgttggcaggttcagaacaccgcgacggtttttgataccgtggaacactgattcgcgttgataccagtacgggtcgatctgtttgtcgccgtcataaaccggatgttcgctaacccacttatcaaaatcttcttgcgtgatatcctcagtttcgtggatctttggatcaacccagattgaatacccgcgtgattctgcgaatttggataccagataggctaacccatacgggagtttcccgttgtagtccatcaagtaaatgtaaccgttccatccaccatatttgtatttggcctgatactgatagcctgggggctggaagctgaaatagtcacgcagttcatagacaatgtttggttctgcctgaatctgtacgtggcttgtgtttaaaaatttgacttcaatatccactatgattaccctatgtacaaagtatatacgtatttatgtcataaatattggataaacacttggagataccaatgaacattgattacgaaaaagttgatgggttccgtaccctcgacgcaaaagaacagaaaggcgctttagccgattacgctatgactgtgtttgcggttaagctgaacaaacaaaaatccttcgataacatgctggcggatctggttgctgctttaccggaagatgaagaaaagccggaactgctgatcgattcaccagaaccggaaatcgtcgcatataaaggtgaggtgactatgggtgaacctgtcatcgaagccccgaacgttcccgatgtggttattgatgcttctgcggattttatggagtacgttaaagaggtcgcgccggaagtagccgatcaaatccaattagtacctgatgtcgtagaagctcctgtaagcgcttctgacgagtccaaaggcgaactggtatggttggaagggtttagcccgacaatcttcatgatggggcgctctgcgagttctaacgggtattatacctgtccgtggtggatctatgactggattaaacaaaccccagactggtacaaagatcctgatagctgtccacatgcaagcgcaatcgacacaatcaaatcacttgcgttctatatcgtgcgcgatggcgaagttcgtgttcgcgaaaccagaaatagccgattcgaaacatttaagttttagcactttttgctaaaaacttgttgacgcataccctcgtttaaagtatatttgtactcgaaggcgggggaatggctctcgcagtgaagaaggaaagcaaaatgaaaaacgaaatgatgaaaaatgcttactacccagttctgtttgtttgggctgatggtaaagtgaagaaagtagtcaattcaaatgctccttactatactgttgaagaagcactgcgccacgcttacgaagctgattatcctgtccctgctgaacctggttatgctcgttggaacggttcaaaatgggttgctgatacctgggacaactacgaagaagcaaaaatggaatgcgatcctgattatgtttctcgccaaatggaagcgcacatgattgcagaccgtcgcctggataacgaagctcgcggtttctattaaaattcaaagggggctacgcccccttttttgtaggtaaaatatgactgaattaaatcacgaatgcctgaaagacttatcagaaggtaaagagttcggaaacgtcatcttccttgatatcgacggcgttctaaataatatgcggtgcatgaaatttggtgagcatatggacattgaatgtgctcgacacctgcgccggatcgtaaatcatgctaactgtgatattgtcatttcctctacatggaggatcggcaacacaacccatactctacgggaaatcttctacccgtggggattgtatcgcatcattgggaaaacctgtacgaatctaacagaccgacaagcaggacgcggtgatgaaatcaaagcatggatcgacaccttcggatgtaagaattaccttatccttgatgacgataccgatatgctaccggaacagagtgaacatttcatcaataccgatgggttcgtagggctgacagaagaacaatccacttacgcgatccgtaatgtgttcggtgtaacaaacccgttctgtcctgaatgcaacggctatgggcgcgtgaaccaatatgataaatgtccgtcttgtgacggcaaaattttacttctctaaatagagaaaaactaaagaggttttgaaaatggctacagaaaaatggactacggtacacccgatcccgtggcgtaacaccagctttacctatctgccgtggtggatctttgatatcatcgtggctgcgaatgctgcaagcgaagactggcgtgattatgccgaagaaaaatacgcgaaagaattcgacacactgaaacaagcgtatattgattacaccgatgttgatttcatcgaatctcgtaacggttatctgtataagctgagtgattttactcctgctgatcctgtcgtaacaattacaccaaaaaccgctcctgctgatttcaaagtaggtgatgcggatctggctgcaactgatctgtttaccatcgatccttctggtacagaaatgactctgagtgttgactcttccggtcatggttctatcgttggtggtaaacttcatgcggttagtgaaggtgatgttgttgtaacagcaacctctggatctgttactgcaactctgacggtaaacgttaaacctgcaccataataacaactaagaaggtaaaaatgctactatttgaattcaatgatgtattcgcaaaattcagcgacgcaatcgaagccaaatttggcaaacgcccacaaaacatgacagatgcagaatatgaagctgctgtatcgtccctggttcgtacagatttctatgaaaaactggcgatcgaggtgttgggttgggatatgatgaaatggggcatgacctatcgcgatcgcgaagtcggttttattctcgtcaacgaagcaaaaagcccgtcctgggtgaatagtcaaaaaatcgcgtacatggataaagtatgcgcacagatgggtattgtacgtttagacttctggacttgtcgggatctgaacgaactgaaagcccacgcttaccgttgccctctgatctcccgcaatgataagcatcgtcaagcatgggatagcgcagggaaatatcgtagtgttttcctgaacgacgatatgaacatcactattcaggatgtgaaccgctcctttgcggattacacaccataaacaaaaaagggaaccgcaatggttccctttcttttatgcaatttttctgatttctttcaatgcttcttctttgctaccaacgaagagaatcgctttacctccggcttttctgaatggcaacacagcttttgccctgtcatcaatcagtatacctttgtccgcatatgctgctttctctccgctgcttttggtgtagtggaattcaggcagataaccgaacaccttcatcaacgcttttcttttttgttctgctaccgcatcggaattgtatttccctacgctggttaagatcgcaacctgacctaaagttctcaaatgacagaacaggtcgatgccctcttgtaatggttccagattttcgtagaagtcagtttgtgatatagcctgtttcgcttttttcaattcttcttccggcattctcgccgggtcaccgtacatcggaacaaaagaaccttcccagttgaacagtacaccatccatatcgaacaaaaactttttcatatcaattcctcggtttgtgtgtgcatcatattcatatatgttcctattgtcaaccccatgtatcagttttcggtgcgtatgctgcaactttcgccactaactctttatcaagctgatcaatggatttctgcggctttccttttgccttaactttgatgtagttagacttaacgacaaacataccgcctttgtcagatttcttgatttcgctgtcaatgcctactttgttgaagctgatccagatatcgccgtccatgtactgtttcagagagtcgcccatattcaggatcttcgccatagtgagcgctgccccttcgtgggtatccatgaggatttctttaggcactacacgatcgcgtttaaggttctgctgcatagcaatatgaacatcgttcataacccaaacgatatggatgttttctttctgataacccagcgcttcaacatcacgggcgatacttgccagcttgctcatgcttttcagggttacgtcaaagatcaggtttggtttacggtcttccggtgctgctgtgataccagcgtacacacgcgcctggtttttgttggatacgttgaacacgtctgcgatcacatgatgcagtgttgctacgttgtccgggtttttcaggttcattgttttgacatcgtgaccagttttcgctttgatctctgctgccagtttggtactacccatgaccaattttttgagtgcgtcaacgtccagggtgatcccttcgatacctaacagcttttcgagggtgaaccctttaccagaacccgcgccgccagccaggatgactacctgaccaaatttaggataagccttaccgccgaaggtgatcagcgcttcatcaaggctcgtaaagtctttgaatgatttcatcttagaactccaggtgtttatttaaaagtatttattgacacggtttatgagtgtgtttatagtgcaattgttcgacggataggccggaagaactttaaccataaggtaacaattatgaaaaatgaactgcatgaattcatcaacgccgctgctcttggcgaccagtcaaaatataaatcccgtcgcgataccctgattgacgatttctgtaatctcttggggttcaagcgctggcataccccgtctatgcgtccagattgtgatccaaaatgggattacttcaaatggagtgatcgcgatcgtggttacgtcgataacgtccgcgtaatgtctttcaaccacttatacgcaaattcaacaattgctgttgctaaacgcaacgattcgacttatccgaacgggtggagtgttgctaaagtcatagaaacacttcttcaactgcgtcgcgaatataaatcagcataccgtgtcaatcccaatcctatctataatgaatggcaaatcgtcgcgaaatacctgctgaacatcacctattctattttctgtcgcttcgggacaaaagagattggatttggctctcatgatataattgcagaagcacgtcaccgcatgatccatgcaatcctgaaaattcaaaactctggtgggcttgttcttgctgcgttctgtgatgaaattgtttactacggagaacaggtcgaagttgatgatgttcatcacgaaaaattcaaaagatttgtattcgggcaatataacagctattcatatggaaacgatattcgtgtgatgaggcacccgcgcattatgttggatatggaagggtgggaaccaggtcacggaattggtgatgccgaaagccaacgtgaacgccgtgttcgttcagttgctaaaactcgcgaattgatgacaggtagccttactgattacctgttcagaacaaaagaagacgttgaaaaagaatttgttgacttgtctggagaatagcgataagctgtaatctctgaaaacaaggagataaccatgaataccattaactgccgcaaagagttcgttgagttctatcacggatcatgtactgctgccggaatcgaaagcatgttgttgcctccttgtgattctgatactctgtctgaaaaaggcagaaagaaaaatctggatcgtgttttcttcactgctgatatcgggctggctcgtatctatgctggaagggctgcacgttcaataggtggtgatccggtactgtatcgggttgtgtgtccggtagatgtggtatgcatgaacgatgacaaaggcgcaagcgtttatcatgctgcatgggctttctgtgaggaattatgaaagataaggtgttagcgtatctcgttttcttgctgggatatcgcgttgaagtgatgggtggttattcttctttgtatggagatttaaccgcgatctggatggttgcgttgggggttatgtttacctttatggcgatctgtattgcgaatgaggctgatcaaaatgcttgaattttatcctgctggttgcaagtcaaatccgcctgatgcatcgttccaatcgtggatctatttccatcgtgaactaaacgacatcatcgaaagtcagtggaaagaccatcctgaacgaagtgcccccgatttagtcgatagcgtaacagatgtacgcaccctggaaaaagggctgtatgattgtctggttcagggaatggtgtgtaaattgattttgtggtatgctccgatcggttcagatctaactcgcaaaatcgcccgtggctatatcatgacgaaacgtgagtttgaccagatctggaacgaacccgactgtttcgaacgcgaaaaatatgaaaatgaggttagttgcatatgaaactatttcatgttgtgtatggtgggatgaaaaacatcgacatcgccgcgttatctgctggtatgctggacgaactcgaagcacagatcgggaaacgattcaaagccagtatcaccgaaacgcaaactttgtttgtcgatcaccctgcggatatggaaaaccttgtcaacactctggatgatctgatgatcccgtgtgctgatggttggaacgaagcatccggtgttaatgtagttgtaacttttgttcttaaaaatgttgacagcagaaatgccgaagtgttagagtttattcgtaaaattgattctactaaaggaaagtaactatgaaaatcgttcagcgtaatatcagcgaagttagccagcaggaaaaagtacagattcatttcaaattcaatgatctgaaactgggctatgcacagatcgcccgtgagcacatgctcgataacggcgacatttacgtgattgttcaggaaattgagcgaattcgtgctttccgcgcagaaaatccaaaagtgaaacatgctctgcgccgtgtgtacattaataaacatcgtgaagaacagcgtaagcctaagaccaaagctaaacgcgatccgcgtccagataacaaacgtaaagcaatcaacggcgctatggcgctggcattccaggaagcgggtttagcataagaggtttacatgaattcttcaatgatgaatcgctggtcgggcgtgataacttcgactatcaaaaaggatttggtgaaggttgaagcaaaaccaaagccagtagaaccggaatcactcgatcctgctgagttggaacaccgccgccgtgcaaagcaaattgaattcgatctgcgtgtcgctcgtttatacaacagtaaaaacgatgatgcgcgtaaccgcaaccttcaatttgctctgacgttaagcgactgggcgaagctaatgagtgaaccagtatgttcttactccggcagaccatttagcaacaaaggcggttgctctgactcccgaacaatggaacgaatcaacgcttctctgggatacacggttgaaaacacgatcgcagtaaccagcgccgcgaatagcgagaaatcaaatctcgatgcgtttatgaagggttctgtgatccttccagaagtaaaactgaaactgttacgcaaagctgcgtatcaaattgaaaaacaactgaaaatcaaaggttaaattatgtttgtgaaatattcttctctgactaaccattatgaaggtaaattcatcaatggtgtgatcatgaatggttttactggttgtgtgtgggttgcgcgtgaaaagatccacggggctaattttagcctgatcacttcggacggtatcaaagtcattccggcaaaacgtagcggtgaaattctccctgctgaacagttttacggttgtgaaccagtagttgcaaaatactctgaacctgttcgtaagctgtgggaaattctagcaaatacctgtgaatataaggaatatgctgatactggttctttggttgttcaggtatacggcgaatttgcggggcgtggtgttcagaaagatgttgactacggcgaaaaagatttctacgtatttgatatccgcgttaatggtcaattcctccctgataacgttgttgcaaattacgctgttgctgttggcctgaaaatggctccactgctggcatacggtacgtttgacgagatccgcgcattgcctatcacctttgattcggtggttaacctggcgaactccggtgcgatccctgcaaagaacggtgttgaacctgagttcaaaaacttcatgatgttgaaagatgatgaaggtgagaacatcgcagaaggtttcgtgatgaagcctgttcaacccgctttcatgccgaacggtgaacgtgttgcaatcaaatgcaaaacgacgaagttcaccgagaagaagaacaagcaagcgaaccgcttcaatgctccttctgaactgtcagaaacagacaaagtgaagctgaacgaattcacctgcttcctgactgaaaaccgtgtgaaaaacgtcctgtcaaaaattgacagcgcgaatatcaccgcgaaagatttcggtcgcgtgatggggctgacggtacaggatgcgctggaagaaatcgaacgtaactacggacctttcctggaacagttcgaaaatccaacgctggcgaagaaaaccttcactaacgaagcgtcaaatctggttcgtgagaactggggcgcaatcctgaacaatgaattttaaatctgttctcgaaaacgcaaaaacggctaccctgatcggtagccgtgaaccccctgaacgtatcgcgagtatagccataaagattggacgtgctttaagtgatcgggggatcttcgcttactctggtggtgctcctggaatggatagccatttcatgtttgactactcaccagaaagacggcgtataatcctccctgagaacggttttaacgggttgtattcgaatggtaaggatatcatcgactatacagaatacgacacgtacaaagccgctgacgaagcgagaaaggtagctggacacttcgacaaccaaaacgaatgggtacagcgccgatatgctcgcaattcaatgcaggtattaaccgaaaacctggacaaacctacagattttgttctattctgggcggtagagaaagatttttgtgttaaaggtggtactgcgatcgctgcaaggcttgccagattgtataaggttccaacgttcaatctttggaatcaaaacgttctggatgaagtctgcgatactttagggattaacactaaacctcctactctggattttctctggtgataactcccgaacaatcacgtaattacgaacgcctctcagttgaagaggcattaaaaaaggcgaaacataatggtagaaatcaatggaatcggtgtgaacgcacaggcgggaagcgggacacagtgggtcaaacgcgaaacgcaagatgatccccgctgtggacgtagcccgacactggcggaacgtgcgcgtaaacttgttgacgaaatcaacgcgaaaatggtcgaagcatcccgcaaagacatttccgagtatgtcctgaaatatccgactaaacaatcatatacctttgatatgaaacgttttatcggtaaggttatggatcaggaatgtaccgaaaaagcatatgcggatctgggtgaatggctggcggaagaagggtttactttcgatacacagcgcaaccgacaagctgcgttactcaataccttcgcgggttcgcgtcgtattaccaactttagcgatcctaagcgtgacggatatagcgatctgacttattacatcacctggtgaaaataattcgaaaaacttgttgacgggagttatgagtgtggtaatatagctcccgtagacaagacactaacctaaaaggaaaacatcatggaaatcaaattagtacctacttgcgctggctactgcttggcactgaatggtgtagcacacaacggtaaaggcttacgggctaacgttgaagcaatgctgaacgaactgggtgcggtttatgaatatgatgacgttgcaaccagcgttaaaatcataagccttgaaaaagatggtgttaactgtgcgggttggtgggattgctacatcgactatagcgacaaccgggtcttcttactgaccagcaactaaggatcgactatgtttggaatgaatgagtgttcagaagcggacgcgctagaagactgggctgactttgatgaccttgatctcgatgatgaagatggagaattcttctgtgttgggcgcggggttgaaagaacgaagcgtgaacttcgaagccgtttagcaatggggcttactgttggatctggaaagaaacagcaagttaaatattccgatggttctattcgaactgaaacggttgtcaaagaagtaaacgggcgtgtcattacgtccgagcggcagaaggacatcaaacaattgtacgatgttgcaaaagccgctaaagtaggaaccatgatcacttgtcctacgtgcaaacagttgcacaagaagacgacatatcataaggtgttctgctctaatggtaaaaaatccaggaaagactgtaagagtaaatactggaacacgatccatccagaacgtttggatcgtatcttttaaatcaaaacgtggagtacgtttaaatgaaaacttttaatgaactgaatagcctgatcacctcaactgattcctacaaagtgtcccactggttgcagtatccacaaggcactgatgcggcgatgttctatattgaatctcgcggtggtaagtttgatgaagtagtaaccgctggcgttaacttcgttgcgcgggttcttgccgaaccaattaccatgaaacaagttgagttggcacgggtactttaccgtaagcactttgggaaagagattttcaactacgaagggtggaagaagatcgcagaactgggttatgtccctgttactttccgtgcgatcccagaaggtacggttgttccggttaaaaatgccgttgcgactgtgtacgccgaacgtgaattctcatggttggctgggtggctggagacaatgacgattcgcggtatctggtatccgtcatctgtagcaacgctatcgcgtgagtgtaaaaaggttctggctcattaccttgatatgacttctgacctgactggtgaagcatataacatcacactgggtacacgtctgcatgatttcggggcgcgtggcgcgacctctgctgaatctgcgggtattggtgggctggcacacctctataacttcatcgggactgataccgttgaaggtatgattatggcaatcagtctgtttgcggactatcaaactctgtttgatgaagttgaaaacgtcgaagcaatcggtgtttcaattccggctcgcgaacattcgactacgatttcctacggtaaagagaacgaagacgaagcatataaaaacagcatcgaaatgttcggggatagtttctacgcttgtgtgtacgattcctgggactacaaaggcgctgtagatcgcattgctgaatataaagagcaaatcattgctgcgggtggtactctggttgttcgtcctgattccggtgatatgattgataacatcatgtacaccctgcgtaaactgggcgaaatcttcggatacaccgtaaacagcaaaggttacaaagttctgcataattcagttcgaatcatccagggcgacgagatccacgggcctgaaacaatcaaccgtgtgttaagttggatggaagcgaacaagtgggcgagtgagaacatcgcgttcggtatgggcggcggtttgctgcaagaagttacccgcgacactcaaaagtatgctgaaaaactgtgcgctatccgcgtgaatggtgtgtggaaaggcgtttacaaatgcccgaaaggttccgaatggaaacagagtaagaaaggtttgctgatgaccatcactaacggtgtggaattcaaaacaatcgacactctggaaactgagattcctgacgggtggcgtgatgcgatgattacgtattacgagaacggtgtattaaacacctccgatacagtaggggttatccgtgagcgagcaaggatttaatatccgcgccaacgataacggatcagtagtcttctacaacaatcagccccttgtcgctcgcaaggggcttttttgtaagttggtgggctacgggttcaagttggaacaggtggacaacgcgacactaaaagaggttgttcggattgcttatctgttgaaagataaaaaagatgaacaccgtgctattgcaatgcttgagaaattaggcgaaaatcattgcttcgtggtgaatcgtgggtataagtacgaaacgatcgccttatttgagaaaggacttggtgaattatgattaccacaatcaaagaaggggttgacctccatttaggcgactccgtaaagctgattaaacagcttgaatctggttctgttgacttgaccataacttcgcctccgtatgacaacttgcgccattataacggctctggtgatgtctggggtgaacacgtatggaaagagttgatatcggaactgtaccgcgttaccgctcccggtggtgtggttgtgtgggttgtgggtgacgcgactatcaacggtagtgaaacgggtacatctttccgtcaagccttgtacgcgatcgaacaaggttttcggttgcatgatacgatgatctatcacaaaaccgctctaccgaagaaccataaccgatacgaacaggactttgaatacatgttcgtgtggacaaaaggcgcaccaaaaacattcaacccgatccgcattccgtgtaagttccctgaaaaggaaaccgcacgacaaaacagctacttttccgaaaccaacgaaaagaaccgttcagcacgttccggtaagaaacgtaaacctgttggcaaggataaaattaagggtaatatctggtattacgctgtagggcgcaatcactcaacgaaggacgagattgcattcaaacacccagcaatatttcctgaacaactggcagaagatcacattaaaacgtggacggttgaaggggacttggttcttgatatattctctggttctggtacagtgatgaaaatgtcgatactaaccaacagacggttcaaaggcttcgaactgatggagaattattatcacgattctattcttcgtgttcagccatacgttaacaatctggaatcttttctatgagttatttgggtgttatcccctatacaggcaacaagcagtctctattacctgaactcttcaagttgttccccgaaagaagttcatacatgcgtttcattgattgtttttgcggtggccttagtgtgtcgttaaacgtccctaaacccgttctaagcaacgattacgataagacgcttattgatatgtatgagcgtcttaaaacgcttcctgacctgtctcctgtgcgagaattgattgcatcgaagggactggggaaagacaagaaagaagagtatctgaaattccgtgatgaatacaaccagaacaaagatccgttatggctctatgtcctgatcctgcattcattcagcaacgttaaccggacaaacgacaaaggcgacttcaacgctaatttcggatgccggacgctcaacgatgcaacagtaaaacgctttgaacatttcaaaaagaatgtgaaaggcattgagttttccagtggttcattccgtgacattgatatctgtgaaaatgatttcgtgtattgtgatccgccttacctgatcaccgatgcagtgtataacaagttctggaacgaagatcgcgaacgtgagttatatgctttcctggatgaactgcacagcgaaggaatcatgttcgggctgtccaatgtgactcaccacgccggaaaacaaaatgatatcctgattgaatggatgcagaaataccgcgttcataatctggataaaaagtatctgttaggccagcataccgactcttacgagcaaaacaaaacgcaagaagtctacgtgtgcaactaccagaaacgcgacgtaaatacattccctttaacactgaacgatttaatgtaggttaacatgtttaaaatttatggctatatcccttctgtgtataactgcgctccgtgcctgaactcaaagcgcttgctggacgcgaaaaaacatccgtatgagttcgtgtctgttgcggattccgtggaagacggtaaacctgtactgaacgaagcggtgatcgatgaactcgaagcgcttgttggtacgcgccggatgaccatgcctcagattttccatgacgggaaacacgtaggcgggttcgaccaacttcgtgagtacgtccgcaccctgtaataaataatgacaccttactgaatggtgttattatgctgacgaaacgaattaccaaaaaagactacccaactatcaagcaagctctctttaccgaacaagggggctgttgtgctatctgcaaacgtcccctggagggcgagatcgagaaacatcaccttgaccatgaccatgcgttagacggcgaaaacgccggacgtgtgcgcggcctactgtgtaacctatgcaacggtacagaaggtattgtgaagcacaaattcaacagatccggtctggtgtcccgtgatgtcgattacatccagtggttagagaacttgcttgcatatctgaaacaagactattccgaaaaccgtattcatgacaaattcataccagataaggtaaaatggttttcaagacttaccaaacctgatatgattgccgaaatggtttctatgggcttcgagtacgccgacaaagacgaacgcaaagccttaaccgcgaaatatagaaagcaattaatgaaggcaacgaaatgaaagtagaaaaacgcgacggtaaaaacgtcgatttcgataaagaaaaaatccgtattgctgtagaaaaagctggcggtactatgacggatgctgatgccgcaatcatgctggttcagtacaatcagatccgcgatggtagcgcaatgaagatcgcccgtatccaggaactcgttgaagaatccctgatgaaaacgaacccagcggtcgcccgtgcatacatcgaatatcgccacgatcgcgatattgcccgtgaacagaaaagtaagctgttcaaagatatctccggcatggtgaatctgtccaacaaagagatcaccaacgagaacgcgaacaaagacgcaagggtattcccgacacagcgcgatctgctggctggtatcgtagcgaaacacttcgcacgtaaccacattctgccaaaacacattgtagaagcgcatgattctggtgatatccattatcatgatctggattacagcccgttcacgccatacacaaactgctgtctggtggatttgaaaggtatgctggctaatggcttcaagatgggtaacgcagacatcgaacccccgaaatcaatcggtgttgcgactgctcttatggcacagatcaccgcacagattgcctctcaccagtacggcgggacaacctttgctaacgttgataaagtgctggctccatatgttcaaatgacatatgataagcactttaaagatgccaaaaagtatcaaatccctcgtgatgttcagtatgcaatagataaaactgaaaaggatgttttcgacgcgtttcagtcatatgaatacgaagtaaacaccctgcatactgcgaacggtcaaaccccgtttgttacaattacgttcggtactggtcaatcccgatgtgaacgcatgatccagaaagcgattctgaaaaaccgtattcgcggcctgggtaaagagggtatcactccggtattcccgaaactggttatgttcatggaaaaaggaatcaaccttgatccagaggatcgcaactatgacatcaaacaacttgccctggaatgtgcttctaaacgcatgtacccagatatcattagttcagctaacaaccgtgctattactggttctagcgttcctgtatctcctatgggttgtcgcagtttccttagcgtgtggcatgatgataacggtaatgaaattcttgatggacgtaataacctgggtgtggtgacaatcaacctcccgcgtattgctcttgaagcacaggaagcagacgacgcacacgaggctttttggcgtattcttgatgatcgtctgggtttgtgctttgaagccctgatgactcgaattgatagtctacgtggtgttaaagccagcgttgcgcctatcctgtacacagaaggtgcatttggtgtccgtctgaatcctgatgatgaaattctggaactgttcaaaaatgggcgtagttctatcagtctgggttatattggactgcacgaaacgctgttgatgtttggctcaggccagcatccattcgatcgtatcggctcccagaaattaggtcgattgatcattgaatatctccgcgctgcaaccgaagcatggaagaagaaaactggttttggattcagtctgtattcaaccccagcggaatcgctctgccatcgcttctgtaagctggactttgagaagttcggaagcgtcaaggggatcacggataaaggctggtacacaaacagtttccaccttgacgttgatcgcaaggtgacgccgttcgagaaaatcgactatgaagccgattatcattacatcgctactgctggtcatatcagttacgttgaatttcctgatatgaaaaacaatctgcaagccctggaaaaagtctgggattatgcgatggataaactggattacttcggaactaaccttccggtcgataagtgctttgtatgtggctctgatgacgagttcacgcctacagaagaaggtttccactgtaagcactgcggcaatcacgatccggctaaaatgagcgtcacgcgccgtacatgcggttatttgggtgctcctgctgtccgtggtttcaacgaaggtaagaacaaagaaatgatgcaccgaactaagcatcaaaattaatcaaaaagccccttgcgaaagtgaggggcttttgttatattgcacataccgaaactatgaggtattgaaaaatgatgtactggacaaaagattattttgaatttcgtgacgaagaaagttttgggacggtgtaccgcaatttagctttgcgtggtagtcctctgtcgcctaatcaactatcatctgtcgtgtttcctatcaaggtaacgcactgcgatcggaaaggtgttaatgggatcgttgatgccaatggcacaacatggtattccgaagattcttatctgtttgataacgaggatcgcggattctttaaaaagtttgtcgcgattaaacctgctgttgaaaaagccgacgcgcaacaactgctggattgttctcacctgctgggacgaatttacgtagatggtaagctggtgacgaaaccaggtgatctggaaaaattcttgcgtaaggcgcgggaaactaccctgaaagacaccgaaaaacgttatgatacggcaaccgccaatctacagcgtttgtctggtgaactgaaagttcttcggggtgaatgatgtttccattaaaggcgcgggtacgcaacaaaaccggaacacaagaatggatggagtgtttacgcgaaactaaacactactacatttcacaggctgtaggctatgacggaaagaacattcgttataacaaagtaggtggtaagcgtgtggggatggaacaatatctccaattagaaaccgtccgacctgtgaacgttcctttcgatctgaaactaccaaacggaaagccaacgatatgatcgggaaaatccttgatactctgtttccctcccgtgtacgcgcacgggtagaaagagaaaaccgactcgaagagatccgcttcaataagttccttgaggacaagaagaagcgcgaagacgagaaacacccaaacgcaaaaatggctgagggtgtatcgaaatgttctgtcgtcgaactggatcgcaaactggctgatgtcaaaatcaacctggagatcatcgaactgaacaagcaaaccgaaagtctgggtctgactgtaccggaagacgtgatcgccgctgtaggccacacctccgtaagcgtcgataccatcgtgacgaagattgatgtgttgctgggtggcaaaaatgccgcttctgtaacctccgctgacgttagcgcttacatcgactccctgaacgcgaaataagaggaaggggcgaaagccccttttttggtatgtacgattacactattgaacgtgatcgcggtgaagaatggttgatttctcgtgcgagaaacttctatgttaaacttcctaaaaactttcatactttaccgaatgatgatactgatcgcttattgaggattcttgtagatgggaatgttccacagcgcgtttttcaggaaatggttgatcatgcgtgttctgaatgggataaaaagtattgcgaagaactgacgcatgatagtatagtaaacagcaacctaaaagacgcttacgaacgaagaagtgtgtacgacatttacgaaaaagagaggaaagaaatgatgttcgaagacggcggtagtgcattcaaaccagcacgtaaaacgtatccagactggcgcaaacagtacgcagaacagttatggcacattgacattcccgaagcgctcatgaaagcgattagccctgctgttgactactattcaggctggaaagatgaatatgagttagaagtcggttcgtttaaggcgcacgtcatcaaagcgaccagaattcttgatttcgttgaagctgttgcgtcatgtgatatcgttgaagatattcgtattccttcaatcaacgtttctcggtatagttctccgggtaacattcgcggggatcgttatgcgaacctggcaagcactacggataagctgaacttccataaaatcaatgaaaaaggatttgatggttgtgttctgatttcaatggtagtcgccacaacacaaggcgaatacaagctgatcattgattgtgacaaagcggctcgtgcaattcccacagtcaaacaatgctttggtgaagatttcaaagtattgatgaaagcccgtgcgatggaaaagttcatccattcgtgcaaaaagaacgtgctggagaagtatgatccggcgctcacatacaccaaaattgataaagatctggtaggtgatttatgctgattaacaaagcgcagtgcaaagcgattaactttctgctgcacgaactgattgaaaacggtatcagatttgaattcgttgatccgattaacggtgatgatcgtcatctgctccgctgggtgtctggtagcaatccgctggattcagtctcccaggttgtagagtctgcgcataacaatatgccttgtcgtgttctgttgggtagcgttaacgcctcaacatggaatggatctgatgcttattatgtcggattcaaaaaagagttgacggaagacgaatgatgttataatatgcccctgtagacaacaaactataggggctaaatcatgaaaatcaaaaatactgctactgaaaatctttgcaacgaaatcgcggtgacttactggaaagaaggtcacgtaaaagcaatgaaggattttcaacagtggtgtgatacccagaagttagccaactgggaatacgccgtaatcgtggaacggatcaaagaactgatcattgagaagaaaggcactataaaatgattcaactgaaattagacacccaagcgctgaacaacctgttcccagaggcaaaaggctgatgaactttgaccgcatctataacatggatgtggttaacggtaaaggaatccgtgtagtgttgtttgtgactggatgcaatcataaatgcgaaggttgctacaacaaaatcacttggaatccccgcaacggtacaccatacaccgaagagactgaaaacgagttgattaaacttctttcaaatcctcatgtggacgggttgacgcttacaggcggcgatccgttttaccgcaccaatcatccagtattgttaaaactgcttgagcgcgtccgtgcgacgtttcctgataaagatgtgtgggtttggacgggttacgccctcgaagccttacagagcgatacagaacgttctaagctgttaccattcattgatgttctgatcgatggacgatacgaaaaggatcgaccgactaagaaaccgtttcgcggttcggataatcagcgaatgattgagttcaaaaagaattccatcgaaattaaaaatatcgcttgacctggttggtagttctgttaagatatccacgtagcataaatttaacccaattgagagataatatcatgatcctgaatttcaaaacccgtaaagaagcccgtgactattgctggaagtggtcgatcccactgaaaaatatcaccaaaggaagcggttcacatccgtggacggtgagaacaaaagaaacccgcttcgaaactggtaaagattacaagctggttgatgtcgaaggtttcaccgacaatggcaaaaacattgctaacagtgttcagtcaaaacagatccaccaattgatgaacggtgttgtacacatcacaagccgcaatggtgatcgctataccttcgatgctccggcaggtgtcgctatgaacacccttcgtgcatgggaagcgaaatacttcacagaagttgctccggctaaagccccagcgccaaaacgcgctaaaaagccaaaaccagtaggcaaaccgtccgttgctcctgtaccagctaaaccagatctggattccgaacttgacggcggcgttaaccttgctccgacaaccgaaccagttgcaaaacctgctgcaccacagccagcaacggttgaagcgatgcctggtaactttgttgtaaaccgtccgtatgttctggtagatgaagctggtttcctgcgctcgcacactgcaaacaaacgcattgtacaacacatcaaaaacaacaacggcgttctggtgtttgttactgttgacggcgacggtgacgcaactatatcacaagaacgtagcctcccgtttgtaatgcatcgtgagcgtaagttcttccgtgaactcggtactggcgcagttcaggcagataccccagcggttcagaccgttgatattgccaaacagcaacgcgacaaagagatcatcgaagctgcacaggcagtagaagacgcactggcagaacaccagaaagcgatcgaagttgtcacacagaaagctcgcgcagttcgcgaagccgctgcaaaacttgcactactggcacgtaagtaatataattcgggggtgcttacgggcatccccttttttatttgaggtaatcatggaattattcgctggaaaaacttacggtttaaccgtatcccctgaaatctttgcagagaaaacctggaaaacaggtatcgcaaacatcattcgtgaaaaaggttacgtgacgattgatcgcacctcgatcggtgagttcgaagaccgcgcgtttatcatggacggtggttacgaatatgaactccctgcatcactatggaaatggttcaaggaagtaacgccggaagagggtgaattcaccccagaagaacccgaagaggttaatctgggtaaaggtgtagaggctgaaaacgttatgcgtattgcaacgcccgaagaggtttccgctggtgttacgggttcggatctgtgtctgatggatatccctaaattcacgtatcgccctgtaaaggaaaatcctctgcgtgatctccgtatcgatccatcattcggggctaacctggaaacgttgagcatcgcaccgatgccagtacgtaaatccgatgcaatgcttcgtttcgccttgcaacatgttttcggtggtggtagcatctatcaaatcaacatggaatctgaactgaaaatgcaggaagaccagattgcaaacctgttcgatctgcacactcagttaaccgctgttgagaatatcgaaaaactgttaggcaaagagaaaaagcgtattttgcaggatctcaaaccatacggaaagaagaatgaaagtcgaaatctacggcattcccgaaagtcttcataactgttacgggtgcatacaagcacaaaagctgttgacagaaaaagggatagaatatacattttatcccgttctgaaagaagcgaaaaacgatctgggctttgaatacgatcgcccacgtatcgaagagttagcaaaacgggtaaggcaacgtagtttagcgtttcaatacccgcgtatttttgtcgataacaaacttatcggcggttatctgcaactgaaacaacttattggtgattaaatgagccgtgaaattttactccctgctgcaaatgctgttcatgctgaaacgatggaatacatggagaaattcgttgaacgcgataacaccgcgatcatcactcctactcacctggacgcgctcgaagatcgtcttcataagcagattaaagatcaattccctgaaaaggttagccgcaacttcattcgtcaggaaatcgttgcaatgatgctgaaacattacggcgttgaaatcttcggtgtcgaaccactgaaaccgaagaaagcacgtcaaatgcctaaacagatcaccgacgaagcaatcaagaaataccagaagaaatacgctaagaataaatgatctttaatacgattgaatgtgttccgtcaagcggtaaaacaaaggcgattctgaaccatatcaatcaaacgggcgaaaaagcaatcatcgcttcgatttccatgatgttatcaaaacagtcttatgactattacatcaaccaggtaaaaggaaaacgggcggtgattgtggacacggatcaccgaaccaaaagaaccaataacgatgcgctgcgtgaagtagtcaatgattacgatgtgattttcatcactcatgcagcactgaaaaacattgatgactttgatttgtataaggatttttccctgtatattgacgaagttcctgatttggttgcgttcgaaagtctgcgatttaatagcaatatcaagcacatacgcgagatttgcttgccgtttagttgcaatgccgatgatatcgttgatttaaaacttgacgaagaaaaacgagaactggttacacgattagcctatgatggtcttcgtaaacgtgatgatatcgcaatgaagatgttcccgctttaccgtgctctgttaggggctattccggtgaagatgcaatgtagcgattcgggatatgtctgttacttcgtagaggatcatgacgtaagccagtggaagttcaaaaatgtaaccattgcttcatccaacatcaaagacacaattacagggaagatcctgcaaacgtttcatgatgtggagttcaaagattcaccgcttcaaaagctggttgactttaagcaatacaaaaacactgggcgcatacatatacatgtgctcgcagagggggattattcgcgttatacgggcgatctctctcaatctgggacgacagtatacacccagattaaaaaacgcgtggaggcgcttttagggggcgaacagttcatctattgcaccaacacatacagatcgaagtttagcgaggggcaggaaatcccgtacaactcgcacgggttgaacttctattcgagctatactaacgtggtagcattattcagttacaacccgttaccctggctgcgtcaaatgctccgagcggttgcggtgtcctctggacttgaagaggaagaattagttgatgcttatgttgtcagtaaatattacgaaccagcctttcagttatgcgctcgttctgatatccgacacaacaacagcaaaagaaagattaatttatttgtgcctgatatgcggttagcgaaatacatgaaggaaaaatattttcccgatgccattatcgaaaccacagaagcagttcaaacgaaaaggcaacgcaaatcatttcaaacccttttccaaatgacggacaaagagaaaaacgcttttacgccatacaagaaaagaaacaaattagattatgcgaatcctcttcatcacgcgattgttaaagattggctgaacaattaccgtgagaaaaaggcgacttgatggtcgccttttttgtttataaatatcagtattgaataagataaaggaaaacgataatggtagctaaatcattccgcgccacaagtggccttgatgctgctggcgaaaaagttatcaacgttggtaaagcatcacgctctgtgttgagcgacggcgtgaacgttgacttttttaacgaatttaacacgatccaacaatacgattctacccgtggttatgctgcgtttatggctatcatgtacgcgcgtcgtatttggtacgctcgcgcagatattccatcaccagcgggtgctttcgatgaaacaaaatggatctcaacccgtaacgatccaaaatgggtatataacaacgtaacgagcaatgacggtctccctgttgaatccggtacgtacttaatggctgacggtcgtttctctgaactgacctatattctgccagatgcccctgttgagggtgatattatcactattaaagatggtggtggtcttgcaggggtcaacaacctgttagtgcgttcaaacactcgtcagatccgtttacgtgatattcagtcaagctcttatcgactgactcacccatatatgaccgttgcgtttatttttaacggcaacttatggcgtgttgctgaaatgcgcgataaccgcgattcgcagtttgtgaacgcaacaggtgcgggttctttccaactgcaagcgggtatggtaacattccgtaatagcggtacaggcaagattactctgcaattgcctagatacgcaaacgatggtgactcaatcacaacttacgatctggatcgccttgcttcggtgaacgttgcgactctgcaagtttatcctggtagcggacacacgatcagctatgacggtatcaacaacgtaacttctgtgacttcacagcgttccggttatggtatcttcatgttcgatcaggctaatagccgctgggtcgtttatgatggtgatcagcgcgttcgtctgcgtcgtatcagtgatgacctgaacatgttgccgaacgattacgtgtttatcaccccgatcgctggtagtcctccaactgtgcgtaacgtaacgctgactcttccgcaagatgttgccgaaggtgatcgcgtgtatatcagtatgtatatgatggggaaaacgcagaactgcacaatcaaagttaaagatgattccggtgaaaagatccgcaccaacaaaaacatgatgcagttcccacagcgtaaggattatccacctgatgactggttcagtgttgacactctgactttcaacgccgatactgactatcttccatatatagaattgtcgtatctgaaagctacgaaagaatgggtagttgcacaatatcgcccgatcattgaacgtgttgatccaacaaaccgttctcgtctgggtgtgatcgcgctggctacacaggcagaagtaaacaaaaactgggaagatttgccttctgatgaactggcagtaaccccgcgtacactggcgaataaaactgctacggaaacacgccgtggtatcgctcgcctggcaacaactgcggaagttaaccagaacactacggctacttttttggatgacgtaattgttacgcctaaaaagtttaacgaacgtacagcaacagaagatcgccgtggtgttctggaaattgcaactcagacagaaacaaacgctggtactgatgacactaccgcaatcacgcctaagaagctcgacacgcgccgcgcgaccgaaaccctagcaggtatcgggaaactcgttacaacgggcgctacgacagcggagggggctttacgtggggatgctggtactaacgtctacaacttcaataacggtgttgacttactgactccgaaatcattgaacgagaagacggcgaccgaaaagtcaaaaggtctggttgttctggcgaccgaaaacgaagtggtaactggtgctgctggatctgcttcaatgccgatcgtagtaactcctgaaatgctccatcgtaaaacgtctactgaatcgcgtatcggtttgattgagatcgcaactcaggacgaaacgaacacaggaaccgatgatctccgtgcggtgacgcctaagaagctgaacgatcgcaaggctactgaatcgcttgatggtattattgccctcgctaccactgcggaagttgcagcaggtacggcaacgaataaggcagttgttccggttaagctgaaagagttcttcaacgttacgagtcatgttgcggttgcaaccactgatggtttaactcagtccggtactatctggacaacggttaacctggggattgcgtctgctactgaaacacagcgtggtactctgcgcgtagcgactcagggcgaaactgatgcaggtactctggataacgtggtcatcacgcctaagaaactgcaagcgaagaaagcgacggataccgccgaaggtatcattcgttgtgcaaccaacagcgaagctgctgcgggtactgctactaacctggcaattactccggctaccatgcagttcttgaacggtactgatccggcatggggtgctacaacattgcgccgtggtgcggtgtttatcactaccaaatcgaacacgttcatcggtgataatgtggttggttctactcagcctgtagatagttatctggaagatttctacgctgtatcgcctcgcggtctgaactttgctctgcaaaacttcttaccgttgaacgcaacagcacagaatagcctgaaactgggtggtgtggtagctgcaagctggatgcgtcgtgatgcagatcaaaccgtaacgggcaacaacacgttcaacggtacaagcaacttcgttggtaacgtaaccactaacgggactctgacggctaacgctgcggtaactgttaacaacaccgtaaccacgaacaataacattaaccagtctgcgaaagcaaacacggtttatgctaatactgttttgagtacagcaaccgctggaactaaaaacttgcttcgtactttccgtggtggtgtgacggatactacatggcatgaaactgttcagggaactacgtatcgcttggcaactggcacaaccgacacgaccgacgttctgactgttggtgatgtatctaacggtacaatggcgtactccggtactactctgcgcctgaatggtaaagcactggctaacacgaacgcaacaggtgatgtgactattgcaagtgatgcaagtcctacggtacaattacgaaccgatgcaactaacggttggaacggcgtaacaatcagtaatgataacggcgtgactactgcaaccgtaatcaacaccagaaactttacccagcatcttgacagtacctatgtcaatacagcgggtgatactatgactggtgcgctgtcagttagcgtaaacggcacgggtggacgctttaccagtgtgagcggtacggcacatgttcaggcgggtgatttctctggtaacgtccagaagatgcgcttaactggcattgacgataaggtattgactgaattcaatatcaatatcaccgattacaacaaagcgatgatcaacggaaacctgatctatcatgcaggtcgtaaaccaactccggcagaaatcggggcggtagcggtagcgggttcaaccgtcgatactctggttgtgcgtgactatatcaaaatcggtaacgtgaaaatcttcgcaaatccaacaactaagacttgtgaatttgtgtgggaggaataatttaaatggcgaataacgaatttatggcgttattcggccctgatagtttcacggcgaatgtgttttcagaagcaaacgccgtgaaatatcgccttgttgtccgtggaacgaataacgattctgcggtcaactcggttgaggtatctattaacggggctgatattataaacagacgaacacaagttgcttgcggaattaacctggctgtcattgatggaacaactttagcattattggattacaaagcattcgatatgtatggtgatcctgctacgaacgggaatgcgattaaagactacctgaattcacttccagcgaacagaattgtgtgtttttatactttcgatgctatcaaaagtgatgacaactttttagcaacaatgaggaaaattggttctgttgcatggcctgaaacacgattctttagtattccgacgacaacaaacagcaattcccaacgttcatcttattcagctatctattcatctacgatgaaaaagatctgtatggaaaactttgtgggtggttctggtacggggttgaaagacaatacaacgagttttgttgaagttgtgtttgatgaatttagtgatatcggggtaactggtattcctgaaagaatggttgatgatgtccagacataccagaacagcggggatatgtacggcttccatttatacggattgtggtcaatcggtaatgatgtttatctgggtgacaccttcaaatttactggggatctgtattgttcaaaagaacttcgtgatgctgggggagaagttcacctgtatatgtggacagaaaacggtagcggacaatggatcaaatcaaccattctcagaacaaccggattagcccctgatacatggcattcgttaacaggatatttcactattcctactgatgcggtaaatgctcgaatgggttcacaggtgtatcattatccgtcaactgtaaaagtcgggcttgctcagtgtcgaaatgtccaaattgctaaagtaccgcgcgaagaagtagatcgtaacggtgctgcgatcggtgtgaacggtatacgaatgcaaacactttccgaagtgactgcaacaggaacagaaaacccgattgaacaattgctttctctgcctgtttcgcctactggggttatcagtgacaagaagatcagttcgcataactttgctgaacttgattatattgtttctgatccggttgaatatacttcgacaagcacagcggaataccagttcaaagaatggactgctacccagcaagcggcggtaacgaaagcgtcactaagcagttacggattaaaagctggtgatacgatccgtatgcaatgccaaatgaaacgcgatgcgaatgcgattgctaacagtaaatcagcatatatcgtaatgcagttctgggacgctgataacaaatatattaaaggggtcggtatggttgattccggtacggttccaaacatatattcgttctataaagcagaaggggttgttcctgctggtgcggttacgtttgatttcggtttatatcgttatccaaacaacacaaacatcggtacggtatccgctaaagacgttaaactgtcaatcgtgagataaaggggcgaaagcccctttttcataaatacagtcattacaggagaaatttttatggctgatttgaaattaggtacaacgctgggtggtgcgggtatctggagtgcgtcaaacctccctctgctgccctctggcgatagattgctgtttaaagggtggagagtatacactgagaacgatcgcccgacagcggaggatataaacgccctctcaacgatcaacggcggtgttgttgcgaagaatactacattcaatcagaatttggttgttggtgcttcattaactgctaacttgattcagtcgaatagtgttcttaccatccaacgtagcgcaaaccctgcggaaatgattttctatcgtcccgatattacggcaaccccatcatcggaagcatgggttttaaacatgtatgcgaaagatggtttaaatcgaaacatgggttcgttgattattgctgcccgtactgacggcggaaataaagtatatctacgggcaaataaagacggttcccctaatacaagtttaacgttggattcacaaacccagcagataacagttgagcaaggatctttccgcgtaattggtactacgaatctgggtgtgacgaacgctgcatcaatggcggttagcggtgcgattactgcgaatacagtaaccccgacaaactgggctaaccatgatgaacgatatatgacgggcattcctcgcggtatgtctggaacaagtttcggtgctgctgttgtaactgaaaagaacgatgttctgtcagtaggcggtaacatcaccgatggcccatatggtaacactacgtattacggacaggttgttaactatcgtcgtacactgaatagtggggtttcattagttcaaacatacttcgggaacgaaatgtggtttcgtcttggaacaggttctccgggcgcgtggtcgtggaaccagggcgatgctaatggttggcggcgtgtttatgatacggtcagtccaccaactccggcagaagtgggggcagtaaacaaagctggtgatacaatgactggtggtttagcgttacttggggatttgaccttccaaaatttggtaaatcgtcatattcgtttcgaatacaccaaaaacgacggttctaccgctgttgacgcttatatctataaagatggtgtagatagccctactcgtcgtgctggacttcgcattaactgtgccacaccgaacaaagcgagcgggaatacttcaaactcaggtgattttatattcggggagaatggtaactttacactacctggtggcggtatgattgttcaggacggattgaaccagggtgtttattgtatgagtgcattaagcacaaccgcaagtggatctaagaactacttacgtaaattccgtggtggtaatagcgacacgatctggcatgaaactgttcagggcggtacgttgcgttgggctactggcaacactgatgcacaggaatgtatgcgccttgatggaacaagtttagtagttcaaggaaacatcacgtcaggaaacaatttcttggctggtggtatcatgcaaacgaacggcggttctttgtatatccgaagctctggcggtactcatacgtggtatcaagaaccagacggttctgaacgtgctgttacatggtctgatagttctggtatctatcgaatccgttcaaacaatagcaaggctgctacatgggaatttaagaatggtatgatctattattctaccccagtaaacggaagtgaccacggtttgattcgaggtgttgttgatgctggcggttgggatcaatggactgctcgatctgctggtattctgctggatgtgccaaatatccataccagtgcttataatatctggaaagtgacgaagtggggaacctctcatgttgctgcgatggatattcaccgtcctagcgatagtgattcacagacgcgagttcgtattattacaaactccggtgcgtacttctactttaacggttctggtgaatttactgcatctggtaacggtagctttaacgatgtttatattcgttctgatgaaaaactgaaaagtaatttcaataagattgaaaatgcattagataaagttgaactgttgaatggtatgatctacgataaagcggatcatatcggtggtgaacctacttcccgtgaagctggtttgattgcgcaacaattacaatcagtattaccggaagctgttaaaactggcgaagatacagaaggaaatgaaatcttaactgtttctccgaccgctgcgatcgctttgttggttaacgcgattaaagaactccgtgaggaagtcagggaacttaaatcccgctaattaaaagcccttcggggctttttctttttataaatatcataaaagcatttgaggatctaataatggcagatttaaaagcgggtactaccgttggcggtaatactatctggagtcaggcgaacttgcctttgctcccttctggaaacacaatcacatataaaggctttaaaatctacaccgaaaacgataagccaacaaaggccgaaatcggattaggcaacgtaacgaacgatgcacaggtgaagaaagctggtgatacaatgcaaggaactttggaattacaaggttctgcaactgaattgaaattaccattcaggatcgcaatggttagggcaacagaaccgtatctcgttgcaactcgcacagacaataacccagtaacaaacgggtttcctagcgcagaaacacgcacatttgttatacattcaaaaaccacgtcaccaacgtcagatccaaacttgggggcaaaccttgttgatctgatttgtacccaacgccctgcgggtggtggtgcttattatatccgtgcttttggcgcaccaaacacgacaactggtgctgctggggctgtccgtgctgaattacaaatgttgggtgataatggtcttgttagtttaacggggacacaattcaacatcgggatgcaaaccgttgtcagtggcacgatctttggtgcgcaaatggctatcaaaggcgacggaaacaaaaacctgttcttccaggatgctggcggtaatgagcttagtttgatctatgctgatacaggaaagaacttatatgttcgtactggtggtggtgcatatgcaaccagatttgcatctgatggaactttagttctcgctaaccatctaaccgttcctggacaggctacgtttaacggtatgggtatattcaataaccgtgcttccgttgaaactgattatgctactcaaggagcaaacactgcaatacttcgagtaactacaaacggtgatggaaacggggttggtgatggtgttacccacttaggctataaagacagcaacggacgatataaccattatttccgtggtactggtgtaacgtatattaacaccaaattaggttttaacgtaaacgttccatcatattataatgatgttccccagggtacgccagcgcaatatttcttgcctactgttggacagggcgggaaaaactatttgcgtcagttccgaggcggtaacgcggacacaatctggcatgaaactgttcagggtggtgtgtggagactggcaacaggttctacagacggacaggaagaattgcagatttctactgcgggttatgctcgattccgtaacgaagttcaaagcgctacgtctggttctggtggacagttccgcgcggtacaaggaaactacggggtaatacaccgaaatgatggtggtaactactataccttgatcaccaactccggcgatccttatggaacatggaacagtttacgcccgattactatcagcttgactactggtattgtttctataggaaacggcgcgaacattaacggttctgttaactttggcaacgcggtaaacttcaacggaacggtcgaaacaaacggtattggttgtggtacgccaaacggattgggtacgactggtatttctctgggtgataacgatacaggtttcaaacaggaaggtgacggtattctcaacgcctatgcaaatagccagcgtattatgcgatggactactggtgcaactgctaactataaacagttacaggttcagggtgttaacgggccagcattacttctgaataacacagcgactaaccaatcgtgttatttgctgattactttggcaggtaacaacggcgcatacttcgggtttggtggtgctgatgataacgtatcggtacacaactaccgactgaatacgaccttacagttgcgtacttcggatctgtatatgaaccgtggtctgtatgttgaaggtaacgtaaacgccaacgatgtgtatattcgttccgatattcgactgaaatctaatttggttgaattgaaagattcattaagcaagattgaacagcttaaaggttatatctacgataagcaatcaaaagatgctgatgatatcgtataccatcgcgaatccggtctgatcgctcaggacgttgagaaggtattgccggaagcagtgcgcgaagacatcgacactggtatgttaaccatttcaccttcgggaattaacgcgcttctggttaacgcaatcaacgaactgcgtgaacgtctggaagcaatcgaaaacaaattaggggcttaattgcccctctttcatgaggtatttttatggctattgtaggagttcctggctggatcggttcgtctgcggtcacagaaacagggcaacggtggatgtctgctgcgggtaacgcggttcgaatcggaacaccgttttatatgtctcgaatggcgggacaatccgtatataacatcaactttacggtgtatgagcgttactataacaacgcccgttatcgtggtcagtggggggttggttggtattcaccatattcgaaaccttccggtcacggcgcagttggtggtagttttaacggcaacgcattcggtacttgtgtttctgcacaattcagcaatgagattagcgtaattaccattcaaaacggtcctgctgttaacctaagacttacgatggatgacggcggtgtgtttgactttgacaataacggtcgtatacaggatggatatcgccaatatcagattgcttctgcccaacataacgcgtggtatgactatttgaacgcccgtgtaggccaaacacgatccggtctggtcactcaacgttaagtaaattcctaaatatgttcggggtcggcatccccgaacttgaggattaaatatggcgctattacaagataaattggcggtgcttgaacgggtaatatcgttcatcatggcggtcaaaacatggaaacagttattcattaaattggttcttatcgtcactattttcattatgttcgtaacatggtataagtgggatgacttattttcagtctggaaaacatcttcaagcgttatagacgtgccgacgatggagattgaaaaggcaaaaaagtttgaatccgcatccatcgaacagttaaacatagtgcatttaactacgggtgcggatttttcggcaatctttgggttcagacctaagaatgtcaattattttgttgatataattgcgtatgaagggaagttaccgcaacagattaacccgaaaaatctgggtggctatcctatagacaagacatcggaagagtataatagacatataaacgggctgtactatatctcagatattgcaagcccgtatcttccaacaaaagaccttgttccggtagcatatacctttagttgtccttatttcaatctcgaaaactactattctggatcgattctaatggaatggtatatacagaagcccgaagtcaccgatacgaagttaatgatcgtgtgcaatcaggccgcaagaattttaggcaggattcgatgataatttcagtttcatactactcaaagcccgattgatgaaatcttttactttcgtcatcgggcttttatcgtatatgtcccatacgcgcataagttcatatggtgtaggtacatattcatcgttccagtatccaatgttccctatcgtaatgcgccggaaaccagcctctacgctgtgatatacaaagaacccagccttacccacaggggcgactttaaaaccgcgtgtagcggctttcatggcttcgtcgtgtgtcatgatagaatcacttcgcctctgtattgattgtggtagatgtatggacgaacacccagcgggtgattatctatgactaagatcaggtcaagttcgtcgtggttatcatcttctgcaactatatcccagtcggtcgctttctgttcttcaacactggcaatgaatacctggttaatctcaaccttacggtgagaacggcgaatgatcgtatccccttcgcggaacacgatcatatctgggttaatcgggcggtacgcggttttacccgcgcacacttcattaagcatttcttcgtatgtcattataatacctttactcgctgaacgatggtttgtttaacttctttgtattcgttgtgaagtttaggtgtcgctttgaaacgaatcacatcaccctcttcaacaattttgtttccgtagtagataaccacgttaccatctacgttgattttggtcatgaaacgttccacttcggtgtaataagaaacttgggtatatccgagagaaatcactttctcaacaaccccgctcatttccatacgcttaccgatttccccgatgtgctgcgctgctgcgatcttcgcctgtcgctctgcttcccattctgcgcggatttcttcacgtttagcgatgtaatccttctccagcgctacacccatgcagtaagagcaaatagcctgaaatactgggctatcgttgtcgttttctttgcactgatcagcccaccacagaatcgtatacatcggcatatcagcaatcacttcacctttacgcttaccgattggcatgatgccttgttccagcagttccagattttcggtatcttgtacagacagtttgccgcgacgttcgaacagatcgaaatctgcgaagccctggaacaccatctggaaagtatcggtctggttcagacgatccaccatgcgatcgaagtattcacgcgctttcgcttccgctttatctgggtcagtagacaggttgcagatatagttatcagaagtgaatccacctccacgacgctctacacgcagagtgtacatagcgtttttagcgccagaagaaatgaagtatgtcgcggtaactttagtcaggttagtcatggtgaatctccttagtggtttcgtttcgacaaggccaatatagcaaaagccctcaaccgaagtcaagggcttttttatcatgcgttcgaatctttcataactttatgaagatggatatcaaaaattttccagtatgcttttccgcgaggataaatttttgctttatcaatgtcttcgttgcttccccatgtattgtttgggttacgacaacgattttttgcataatccatgtgccagaataagcgttgcaccgatgaatctgtgcctaatggatcttctttgctgaacagaatttgtgaactcataagaagaaacctgttcgaactactaaatcaatctgtttttccggtatcagtggcgctttatcgtcaacgttgcactgataatacatcccgacatactcatgaggaacgttggattcgctcgcccatttcaggttgtcgtctgtacgcggccctaacatgaggttaacgatattgacagcgtgatcctgttctggggtgttgttgcatccgttcacataatgcccgtgagcggttttgaggatttcaatgatatcttcgtcggcttcaacgagatacagccccgtgttttctgggatttcctcaagaataatcaaagcggttttcatcacacttacctttatgtttctgcttacgttttgcttctttaagtgctcgcttgcgatcgcggtgagtagaagcgcggttgaaatcatgttttgctaccagattgttcatttaaagcccctcaaaaagaaatatttaaggggctttcgcccctcgaattaatccagcagtttgcggatcttatccgcgatacgtccggcgcgggttgcgcttgcggtgtgatcgctttctttggtagccagttcagccagcttacgctgatgttcttcttccgctgctttgcggtctgctgctacctgttcgacctgcttctgatcatgcgcaatacgcgcttcgagttcggtcagggttttgtcaaaagttgctacgatttcgtctacagaacggattttggaaaacagtttcatattcattatctcaattagtatggttggaattcaaagtcaaacagatcatttagtgcgcggttgtattcagtatagttctcaccatccccgaaccgcatctgaatcgcgctttccgctattgtaccagtaagattcgagaaaccaaagaggtttttaatcttatcgtgtgcaacgaagtacagagaagcactatccagcaaggccaccatcgctgatggttcatgttcgcggcgtttgatgcgtaacagagtacggtttgcgccagtcttacggcgttgatttggggctacgtagaatcgaaatactaccttacccgttttatcatcaactaccaggtagaagccgtgttctttcaggtcaaccccttcgaacttggtgaagtcaccgcgcttcatgtcacctatcttaacagcatatttgtggatgtcaagccttgtcagaattcttttcatttttcttcaccagtttatttcctaatttggtgtttacaccagttttcatattcattgtcagtaccagcaagaagatagggcatgacaaaatcaagatcgttgcgccgaacactaagcgaactaagcgaatcaacaacgtcccgatccatttcatcggtatctctacccacttctgaaccgttgcgagtaccagcataacataacccagattaaatgcaagggctgttgcgataataccgtaaggttttttgaagtatgtctgttctccgtcttctgtacgtccagcggtaacgttgcctccgttccagatttctttagcggttttgatggctgtttctgccccgctcaagttctgccagtagtcaggaatgctctgtaggaatttcataatcgaatcctccgcgcctgaatcgctccaggcgctgttttggggttagtagtgactgaatcccacagttacatcacgcatcacttgataacggcatacacgcatcttagcgttatcgtaatctgtcgggattgctacaacatcgcgaggattaaccttaacctgaatgactcgcccacgtcctccgccatagtgaggcaggtacgattttgcggcaacatgcaaaccgcatgaacaggttcggtttttattctcgtctacctggttacgtggcatttcaaccacaacaccaggggaattatcgaacttaccggaagccagatcgcggaagtcttcacgaacacgtttccacgcgtagaaatctccatcatctgccagttcgatatcgttatgcaccatgaacccgtaaagctgatacacagcatcgcgtgaagggttttccatcaacttctcgaagaagttcaccaggtgctcgtaagggcgatcgttgtacatttcgcgaacgatacgttgtgtgataccgctgtcaaacacgatatctttgtacaggactttatgcccgatgattttaatgttgcctttgctgtaaatcttcaacgcttgcgttgtgtccaacagtgtagcaactccctcgatgtcgcccttaaccattaaagcatgtgctttttcgaagttagggtgtgacgaatccgctgtgatgatcttgccgtccagtaccagagtaatgaacgattcagaaccaatcattttagatttgacatctgtttgtggaagtggtttcgacgcttccgtattatacttagaatgctgttcggtaataacgcgcccgatggttcggacgcttacaccaaattgtttagccagtgcggttttgtttgcgctggtcagaaagccctcataaactgctttcttttgtacatcatcaaggatcttaacgtttctcattatttccaccgtataagtttgaccaaatccatcacaattttatcatcattaaacatactgcggaatgtagaataagatgaatgtaacaacatgtaatgaattgatgggttgcgttctgcaaataaatcgtaagcagtatcaacgcgttctttcatatctttccgcattttgtaatacttcgttgacatttcacgaagtaacaggttacgcaccacagtttttgatttgtttttgccctcgataacatcataggtaaacttaccatcaagataatcgagcaacagatacaattctggattatagcggtttttaaccatgcgatcaagggttacgcccatagaatcgcgcagggttcggatctcgcttccgtggtttgatgaaatccatgcagggaaccagttaggttttatcttcttcgctgcgtccgcaaaacgttttaccagataatcatcaaggcatttcatgttgctatctggaatgcgactccacagagagtttcgcagaaccatcacttcgttcagccctgtaaccgttaacatggtcatcatactgctggcgatgctacccaacgaatagttctgtgcttctccgtccagtcggctatattcatcaacaccataaaggcgcatagcgtacatttcatccagtttcacaaactgtgctttagtcaggtacagatcgtttttctgtaagttgccctgatcatccaggaagtaatgatatgctgtaggcgtttttggacgcggttctgaatcaccagaagatgattcacgcgttgctttccagcgcttacgatcttcggtatacgtttcgaattctttggtcatttcactggttttcagtgtaacgatctcagattcatcgaaatacccagttctgatcaagtcctgaacaggttcactattaatctctttggttacgaaactgatacgatccgaaccattcaacatgcagtagccgatcagatatgggcggagtgaacgcgcttcattatcgttttcaacgatgaacagtttcttctgtcgccacggttgaatcatgcgcataacgtcctggcgtttggtagtttccgctttgtatgtctcataacggcgaccagaacccacacgttcgaatacgcaatctttcccgtcatatgggttagcccagaaaccccagatatattttccggttgcagtctcagagcttttaagatgcgtcaggatttcagccagcgaatctttacccacacggaaacgcttatcgcggcttacaaaagcctgtaacatgctaggcagattgttgaaccatatgattttatcacgggttgttttctgcttgccgaactccgcaactaactcttcgtcatagcgtttgttgatcttttccagtcgatccaggattacttttttggtgactttatcaaggctcaactcttcacgcgacggcatgaagtccagcgatcccagagggaaatccagaatatacgcgtaattgctgttacggtagcagtagaacagcgagttttcgaacatgtccatgtcgattggatagcaaatgttacccatacgcgcgtatacgcctgaatagttgatggacttataacggatgatcccgcgatcgtctgcttctttcggttgccagtttacatcaacctgaacaccgataaagcgcggacggatacccgtaaacggttcgtaaacacgcgccgcttcacgttcccattctgcgatatcttcaactttcacaggaacggtgatttgaacgccgttaggttcgtctgtttcgatttcgtagatttggtcaacgaaaggttcaccattatccatgtaagccgtgtacgcgcgtttaatgccgtcctggatggattcgatagtgaatgtttcagtgtagcagaacggggatttgctacccagtcccagcgccccgatcagttcgtcggtgtcggttttggtggattcgaagtaggttgtaaacacctctttaaccatccagtcacttaaccccgtgccgtaatcacggacgatgaaacgcggatcgagaacagttggcaactgaacatcgaacgggttcatgttacccgctaccatatgaccatcaatggcattacaggagatctcgcgaatgattgcacggatcttgtatttgtagatggttgatgacaggattttgaacgttttcgcactggtagccattttaaacttcgtgcgttcgcctttatcgaagcccgttgtgtgaatggtttgtggtgctaactgacgtaatttcattgtttatatctcacttggtgttaaagatgatgttatcgcatgaatatttcacaggcttttgatcaagcccatactcaacaggtgtacacatccggtcaaggtattcgtaaacctgttgcttctgacgttcgcggtctttcatatccatgataccgaccacgatagcagttacaaaacatattgcaatagtacacagcacagctattgtaatatattttcccgtttttggtgcatcatatggtttcattgaatcgcctctgcatattgttctggtgtcaatttacgcgctactaagcgccctttggttgctcgtttgtttcttgaaatgtagatgtttgcaatgttgcgtttaccttcctggatctcattgtacatcttttcggtcatattgcactgataaacttcaccgttcggagttttcaggaaaaacgcgtatatgtctttttcgctttcctgaattactgatttctcacggatacggcttttggttggcgtaggctgtgcgcccaactcgatagctttacgctgccatacgatcccgtgtcccgctccatgtcctaccagagcatgagcaatttcgtgcatgagagtatctaaaacgttctcgtatgtgtcttccttaacatgatcgcgacgtaactcaatcaacttacgagtgtatgaacactgacctaaagttcttttgaaacgtccgttgattttgaaagaccaatgagataagccatacttcgccatgatgcttttgtcccaaatggttatttccatgtcgctacgagttttgaacattttatatcctccccaaatcagtgagaacactataacaaaaagcctcccgcgatgcaagaggcttttgtaaattatttcaatttcttcgaaagttctttcaaatcattaagatattcagttttcggggtcgtttcttcccagtatttcagttgcttacgcagttcgttcgcttcgtcttccagcttttgacgttcatccgtggttagatgatagatgttcatcgcaaccagaatttcggcgtggttctcgcaacccgtccacgtagatacaagtttaaccgcttcgctgcgactaagccccttcaatgcgtcaggttgtgcgatcatctggtcgatgaagtcaaccttcgccagcgccttatctaacgcttccttagtctcctggatgcgtttatcaatacgctgttggtaaacaccaatacggatatcaacgaagtctttcagcaacgtttcaggacgctcgtatgaatgcagtttcccgttaaagataacgttgatgttcgggtttgagttctcaatcaatccgaaatctttcaggatcttctcacgggtaagcccgtttgcgtactcacgtttcagggtgatttcgtagcggaaatcttctttcgatagatccttatagcttacgatataccctttctcttccagcttatccagaatagaaatatatttcacgcgatcatacttgaccggaatctctgtgatcaccagtttagttttaccctggagttcatacttgccgtacatcgtaccgttttcaatgtcacctttgaaatgcgggtatttcagatccagtgtgaaatctttcccgttcaggtaactaacgcatccattcagaaccgaaatcggatcgtgtggtggaatgttggtagcgtatgctttcgcgatcccactgaacccgttaaccagtaccatcggaatgattggtaggtaataggctggcggtacgtgttcagggtcttcatgtgggattgttaaatcttcatccatgtagatcgccttgaacagcggagacagcttacatttaatgtagcgcggtgcgcctggctttttaaccagacgggaaccaaagaacccatcgcggtcaaaaagcgggatgttattgcaccagtgcgccgccataagagacaatgcctcttcaacggatgtttccccgtggtgataaccatacattgcaacaccgccagcgatagaggctactttctggaagcctgtaccgcctttcgctgcggaatgcacgaagaaacggtgaacgggtttgaacccgtctaccaggtgcgggatcgcacgagaataaattgtgtaaagggcaaacgtaagcccttctacctgcacaacgtctttaatacttctttccatcatttcaccgaaaatttatgttttccgttcacccagtctttacgcggatcggattcatcaccgaaacacagttccagaacgtctttgtattcgtcgcccagtacgattgtatcgtattttaactggtcgcccaacacccgatcgtaatcttctttacgtaaagaacccagccctttgatatatcgtacctctttcgccttatcgcggaacggtgcgaaatcttcaagggagtagaaccatttttcatctttaccgactttcgcaatgataatcggtgtgcggatataacggatctttttcttctcgaacaactcaggccagcggctaaagaacgcaatcagtagggtgagaatatcacccccgtcaacgtccgcatcgaccatgatcccgatgttgtcgtaagtcatttcggaagagtcgcctggatggagattcaggatcgccatgagttcagacaattctttgtttttgagcacttctaagttactcattccccaggtgttcaacggtttaccacgtagcggaaatgcgccttgtgtctcttcgtttctgcactcgataaactgccccacggcggaatcgccctcggtcagaaacaaagtggtttctaccccgtcagtgtcgatccctgatgccggaacatgttttgcaaccttcgcctttttagctttcttcttcgctttggtaatggctgcggcttctgcggcctgtttgcgaatcagagcggactcaatgatcggagtgattatttcagaagtatccataatatgtttcgcgatctttttatagttcagtccggcgtggttgttgaactccccagcggtgttagtcagtttttctttcgtctgactatcaaaagcgggtgcattgaagttatgcaaaaacacaaccaaagtcaagcattcttttacacgggctttcgggatctcgatagcgtgtgttttcttgatcatcggttcgagttcggaatagataccgtcgatcatggtatcaacatgaacaccgccgtttttcgtatccagaccgttaacgaaggatttctgtttgaaaccgtcttctgtgctcgccaggatgaaactgattttgttgtttgtctgggtaatcgttttatcgccgtacatcgcgccatacatcgcgaatttgttcgggaggatatcaccgttatatgtgaatttaacggcagggaaagccactgcaagcgccataaggcgatctttgatgacttcctttgtctcttcgtcgataccgtccacaccgaagatagagaagtcaggggtaaacttaacggttgtcccttgctccttcgtcgggctggtgcggtaatccatgttctgcgctccgtccgtacagttgatcgtgactttgcgtttaccgttggatgtctcaccgataaagattgcgctgtaacagtttgtcaggaaagaaccaacaccgttcatccccattgttacacggttttcgtcatcgaagttagaaccggatttagccattgtccaggctgcaacaggtttaggaacaatcttcccttctggcgttctcacgtcatcttgtggaataccgcgcccgttatccgaaatagtgaccagattgtgatcaatcttgacttcgattttgttcgcaaatttgaaatcagttcggatcgcttcgtcgatggagttatccaggatttcgttgatgattttcaccaacccttccacgtattctactttgcggaatttacccatgataaaacgttcatgggcttctttgttcactgaacccacgtacatgttcggacgtttgcgaatgtgatcgcgatcgctcaagcagaatgattcatcaaccttagcgccctttgctggggcttctggtgctttctgcggctcgttatcgtccattaagaaatctaaactcatattcacctcgttattagttctcaggcattatatagggttctatgaaaaagaaaacccctttcggggtttacttgttgtacgggaatccgtctttcaccatctgcggcttatcaaccgttcgtttcgcctcgcccccgcaatcacaatctttcggttcgtcgcggcttgcgatgctggacattttcggaaattctttttcgcacttggtgcatttataggtatatgttggcattaataaatctctgacaatggaataaaacggatcggggttgcggctttgctgaaaacacattgtttgttccctgcaaacatgagatcagtttcgtacaccatacaaatatatccctgattctccaaaatttgccgctcccagctatcgaaccatttagacaacttctgcaatgaagagaagccgaaaatatagctacgataatttttaccatgttttttgaggttacgcattaaacgaaggtcttcgcatggtgcggggtgacgagtctcggagataccgaagtttaaaccgaactcgattccatgaatatcgagatactcatagagatcgtcttcatcaccgacacaacccgtatacgggcctaattgcttacaccatccatcatatttggataatatagacgcttttaattcaacgcgataaaccaacatgatccgatcctcgtaattgattaactacaagtagagtaccacttatctaatttcttatcaagcagtttgttgatcacttgcgcgatttctgtcgtcccgtgggttgtactcagtttcaggtaaatcacatccagggcacacacgatcgcatcaacgctttcttcgacgatatcaccgccgcgttgaggctgaacgagacattcggagatctccccaacctctgcggacaggtggtgaaccacgtcgctaacggttcgttttttgacgctatgagcggtcttgaaaaacttatccagaactacagcggaattttcgcgcggtacttcctcacctttattgacgtggttgatttcagtttccggttctggtgcaacccataccggattgaaaagccctttcatatcgttgaactttacaggaacgggaataccttcaagataaagaatccctgtttcttcatacaccatactgatccggcgtggtgaattgaagtccatcggattcttacgcaacgcgtcatacatacgacgaatcggatcggcttctgatgccatttgacacacagccattaaaatagatttcggggcgtacatatcgccaactttatacttgctcatttacaatacctttatgataaccaacaataaaacagttcacttctggacgttcgccagggaaatgcacacactgcatgacgcgttcagccatgagttcttcgcccaaataaacagaggtggtttcttcgttgtaatgacaatcatacgaagtcttaacactcataccaggcaatccggcgatatgcataaactttgagttcgtgcatggtttaccctcaatgttctttccgtttacatcaaacgttgcaaacatttcggttttgctgttctttgggcgtctgctcatttcttcacaacctcattatatgttgacaggttccattcatgcacttccggcactttggagtaatgatccaggaatgttaactgaacttgcataacactagcacgatccatattgaaaaggaagcgttgcggggaagtaatacacagaaaatcttcggtgcttcctctgcttgcgctaaactcttttgtttctccgccgtcaaattttgcaaagacaggcgtagaaaagtatggggcgaaaagactacgtttggaatcgtccgtaatcgcgctgaaacacacgtctacgagctttccggttccttcccgtctgatggtgagcattgtccctttcgtgcgccctaagacgtttacagagcgcgtggtgacatcaccaaaagcgtttgtgtaactcacagtctccacaaagcccatatcacgacgttgttttaacattgcttcgtgttgcgcttctgcatcctgttctactactcgttgtgcggcttcatacgccgctttgttcggatctcttgattgccatgcgaagaataaaacccctgcggctatcagtccgaagattgaccaacttgcggtcgctgatagtttcattttaatattccaaaggggccgaagccccgattttagcgaagatagcgaacgtaaccgctacggtcgatcgcgttctctgggttgttgaagatattaccgcgaatacccttagcaggtgctttccatcctgcggctttcaggatattgccgtcattgtccaggaaaccagcaactgaacgctgatcgaacatttcaccagtctgtttgttgcgagtatcctgcacaatacgatgatacttacggcctttttccagaacgaaaacagtttcaaagaattcgttttcgaatgcgccaccgttacgggctttgaacatcgcatccagtaaaggctgtgctgcggctttcagttcgtcaaaagtatacatggcaatctcctaaagtctgtttcgtttcgatgggataactatatcaaagctatcccgtgaagtctttagcaaaaagtgctatttgttaaacccgtttcccttgataccatttcgggaaaataacccggtcaataaaagttctccccaagttgaaactatcaccgaacaggagaacaccaaacaaagggtcgtgcttgatatcgtttttcccgacagtcttcattttcccttcgtggatcacggtgtcacccaccgtgatatccttgatgcttacttttacatgatgcatacaatcacctctgcgagtttagcaggttttgcttctggtctaactttcaacgcatcattcagattcttttcaaccattgctaccgcgtcgttttcgttgaaaccgttcttaaccaggactttaactactttggcttctaagtttttcatgatgcgttccttttgtctgtttcgtttcgatgtgtgtaatatactgcatatcgaaatttgggtcaatacccaaatcaaagaaaatcgtatttttcttttaatttttcgtaatacgtatcccatgccgcttcgtcgttgatgatctcagtaccgaaccgataagcacgtttgcgcagttcgaaacgttcacggatacgctcaacattgattttcactgattccggcgttggttgccagtccgcgcacaaatgacgatgaaacagggagtttgacagcggactaagatcgaaatcttcgtatgcaccgtccatgtattctttaccgttacgcgtgaggtattcagcacgtaatgcaacatgacgatcgcgaaggtatcccagcttattgtaaaagaaggttacgtgtccggttcccagcgtatacacagcagggatttttgacaggttgatttttgccttaccggataaaacggcattggggatgcgagggagttcgcgcagttctgcgatcaggtgttcgttcagcagaagagaaggatcgattgtgttaatacgtgtcatagttgcctccttttggtatgtgcgcaatatacaaaaaagcctcttgcattgcaagaggctattaaaattattttgccagtggtataagcatctttcgcataccgccgttttgtgtcgcatcatacacgcgtttagcttcaataagggaaagttcgatatggtatgatttccctttcccgtcaaaatcaaacgttactgtgccgcttgctacgcttacatgagtaaagatgaactcaccagcgaaatgctttcgaaacgctttgtcatgatctaggaaccattcaaacgcttctccgtgctggtacagtctgacgataatcattgaaactatgacgaaaatcagaactgctgcgacgatcgtaagttctttcatcacttacccctgtttacagattgacggtgcagcacacggttaacgcgtggcgcttgatacggtttcattttgtacggtgttggatcagagtattcgatccggttcggcattgcgtacagttcaacgcgtggttgaatccagcggattgagtcgattaacccttgagttaacgcacgaccgaaacctacaccaactaaacataaacgcataatatccccttactgtgccagaatgtgaagccattcacctaaccacacgatcgcctgataagacaaccacaccgcaccggatacacacgcaatcacaccaatgatcgcaaatccgattaaaatgttcaaaccttctttcaaatcaccaaacatgtttcatcctcttttgtttcagtccctacaaaataacaaagcccctgcacgaatgcaagggctttttatcataattcgactaactgaggcaatttcagaaccatccccggaaggatatagcttgcattactaacggttttacggttcaacttagcgatagactgccagcgctcaccacaaccgtataatttttcagcgattgaatacatgctatcgccaggctgaacaacatattcatcgtattcgactttaacgaacgcggggttcatgagaatgtcaaacatctgcgcttttgcttcgttcagtgtttttgcatgtacagttttacccacaaatgataatttaatcatcttttcctcggcagactcaatggatcggtttcttcttcacttgggggttcttccagccccagcgcatatctcaatgaatagactatcatcaaaacatctttcgcgcaatcgtgaattgaattatgcatcacaaaaccatcaagcaaccctttccgaagaggacaggtcgaagcatcacgcgttaacaggcggttttcgatacatgtacgcacatcgcgactattccagaacacggtcggcatatcttcgaagatgtcgatcttaccaaccatcttacgcacgatatcaaccaggataccgcgatcgaattcagggccacgaacataatcgagtgattgccaacggctcacaccgtccgctttcaggtcttcaaagaattgtctgtgtcctgcatacagttccagatcttccggcgacggtttcaggatttgacgggcttcttcgctttgctgtttccaccaatcgatcgttgatttgtcagcaatgcgatccggttgctttttcaaatcgaacttatattttctcccccgcgaaaccagttccgcgaatgttggcgggttgtgggggtcgtcgataaacggaacgtaagacagttcaacgagtttaccgtttggtgacgggcctacagtttcatagtcccatacgtaatcaactggaagatgtgacattacgaatcctcttatattcttccatgaaaccagccagcgcaagggctactctgggagtgatatcaaactcactgatttcttcgttactcagcatctgcataccgaattgacgcaaaccacagttatatatcgactgttcgagtcgctttgtattttcaacagcttccacgaattcacacagatagtcataatcaacgtgtaacgggatttgctcgcggggtgtctttaaaatcaggtcagcaatcagatccgcatgaagacgagggaatttcatagagatatctgttttcatggtaagtaccacaggtctttgttttcgcgtaagttacgcatgacacgaagaatcatagtaacaacaccatattcttcatatgtaagttcaactgtaagggcgacgttaccccatgaataacttggcccattagggcaatacagatttttattgtagctgtcaatgtatttcagcttacggatcacatcagcaggatcgatagtgctgtacattgcaaacatggaatttgcatgagggtctttttcgcgaatcttttcgactgcgttcagaatctgctggatgtcggtaactttgatactcaatttcataataacctcataggggccgtagccccttatacatagtcaacggtgtaacgtgcgcgggttacgcccacatagattaactgcttacacagatcgtaatctgcgaacgcatacgcatcgcgcgtgtacatgtacgcatggtcatacgtgctcccctgcgatttgtggtacgtgcaaaccggaagaggtttaacatcctggaacttgtttttaatcgcccagaacgaatgccacggggctttataccctgtttgttgcttgatgcgcttataagtgctcgcaacgtaagccagatagttacccagacggtctttcatcaccggatcaacaacaacctgaatctgtgcttcggtttcctcttcgagcgataccgttttcagaagatagaattcaagttcgatcttctcgtcgcacttctccgccttgataacttcccgacgcgggatgatttctaaaactcggattttttcgttgttgttataaacaatctcggtgaagatttgcccgttcaaccgcatttcctgaactaacggttcctgcatcacgatcacttcatcgagaatgaacggttctgttgttttgtacaggtgtttacggatcgttgcgttcagcttgtccacgttgtcgttagtgtacgcgaacatgcggttctcgatcaagtcatccggcgttttaacacggcggaaatactgacggaggaagtcaacagcgttagcatgttggaacacacccagatcaccgacagacatcggtttcagcatcttaccatcgcgtacagcgcgtgaaacctgaataatcgggttcccttctgcctgacgcatgattttatccatacggataacatcaaagatttcttcatcaaagaacggggagagttcaacacgtccatcggcgtttaccggacggatctgatctttatcacccagtcccagaataacagcgttgcttggaatactgcgccggatgattcggaacagatccatatcaaccatcgagacttcttcaacaacgaacacgcgacaggtagacagatcaggcgctttcttgcctttctgctgttcgaacacacgcagttcttcgttagtcacagggctaatcttcaatgcagaatgaatcgttgttgcgtccattccggtagccgctgctaacacgtttttagcctggtgtgttggggcagttaaccaaataccgctaatccccaaccctttcagagtgttaaagacaaacttaaccagtgttgttttaccaacaccagggccacccgtaatagttgtatgaatggcgttctggatgttgtggataacgcgatcatgcgcggacttctgatcgtcactcagatcatcaaatgttaactcgctcataatttgagtaataccccttgaattttcgaattctcaataaaccaacgcatctcttttttctgttcttcggttgctggtagttgctcggttttgcggaagaaactgaaacgcggttcatccggcgtgtagttcagtttggtttcgtagcacttgcggataaaatctaatttatcttttgcaagttgcggtgatgcaaacagttccggcgttttcccgttttcaacgtatggaatagtaaagccgtctttgtctttcgtaacaatgatatagtatttgtcaatcattttcgcccctcatagatgacgtagaaaaaacctataaaccatagcaatgataatactatcaaagcggcttttctgtcaacaccgttaacgtggaaaacgcaccaaccgaagagatacgttatcaccgcgcagacgatataagacaaagcaaatacggcatgtagcgcggcgatttccattagtagttgttcgcccaacgacgcaggttttccgcctgtttcagagcatacagcttgtagatggtttccgcatccattcccagcgcgaggaacttacacatgaagaagtgccactgatcaatcagttcaaacaggatttccagtttgtcttcttctttcatttctgcgaatacctggctacgcagttcttgatgatttgctttccacggtttccatacaccggaagccgcttttgcaccgcgagacataccacccagagcggtgtaaagttcgcgggtttcatctgcaatcgcatcatcttgcagtttcagccagtccaagatatcaccgcacgttttcaggttatcagggcgcggaacccatgaaagggtatcagacaggctttgttgtgcgtggttttgcagatccagcattgattgcagaggatcgccgttacgtgccagaaccttttgatattcggtatcaacaaattccagatcagcagggttaaccaggtgcgcacatgatgtaaaagtgtttttatcagtcatatcaatctcattttttcggtgatttgttccacgacttaaaccgaagtttcgccgtgagtccagaaacagtattatctttcaaatactgcatgatttcaagtttagttgcgccgtccgtttttatcatttcgttgatatcttttgacggccacgggcatttgtcccacaacacaaccttttcgccagcctcaattaattttaaaaggcggtgagtagtatcagggtgtctcgcttcattgtcaagaacccagacacgcatatttttatacggaacatcggacagcgccatttgtccgcccgtaatcgcaccagcattatctacaaacaggctatccagcggcccttcaagcaggtagacaggtttcaacggatcgatggtatcttgaccatacactttcgttgagtgttcacatgctttgattgtcatgtattttgcgttggcattgtcacgcaaggcgcgtccctggaatgactcgattttacccttttcatcaaagatagggatcaccaaacgtggttcatccttcggtaaagggtatgcgtccgcattcacagagttaaccaggtgttgccattgacgcgtaaaccagaggcgatcatatttgtctttaggtatgtgacgacctgcaacatacttaacgatagggtgattttctggcaacgtgtccagacgttcgcagaactgcaattcaggaatatatttcttttcttccttcggcggttcttcgtgcgtctgttttaaatctttacgatccttgaaagattccatcaaatacgccgtataatcatccgggtaatagtctttcagaaacacagaaaacggcttgctgtagttgcagttaaaacaaccacacatcatatgtgtgcctcgttttgacggaaatatccagaaacgttttttgtgcttatccttcatggagtcgccacaaatcggacaacgggaatggatactgaattctccaccccgtcgaacgatttcgctttgtggtaatgatcccatgatacgagttgcgaactctatatcaagatacatgtttacctctatcggctaacttctttctctgtgccgtctaaagtgattttccattcatagaatatcttataaaacggataaggtctaggaatatcgacacccgatgaagtttttctttcgttcgtgtacacgatcgcggtgtcgctcatgtacttgatacggatcggaaaccaggtgtaattgttcgcagtaacccagatccggtaattcaaaggcggtaatggtttcattcttcactcttcatgattttacgtttgcgtttatatggacgcgtagaacccagaacctttggccctttgttcgtgatcgcgcctgtagtcacacccgaagcaatgttatccacgcttccgcctgaatcacctgcaaccatttcttcgttgagtctttcgcgaagttctgggaggttcatcatgatctcttcgtgttcttgctcggtcagattccaacggttccgtagagagtcatacgcgcttgtaaggttcatgaacccagacatataaggaaccgcgtttaaacggcgcttgatatgtcttacagagcgatggaacggggaatatgcttccagttcttccttcgtcttcgggtttttcaatacttccccttgaccgtcgatgatacccagcttgtaagccgtccattcagtccagggctttttcagtaggcgaatcattcgcacactgtaggttaaatccatgtttttgattaattgatcgctcatagtctttactctattgtgaaagtgaaaaggttttgcgcgggttctggttccggttcagggaattccatacagacaacttcacacatcggtttcacgcctttccattcttccagatagtatccggtatcaatgccacaacctggttgcatttcaaggccagtttcatcaagaaactttttgcatttcgatgttgtcgttgattcgtcctgttggaaataacgccgtccagagtaacggaaattcgcggacatctgcgggagaatgaacgtacccgcacgggcaatctgtgaagcacgttcaatcactttatattcaaattccgcgcccgtatacttacccttaaaatcggatgtctttatcttgccgaaaggcggattgctgatcgccatatcaaacatagtatcaaactccgtcgttaacgcgtctgcgttaatccaggtcgcttccggtacgatacgcttacccaacttatagtatgtatggtttaactcaacacagacgatttcacgcggtttggcgtacatcatcatgtgaagcatcgcgaaggatagcccaccgatacccgcgcacaggtcaacaacgcttccactggtacaagcatcaatagtgaaatcgcgagcaagtccgatcggggtaaagaacgcgcccagttcagagttattcgtaaatgcaccttcatggaagttttcgataatgaataacttttcgtcgtaggttagcgccttatcagactccaccagatccattatcttgttgtgttgcttcgtttccgctttcgttaactttgccattgaccttttccggtaataagaacagaggggtagattctaccacatcaaagccccagtcatcaacaatattgctttcccagtcgcgggtttcccacgggctgcaaatccacttatacaccccagcaggatcttcaacctgttcaggcatacccagcatttccgcattgataccttcgtccagatagccaggatgaatattaggccagcgcatgatatcgacatagcctttatcatcaaccgatacgatccattcggaacgatacggactatcgaactccggttcttcgtctggaagtatcatatctaataaatcactcatttcactaaaccttctttaacgccctctttcatggctttcagaacaccgataaaagcgtctttgccaccgatagcgccgatgataagcatcaggacaccaacacaacccgctaaaccgattctgaacaggttccatgcaaacgggatagccagaagcactaaccacgggaacggaaagcccataagtgcgtttagaaccagtaagataaaagcgattgcaagtttcatgatgtcctcctttgtttgtttagaataaggtatcacctttcgagaaggattgcaatacctacagatacaaaaaagcccctttcggggcttaattttatgctttgttgattagataccgaagaacgtttttggcctgaacttcgttacagcagagtttgaattctgggtcgattgggaggaagccccagaggaaatcaacgctaccttcaacatctgctttcccacttttcagcatttcaaccagcaaacctctgtttactacgctgttcactactgcatcgaaataacccgcgctgaaatccagttctgggttcatcacttcgtcgtatgggttgttcagtaagttcatttggtatctcctttaatccgtttcgttgtctacgggagtcatattatcacaatcataactcccgtcaacccctaatcaggattattttgcgttttttgcaatccagagagtcagtttagggaatacatttgccattgccacaacaaacagcacccagaaagccagcttaatcacaccgatcacgatcagaggtgcaaacacaagccaccaggaagcatttgccataaccccgattgctgccagtttcagagacaggaggatcaggaacacaataacgagaatctttttcatttcactatacctttggagggggccgaagccccgttaaaattgaatgtctgtgctgtttgctacttcggctaacttactgcttcggttagtttcagcttgttttaccatagcaccttgtgcttcttcaagcgttttcggcatctgacgacctttataatcagatttgaaccctatatcgctgttgtcggtatccatccagcgttgattacccttacgcacttcgagtttgaagtggttaaagtggttcttatcgccgtaacgggatttgatctgcttgaacaactgcaagccctgatcagctaactcgtcggtctcaatcacagctaacataaagtcagcagtagccggaagaccagcagattcggcaacgtcgcccatgctgatatcagaagcatcccacgcggcgcgggtagtctgcgcaccagtccacattacggtatttgtttcaacagccaaaccgcgaagttcttcggcaatcgctttaaccaggatgtatgtgttttccgccccgcgtacacgggtagaagcacagatccccaggtagtcaacaataatcacatcaggtacgaaacccttcttcaatttaagctctttaatcagcgctttgaagtggttagcgttcgcccctgctgttgggtattgcttaacgattaaacgtccgaccttcgactgtttgaggcgttccatacggttcttatagtccgcataggtaatgttcccgttgtcgatatcgtcaagtgacacatcaagcaggttagcgtcaatacgtttagaacaaacgtgttcagccatttccatactgatatacaggacgtttttacctgattgcaggtaatcagcagcgagagaacaaagccccaaagatttaccaacgttaacaccagccattaagatgttcaatgttccacgttctgcgccgcctttggtaatggcgttcaggatcgggatattgaaagcaatcttcatcgctttggactggtaaagcatccagcgtttttcatagtcttcgaagtaatcatgaccgaccgaactatcgaagctaatcgctaacgcttccgccatgatgtcagggattgccccaacgtcagggattttgttgttgcgttctccagcaggtttttcagcattcgcctggatctcaattgcacgggacagagcgcgatacattgccttgtcacgacaataggtttccgtttctttcatcaaccagtccagatcttccggcgcatttttcatgctgcggatcatctttttggtgtcttcgtagactacatcactcaggctctttttgtccagagctacttctaaagcagtttgtgaaggaatgctgttgaattcctgtacgtgcttatccatcaaatcaaagagaacttgcgcgttcccttcgaaatattcacggcgtaaatggggccacgcctgaacaaaatacgtaccattaaaaaccagatttgaaaatattgtttcgacgatcattgttacctcttaaaccagattagcgaacatctgaaagaaattatacagctttactttcaacgccgcccataaggtcttttcaggctttgggagattaggcttgatctgcgcgtagattgcatcgtgaaccagcggaatcagtttttctttatcttcgtccggcgtactgaattcgactttcaagccgttatcccaatacactttatggatgtacactaagtgtgcaacatcgttttcatcgttgatcaacagttcttgaataacgtcctgcattgcttcatcaagaatgttctttgttttttgttcaatgtccatgattcacctattaaaagggggcaaagcccccagttgtttattactcttctgacatatccacatcatcagggatatcgtcatccaaatcaaatttatttgacggttctacttcatcgtcagaataaagatcttcgagtgctgccccgtcagtgatctctttgtcaggaatacggtatttttcctgaatcgcatcaaggaatggctggtgagtgaacagaggtttccagaactcaatagagttggtttccgtttcacgccatttcttatcttcaacttcgagttcgccagtctcggtattcaggaaagcacggttgcgccagcctttcgttacggtctgaacgaagttcatttccatagccagatccagaagaccagagaacatactgataccgccctcataggtaacatgaagcgggaatttggatttctctttcacgaagcgagatttctcgatgttcatgatgaagtcataaccgacaacttccgtaccttctttcacctgttgtttgcccaggatgatcgcggtatctgcggaatacatcagaccagtaccaccggaaatgactttcttactgtacatttcttgtgtgtcgtatgtgtgacagatacacaccatcggaatatccagatccgccaggtaaggcgtaaccatacggaacatacctttaagtgctttagcacgggtcatgtcctgtttgtcgttgtcagacagggcatcagccagttcttttttactcgcggtgttgcctacagagtccacgaaaatgatcactttgtcgccacgttccagcgcgttaagctggctcacaacgtcatttcgaagttgctcaactgtcgtgatacgagtatacaccacacgatcggggtcaacgcccattgatttcaggtaagacttagttacgcctttctccgaatcgtagaacagacacacagcatcctcattcgctttgaggtacgccgcaaccgtcaccagccccagattcgatttaaagtgttttgacgggccagcaaacagagttaagccggaagtcagaccaccatcgaaagcgccggacagcgccaggttcaggatcggtacacgggttcgagttttggtgatgttattgaaaacatcgctttcagacagaattgacgcagattgactattcgagtttttgatcagttttttcaggagtgctttattagacatttatttttccggtttatatacacgcataatatattcctcacaaatttatataaatggggcatttctgccccgtcaggtcttaccagtcatcaccgaacagagtgttcagggatgcgcgtttttcgtaatcaattttacatgcttccgtgatgttttgcaacgggctaaccacatgtttttcaaataatccgccatagtctacccacttcaaaatatcttcttcgatctcagttggtaaacgcgtaccggattgccatgcgatgcaatcagcttgccacgggtttttatctcgcaacggcagaaccatcaccttttcaccttccatgatcggggtgattccttgaatacccttcgtatggcggttaaagaacagaacgcctttgatgtggtttggtgtccctttgattgggaagccagcaccatcattatattttgagatattgttagcagatgatacaccagctatttctcggtagtcaagcgccttatactcttcttcaaatactttgaagtgttcgtgtaaggattcttcaccttcttgcaggatgcgacggatcgcttctttcaagaactttttaaccgctgtcggtgtactgcttcgctgggtttccattcccatgatctttaatttaggcttctcgtagcgggttccttcggagtcccatacgttagccgcatatcgtttcttagccgtccagaaactacccagacctttcgatcccagaggtggtccagaaatgatttcgcgatccataaacatcaggtgttcgacgttgttcatgtactcgcacagttcgcggtagcccttatcaatgataggttccatgcgttctttactgaacttatccaggaagtcaacccaatggttgttatccctgaacttactttcaccgccgactttcgcgatcacgttgtccatacaaacataaatggagtcggtgtcacagtaacgcacgtatgcgtaatccgtagtgttgcacagttcgttaaggtattcgttaaccttacgctcaatccactgaatagccaactgcccgaacatggtgatcgcgctggcgtttcgaatatcgaagtaacggaaatgttcgttacccaacgcaccataaagggagttgatactgattttacggttaagctgtgcggtgttcgcctgtgcgattttcttctcacacactttcttcacggctttaagcatttgcttagacagcgttttcagtacagcttttgattcatcgctgaaatcttcgtagaactcgaaatcagggttgatcatttggttgtgcgcgtctgtcaggtgttcgagttcgtgcttaatcagttcgagatttcgctcacccgccatcattcgttttttccacgccttacgctgatcaaatactttcttgatctcgaccggaatcacgcctttaacatcgcgtcggaacatccacccgttaggagagcagctaaattcgtcgctaggacgcggcgcagtcttattgatgtattcatgcatcggacgcactgcaaagctgttagcgattgtctcagggcttatattcacctgtcggatgatagatggatacaggctggtcaagtcgaacgatacaatgtaacggtatggagcgacaaccggatctttaacgtatgcaccatcatacggcgttttagtatggcgtttgttttctgggattactttcttctcttcacgcagagagttgtaaatgattgcgtcccacgttttaagcggcgacataaccccagggaagttgattttcgcgtagtatgctacagacagaaccagttcgataaagttgcgtttaccgtcgatatccaacacgcggataacgtcaacgatgttatacgtgatgtatttctggtgatccgcttgacgaagttcagacagcgaaccttcataatcaactttgcttttacctgtttcgaactcagcgatcgcacccagagagtaagacggttgcggggtgaaactgaatttcttatagagatccattccatccatttgagcaacgccgtaaatctcatagcccagttgttcgttcccgtaatggtcggttgttgtcttcgcagtcactttcccgaacgggctgaaatgacgaacaacgttttgcccgaagatgttcaggtaacgggtgatgatatacgcaatatcgaacttgtttgagttccagcccgtaacaataacaggcgtccgctctttccagtctttgatataagccgacaacagcgacttttcggtctggaatgaacggtaaacaattttcttcaagtcttcttcgctgatctcgttttcggtatcaactttcgacgctacccattcatctaacccgccctcgaccagatcgtacacaaagaatttatcttcaacgctgtcatagtgtgtgattgcgtcgatagcatattttgcttcgcggggatcagggaattcaggcgcggtaacttcgatatcaagtgaagcaatgcggatcttgtcgcggtcgtattcgatttcctttctgtaggcatcggatatatacgccagcctgaaatcatccatgcctagcgcttccatgcctacatctttcattcgctgcatccagttttttgcttctttgatgctttcgaagttctttttgatgcaggtcttgccgtaaatgtcgcgatatggcgagtctacacccgccatagcgtgttgaaacattgtaggcgcatattttgttttgcgaacctgttcgcgtccctcagagtcaatgaagcgctcgtagatgtgatcgcccatttgctcaacggatagataaaattcattcattacggttttctttctccgtgtttaatcgtgacaggaatgataccccagccagcttggtcagatcaagcgagcgttgcgctaatttgtgatagcgttgggtgtctggtcgatttaggttttcaaccagtgcggtatattcttccatgatacgggtatagaatttagggaaatgatcccgcgcatatgcgtaggtgcgcaggtcagagagattgcaagtaagagacagtttgatgtcttcgctatgcagacggttgatcagatgatcgcctgattcgatagctttgatgatttcttcaatacgaattttcataatttagtcctcacaagtggtatgtaaccaatataacaaagcccctgcatttctgcaagggcttttgattaatgtccgatccggtacttgtatttcaaagtccattcagctttttgtgcgtgagtcaatacgcggaagttgttctcttcggagaatttcagatccggcgtaaggatggaaaccataccccactcttccagaagtcgcgcaatgttattgcggcgcagttcgtcatcttcggtcatgtcaacctggcgaccgtccagcttcaacagttctttgaagtgtacgataaaataacgcccttgtttctgtaggatgtgacaagactgccacagcattttctttttgttatttgcgatcccgatacgggtcagcgtttcgcgaattttcaggaaactgtcatcgctggacagtttaatttcgagcatgttcatacatcaccatttctttattagttgttcaacctttttctggtcggttttatttttcacaacatcagccaacacagataaagcaactttcatatttttccgcttccactcgtccagtttttcaagctgtttgagttcttcgtaatattccattgctatacgtgtatttacaccgtatcgtttttggagaacatgaaggataactttcatttcgttatcttcggtgagtttagcccacgccccgaaccgcttacctttgcgcaccgtatgcaggtaataatcaaagtgcgcctggtctggtaaaccggaaccgatcatattcatcgtgtatgcaggtatcagcgtttcgatatgctggctcattgcattgtcgatgaaaaacttatcgtatgaatcaagggcagagatccgtaatggtgtcttcccgttgttcagttcttcgagcaccataaacaaggtgttttccttgtctttggtgtactctttcacaagttcttcgatcttgtcccagtctttagaacgccaggccgcttcatgttcgttcagttcatcttcatcgagaaaagcagccagtgacattttaagcctcccacgcgagggtaagcattaagcccatgaacaggtattgcaggtgaatctctttgttcactgccagcccgtactgtgcgttgttttcgcctactgcctgaatgagtgcaaccttagattcgttggtgacgatcgggtataccgcatccagaagtttagccaggaaagtttcatactcaggcgcgtacttgattgcttcggctcgcagtgctttgaagttcttcgctttaagcccctcaatcactggtgtgatgtccgaaccaacaatctcagacagaataccagcatcaattttgccacgcttagaatagaacccaagagctttaacgatggatcgcgcgtctgggtagtgcttcttaacgaatccggcgatcacctgctggtcatattcgattttctcgatttcgaggataccgaaacaacgtttgatcatttgcttcatcagttcaacgcgttcttccttcgacggggaaccgaacttgactaccggacagcgggagatcagcgcagggtgaatcccgttgatgttgttcgcggtgatgataacagtaacgttcttgctgtacgcttcgataaagctacgcatgtgcttctgtgcttctgccataccagggcgatcgaattcgtcaatcaggatgattttaccgcctttcttctgcgtcatggaggacgcgtaacgatccagttcgttacggatgaagttcacaccacaatcggaaccgttgacaaacatcacttccgcatcaacttcgttagccagaaccagcgccagcgttgttttacccgtacctggggaatcagaaaccagagtcatgttgtcgatgcgtccagacttgatgaagccgcgcatcgtcgctttatcagcagcagggagaatgcattcatcgatcgtcgtcgggcgatagcgctgatcccatgcgaattcttcgggagactgggagattttgccgtatttggtttcgattaactgtacgttttcactaagttccataatattaccttcaattgattatcaaaaaggggcttaacgccccttgtgtactactttgtttatcttacttgaactggctggttgcttcaagtaccactacatacgcaacgccgttttcggacgagaatttcgcagcgccgcgagaagagatttcaactttgtaatcgctgttgatgaactgcatgttgtcaatcttcatatcgaaattgaacatgttatcaccttcgtaatcgcccacttctacagagaaggttgactggctttctttacttttcgcggtgattaccagcttgccgttgattggctcaacagacaggtcggtcagtttcatcatgcgtgacgctttgatcagtttttcgaaatcgttcgcgctaatctggaaaatcagatccgcaactggcatttccagacgcttcttaggctgtacgattgtggttggatcgcttgaacgctcaacgattttcattttctcaccacgaatgacgatttcgccagtggacagatcgtgagttacttcggcatcagtgcctacaacgttcagcatgttcaggaatgagttcagatcgtagatacctacatcttcgtcaattacgtcagaaatcgttgcttctgcgtaaactacgctgttgatggatttcgtcataatgaacgaaccctttttcagcattacagacgggttgatctgggagaagtttttcaggatatcgatcgtttgtttagagaatttcatattcaacctatagttttcaattaggcaaaagtgccgttaatcagggattctacaacgcgatccgccgcattgtcaaggaattctttgcttttggactcgttgattttcgtacccgcttcgcgagcgtcgtgaatcagtccggtatgtactgcgcttactgcttcgtcgatccgtttgtaatgctcaaagcgttcagcttgaggcatcgcacggaaaatctctttgatgttttccggcactttacctacccaggatttgcgaacgttgttcagatgcgctacatatacgttttgttctaaattcatatctacctcaaactttcaaattgggggctttcgcccccgtaagcattacagatccagcagtttatccaggtcgtcatcaccggaaccaccttccaggtcaaacggaggggtgttgtcatcttccggtacgcttccgcctacgttcagttgacttacgccaccagattctttagcacctttggactggttgccattatcgaagtttttcagttcgttgtcaaatgagttcagttctgaatccagatccgcaccagcgcttgcgccagcacccattgcagcaccaccgaatactttggtgaacttcgcggtcagttccgcagttggtttgaactggtctggagcagtgattggacgcagatcgctcataccttcgaagatttctttctgacgcgcttcgtcttcgatgcctttgattgggccaggaacaccaaatttgctgtcgtcgtagttaggccagtcgcctactttcttcgcggtcagggtgaagttagcgccaccaaacggacaggtcacagcaacacctggttcatccagatctgggttccccgcgatagccgcagtgattttatccatgatctttttaccgaagcggaacttaaacaccttaccttcgttttctgggtgcattggatctttaaccaccagaatgttcgcccagaacgattgtttacgtccgatcatacccagtgttttttcggcttcgctgcctttcactttcgctttttcgaacagatcgttttcagagatatactgacacacagggcaagcatcgtaatcgccgtgggtagatgggcagttttcgatgaaccactggttattctttttgaatgaatggttgacgatacgcacgaacgccagttcatcatcagatcggttaggcaggaagcggatcaccgcagaaccgtttttctgtgcatcgacaccgagtttccactctttttcatctttctggaagccggaggaacctttcagagcggcgacttgttcttgcagtttggttggatcttgacgtttaaagaatgacatatgttatttctcgtttaagttaattaaagtttgtttcattaagtttcggtattttacgatttcttcgttactgatttcaactaattttctgtatgcgtttagttttttactaaattcattccagacgaaatccgttgcgatttcatcgtgtttatttatgatgtctaaaaacgagtcgaggatcaagaatgactcataagaaatcactccagaaagtacgagtttgctgatatacgaggttgatgatttgacgctatactgaaacaccgtagagaggggaatacctttcatgcgggaaaattcatacaggttttttacatcgtccacgaaaatattatcaattcgcctcaacttgcctatgtattgacgataaaacacgatcgtatcttcgtctacatccccgacccagaagtcggggttagctaccatgttggagagaagtataagatatatttctttgaatgtaaacctttcggctaactttttgaaaaaatacttatctcttctcttttcgaacgctttttcagtgatctttatttcccatttgtacttgatcgcgtcatacttcccagcaaagtgatttttcatcaccaggtacagtttgtataccgcgatcggtttcaaacgggaattagcgtctgaactgtcaaacggggttttaaatttcacatgaaatcatccagggtttgcgtcgtcgcgtggtctttagccacagaaggacgcagcagattgtttttaatggcttcgtcgctaatcttgtcaatgatcgctttcggtactgttttggacagcatagcataatcaatgctgttttcgtccatccattgtaacgtagcttccatgtaggttgccccctcagaggcaaccagattttcgatatacaagccgacttcggttttgtttccgatttcgctcatattacgccttatcgatcacatcgtacagttcgataagttcgttgttctgttcttcgaacgcggtacgtgcctgttcgtgatacagtttgaacagcttgccgaaggttttgccgtcgataccataatccgttttcgctttggatttgatatctttgaaagaaccctggaagtgttcgatctgagttttcacgttcgacgcttctttgatcagttctttaaccgctttagcgatgtctggattttcttgcagtaattctacactcattttgttacctcaaaagtcacttagtttttcatacatacgggtaagtttgcattccatgaagtatttctccatttttgctttgttcccgatttttggagcattgtacgcttcttcgattgccgttgcaacatctttcggaataaaatcaaagtcgcgaagttcttcgttttctctgtagcggatcgcccactcttcgggcatacccacggtcggatcgtccgcttccagccaggcttcgagttccgcagcgtaaattgacggtgcgcgttctccttcaaccttcgtaacaatatagtcatttctgatcttaatgcaagcgatactatcttttttatcgcctttaatgatcttcatacgcaaatcgttacgcggtgaaccatatttcggtgtaacccatttcttttgtgttggcgaccactggcgcacaccctgatatttttgaagggctgcaaagtcaccatcagcagaaacgatcagaacacgtttaccttcggataccgctttacgcgtcactacaccgatcacatcatcggcttctgcgaagtcaacgcggatacctttgtacggtagattagcacggatttcatcgtatgtcggatgaaggaaactattcaggcgatcccagtcccaatccgatgattcttgttccatttttcgtttctttttgtagtaccatgctttacttctgcgccaatacttgttatcatcaaaggctagaacaatttcagggtactcacctttgaatttaaccacattgtgacgaatggtgtcaagcactatgtgacgaacaatttgttggttgatgtcattctggtctttcggcttgaagttgttcatcaacgttgctaccgaaaggtttgaaatatctatacacatcacatcaacaggatcatcgtcattgctcattaagctgttcaggttgaacatacttgcaaatgaagacatttcaatacctcgttgttgttgaatgaaactgattatagtgatcactttttcaaagtcaatagatcatttcaaaaatctgagcgaagcgaaggacacgaacgtagtgagtgtctatgtactgaatgtacgttttaatatttttatattttatatatagagaaaacagtacatttccgtatactttttaaccagatctaactatccgtttcgcttcgctcacggaagcgcttcgcgctgattttattaaataatatagattggaagtaggtttgaaacacctgattcaatcggctataatgaatgtattcaatttggagaatataatgactacaaagatttatgcagataatgataagctgtatccagttatgtgtaagtggaaacagcaaatccgtgaaactggtgatcgtaagatgccggatgaactcggtattgcgattatgaatattgctcacggtttggcacgtcgatacaacttcaaccgttattccgaagactggaaaatggatatgatcgatgatggaatttcggcaacgatttccggccttcataactttgacgaaaccaaatatacaaacgtctacggttacatcaacaaggcttgctggcaagcgtttgtaactcgtattctctacgagaagaaagagaacgcgaagaaatacaaatacttcctggaacatgtctatgacagcgatgatactgatatgacaacgatagccgatgaaactttcattcaggatatccatgacaaacttaatcagtatgaagagtccgcgaaaaaacccaaagataaaatcgaggttgtggacgaatcgccaacattggaaatgtttctatgaaaattaaaattgacctgaacaaaattttagcagatgctaacgacgaaattgatctgcttccttaccttgtgaaattagagttgcagagcttagggattccgattatcatcgaccctacagatgtacgagatccagacttccagataacagaaggtcgtctggactatgtaataaacgccgaaacaatgatcatggagatcacttactatgaacgtgcagcatgaagtaatcgacgaagtacaccaaaaatcagcgctggatcttcgtgaagaagaactggaatccgtcaagggtacacgcattgaacaagaagccctacgcaaagcgcaaaagttcatgcggaagaacaaagcggaatggaagcgactgcataaacacgcagagaacgcactcttcgaaggtaacaaagagcagtacgtatacgcgatcaaaaagatgcgtgatatgctcaagcaaccatacaacgatgaactgattgaaacgatgtggatcacttcgaaccagcagttgaaagacctgttcatcatggcttctgaaaaatacggcaaataaaccccttcgggggttttgaggtttatatgaactatgttttaattggggatacccatgccggacttcgccaggataacccctggaacgaagaaaacctgtatgcggtattcaaacagatcgtagagtattgcaaagaacacgggatcacgcgcggcttccatgctggcgacttcttcgacgttcgaaaagcaaccacacaaacgacaatgaattttgttcgtgaaaagctggttcctcttctgattgaggcggggatcactctggatgttcttgtcggcaaccacgattgccaatttaaggacaaaatacgccccaacgcgccacgcgagatactaagtcaatacgaatgctttaatgtcattgacgaaccgaccacggttgatttaggtggcggaaattcaattgacctgatcccgtggatttgtcaggaaaatagccagcgtatttttgactacatcaaacaatcgaaagctaacttttgtttgggacacttcgaactgtctggttattatttctacaagaacagcaaagccgatcatgggctggaacctgatttcttgaagaagtacgatcgtgtttactctggacactatcaccacgctaacgagggtgacaacgtgttttatatcggtacgcctctgactatgagcgcgaacgacgaagacgaaacacgcggattctatgtgttcacgggcaagcctgaattgactttcatcgctaaccctgtgtgccaccatcgccggatcatgtatccagcacagaaagatgttgatcttgaacagttccgcaactgcgcggtgcgtttgattgttagtgaaatcgatcaggggcttgcaaagttccaaaccaaaatcgaagaaattgcctatgaaatcaacatcatagacaaagttcaaacagattcagatgtcgataccgactttgaaatcaaaaccgttcgtgggcttatcactgagtatatcgcaaacatgcagatcaccgacgatgaaaaagaggaagtgaataagcggatcagcgaactctacgcggaggtgtcaagtgcatagccgttatgatgaatatttcggggcgaacccccgatattctcacctgttgcgtatgttgggaatgaaacacatcattgccacttctgacgaagcaggggaaaccagcgcagtttgtttgaccatcatgaagggtgtatggcattcatcaagaacatggtcaatcttcatgcttgatacactggacgatgatacgctatcatatagtattgattcatcagttattcaactgatcactgaattatgtgaacggattttaaatgaaactaaacttcaaaaaaattaagtatcaaaatattctgtcggtcgggaataccccgatcgaactggaatttgatacagcaaagaaaaccctgatcacggggaaaaacggtggcggtaaatcgacactgatcgaggcgttaacctatgccctgttcggtaagtcattccgcgatctaaaagtcgggcagttggtgaacagcgtcaacaaaaagaaatgcctggttgaactggaaatcgaatacgggaaagactcgtacaaagtggtgcgcggacaaaagccgaaggtattcgagatctggaagaacggcgagaaattgccggaagactccgcagcgggtgattatcaggcacagcttgaatctatgctgaacatcaaccttgtgggcttcaaacaggttatcgttctgggtacagcgggttacactccattcatggaactgaaaaccccagaacgccggaaactggttgaggatttgctttccctgtctgttatcagtgaaatggataagctgaacaagtcatacattcgcggtgttaatcagcagttggatacactctcaatgcagggtaatcacatccagcagcagatcgcaacacaccagcgcttcattgacgaacagcgagcgaaagcaaaccagaacaacgcccgatacaaagagatctacgatagccacgtagaaaccgcaaagaacatcaaagcacagcttatgcagttgcaagcggagattgcggaatcggtgatcactggagaagaccggacggaagatatcaacaaactccgtgacggttattcgcggctttcaatgactgtagaacagtttaaaaagctggaggtgatgtatcagaaaggcggtgagtgtccggcatgtaagcaagcgattaaacccactcctgagcgtatggcggagatcgcagagaacatcaaagcgggtacacaacgtttaaccctgatcaaaaccaaacaggacgagttacaagggatcatgaatgacttgctacaacagcaacgcgcacttaatgccctaaaaaccaaatatgaagccctgaaaggtactctgcaaaacgaagttgctaacgctaaacgcgcacaggcgatcatggaacaggcaagcgcggaagtagtcattgatgaagaacccgtgaagcagttgcaacagcaggaagcagaactgaacgaaaaacgacaaggctacgtcaaggaaaaatatattcgtgatattgttacggatatgttgaaagattccggcgttaaagcgagtatcgttaagcgttatattccgtacttcaacaaacagatagcatattatctggatctattgggtgctgattatcagttcactttagatgacgagttcaacgaatcgatcaaatcactggggcgcgatgatttcagttatgcgtcattcagtcaaggcgaacgcgctcgcatcaacttgtctattctgttcacatggcgtgacgtgacaagtaaagtatcaggcgtggatctgtctctgctggtacttgatgaagtgtttgatgggccacttgataaagagggttcattcgcgattaaatccctgttggattctgtagatggtaacgttattgtaatcagtcaccaggatcttgatccgcaggacttcgaccgccacatcatcatgtctaaggttggacggttcacaaaaccaacaatcaaagatatggcgatctcatgttagaacgtgaatttgatttaaagacctctcccgaagtggagaggttttatctccataatgaactattggaagaaaaacatgtagttacaatggcagatgttgaggaagcattcaaagataaccccattgaattgacccgcatcaagaataataaatcttctgtgtggttcctcgaaaaaatctattgacagtaaaacataaataccttaaagtcgcccgtgtactgagttgcacgggtttttattttgaggaacggaaaatgattaacgaacaaatgtcacacagcgaagcattgaagattttgggcgctactggcgacgaatctaaagctgaactgtcaaagctctttaaacgtgcttctctgcgcaatcaccccgaccgtggtggtagcactgaactcatgcagaaaatcaaccaggcgtatgacgttgtaaccaaaacaaacagcgctggtaaaactttcagtgatgttcgcgcagaacatgcagcaaacaagaaagcgtgggaagaaaaatttgcagcgtatttcgtgctggcgaaaaactatttcagcactaaattcaacgcgcaagaatttgcggaatatttcacgaaattcaccggacaaccaacaacctatacccagacaatcagcgaagttcgcggtcatacggttcacgcaacctatcgtttcacttctggtgatgcgttctttgacttctctttctcttgtcaaccgccgaacggtcaaggtttagcagcgccggacgcgtccgcactgggtagcgtatcagttaatactctggttctggttggtacgaagaaacacaaaatggcaagccgtgattaccaatggggcaagaacccagacaaaatcacgccggaaagcctgttccctactaagaaactggaatccatctttagcccgactaagaaggatctcaagttcaaacgcgcggactacatgacatcctttgcccgtatcctgggtgcgaaggttagcggtaacgatgttattgttgatgttggacactataaagttcacttctaccgtcacgtattcatgcgtaaaggcgcgtatgtgttccagtatgttgttgacccaactgtgaacaaattcaaacctgctgaacgtctgaaaggtactatgctggaagatgaagacggtgcatgtctggatatgatcatcgacactttcaaagaaatgcagaaagtgaaaccagacgcaagcggcatcgcagcggtaatcgaccggatgaacgcagagtttgcagcggggcatcgttcagcatcttttgttaaacgtaccgcacagcaagcagcagcgccagcgccggaagagaaaccaaaacgcaccgttaaccgcatcaataaagatgactatttcaacgcactgaaacaagcgggggcaacattccgcagtaactacggtgagtttgataacggcgcgggtttgactttccacttcaaacgcgagatcagcaaccgtaaaggtttctggagtttcagcagctttgatttcatgcactccggtcagaaacatgttgaatggttgaaagatatcgacattgacgaggatagcaaaggcgcaagtatcggtttgttggttgataccctgaaacaacttcgtggtgttgctgactggtacacagcccgtaagatcctggaaggtatgcgtgataacttcaaggctggtaaattctccgcacctcatgtgaagaaagaagccgaacagaaacgcactgaaacgcaagctaaggacgagttaggcgcacagcctacgaaaccacaggcagcgaagaaagaatccccagcggttgataaggcgcatcaggcacagatggatcgtgagaagtcacagatgaatgcaaccatccgttctatgctctctgccctggttaaagccggacgcaaagacacgccggaagaaattaaaaaagcagttgatgaagcaatcgctctttggcgcttgaaacactaactggttatgctataatgggaactgttgaaaagcagttccctttttttatgaggtgagtatgattattcaggtatcggttcagggcaacaccctgacagtaacaaattccattatgaccgctatggctgcatgtcgtgatcatgtgatgtcaaaccctccggtaacggaaattctggaaattgatgtatgggaagacggtgtgatcgaagaatcatttggtttcactccgttagaggaagatttacgtaaaatggaacaatggctatggcaaactgtaccccaatgaaactaccaaaacacacaaccctgttaacccgcgaaaaacttcattctgttgaatggagtccgttagatgtgatggtgttcgatctggaatccaaaatcatcaacgctcatgttaacggtttgagtatcttttctgttgaatttgaaaagattcgcgggtacaatgaagcctgtaaagacaaattgcgcgtcatggttgaagctatgggctacatcgtgactattgaagacaacaaaatgtggatcgcgctatgagcaaagtaaaagcagttttcgccgttggtcatgatatgtacgaagtggactatgcgtttggttatgaacagggtttaccgtggggccactgcaaagaggatttgcagaacttcaaagaagaaaccgcaaatagcgtcctgatcatgggtgcgaacacttttacttctctgcctggtaaattgccagggcgagttcattgcgttctgtctgcatccggtcaacgtctggtaacaaagaacgggaataccgctgattatgtcatccacggtggcgggttgtctgctgcaatcgacgtaatgaaagaaacgcatccagatcgtgatgtgtgtctcattggtggtaagtggttgcttctgcaagcaatcaataatacaatggttgatgaagtggttgtgacgcacatttacggacatcatgtatataatgcaccagcttttaaacgtgatgtttcattcacggttcctgaattctgtgaagcggttctgaaatatgaactgactgatttcaaaattcagcagatcgaatcaaacgaacgcgtcagaaaaattatcgtcgatcgacatacgaaaaaggcataaaatgaaacaatatcttgatatcgtcaacaccgttctaacacacggtactgaatcaaccgatcgtactggtgttggtacactgcgcatcttcgggatgcaagcacgttggaacctcgcagaaggtttcccagctactaccagcaaacagctattcttcaaaccgtgtaagcatgaattacaatggttcctcgaaggttctaccaacgtggaaacactgcgtaaaatgacgtggggtgaagatagcgataagcggacgatctgggacgataactacgaaaatcaggctaaagcgctgggttatacgcatggttatctgggaccgatctacgggcatcaatggcgctcatttggtgcggaaggttcttattatggtgttgaccagattaagaaagtcatcgaacaactgaaaaccacaccagacgatcgcgggatcatcgtttctgcctggaacccgatggatctggatgatatggctttgcgtccgtgtcactgtttcttccagttcgtcgtaatcaacggtaaactgtctctacagtggtatcagcgttcagttgatgtcttcttagggttgccgttcaatatcgcctcctacgctctcctgacgcatattatcgcggatatttgcgggtatgaagtgggtgatctggtttggactggcggtgatgtccatatctacaaaaaagcagtagaacaagcgcaagagttgttgaagccggaacgcgcaccgcttccacttccgaccctttatatgccgaaggtaaatagcttacttgatttggatcaagaattctttgactccatccatttgaaagactataatcaccacggctcgctaaaagcagctatggcagtataaacaaagggggcgaaagcccctttcttaacaaggtaagataatgagtgatattaaaacagtagtgaagtcttctggcgtaagtcaaacgttcgaaaaagaaaaactgttcaaagtccttaattgggcgagtattggaagaaatattgatgttaacgcattccttgaaagtgtcgttgacctgcttcgtgatggtatgactaccaaacagatccaggctgtagcgatcaagtatgcagcggatcgaatctccgcaaaagaacctgactggcagtatgtagcggctaacctcgaaatgttcgcccttcgtaaaaccgtttacgggcagtttgacccgattccgttctacgaacacatcactaagctggttgaggctggaaaatacgataaagaaatcctgacaaaatggactccagcggagattgattatctggaatcgaaaatcaatcacgataaagattttgaattctcgtatgctggcgttcagcagttgatcgggaaatatctgttacaggatcgcacgtccggcgacatctacgaaacaccacagtacgcattcatgctgatcgcgatgtgtctgcatcaggacgaaaaacacgctgataaaatcagtcatgtaattgacttctataacgcaatttcggatcgtaaactgtcattacctacgcctattatggcgggtgtgcgtactcctacgcgtcagttctccagttgtgttgtaatcgaatccggtgattctctgggttctctgaacgctgttacgtccgcgatcgtgaagtatatctctcaacgtgcgggtatcggtgtcaacgccggacacattcgcgctatgggttcaaaaatccgtggtggtgaagcagtccatacaggcgttatcccgttctggaaacacattcagacggcggttaaatcctgttcacagggtggtgttcgtggtggtgcagcaaccctgtattatccgatctggcatcttgaagttgaaaacctgctggttctgaaaaataaccgtggcgttgaagaaaaccgtattcgtcaccttgactatggcgtacagcttaacgatttgatgtataagcgtttaatcaataacgattacatcaccctgttcagccctgacgttgcgaatgatcgcctctatgacgcattctatcaagcggatcagagtgagttcgaagaactgtataccagtctggaaaaagacccaacggtacgcaagaaacgtattaaagcggtagatctgttccagttgcttgttcaggaacgcgcacagaccggacgcaaatacattttcaacagtcatcacgtaaaccagcagggtagtttctctgttccggttcgtatgtcgaacctgtgctgtgaaatcgcgatcccaacttcaccgctggacgacgatgataaactggctggcgaaattggactgtgtacgcttatggcgatcgttctcgataatgccgatataagcgaattcccagcccttacacgcatcgcagtacgcgcactggataacttgctggattaccagaactaccctgttgcggcggctctgaaagccaaacagcgtcgttctctgggtgtgggtatcaccaactatgcatcatggctggcaagcaactattgcgactactccgaagcatacgccggaaacgttcatgagttgatggaagcgtttcaatttaacctgctggttgcctctatggaactcgcacaggaacgcggtgcatgtggactgttccacgaaacgaaatatgcacaagggctgttgcctattgactggtactgcaaaagcgttgatgaactggcatcacctgtgtataactgcgattgggaatggttgcgcggtgaaattaaaaaacacggcttgcgtaactcaacactttctgctttaatgccttgtgaaagtagctcgcaggtgagtaactcaaccaacgggattgaacctccgcgcggccctgtgagtgtgaaatcttcgaaagaaggttcattcaatcaggtagtaccaaaccagaataatcagattgacttctatgattatctctggacaatggcaaaacgtggaaacaaaggttatctgtcgcacgtagcggttatgcagaagtttgttgatcaggctatctctgcaaacaccaactatgatccggctaacttcccagatggtaaagtgaaatctgaaatcatccttgaagatctgctgtatgcaaactatttcggcatcaaaacgctgtactaccacaacacccgcgacggtgcaggtgaggaagaagcggaagattgcgaaggttgcaaaatttgattcaatgccccttcgggggctttttataaggtaaatccatgttaactgtaatgaacacaaacccagatcacaaacacttagaacagcctatgttctttggtgaggatacgggcgtagcacgatacgaagaacagaaacaccgtgtattcgaaaccctgactgaaaaacaactgtcattcttctggcgaccggaagaagtggatctgtctatcgaccgtatgcagtacgcgaaaatgccggaacacgaaaaggttattttcgattcaaacctgcaatatcaaaccctgctggataccattcagggacgcggcccgaacctggcgttcctccctatcgcttccgatgtctcaatggaaacgtggatcgaaacatgggcgttcagcgaaacaatccatagccgcagttatacgcacattcagcgcaacctacacatcgacccgtcgaaagagttcgataaaattctgcgcaacgaagcgatcatgaaacgttcggcttccatgacaaaatactacgatgatctgatcgcagaatgtcatgaactgaaaaacattgtgctcaaaatcgaaatgttaacgtcccacggatacccagacgaatcgatcgcagagtacgaaaagaaacgcaaagagcaaatgcgtaaatgcaaggttgctctgtatctgtgtatgcacgctgtcaatgctctggaagcgatccgcttctacgtgtcgtttaccttcacgttcaactttgccgaacaaggcaagatggaaggtaacgcgaagatcatgcgtctgattgcccgtgatgaagcacttcatcagaaaggcactcaaagtaagatccgactctggcagatgggtaaagatgacccagaaatggcggaaatcgcttaccagtacgaagaagaagcgacaaagattttcctggaagtgtacgaacaggaaaaagaatgggctgaacacctgttctctatcggtgatgtagacggcgtatccctgaaaagtacgattgcctatatcgaacacctgacagatcagcgtatgcgcgcggttggcttgcagtctccatttaaaccaacgccgaacccgtatccgtggatgaacaaatggttgaagtctgacaacgtacaggtagccccacaggaagtagaagtgagttcttacctggttggcaacctcaacaccgagatcagcgacgaagcctatgcaaaatggcgacaaaaatacgcttgattgtcgcgtcgtaaacaagtataaaggtagctgggatgtcgatattcagagaggtacgaaattcggcaatcccttctacaagggaacacgggctgaaaacataatgaacttcatcccgtatttccaaaacttgattcgaactggcgtgatcacaatcgacgaactgaaagcattggacgggaagcggttaggatgtacatgcaaacctctaccgtgccacggtgattatattgctcactgcgtcaatgtgttgaccggaaaggtgaataagttggatatataatggacgatgtaacatttggtgtaatatttcctttgcgtctgggttcagacaaaaggatagaccggagttttgttaaatgtggagaattccggcattgtgtgtattttattgaaatcgacggtcggatagtgtatgttggaaaatgtcgtgatttgtggaagcggttagacacataccgcaattcgaaatactggcgggaagcaaaccccagtaatattctgaaaaccgcacgtctggaaatggcaatcaaaaaacgtaagcgtgtaaatcttatcgtgacaacacacgatgaagacacatatcatgattttgaaataaacatgatccgaaaaatcaatcctgaatggaacaaacagcactatgacaaagctaaccaaaaatcagaaaaccctctttgaccagttgatgaaactgtgtaacgaaagcgaatgcttctacttcattgatcaaaaaactgtgatgcaaaccaacgtgcgcatctttaactatcgcatggcgagctattccgactggttaaaacccggtgcgctggaatgtcgcggtatcatgtttgcgatggatggggatacccccgtaaaactcgtcagtcgccctatggagaagtttttcaactatgccgaggtaaaggcatgggaagcactgaaatcctctcctgtgacgattggtgaaaccgtagtggatgtgatgattaaggaagatggttccctgatctccaccttctgtgattccggctatctgggcgttaagtctaaagcatccgttcaatctgaacaggctatggacgctatgagcgtgatccagactaaccgcgcattgttcgatcgcctgaccgaactggttaacgatggtttcacagtcaacatggaatacgtcgcaccgacaaaccgtattgtaattggctatcaggaaccagcagtggtgatcctgaacatccgtaataacgacacgggcgaatatgtcgattatcaggatatcttcgcagatggtgtattacgtccgttcctggttgagcgcgagaaaatcgaaatcaccgatctggatgcgttcattaccgaagcctacacgaaagaaggtttcgagggttacgtgatcaaaactgataaaggttttgtgaaagcgaaaaccaactggtatgtaaaccttcaccgcacgaaggatagcatcaacaataacaaagatctgttcttaaatattgttgaaaataccgtcgatgacctgaaacaaatgttcctcgatgatatgtacgcactcaagaaaattgacgcattcgaaacgttattccttgatagtctcaatcgtctgactgcaaaagcattccaggcaatcgaagacacgaaaggcaaatcacgcaaagactacgcgatcgccctgagcgctgacttaacccctgacggtcgtattatcttcgggcctatgatgcgttatttcgatgataccgataagcaaaagctggttgataacatcgttgcattaatggcgaagaactacgaacagtttataccggaagaatataaatgacaaagtgctttggcgctggaagcacaacgttagaagaagagaaagcagggatcgattccctgcttctttacgttgacgttttcccagaaaccggaaaaattttttggaatagcaatgcagcaaaacagaatcagggaaaagaagctggttctattatgagcaaatcaaaaccttacgtgagaattcggcacggcgatagaaaatatttaagacatcgcataattttctattactgtaatggttatctgcctttgcttattgatcataagcatgggttggaagctggggatggtatagaaaatctacaggaatcagatccgcttcataatatgctgaaaagaaaagctaaatcaacacctaaaacggttaaatccaaaggtgttgattacagggcttcgcgtggaaaatatcgagcacagataaagatagacgggaagcaaaaacacatcggttactatgataccgaggaacaagcatcaatagcttacgaggaagcgttatatgaatatcaaaaacgtattgggtacgtttaatataagttcgtggatatggcctgtaatagttgctggttcgttagcagggcttttgtacatgacaatcacgctgaaaagtgaaaatgaccaattggctaaagatatcaaagagttacaggctgatatcaaaaaagtcaaagagacaaacaacaccaatacggtgatctatgtcgaacaaaaaggtaaggatcagcagttggtcaaggatgccggacgtaaagacctgttgttcaagaaaccaggactgatcgaaatcaagatcaacaagtccttcgaagagtatatggcggagtacgacaaatgaaaattgcaacgttagcccttgttctgggcgttctgttggtcgggtgtgctgagaagcccccagaaaagattttgcctacgctccccgctaaggtgaatccggtgaatgtgaaatggaaagtggttgcagaagtccgagagattgacggtaaaaaataccttgtcatgccttatgacggcaatccatacgttgccctttcatatcccgattcgttaatcttccgtagctggatgaatgacgttaagcgtcagaaagaccagacggataacattctgtgtaccgtgggataccctgagaaatgcaagtcaaaataatcaagtcatttttccgtgacataaccgaaggaaaggtttatgatgcgaagaaggacaaagaaggtctctggatcgaaaatgactggaaccgtgatatgtggctcaatctaacgaatgagcataacaaagaactgattgaatatgagattgtgaaatgaatctgtttattactgtaggcgtaccaggtagcgggaaaactacatgggcgaaagaaaaagcgcgtcaactggggaacactctgactgtttcccgtgacgatatccgcaaaaccctttactgtgctggcggtgatctcactggctatcgcttcaccgaagagaaagaactgtttgtttgccgtgtgcaagaagatacagttcgtaatgccctggcgagtgggaagaacgttatcgttcacaatacccatttacaccaaaaagatcatgatgtgtggcgagagatcgcgaaagagttcaatgctgatttccatatcgaatggattgatgccgatatcgtagaactcctgaaacgcaaccataaacgcggtgtgaatgctctacctgtttcccgtgtctgggcgatgttcgaacagtaccgtaaactccgtggctgggttccggctatgagctatgcagatccgagcaaaccgaaatgcgtcatcttcgacgttgacgggacattaaccaaagttggacaacgtagcccgtatgacttcacgaaggttatcaacgatccgcctaaccctcctgttcaagaactgttcaggatgtataaggccgctggttatgcctgtgttgttgtgtctgggcgtgagggtactgtacagtgcgcacatgataccgctgcaagcctgatcggatacgatgttgacctgagcgatggtatctacatgcgcgaagaaggtgatcatcgtcacgatattcacgtaaaagagcaaatacttgttgaaaagattctcgataagtattatcctgttcttgcagtggacgacagggatacaccagtcgggatgtggcgaatgaacggtattccgtgtttccaggttgattacggcgacttctaaaaaacagttgacagtgagtgcgggtgtgataagatacccgcacaaacaaaggagaatattatggttattcgtgaaaatgaaaatgtgatggttgaactgggtgatcgtgttaaagttgagaatcctgttgaacttcaactgaaactcaaccagttaggccagcgcattgctgataaaattcctgctggttatacagtgaagattgtccgcgatggtcagttctccttccttctgggtattttgagtcaacgtaacatcgttgaacagcagttcgggattcagtggaatccggtaactaaattcgtagcatgggcgggagtattatgagcgacaaaatcagaaagattcatcaggcatggttatgtactgaaccaacgatgcttcgttatggttgtgtgtttgggttggttgataatgatcctcaacaggacattgcaacaagtccggttgttgaatatgcgattccggcgaacaaatcgtttgttgaagtggtgacacgttcaggtactacgtatcacatcgtcaaccctgataacgatttcatcaaagacattctgaaatatatggatgaccgttaatgaaattcaaagtaatgaatatgttgagagcaatcgatcggagtcaacgttctcaatgtatttcgaatcgtgtaggtgctattatcgcgattggtggtcgtgccgtcgcgtggggcgaaaataatacggttgaccttgattgtcgttgcaactcatgcaacaatcatatggtgaatgatgacggtaaactgaaagcggttgatcgtcctgaacattcagcatggtcaaacgataacgaaattcatgcagaaatgaaagcgctattgagtgcgcacacaagaggtgttatactcaaagacgcagcactttacacaactgcatcgccttgccctaactgtgcgaaacatatcgaatggtatgttgctagcggggcgattacatcggtgtattatctcgataaatacgatcgtggtaatgatgaatggatttcacgcttgcagaaatatggctgtgtcgtggaacaaattaaacgggaagagttagaatcgtttatcgacttttccaaagtagtgtttaacaacaatgagtaaagaaatgtctgaactgaaagtaaaagcatccggcgaatatgtgatcatcgaagctactgcgcgtccgcagggttccgaaatcaaatctgaatctggtatcgtggttggtgtacgccagcacggggaacaacctttttatggtaaagttgtttctgtaggcgtagacgttccagcagaagcggcagaacgaatcctgggtaaatatatcccactgccaagcgctcacatggcgaatgttcctgaccctgatctggttgcgggttacatttccgaaaaagaagcaaaagagaaggaaacaaaatacgtttccgcacattacaaagcaatccaggcaatctacgagatctaaaaatggctaaatcaattcaagcaattatcgctgataccgtcagcaaatccaaaaagctgttcgacaaaggcgaaattctggaagccccagcgcgtattgacgtaatgacagcaatgatcattgatgcgcatcagggtaaacttaaatcccgtgccgatgaagtcatggcgtacatcgtccagttcgaagacgtatgtaagtacgcgaaagatgttgatccgttggttcgcgagatctatcgcaaacagttctaaaaaaattcgcaggtgtagttcaattggtagaatatctggtttccatccagattgttgagggttcgagtcccttcacctgctccaattcgggtgcgtagcgcaatgccgttaaatggttcggaatatgcaaccatatcccacgggataggctctgttggtatccggtaataggttccccggaatgcggggtgaagtaaagaaacttccagcccactaaacaatgtgagatctatatgagaattcgtgaaaagacggtgtatgactctaagttaggcaaaacaatccatacgttcaaagagattacgccagcgcaattcaaagagcggtacggcatgacattcaacgaatggaaagcggggttatgtaaaaatgactaccgatataaattaaaattccgtgaatgttatgttgatgacgatccttatgcagcagatgtatgtggtgaaacagtaccaattatcgagaattcgcccgacgcactaatccaatcttgtatagacgcagcatatgaaatttaaaagagaaaaatatgaaaggtcttcaaaagctgtttgaattaaccccaaaaattcgcgaaatcgtcgctgcatcaactgaaaaagaaatcaacggtaaattgatgaaactgtttaccgaagaaatcccagatttcgataacgaataccgtaaagcgttcgatgcgtattctgttgatggtttctttgcatcaccgcaggtgaatagcaaacacgaatatcatcgacgattctttgactggtcgatcgtcaatatcgttcgtcgaactgacatcgaacctacaaaccatcaattgatctctatggattcttctgtattctttatccagtaccttatcactggtggatttaaagcagaaggtatcccgttctgtaacgaagctctggaagaagagttcgcagaagcgtataagtatatcaaagcagttcgttaatcaacaggctatcttcggatagccttttttctggagaagcatatgcgctttttgaaatacgcaagctggcttgtactggttcccctggatattattacgggtgttcttgctattctgctggctcctttcgtggttccgttctacagtgaagaaaccggacacttacctaaagggttccgttggatggaaacattcgataacccgatcgatggtgatggtggacatatccggcgttgggctaacatccggtatcacttaggcgatctgggtgtgtatgcgcaacgtgtaggctggttgtggcgtaacaaagcgtacaacttcgcttatcacgtcttagggcgtgaagcacagtcagacttcgcctggaagggtaacccgaaaacagaaggtggttccgatccttcgcgtcacggttatctgttgatgtggaatgattcggcatgggggctttatgtcttcaaaccgtggcttaaagtcggaaaggttcagttctgcttacgcgtgtattgcgggtggaaactgaaacaggaagtaactgatcctaacgggctggatcgtgcaatgctggcgttccatatcaacccgttgcgttattatgtcgtagaaaggtaatacaatgaaagcatatcagattttagaaggtttacacactggcacaatctacctggaagaaggtaatgatgttcgtgtggtggtatccaaaaccctcgaaatggattcagtgatcggtaaagctcgcgttgctccattcgcaaaacgtgaagtcgatattgaatttcaacccactgttaaagtggaaggtggacaacacttaaacgtaaacgtgttgcgccgcgaaactctggaagatgctgtgaagcatccagaaaaatacccgcagttaacgatccgtgtttccggctatgcagtgcgtttcaattcactgactcctgaacaacagcgcgacgttatcgcccgaacctttacagagagtatataatggcgattgaagacgtacagggctataagccccactcgaaagaaaagatcgacaaagtaaaccgcatcaaggccgcagaagttgccctgggcgaaatcttcaaagaactggatgaagagtattcaagtgattacgcggtatcggataccgattcattcactaccgaagaactcgatgcgatgcttgaacgtgtccatcaaatccaactggcgaaagaccgactgaaagaagcctctatgtgggcgtgtcgcgcggtgttccagccagaagaaaagtattaaaaatcaagccgttgccgaaaggtagcggcttttttcgtttttatgcaaaataatgcttgcactgaatccgactttcttgtatctttaaccacgtaggcaagacaacttaactttgaggatgacattatgaaaacttacaacatgaaagaactggtttgcttcaacactcgtcgtgaagcccgtgcgtatgttctggctgctggtaaaaatacctctgctgtaatcgacctgggtactgataaagctgttggcgcacgttgggctgctgttgtggttatcgctgctcctgtgactcctgttaaaactctggttctgggtgcgcgtaaagccgaaactctgaaaaccagcacttgcaataacagaggtgttcataatgtcaccgtcatcaaaaaacgtagctttggtttgagggcttaacatgagttcaattaacacagaaaaagattttgtgatgtttgttggggtacagactgtaaagaaagatatcttcggtaaactgtatctgtcaaacgacgatcgcaacccagcatcattcgaaaccgaagatgatgcatatatcgcgaagaacaccagcgataacgaagacattcgccagtatgcgcggatctataaccgtgaagtaacaacccgtctggagagagcgtgatgcgtgaaggtatcgaagtaagaacgtttcagttcgaaatgcgtcgtatcccagaagcatcaatgaatctcattcgagaacacaacgtgaaaatcgtagaaattgatgcatacgcgggtactgatctttataatgatgcgaagattgacagcattgatttagaccttgagggtgatattggggatctgaataagctggctattgcattgaatgcagaaaccaacaaatacgggtatacaatcaaatgaaatatattctcgaatatcatgagcatcaaattaccgaagcaatgatcgataagatgcgggtatataaccaaaacattaccagcatcaaaccgctatcagtgtgtcgtgaatttgggggatactccttcgcgatgtacacaaattccgaagacgacgcaaccgcgtatctgaaaagtatcggtgcaatattcgacaaattcgaaaaagtatggaaggtaggtttctaatgaaaaagtattttattgaagcggcagatcgtatcgttcttgctctgttgaactggaaccgtcgccagaatgtctctatcatggcatcaaccaacgggacaacatatgaccgttatgatccggcgcgtggactccataagccttacgaggttaaagcgtgaagtattacggattcaaaacgagtcattacggtaaagcataccgcactgacaacatcgatcgcaaacgtccgtactatgattctctggtacgtgctggacgcaaacgcgctcgccaggaagggaagaaggaagctgaaaatgaaacagaatagtgaactggctttgattgcttttggttttgctctgggttgtatggtttctgcattactcgttaacttcgcggggtgattatgggttattacatccgatttcctcatggttatatatccagtagtgtttttgaaatgatcgaaacacacaaacagaaaatcaaaaatgtttccgtttctaccgatgacggtggcggatttgattacatcagtgctcactttgaaagcgaaagcaagggacttactgattatttccttcgtaagctgggtgctaagttgatcgacaaaaataataaagtgtatgaggttattcgataatggatatcggatcaggtagtcagtatccatcatgcgcattgagcaacttcgccccgcatccgtttacgtttgacggggtagaatgtgcatcaatggagggctttttacaaagtctgaaattcagcaatccagatatgcaagcgcatgtgtgtacgctggttggtaaagccgccaagttcaaaggcaagaaaaagaaatggtatcgcgatcagaccctatactggaagggtatgccgattcaccgtgaatcagaagcgtatcaaatcctgattgaaaacgcgtacaatgctcttttcctgaatgacgggttccgccgtgcgctggctgcaaccggaaaaagtaccttgactcattcaatgggaaagaataagatgaatgaaacggtactcactgaacgtgagtttgtccgaaatttaacccgattgagagatctgttatgaaagattatgatgaaagagtagaatgcgcgttcctgttcaaaggcgcgattaacccgctggcattactccacgcacagggtgctttgagttctaccctgattatgggtgttatctacaaagcgggtgtgtattacgttaccatcggcgcgaacaacattaacgtgatcaacagctacgttgaaaaatgtaagctgaaagatattgtgttcgataaagtcgaaatggatgttccaggcttcgacgctgtttatatgtacaagggttgataatgagttacgtaatttatttcgactgttcggatctcgatcctttcgttctgcaacaggcaaagaaatatcatcaagatgtcgttggcattggtgtaacaaacgatgatatgttgtgcatcgaatttgattactatcgtacattcgagcgtgatcaattcctcgctgatatacaagcgtttaaaagttcccttttcttcgaccgttatgaggttatatcttgaaaccagttattcttaccgacattgacgggatcgccgtaaaatggcaaagcggcctcccgttctttttgtctaaacacaacatgccgaccgatatcgcgctggatatggttacggatgaaaagttccgtgatatgactgaaatctttgggtgtgatcaccaactggctaaaatcctcatggaagaatacaataacagttcgtttattcgctatctaagcgcgtatgacgatgcgttaattgtgatcaaccgtctgaaagccaaatatgatttcgtggctgtcacggcgctgggaaccactcctacagcaagccttaaccgtattgcaaacctgaacacgctgttcccttctgcattcaaagaagtgatggttgtcgggcatggtgaaaccaaagtacaccgctacctggaagcgaaagccaaatatggcaatcgtctggtttgcttcgttgatgaccttgcggtaaacttaaacgaatgccataacgtcatcagtcagttgccgttattccatatgttgcgtggtgaacgtgaaaccccgtggtcgcctcaccagtcagttaaatcatggtttgaaatcgaagagaaattacatgatcttacagattctaaatgaactcgcttcgactctgaaaatttcagagaaggaagcgatcctgaaacgtaatgcaggtaatgatctgctaaaagagattttccgcattacgtacacgaaacagattatgtttcacattaagaagttcccgcaggtggacggtaagccaggcacaaccccgctatcgaatgctatcgcggatttgatgtctgatttggcaacgcgaaaatatacgggcaacgcagcccgtgatcgtctgctggatattgtatcatcagtgaacgagaatgatcgcgaagtgcttcgccgtatcattaaccgcgatctggaatgtggtgctggtacaacgttaccaaaccgcgtatggaagaaactcattccagaacagcctcaatgcctcgctacgccgtttagcgagaaagccttaaaacgtattcgcttccctgcttactcgcagcttaaagccgatggtgcgcgttgtatgtccgatctgttagagaaccagatccgcaaagcaacccgcgcggggaatgagtatgaaggtttggtgaatctggacaaggatctgaaaaagattcgtgaatatctgggttatgatgttgtacttgatggagaactgatttatgtccctgctgaaaaaactgctgtcgttccttcaaacagcgttccatttagtcttgctgggtttatgggcgatgacgacgattctgtttctgaccttgtggcagatgttaggcgggaagctaccgagaacgagacacaagcggaagcgaaacgcgaagagggcaacgggattgtaaacaaatccctgaaaggtactatcagcgacgaagaacagcgcaatatcgtttatgttgtctgggatatcgtaccgtatgaagtatactatggtgatgctccgagtgttcaaccatattgcgatcgtttctctatcctggaaggtgcgctggctggctctggtgtaacatcggttaagttgatcccttctatcctggtgcagaactatgcggaagcgaaaaaggattacaacaattaccgcaatgacggtaaagagggttcaatcctgaaaaacgttgatttcaaatggaaggattcacgcgttgcggatcaggtgaagttgaagaacaaaaccccgatcgaactgcgaatcatcgacgtgtacgaacacaccaaagaacctcataaggttggcgggtttgtggttgaggacttatcaggggaagccagaacgaacacaggttccggtctgactgatacggactaccgatacgatgaagacggtattaaccgcgtgtacatcccgttagaagaacgtggtgaactggatcgcgaatacattatggcgaacaaagatgactatatcggcgctatcgtcgaaatggaagttgacggactccagaaatcgaaaacgcgtaagaagggcgaacctgagttcagtttcttcctgccaatcatcaagaagattcgacgcgataagaccgaaccggatgacattcacgttatcttcgctgatctgttttaaatagcactttttgctaaagaagccccttgcatatgtgaggggctttttgtatattacacacatcgaaacgaaacagacaaaaggaacatcccatgaatatcaataaagaactcgaaggcaaagtaatcgttctggtaaatgaagaccgtttggcacaactgggtaacggtggtgaaaaactgccagcggacgcactcgaaagcctttctaaaatgcgtgtgatgcgtgttactgacggttgggttacttgtctgcctctgaacgacgaagacaaagccgtatacgatgcacaagcggattcatgggatatcgaagtacctctggtgaacatcgaagttgaagagtgctacgaaatcgaaaaataatgcttgcttcctgggtagtgtagtgatacattacccacatcgaaacaacacggaaagaggaaaagattatgtcaatggctcacttaactaagaaagcggattttctggctctgattgctggcatgaacgcaccgcgtttaactcgcaacaacattcaggtgtatgtgtttgacgagaagccaagcaataacgaagttcagttcccgactctgatctattgcgcttctaatttccgtgaagaaagctacatcgcagcacagaacaaattgtggaaattccgcgattggatgaacgaggcgaaaaatggttgatatgagtaaagaagccgttgaagcacgggttgcggaagcgctgaaagatattgatttcggtcgcttccttgataatgctccaacgataccggacacaatctgccttaattgtgggcgttgtgttatggttggaaaatgctgtgataacccgaatattgttatcatggaaaggaaagaagtttcggaagaagtctggaatcagattcaggaaatcattaagaatccaccagaaccgacgaagcgtttgcgtgaaatcatgagcaggaataaattatgaaatcagaaccaagtaaaactatccgcctgatccgttgggaagggcaagaaatccgttatgaagacgacgatcgcgaattcgttcatgaaatgcttgctcataatctggggttcaaaaacgccgcactggtgatgatgcagcaaaccagtgatgaagacacctggcaatgcgtcattctcgatctggacaaaaacaaggattacaccgaagatgaacttttcgcgctcacagagaacgctacagcgcgtcagaagtgcttcatgatcgatatgcctcgcgagaactacgagaatatcaagaaagcccgtaaacagaacaagaacaacgtgttcgacctgttcatgggctatcatgaagaaactacggcctaagcctcactggttttactggtgtcgttcgtagccgctgccacctgtacacattccaatgtttgcaggtggaaatcttttgatacatcgcggatacattcaacgatcagatacttccctgaatattcatcccctaacacctcaatcaatgcccccactttaacatccattcgaccctgattgatatcaaaccgaatacgtttttcataactggataacgtccgacacttcacagcctggaacggttgaccctgtttgtctgggttctggaagttgttctcatataccgcgttcctgttcatggtgatccatgcgttttcaatatcggtactcgcaaggatatcactgtacagctttttatccgtcatcgagaaactaaagaaacttgcatcccctaacagggtagtgttatccttatgggtaatgtattctgctttagtgaataccaaagcgtcacctaaaaacgggttacttacgttgaacttgtaagcctttaacggggtttgtgcgaggatctccgtattgcttttcataaagataccggaaccatcttcccacagataacagaagtcagacgaatctacgctctgcccgttgtcacggatgtaatcaaacacggtttcatacgtcccgctcaggcaagccggaggaatacgcacgtttgatgcgtcgataggtggtgtgatcaacttcatatcattatacagtgccgtcatgcactctgtaatcgtctgtacggcgttgttactgaacgaacgggaaaacttacgacgaaacaccgtatgcaccggagaaaggtttaggcgcagtatagagcggttcatatcatcggtttcgacgtttgaatacagaacaccgtagtaatgctgttctaacgtttcgttatactggaaggatacctgaataatcggtttctctgtcaactgatagattaactggttatcatagatctgcatcaatgtttcagaagtaccgttaatgatggttttctcactcattgagacaagggcaggtaacaattcaagatagacgttatcagcgaacttttcatatgttggatataatttaaccgacacgacgcggtttataactttactggacattagacatcctccctttatattctatttactaaatagtaaatatcgggatacttgaggcgatcatgaaagagaagaaaaacacacttgataaatttatggttacgcgtttaaacatcaagaacagcaaaaataaagtagtcacgttgcctactggtgaacaggttacgatcccccgtctgggctatcgtcatttcacccagattaaagcaatgaaagacccaatgcagttgcttgagtatatcatcaaagagattcaaccgcgcgaattaaccgcagcagaaaccgaattccttttgattcacctgcattatcataatgacgataaagcaatggcgatactgaaagagatcggtattaatctggatgatatgaaaatcagcgaagctaagtatgaacatacttttgataaccttcgattggtcttcaacaaaccgaccctaatgctggatgatctggcattactgcttaaagaagcgtatgacaacgggaagccgatcgaactgacggacgaaaaccgtattcaattaattaactgcctgtatcgttatgaatatgacgatgtaaaacgtggcgtactccaggaagtctatattgtgcatgaggggaaaaccattaaagggcttaacatcatcggtgaatgataatggctagcaatccatattttaacgaagaacaacgtcgtcggatgcagaatccaccaaaaccacaggcgcaaccaactgttcggaagatccaggcaacgttagataaagattcgatgcgcgagttaaaggatatcaatgataacacccttgaaaccgcgctgaatacactggacatcaaagacagtgtgaaatcctttgaggatcgtttcaaagagaaattcgctggcttccaggaacaatacgaacaggatcaacaaccacttgctgaacagttgcccgattttgttgggccagcgcgtccaccatcattaacagacaacagcacaaccagtgttgataactccgtcagtgtatcgaaccagcataacccatttgcgaaaatcgaaacatacaccggaacgattgcagaagcaatcaccaagtttatcgaactcgctgaaaagaaaccagcccccgcgccggaacctgaaccagtaccggaagaggaaccggaggtcgatcgggacaagaagaagatccgcgataaggataaagacgagaagaaattcagtaagcgcgttcttgcgttgctgggttcaatcaaggataatacatctggtcttctgtctcgctttatcggatactctctcgaagcgctggcgaagtttgccaaatggactttgattatcggtagtatcgtattcgctatcgacgttctgagcaaggttattcagaagtggttccaggatattctcgcagagggtgaagcctcgaaagagttatttggatcatacttcggaaatattaaagcccttgcagaaaaaatcaatgaagggctgcaaaacttcaatatgaaggatttgggcggatcattgaaaaacttgttcctcgaaccgtttaaaattctgggcgataccattaaaaccgcaatcacggaaggtatcggtaatctaatctatgctctgggcgaatataccggatcagaaacgattactaacgccggacgcgggatgaaggtatcagcgctacgcgataaacagaaatacggtcttgagattgataaagatgatttggttctgttgaaacagcaagagatccaggatcagaacgataaagttgttgaacagcgttctaagctcgtcgatcaggttaaggctacgcagggtacattctcatatagtttcgggcaacagacagaagcacagaaagcacaatccaagcatcttgaagaacttcgcaatcaggtagaactcgaagagaagatcaccgaagagaagaagaaagaactgaaagcattgcaggaaaaccctgcactgttacaggctgaggttgacaaagagaataccgcgaaccgtcaacgtgtagatgaaaccaaacagatcgaagcagcgcaagagaaagcgaaacctaaagcagataatgaattcgatcagggcgatgaaatcctgaacaaagacaatctgacgggcaacgataaaaaggtaatggaaaaactcatagaatcgcttgaagagaaaaacaattcgaacaagctgaatgaggacgataaagaccgatatcgtgatatgatctcccgctggcaggaaaaaatcaccgcagtaccggaaacgagtgcaagtattgacaagcaaccggaagcagtgaaagcgcctgttcagcctacaacgcctaacagcgttcaggtcaacaacaaaacagtaaacaacacggttcagcattcagtccaacgaactgaccgtaaaccattgattgcattagcttaaaggaaatttaaatgaaaattacagtattgcaagacactgtacaatcatttgctgaaatcaaaaatgctggcatcccctctgggggtgctgcaacaactaaaaacgcgttgactcaaccgatcgtaacagcggaatttccttcccaacgtgcagcaggtattgataacgcgtacaacgcatcaagcctttataataacggcttgctgtttacagcatatgatttcagtggtggacttgcaccaggaagcaaagataactatcgctcattgcgtcaggccgcacagaacgcgcaacagatccttagtgccaacactgggaacgttcgatacaaacaggttttgaatacccgtactatgggtacacttaacccaatttgtcaaatacttttaccgcgaagcctgaacgataacgaagtgaactcacaccgctatcaggacgcgaccgatagtattgttgctaaaggtctatcccgtgcagtatcaaacgttatctggggcgctgtagaatccgtttctggtggtattctggcagaccgtagggaagcaatcgacatcggtacgaaagcagcgtttcaaggctctgataagcgcacaaagatgtattacaatacattcgttatcgaaagccgttatgacctgctggaactgattaaaatctattacctgttcacggtgttgggttatggtactacttcgggtggtactccagcagaattagccggactggttaagcaagcgtataattccagcgcttcgaaggttgcaaacgtttttgcaccatcaacaaaccagacgacagcaagcgatttcaacggcagtatcggggatcagattgttgacttcgtatcgaacgttgaagttattaaatcgcctcctgtgtggtttattcgtgacttccagacaggtgacagtttacggttccctcattctacatttgggccagcaggtattaccagcgttcgtttcgggcgtacaatggacaacattgtaaatacgttgagagaatcaccgaacaccccgatcgcagttgaaatcgaaattcagtttatggaactgatcgatatgcgtcaggattcgatttttgatacgcagtattaagggggaacaatgttctatagcgtagatgaatttttgtcaggaatggcaaatagagactttcagcgaagcaacctgtttagtgttgtattcgcaaccagtccagcatcacgcattctcgacagcacgatcgggagtatccgcgatactttaattgatggtactatgagttccattaacgcgaataacccgaacgagttcatgaacgctattacagggggcgtaagcaagctattcagctatacggttgataaagctattatgtccctgaacaaaacaggtttcagtaaaatcatgggggcgttaagccctcgtttaattacttccctgtttggtgatagtgtttacggacagatgctaacagaattccgtgacaaaatgatgtacaatatggggttgagcatcgttggcgttcagttgcctggtaaaacactgggttatgaatacgtgtataatggcggtgtaccccagatccgattcacccgaccggagaatggtgaattatcgctaacgttccgtgtggattcagaagcgcgtaacctgaaagtattcaacgaatggttatcagctattcgtgatgatgtatcaggccagttcgcattcattgatgaagtatcaagcgcgatccaggtaaacttacacaatcgcgatggtgtcccgcacagcacgtatgtattccagaagtgtttgcctgttaaagtcagcaacccagaactgagttatgaaagcaataacgaaatctggacattcactgttgactttgcctataaaacaggctggcttgttgaagcagataaagaaggttgggacggattcaaacaatcacttatcgaaggcgcagcaattgccgttcgtggtgtggttacaggacaataaggggcgaaagccccttttgaggttaaaatgattgatataatccgcgtaaaactccctggtggagtgaagcgattccctatgtttaccgtgcgcgatcagttgagtttcttactcacaagcgcggacatggaagggaagacgctcacagaacagcaagaaatgctggatgaaattttagatattctgtatccgggttattcccgcaccgaacaggaaaacatattcactaaggtgtattgcgtatcgttcggtaagaacgcaatcaagatccgaatcaaaggaagcagcggacaatcagaagcattcatgcatgtaactgattacgttctgcaaaatgaatatgcccttgatgactcgcttactctgggattcaaattcccgaaacatcgtaacaacagtgaacaattattccttgaatgtatccagtatgtcaagcaggacggcgaaagatacgaatggaatgcattagacgaggatacaaagaacgcgatcctggatctggtgtctattgaagatatggaaaatatcgttaaactgttacgcaagtcctgtcatgttaccgtgcgtgatattgagttcagcgacttattgacactgtacaaaatcctattcaacaaatcagaactgaatgagttcttcaaaaccaactatttgttaaataagaataccgtacagattgaacctataatgaatggaagcccgatggaacgttcaatttacgttgcattgctggcggaagacttgaaacgaaaagagaatgcaaatgcgtaaacatacaccccgacatatcccaaaatataatgtgacttatcgcccgttaaccattggcgatcttgatgacacggataacttcattattgaaggtgatgtgttcagacatcagcgcgattatgtttacattatggctctgttcgacagtatcaacaaagagactgtagatctccaaatcaaatgccctgaatgtggggaactgattaagtttgtgctcaatcgtcatcatatcatggtggacgaatacgaagaaaagctgtacggcaatgagatcaagatttcagtcgaaccacaccgcaccggaaaggaagagttgcccgaactgattaagtttgtagtcatcgacggtgaacaaatcttatgggatgactgtaaagagtcagagaaagaagccgttctggatagtatcgactatccggtctttaaatcaataaatagcgctctggataagccagcaatcgttgcaaacattccggtaaggtgttcgtgtggctacgaacatatcgttgcactgagaggcttagaggcgtttctaaaggtggttggataaaatgggtgttaaccttcgcttactgtatagcgatatcgatcccaacttaacaaaagactggaacaatgacgtaaccgcctcgaaaggggcggcagcggtaaagaatagtctgatcggtatcgtaacaacacaaaaaggcacacggcctttcgatagcaactttggttgtgagatcggggaacagattttcgagaacatgaacccgctaacagcggaagcagtaaggacttcgattgtctccgcgatccgcgcatacgaaccccgtgtttacaatctggatgttgaagtgattccgcagtatgacgagaacgcgatcaccgtaacgatttactacagcatcattgatgaaccggaagaaatagaaagaatcaaactccagctatcatcctcataacaaaaaagccccgaaaggggcttttcttattccatcacgatccagcccattagctgttgatatcgcaattcgaacggagtgatgaaagagcggttattgacaaccttcgtcccgttataggacttaatcacttcctcaccacgaagcacatattcgtatacttcatccatcgtatcataacgcacttcttcgacttcgaagcagaagttggaatattcaatcatcccgatcttgttcgcgtaacgacgttcgatacaaccctgtttttcaatctgagtaatcgcagtatcaatgaactgcgcaagtgcttgcatgaaattactacattcgacttcacggcctccgcttgagatagccaggtaaacgcggctcaatccatcattgccgatgtaaccgatacagtcaccgccaatatagacagaccagactttacccatcggccccatacccatacgattctcactacgagaaacacctttcagtaacagtgccatgataccgccgcgaacgtaattcattttcatgataagccccttattttttcaggttgattaaccaagatggttgggtttctaaactaaccgctttccaagcatatgcaacactataaccggaatacgtctgacatacaacagcattttcatttaaatatttcactttgtgatctgcctcttgttcattcagggcagcacacacgatattcttttcatacactccgccgtttggctggataatggtttcttcaatcagataaacgctgttcatgctaattccttctcgattgcttcgatgatgtggagaacgtaaccgttcagttcttttgctttatcagcggcttcaaccataccgtaacgaggaacttctaaaacgttcgcaccttcgagcaggttgctttcgatgtctacgattacgtagctctcaccgattgtcgcgccttttctccagtcttttacgaacttcatcattttagctttcatgttctcgttccttttggctgttccgtttcgatatgtgtaatataacaaagccctcacgcgaacgcaagggctttttgggttaactgaatttattatagagagtgaaattaatccctatagaattcaatgctttacatgttgcatcaagatctgttggttcgatttcgatgatgtatttcaacgctgtgtttactggaatggtttctggttcttcgaaagatgccagggttggcgctttcaccgtttctggttcagcaagcgcggttttctttacgtcaaacgcttctttgaacttgttgaccctttttagcaggtcatcaatcaattcgatgttagctccgtcgaattgtctggtttgttccagcatactcgtaatctttccgtatgtagtgcgtctggtttgttccgtgtaattcccgacttcataacggtcgatccggtcgatgattgcccgaatatgtccaagattcgcgcgatcgaaatacgcaatcaacttagattttctgaacacgaacatatatggagcattaccgacaatgtaatgagttgccgttagaccaaaactaggatcgatcagaattttaaccgtgttgaaatacgggattaaatttatttcacgttcaggtaaacggaaaacttcatctttaaagttcttcccaatccggtcgatctcttccagagttttacccatcatcgacgaaattatttcaatttttttagatacataagccatttttcaattctcatttaattaatgcataaaagatttgacgtacttcacgatttcttcacgacacatatcgaccggagtatcctcagcaatagcagcatgacagaagatttcaccatccagccagaacgatagcatgtactgaatatcccgaccttcgttttctttctggtgtttcttgatgcgatcaaatgcatcatccatgctttcggtagctgtaagtatttcagattcacccgctacagcagccatttccccagcttcatcactgaattcgctttccagttcttcccagtatactatcgttatcatggattaccccaaacagattttacatttacagagaggacattccgcctctttaacgcgcaagcgctttgttgctgttcgcttcgctgtgttgtgatcatacacatgcaaacagcgataacagatcaccaatcgtttagccgtcataaccaccaccgcaacgaacatcaccttcaatgaacatttcgcggttatctctcaggagattgtatttcttttcgagttccggcccgaatgcgtccgcgtcgtcataccagtcatagttataacttccggtttcatcgtcgtattccggttcgccgccgcgctcattgaagtgaacgattttaacatcatccagattcagttctttcaacttgtcccagatgcgggttatttctacgctattacatccgaacgcttccagtgtgattgtgccgtcatcgtgtatttgaggtaaatcccagcgaggacgagtatcatcaaacatatccatcagagattcaacgtttgactcaccgtaaatctttgcaacttcctgttctttaccagggcggacaagtcctatcccgataatgaaactactgcttgagctattgctcacgaacccagaacgaatcttcatcgtcttgcctcatatttcgcgttctccgcgattttctcatgatacaggttgtatgacaacaccagcgggatacttgccacgataaggccaatgacaaccatttgatattcgcgcttatcgaacgccatgaatgaaatcgcagcgcccagaataaacacacccaatgcaatgataaagaatagagtcattttgacagggtatccatgcagcgtgatttttctttcaggatggtgatcacagtttccatcgcctgttgtacatcaccgtcaaagtgaatcaggaatgttttgtgtagtcccatgatcagacggttgacaatgtaagccatttctgacggcaacagtttaccatcttgatgattgtacttctcaaacaggcggtagagttctgcgctgttgcctggcttctcgatgctgaaattatgcattccagacagaagaccatccagatacagaacagttttgttatcactgcgcaggtgtccgccgaccttgtagtagttgctgaatacatacgggttttcgcggatatcttcgataccgaattcaccatgatctccgatattgccaacatgggcgaagaaattatggtcttccagttcgagaaggattgcaccctttttgtaagggaacccgactaaatcgatctgccagccattttcaccgacaaatacatcatcaacaaccacgaaatccggcagcataggcgcgtatgcgtggttcttttcgttgttttcacgataggcttgtggttcggacaggtacaggatatcgccttttacaacttcaccccagaatacgttacgtgacatagtattttcctcaatatgccccctttcgggggcggacattgttagattttgacttctttttcttccaggacaatttcacattcgaatgatgtggtttcccagactttccagaaatcggacggaatattatcttctttcggaagaatatctttcgcagcgatagaaactttggtttcttcgaagtccagatccgcgaaccatgcatgtgctactacaacaccgtacattacgcgacttaaacgggcattcagtttacggacttcctgaatcgttgcctttgtctgcttatcaagatactcgactacctgatctttgtcaagcgcatccagttcagatttcacctgatcgtaagcccacaggataatcaggtcgccgttgttcagtttcttcttaccttcttcacgcttcgcgacggtagccgctacagcaggaagggaggaaacacccttgattttcacgttcagttctttcgacatgtaaacatcagtcgattctgtgcgctcaaccttcggagagaacccgtaatcacgaataccctgttcagacagccattcacccgcagcttcaccaaagcgctgtttcagcccttctgcgttgcgcagtccgatcgcgttgtcacggaagaacttcataaccttctgacggcctttcaggatttccaggcgcacgttatcagtcacgaactctttaccgcttaacccgcgagtcatgccacggttaaccagaggcagagaggtaaagtctaccagaacagacatacgatcatcaccgattttttcgagcggcttgatagtcaggccagaagcacgaaggtttttcagtgtcggaatatcggtttccagcggcagaactttaacgttcacgataccatctttaacgatggtgaagttacgcacctgcttagtttcgattttttccggcagaccgaattctttctgtttgctttctgggatagtcacatacccttccagatccgtgttgatggaaatgttaggacgggaactgttacccaccagatgtttaaccgatactttggttgtggtttgggtaaatttcggtgtccagacttcatgcgctaccatttgcgccgccagtgctttacgttcttctggggttgcagcgtttgcgatctgttcggtcagttgatccagtgtatcatcttctttctgtacagtctgacggcctgtgcggttatacgcccagtgctcagaagacaggtcgatcactgtgtcagtttgtgccagcagttcgagcgcatcaaccagagtaaacgcgttttcgtctggaaccatgttgtaatcaataccatcaacgaaacgctgtgatggatctacaacagcctgtgcaatcaggtctttcgcgttggagtagtcctgtttggtaaagcagttgtcatacgctttgatcagacggacatcacccagcttttgaagcactttccatgccagatcagggttcattgtgtgcagtgcatgataaagcacgacatacagaacttgctgttcgctggcgatgttcggatcgaatccgtcaacatcattaatcgcgttttcacccagcgcccagatgtttttgatgtgttctggaaccagcacaacaccgtttgcagcgttcaggacatacacgcgcccttcgtccaggtagatcgcatgggtagcatcagcaactttgacttcgatacgtgcggaagtttgcgcagtgatgatttcggcaaatgctggttcgtatgcgtcgaaaccttcaacgaatttgtgtaatgcgttggttgcttctgccattttttccagcagaggacgattcacgtaataaccgtattccaggaacgcgatactgttgaaagtcagtggcagaaccgcacacgctttcaggatgtcatcggtacgccagcagttatcataaccgtctgtcaggaagatcaggctgttcaggttgccgttttcggattgcagatcggtagcgatttccgcagccagattcaacggctcaacgaagccagtacaaccagtaggtttcaggtaacggtcgatagccgcgcagatgttagacaggtcagagacattgctaaccttctcaccacggaacaccgtgccgtaatcgcctttgctggagaagtacaggatcgaaacggtgtcatcctgtttaaccagactcgccagatttgcttttaggtgtttacggatcttaggcagttcgttatacattgaaccggatacgtcacacacgaaaacgtggtttgtcggggttggcttcgatacagcgtttttgaattcgatatttgttattgacatttaaattttctcgtatttgaatttttctaaaatttcgttaactttattgcttactgcttcgactgtacgatcacacccgaacttacgcgccaggagttcaacgtattcatccatcgtagtgagtttggattctgcaatgtcaaacgcaagcgcatacattaccggattccatacccgaacgatttggagagtatactcgttcagttcaaaacgttcaagatattttcgcaaagaaaatacatcaaacggtgcggggcgatcctggctaaaggggatcgaatcccctaatgcatagcgaggcataacaacacagacttcggtttttaacttatccatcagtgatgactctttgatgtgtgttcaaggttacggaagatgtttccatgttccagttgagttccgatcgggccgcattcatcggagtacgtgaattcatagataaacacgccgtcctgattgccatacttcgtgttgtactcttcatacaaccacattttgatcagagcgtctttctcttctgtgtccagatcgtaccagtctcgcccgtcatacgcaagcgcaatttgagggtttgaacggtagcgggtttctgcgctttcttcggtttcccagtcatagcgtttatcgtcgtagaacgattcaaagctattacccagatgaccgcctaagtcacggtgaacatgattgaccacttcttccgctgttaacggaggattgtagtaaccgcagttcggaacgcaatcacccatcatttcgcgcaggttgtcgatattagtcggatctttcgggaaccggacgatgaaactacttgatgaactgttgctcacaaaaccagaacggattttcattttacatcctcaaattgtaagttttctttggttgcgttcgcaatggctttttcgttgctcagtgttactatgcgcagacgttctccagtaaagccgtcgcattcagtgatacttacccagtcaaaaggtttagccatttcaatcgcacgttccagcgatacggtagaaccgaccaaatcactaaatgtatagtaatcttcgcttaaactttcaacagtataaattttcacgatactttaccttttgtttcagatttcaggacgatgttactgtaagggtcttttgctaccagttcccacaggtcgccagggtgttccccgctacggtagacggatgaacgaatgatttcgttaaacttgctcagggcttcgtcgatgtcgtcatacccgcgtttgaggggcttacgattgcgacggatgaagaacatttctttggtcttctcccagcgttcggcgtttttaaccttcataccgcctccattttaccaatgacttcttcgtatgtcacagggttaggttcatagccgttagcgcctattgtatcgcctactctgtttcctactaaagaagcaaccgcaactttcttaccgtctttccacgcagtgaaatgcagattatccgcaacatacgggaaggtttcgtgattgttcaccgcgtcgatgcagtccataacggtatcagacgcgcagatcagattaccaggttcataatcaaccaaacattcaacagtgtaaatcataataatttcctcacgaaaaagcccctttcggggcttgattaatcagtgtccgaacacaccacgaatagactctgcgaacgcgtacagttcagggtttttcgctttcactgtttcgatttgttccaggatgtaatctggtttgtatttcgcaccgaaccagcagtaagagaaagaacgatcccacatgaacacgttgtagtattcaccgttacgcacttcaaccatcacgtaacctggattagaacccagcgggtaatctttcagtagattgaatttcgcaccagcgccagtacatccgttaaacaggtcattaaaagtcatggtatgttccttttcagtttcgtttcgttaaagctaagataccactatcaactactggatacaaacacttttttgaagaattttgtttccggtctttctttgtacggacgcattaccaaatctttaccgtccagcacggttggcttaccttcgagttcgatcaggatgaagtttcctttatgatacttcaatacgccctggctggcagaccattcatcattatcccagtggttgtaatgccattcaacaacggtatcgatcgggatttctggttgatttctcataatactttcctaatttgtttcgctatggcttcaatcacgggtattgaaactgaatttcccgcttgacgatatgcctgttttttactatccggtatgataaatgaatctgggaacccttgcaaacgaaaacactcacggggagtaagtcttctggggttctttccttcctgcaacaccagacattgaacgccgtccttgtaatactgctgggtgatagtcccagtgtgcgtagaatcgcttgtgacggcctgataaccgaaacccttaccgtttgccttatttcgttccttacgctctctaaagcccttccatgcgttatctgacagggtgaacgaatcatcagcattttcgaggatgtcgcctactcgtgtaggggtgcgcgggggaaccggaaacgaaaagaatacatcatccaggaagcagacaataaacacgcgttcccgtctttgtggtagtccgaaatcctttgtgttcaggcgttgatagaatacgttgtatccttcggcctccagaagcccgtaaatcgttctgaacgtctttcccttgtcatgggttagtagctcaggcacgttctcaaagaacaatacacggggctttttagcgcgtataatgcggaggatttcaaagaacaccgtaccgcgcacatcgtcaaagcccagtttcaatccggctttactgaacgcctgacacgggaaccccgccagcaggatatcatgatccggcactttgttttcatcaatggcgaatagatcaccctgtaggttatcatcgccccagttttcgatatatgtttgctgtgcgaacttgtcgatttcagacgttaaaaggcattcgacaccgccgaacgccttatcaaatcctaatcgaaccccgcccacaccagcacagaggtcaattattttcatacgtcaaaatcaatctcgtcaattttgtatgagttttcgtcaatgtccgcccatagggttacattaacgtgtttgctatcttcgtacaactggcgaccaacaattccgcccgtgtaattgctttcggtgcgttcagtaacttccaggcggaggctatcgcgcatgatctgaacaacagcctgttccagtgtaaccgcgtctgggtttttggtatcgcccagtacaacatctttaactttcaaaataacatcagtcattagtaaaacttcccgtaggtgttgaaatttacgtgtgttgggctttcttcgttgatactgatttcataatcgtaatcctcatttgttacagaacgatcatgtttgataacatcaacgacatatacccgaaagaatgcatgatacagagcatcgcggatcttttcagcaagcaccggaggctcactgtacaggttaatcatatcggaaacaatatcctctacgcgaggaatatcacgtttctcgatgtaacccacatacagatttacatctttaaccattagtgccactccgttttaataccatgtcggtatgcgtcaatccccagtggggtaatcagcaaccatgctttcgaattatcgtgataacccgttacccttcgagcgtaacctttttgaatcagggcatcacgccctgatttgctgggtacgtcatcgaaatctaagtctagcaccttagttgcatatccgtaaagtttatacagaacatcaatttcagcgccggataatttaggatacatcatttgtaataccccacaacatgatcacggtatacgcgttcgatgaaatcgttccagaattcgcgatcaacttctttcggatatgttgaaatcgctgcaaggcgttcgacttcacccatgacttcttccagcttttcctgtaccgttgtgaacggtacgccgccagatttaaccagtttcaggaatgcgctatcaggcagaggataaacgatatcaccatctttgtaaatctggatcaactgcataccaccgcgcaacgcgtgacttaatgctttccagtcgatcccgttgttggcttctgcttgtcgtgcgcgttctccgtattcatcccagagtttatacacagacttacgcatttcatcggctttgatcgtgaactggaatttacgccccagcacttcatagaagtcctgacaaccagatttcattgtcgtgtcggtaacgaatcggcagaactcgtttgtagggaaacgatccttgatgtcagacactttcacttcacgcgtatagcgtttcatatctggcgtgaattcctgaataccaccgatcgtttcggtttctttcagtacatcgacaacttcgcgcagtgcagccagtcgggaacccttcacgccatatttcgcggcttgcttacgaacataaccgaacaggccagttagttcagtggtgtaaaaacgccagcggttagcgcggatatattgccagatttcagagttagcgatcagcttgtcatccgaagcgtgaagcatatctagcgctacggtatcaccatcacacgcaaggctaatgaacttagtcaagctatacagttgacgatccacgtcatccacggtgtttttagagcttttatcgcccgtgcttgtgtcgatagtctttggggctttccccaggagaatatcgcgcgggtgtgggaggaagatccctttatagtctttgtcgcttgtcggtgtgttcagtccgtacaggtgagaaccgaacacggtttccattacagttttcaaaattcaacccccagggtttttgcgataccgcgcagttcagcggtagtgatttcaggaacaacaacagagtgagaaccaaactcttttctgatcttttcacacagttcagcacgatacaggatttcgttgtataccgcttcgctgcgatacaaataaaatccaccccagccccctccagtaccagcagtcaatccagtcttacgatctactttctcgacgttccaatctttcaggccagcatctttatctgttgatgcgtacagatattgacgagcaaccttgagaacatgaaattcgcgaggatgctgatttgtatgatggttgtatcgacttataccaggatcgtaaagggtatcgcccactttcacatcagttaaatctttcggattcatttcattttccaacattttgacttttcacagtagaacaccggaagacgtgccagaactggcttcactacgtcttcccctgtgttcgtgttatgaactacttcgattgtaagggattgcccttcggacggccttacaatgtccagttccaggatctcacgattaccttttgtattgatttccgctacgtagtaatcgtgaccgttgatgtttacgacatcacccataataacgctaattgtgtgagtcatgagtatgcaaacttaattttaatattcagggaatccagcaggatcgcgtcacgtccatcaatgacggtcaatcccatgtatttgttatcgtctgtgctcttacgggagtacatgcgacaaaccagagaaccatcttgtgcgatgtattcaacgtggtattcgcggcgttctgacgtgaagatgtctccagcaacaaccggacgatcgacgggttggcgtttagtcccttcgaaggacagtttaccgttaccgtctacggcgcattcaatacctttatgcgcgatgctcgcaacagtaacaggctctacagttccaccgatcagcattgcgggttcttttgttcccagtttcatcaccagcgtttggcggatattatttgacattggttcagtaacaaacacataaaccatatcatttttatcacgcgcaactgattgcaaggtgtaattctttgtacctacagaacccgtgtgtttaattcctacacgatgtccaggttccagcgccatacgacattttacatcagagataccgcgctaagggttgccactttcatgatttattcctctcaaattcatcatcatcagatttccagtacacgttgaagttacggcaatcgtggtcggaagtcaacgtatatttttcttttgttttctcgtcggtgatcaccatcgtttcattctcgatcgagtccacaccatagacgaatactttatcaccgcgtttattcaggaacgcttcacctgtttcaaccaactgccagcagttgacgggtaaaccacccgcacagatcggacggtttacgaggcagtaaggacgtttaatcatttaaattcttccattgcataggaagtaagatctttgaaataccttgcggtgttgccttctgggttgtttgtaatctccatcaggataacagcaccatcaactcctgctttcttagccatgaatgaaatggcttcggtagcaataatcgttgctttcataacatcagctttagaaacgttgatcgtattcatttttcttccttttcattattcatgcggtatgtgtatataatacaaaagccctcacgcgaacgcaagggcttttttaatcttttatcagagtcccgtgaaagctacaacgatttgatagtggtcatcgaagaattccccttgtcgttgcacgacctcatgtaagggcatccagaacgcgtctaacgcatcgtcagaaccgcccataatgcggggcagactaccatcattgttaggctctaacttgatgtactgcgccacagtcggttttgagaagtgtacggaacgcttcggatgatcgaacaacatcgaattgcggattgaaccacggataaccttttcaggaactttgatccgcacctcttcgagcagttcgcggatcgcacaatccaggaacgtttcatttgcgtttttgtgtccgccgggaagggctaacgcgtctttacctggggcgaacttacgacgaattaccagcaggtgattgttgcacacaaccacactatcacccgtgcaacagtttagcgcgtcggggtatgggtagtttttgaatttctccaattcgctttcccatttctcgtattcgtagaataaacgccagaacgtgtcttccatcatccatttgtcgatataatcaacggttgcttgaggaacaaagcgcaacagtttcttatcccacccgtttttatggttaaagataatcggacgaagatcggttgctgatagatccttgccgttaatctggacaggtggaactggtacgtgtgtccatccgaacgctttaagccagtatgaacctgcatctttttcgtaaccgtagatagcgattttgtcgcctttggtttccctgatagcagtacgaacagaggttttccatttctcttcgttgtaaagataatctggaatgttctcaaactgaacacgaacaacatcttcgatcgggaagttagcgttaagccatgagaagatcatggtttgacgctcacgcgccgtcagcgggtttaaaacgttagggtaagcatatgctgaacccagaaggatgtaaacgatctttgcttctccgagtgctttacgcaccattgctgcatgaccattatggaagggttggaatctgccaattacgacagctttatcaaattgtttcataacgtgctccacgtttaaaggttaatcataaaacagacgcaatcaccaatacaccaagaaaaccgccaataaagccgaagaatagcgaaatgaagatagtaaggatgatctgttttatgttcattatagtattctcgttttaggagtcaagcccccaagagcgggggctttaaaaccttatttacgagaatcgaaaatcactttaccagcgtaatcagaacccatgacagtttgaggtacaccgccctgatatttgtccgcgatggtctgctgaacatcaagttctttccagcggatcatttctggggtgattgtgcgttgcagaatggcgttcgcttcggcttctttcttagccgcatacagacgggcatcagcatcacgctcgttagcctgtgcagcattgctacgggcttctttgtcggcaattgcctgaacaactgcctgttgagcgatttgctctttacgtgccagttctgctttttctgcgttcacctgttcttcacgaattttcgtgttttcaacctgtttcttaatcgcttccggcaggtcgatgtcctgcaagaatacctgtttcactgtgtaaccgtaaggacgggcatactcttcaacttcctgctgaattgcgatctgtagctggctttgaacttctgcattatacagatcctgtgctttcggtacagatttaccgaactcacggacagttgacagaagtttttcagtcacatatttatccagcgcctgatcctgactacccgcattgatacggttgatcggggctttgctaccatcgaactgtaacatcacggtcatatccacagtggatttgaatttatcctgggacggaacctgcaatttgtcaaacttcattgcgatgtctttggtgttgaacacctcgaaatcagccagtggatttaccaggtggaaaccaggcagaacaggcttcggtgaaactttacccatgaaggtttgagtttttaccgtaccatcctgaacgatagtgtacgagttcggaaccagccacagagcggcgattacgcccagagcgatcagagtggttttcttcgggttgtttacgatagtgtttaagttcatcattatttccattgggtttatgtttcaattcgatagttattctatcatcactttttcgcttgtcaaactctttttaagaaagttttgtcagcttgtaaatcgtttgatagcacaagcctttgatctcgtccaggacgttcttcaatgaactatctactgaatcatagatttcgttggcttcatcggctattttacggagatacgcgaccgtgtcaagcacattttctgtttttaatacgggtttgtatcgaccagtaatgcctatatggatttcggtgaatttatcaaccaaatcctgcatatcttcgtaaaacccttcaaatgctttatgctgtgaatatgaaccagtcgcaaagtgtgcgctgtgcatataggttacagacattaagcaagtgccaataaaggcatcaattttactcgcggtatcgcgttctgttacttcgttaaacgtctgcatcttcatcccttatgaacgatgaatagcggcgaattcacttgcaacccgtagccctaaacgtttacattcgggttcggatttacattgcttctgctgccattttcgttccatgtaattatagaatagttcactggtatttacgctgggagggatggtgtcaagatatacctgtagcgccgcattgatatagtaatcgaactctttggcgactactgacctatcatcagcatgtgatgacggagacaagattaacaaaccaaacatcagcgctttagatatgcgtttaatgttcataagcaattctctacgtgcttacggatcaacaatagatccgttcctgtatatatttatagcaaaaaaggggcgattcgccccttatgtaaaattagtctaaaaatacatcaagttatctcataccagcataagctacgctcaaaagcgcggatcttatttgcgttctcgatattttcatcccatccaattacgccagctttcatccggcgtaattcctgacgcattttagcgcgtactttcgaatcaatctttttcacagcgattgaaagcatcgcggagatatcacgatgagctttgttaccgtcgcgattcaggtttttatcgaaccggatatatgcgcaacctgatttgtgtttccagttggttgtataccaacgtaaaccatcaggactttccccgtgctgtgcataatactctgaaaatgcttttgtctcttcgatctgttcgatggaggacttatcacggactggaacatatttcttacggtaagtacggctcatagtgttctcctttgtttgtctgaatacaccttaacagttcagaccaacattatcaagaagtttttcgtgataatgtttgcgacagagcgaaacgtatttgtcttcggctccgatctcaacctgcgccccttcggttacgaagttgccttgtgcgtcgatacgtgcaaccgtagttgctttgcgtccacagtgacacattccgcgcagttctcggatctcgtctgaccaggccagcaaccagtaagaaccctcgaacagattcaactggaaatcagtacgcagaccgtaagccattacagggatttcgagttcatcaacaacacgacacagatcgaaaacgtttttcttcgaaaggaattgcgcctcgtcaacgaagatacaagcaattttattccggcgctggatgtcccagaacagatccatatcaggcgcaatcaattcacacttttcgttcagcccgatacgcgaactcactgtgtttgatgtgcgggtgtcgatcgctggcttatagattacaactcgcataccgcgctctttgtaattgtgcgcgtccgtcaatagtcgcgcacttttgccagcgttcatggatgcatagtgataatacaatttagccattgacacgctccacaaacttaatatgattctggaatttgccctcaccttcatggtttttgcatgttttgtttgaacagtatatccaccaatcccactcgtcgtaagggggtttgtcaatgttcatgacgcaaatcaaaggaaaatgacaatcccgacaacgaactttttctataatgtgtgcgttagccaattgaaaaccatcctttacccatgagtttttcattatgtcgcgcaagatgctctttgatttccggtatctggatagcaatatcatactcttctttcgtcatagtatgatttgcgcaacccatacacccgcacacctgcgcgttacaccaacggagtgttccgtatgtcgcaatcaccttcattgctttagctttgattttgtcagtcatgattagctcgctccaccgctaccgcatcacgaacagcatcggtgatttcattttcaacgaaatccaggatatccgctgtaatatcgtcgatacaggattgattgtagttacgtgaatcaggatcatcatcttcggcataatcctgatacgcttcgcccagttgtttcagcttgtgttttaacagcttttgttcttgcggtctcatgataaatccgccttatgtggatcaaccgatggatcgaagtgaacaacgatgattggataatcacccgtacactcgtcgataatggcgctaatacgcaaccaatcgccaccagcaagccccgcaccgataagaggggtaatgataggcaatttttcaggaaacgcactggcgcgttctacggcgctcacaaagcatgatcggattgcgtcataatccacttgcgggccagtaccccagaatttaaactgagtgtaggcattgaagacaatctgaccttcttccgtcatgtagatggagttagtgcctaacttacgctggtctcctttcatcgtcaatgcatcaattttgaacgcaccagggattttgtgcttcacttctttagcaatacccgcacccatgttgcaataacagttacacccatgaatcaagtgtacttttcgtttcaggaacaactctacagcgttccctttgatttctttaataatcattttcatcacctgtatagtggcggtaagccagcacagccagccccgcgatcacaacaataacacacattaagatataacctgtgttcatttaaattggtcatcccatctttgccacgcttccaactcgtcatcatatacagggaacgagctttcgtttggctttttaacgtaataccagataatgattgcagcagcaatcacacacccataaaagatcactaatcccaacatcagtataatcctataccagcgttatattcttcaaccaggtaagtacggagtttttcacaacgttccttatttggcgctttggtgcagaggttcatcatcggttcagactgcaaaaactcacgctgtttaaccagcttctgacgcttgaagaggtgcgcattttcttcgccccatacataagccgcgtccagttgttcagcgattacctgttcacataccgcaacgtctttaatgtcacgattattgcagagttcagccagtcgatcatcagcatgagcaaagccagcaaacagagtgagtaacagcgcaagttttttcatcgttttaccttagtatgaatcgttttcgataggggtataataatgggtttcgcagacataagcaagcactgatcgcaaactatcgctttcaaattctggcttttgattgagttccagactccagccagtgaagcacatccagcgttcttctgcaacgtcaaaggctaaccaatacatgttgaactgtgaacatgtatgttcgaagatgtcgaatagtagtttaccgccgatcggtttcacatatggtttcacgcgttgaagcgatttcaggactgtttcgaggttactgcgatcctcattcatcgcgatacgaagaatatgctgattggtttctgggttgtatccatcaatccccaaccccatatcctggaagaacttagtcgcatcatggaaaatctctcgtccgctgttcggggaattgatgtaaaacttaatgcgttgttttggagtcatcgcgcggacacgggaagcggttttgtgatcgatctcttctttgatgtctttgcgagcgttcagaagtttattcagcttttcctggtaaggtttcattaccgccctgatctcgtcgatacgttcatcaacgatcgctaactgctgttccggtgtcagtttagtttccatgttaagcccctacgcgcacaaagcgatcttcaattgcatcattaacacattcgtaaatgctaacgtcattcgggacgtgcttacgaatacccactttcacgatatccatgatctctttgttgctgccccacacgttcaggttgaagtaaacaccgccgctatgaattgtgctgttgccaacatcaagatacgtatcttgactttcgcagataaacagtttgcgtttttcttctccgtatgcgaagtagatactgaacgattacatacgatgacgatcgaccgtgatggtttccactttaacctttggatctttgttcagttcatctaacacaccctgaatgatgtgtagcatgttcggcttgatgatagtcgggtgactggtaataactcgatgtgatgtgctcataatttaatcctcaatagttggtacacacataataaaaaagcccctgcgaaattgcaagggctttttatcagataatgcgtttttcttctaacagcttcgcggtatggttaaccatgcgagcataatcacgggcttctttctttgaatacttgaaccccgcgttgtaactcgccagcgcctttttcaagtcgcctttgtggtaatcaagccagtattccagttcgtgaagtgcgtacttggaaccaccccgaagggtttcgagcttattgattactacgcgtttggaatatgatttatccattcgtgcggacgcgctacgggctgttacttgaaaacaaccataagcatgatgattctttttgcctttccctacgttctcacatgcgcgagactcgatccaggcaatagccgctaaatgatatcccaaacgtttcgatgtttccgattcaactggctttgcagttttgagatcgtattcgttaccgatcctgaaagcgtactccaaaacctttttctgttttggtgtaatatcatccaattccttaacatagctgggggcattggctggcgctttcttcattactgttgcttgttgtagcggtaaagttgacttcacagaagggagtgtttggataaactctcctaacggatcagtcgccgcgttgccagaaaaagagcataagaaaatgctggcagcaaagataattttcttcattgtaatacctatttgtaacaagagagggctatgataccctcgtcttattatttatgcaacgattttacgctgttttgcttcggtcagctttttctcgatgaattcagcaatgttatagtttgaaattgacgcaatcggatcgtacagcgctatgatttcatcaaacgatacccgaaccacatgtttaaagtgaacgctccagctagtcgtaaagatttcgctgttgttgaacccacaatcagggctgaacatggcgcgatattcgtaccctgtgtattctttcaaacggtttgcgctgtgcgcgttgctggtgatcaggaatttcccctggtgagtctcaaccacaaagaaatagcccagacgttctttattgtccagcatcgtttcaaacttacgattattttcttcgcgatcaacacgggtttcgatcatcttccagacctgttcatattcaggccaatcatgctcgacaacaaccgcttccaggggttctttgtgttgctcttttcggtagcgctcaactttacttagcaccgcagagagaagcagtttatcgctatcacttaacgcggaatcaatatccgcatgtttcatcacgacataacgttcttcacgtttcatactactacatccttatcacagaccggacaccgaatcacacgatacacatcacgaccgccagtgtaatcagttgataccttttctttgacatcctgcgcagtgtatgacagaacagcaccacaacgacaggcagtttgttttggggtaatgcttacaacttgaaccataataacctcacaagaatagtttcacttcgctaccgcatttcgggcagacgatatgttttttcacgatgtaatcagcagcacggaagaaaccgttgtagaacacttcgtttttcttctgtacatcagacagttcatactctaacccacttttgcaattagcgcaaacggtaattagctttggactgataataacgttgatcatgtatacctcacgaaaaaggggccgaagcccccttgatcaaaaattgtcttcaacaaaagctgcaagtcgcccacgatatacggtatccaggatcacatgacttgaatgaccgtactctttaagtttttcaaccgcatacacaaagccgttgttaacagcagtgttgcgcgggttgtcaatctgtttaatgttcccgcatagtatcagaagggtgttctcaccgcaacgggaaataatggatttgatttcgtgattgctcaagttttgacattcatcaacaatcagaaccgaacctttacccggatcaggatgcccgattgaacgcccacggaagtaatacaggctagggaactgcaccacacctttttccagaagtccttcaacgtacttgtcaacttccggttgatccttaaacagaatgttcaggctcgtgatacaaggctcaacagacggtcggagtttttcgcccagagtgccaggcaagaaaccgatttcaccagacagcggactatcagccttgacatacatcagatttgcgaagtgtcccgcgtttaccatgtgcatcgcaccagcaaccgccagcattgttttaccggaaccagccgcacccatgatggtcacaacgtcattgttcttgtccaggatcgcatcaacgaatgacgcttgcagagcatcgcggggctgaattgttttcatcagcttacgctttaacgcttgttcgtgcttaataggcaatacttcaagctgaaactctccagcagcaaccacacgccccacaatctcaccatccgatagaatgtattggttagggtagaaatctgcgtcaggaagcgatgaatacgttataacggcaacagtcccgacatactccaggacttcgacagtttcccagaacagcggcaggtcgatataacctgaatacaacacatcactatctttcagcgagtcatcgccagtgtattgaagaaccggacaacctttagacatcgcaatcaacagcatgttaatatcgcgagtcaccagcgttgcgccctgttgaatacaggttgcaatgatccgcgcatcctgtttatcgagagggaactcttcggggccgacataatcgacgatttttagtgttacattttctggtactgctgggtttgttaagtttaacgaaacccctgtttgggtaattgcttcataattttgtcccaggattgctttggacaaaagccggatcgccagtcgtgcttcatgagcggttcgctctttgcttttcaggtgatccagttcttccatcgttgcagcggtgataatgatttcgctgtcaggttcgatgtaagaatagattgaatatgggttactaatcaaaacattggtgtctaatacgtattttgacatacattaaccttatgtggtttcgttaaaaaatgtgccgaaaacctctttcgctttccggtcataaacggcttttgcttcttctggagtggtataataccccaaaaattttctttttccatctatgtttatctgcgctttatacttcccatttgctttgtgataagaaacacctttcaaccccgtactgctgtttgaattacatttctttttcatcgcgttttgttggttcgtcgctttctgtagatttcttgctgtatctccattttcaacaccatacacatgatctacgataggaggaagataaccattctcaacgtaaaacactattcggtgtcgcaaatacatagaacctttaaaatgaatttgggaatactcgttcttgcttccggcttcacttccaggagacatagggccgcgctgaattttccaatacacttttcccgtagatgtatcaacatctacataactcagaagagactcaatcccttgaatctcttcctgtatggttcttgatgaataaccatgacttttcattacatacccaaacggataatatggatatatgggaacgggtgaagatgacttgaacgcatacacaaggtcagtgtttttgccagttcaaaccgttcgtcgatcgtcatgtcgcattcatcgaaaatcaggttgattgcctgatacttgatcgtttgtccacggaaaatggtattcagatcttgacgtttcgacagaatgaaagacgaatcagcgcccttatccattccatgttctgccgcagcacaaatacccatttgctttgtcggcgcaacgtagatattcagtgtccctttcgactgcttgatgatatcgaaagccgctttggttttacccgacatccggcccatatccagcgcagtttcgaagatagacaccccgccgcattcttgcccccaacgcccatcaatgattcgcgccaggtgcaggttacgtgactgctttacagcgtcaacatagaattgtgaaatcatgttgtcgccttatgcaagttcaacgtgtggtgcgtcgataaatttcgtttcaataggaagatttggatcgttcttccagttgataccgtaacgcagttttacaccctgttcaccagcggcttgtttcactgcattcaggacaggcaaccacactttcgggttagtctgccagccagcagggagaacgctaggatacagatccacagcatcaccagtgatgtgttttgagttcatggtctgggaaacacccttgcggacgttttcgcgctgttgctctacggtgcgcagaccttcgcggacaccgaaatcaacaggcgagagttccagagcacgttttaccaccttaaccagttccggcttcacgccttgcaggttgttcaggcttttctgactaaatttaaacatacatacctctattatgaaaataccctatgggctacacatggtatttatggtttaagaggcgcaacgttttacatgtaaccccaaattgcatcttccgcgcgatcgcgtttccagcgaatcgtcatttcaacactttcctgtttgtcatcaggaggaagtttatcattattgatttgttcaatatatgcttgcgcatctgcttcgctacggaacaacgcatggaaattataatggttgcgcccagttaagttacgatcatccagagagaatttacctttattttcccaatcatcatacacagtgattccgttaacaaacagccccagcccacgatgttcacgcgggaagccagtgatgatatgttttcgacccatctgtgccttttcaccagtgatactgattacttcgtacaggattgcgccaggtttgatatctttcaggacagcacgtttttcaaaagcgttcataatgtattcctcacaattagttttcatatacagattaccacaatctgttttgatgtcaacaaggtctatcgtttttatttgggaaagttaacgtgaaaaggcgatcgtgtaatgcttcgatccgttcatacgcttgtttcaggatcgtcttatcttcagggttcgttgtctcgatgcagatcagttcgtccgagtcgatagcgatcacatcatccatcagtgaagcgaatacgttcacgtcagggtgagtcaattcctttatctccgcttccatcccgtcatgctgggataacagttcgatgatatcgcgctgtaaatctccctggtacgggaatccggtttgaagatgattgataattctttctgctttggtcatatttcacctacaaaaaagcccctttcggggctgggattaaatgtctttgcactggcaaacaccgtatttggtgaaaggcttgtcaccgctcaggtaagaccagaaatcgcaagcctgttcagcggtttcgaagattgcagcatcatagaagccgtgttcttcgttaccatctttattgaggaacacaggaagccagctttgcggtttgaagcagtcagtaacaactacccaaccttctttcgctttcattgcttctttgttcgcttcaaccatttccagcatttcgttcagtaagttcattttaatccccttgtttatctgtttcgttgtctacgagagagatattatcacaacggggattagtgtcaacagttattcgaaacgaattgtgctatttttgaaaaacattccagaacacacagatcctttgatctgcttgccgttcacaccagttgcttcgaatccggttgagtaggtgtctttttcagaacatgcaaaccacttataacccgtgaactggatgttcgtataaccctgtgcttccaggatacgctgtgcctctttctcgtcagtacagtttgactgcaagaacacaacgacgacaaccatcaaaatacacgcaacaattttccacataatttatactcgtttaaggttagttttgcaggcttcaatccagcctgaatagttcggggagaagtcctccgccatacccaaacaaacggtagtatgtccgaatgggttcggtgttgtgattttactattgggattgatcggaagttcactagccccaacactggtcgcaaacaccataccaccagttacgtaaatggtttgaatatgcccgtaagcatcaccaggccatttgaaacggtattcagtgttccagaccttgacgttgtacacatcgtattcatcgaaaagcggatcgttacccttcgttgctttatacaaagcacttcgccattcatacagctttgcttcaatgtcgctaacattgatttctttaccagcgctcaaatcatcaagcacctgttcaatggtgcggattgctccgcttaattcacgatcgagtttcatgatttaatctctttaatagaatcaagttttaaccgagcatcgtaaggcccgaaagcgttgccgttatggtcgaacttatgttcttcactcttccagtatttgccggacttcatcaaaggaattcgtctacgccctgttttattagaatcaaccattcctgtatgtgtgaaaatcatacaataccctcttcttcgagcacttcccagatcaggcgatccaggtgcatcagattccacataacggagtcatacgaacccagcgagcgggagtaaatcactccccatgaacgataagccttttggaatgattcagcactgttttcatcgtgcggcatatcgtcacccgaagcgatcagcagtttcagaaccatcaggctattgagcgcctttggcgtgaattcctgttcgcttaacttcatcgcgtaccgttcgataatcgcgattgacttcggatctttaatacgcccatctgtatgacgcgttttaaacgcgctcattaattcatcgactacggcggtacacttcatatgcttcatccttttcctgtgcagacatccgattatagcggatctcttcgcgctgttcaacttctctcacggcttcggctttcttttcagcggtcagtatgtgatgtactacagcgtttcggatttcccagagatatccaatcatctgcatatcttcaacggtatgatatcctttcatatcacattcaaatacaatttcatcgcgttctgccattgctaattgtgcagtagaaggacaaataaccattccagagtatttttcaatcaacgattccagtgtacgcggttttactggaatgtcaaccgttaccggaaccattcgcatcgttgaatcattatgggattgataaatcatcagaatgtgatctccgcaaactgcattctacgctcaatcgcatggatagcgttatcacgctgttctttgttttcatatccagcccaggtaatcggggttgaacagatcaggtgaaaagtgattgctgggtgtctcttcccttcaacaacgattgttgcatcatcttcgatccaggttacgtgatccagattcaccggatagtttcttacggtaacagtttcaccaaccaaaggcgacacgtccagaatatcacgatcacgaacgtatgatttaatacgagatacgattaacattatttcaactccactgcatatacatcggtttcaggggctttgtgtacgcgcatatctttaccacataccgcataagccggacagttacggcaaccgttatgatccttgttgcccgtcagttctttacggaactgttttgttttcgggtgttcccagatatccttcacaaaatcttcggcttccagaacatccagaccttcttcccagccaccttcaacccagcgttcggtaaacgagcaagggaagaactgaccacgttcattgatgtaagagctaaacatcgtcgcttcacagtcttcggcgtattgcttgtactgttcgaagttcgggtgtccctccatcgcttcaacgaaagcgggggctgaacagctatcgaatccaaatcctacaccagaatcgaggcaatattcaacaagttttttatattgttcgcgggtaacggtgtcccagttcttaccgcgtcccttttgtttcagtcccaggaacacgatcgcgttgacttgtttcaggcgcggatcattcttcacggcatcaaccacgttaaacgcatcatcataggttttcgagctaaccatgaagtgaaggttgatttgctgttgtccggcttctgtcaggttcgctactgagtcgaaagcgacatcaaagccagcgtgtttataaaccgataccgcaacagccccagcaaccgccgctaaacgcgctgcaacgtcttttgatacgtcagcaatggtaaggttcggcacaatgcctttagaacgcgcatacgccatcatatcgaacatatcggggtttgtttgcccctgtgcatcagcaccgagtgcgcattgagtaagccagggcattttgtcgatgatttttttgaagttggcaagatccatgttgaacccgttcgggttattggacttgtagcagaacccgcagagtttacccgctggcccgttgcatttggtagtgatctcgatatcgagaatttcggggaatggtgcgtattctggatcgtgggaatatgttgcaccccagcgagcgaattcaccagtatcaacgttgaaattatagttgtagaacttcgagcgagcgaagcgcatattgccgtgttgatagatgaacagggacggcgctttgatgctggtaacgatatcgacagttttcataatataattctcaaaatttaacatgggattggaagacagcgcgagctagtttttcgctatcgaacgggattgatgttccctggcctttgctgtcaatgttaacgcgccagaactcactcgaaccgtttttggtggagtaatgcatcagcgttaccgttttattcttttccaggaaggtgcgtttgtcaatctctgttttgatttcgtgttgcatcattttacactccgtttcagtttacgttcgtcagccagttcttttttgtacgttttgatgtacttcccgttaaggatgcgaagctgttggaaaactttattacacaaagcacgtttcgctttgtattccggcgtattacggattgattcgatcgtcatacccatttcgtttttagggtacgcgctcaactccctgccgatctctctgtgccagttgcttaactgatcacgctgtgctttgtactcttcaaaagttaacattataactggtctccgtaatctttcgctgcatcttcgggggttgcatccagtcggtaaagctcaacggctaacggactgggtttgatttcgcggttcaggatctcactgataccgcgaaggaattcaatataaggacggaatctcatttgatacgtaccgcgttaaaagcctggttgcgcagttcataagcctgttcaagctgttcagtagtgaacagagggctatcggtattagtggtgaaactacaaatggttttgttgtcggcgttgacttcttcaacaacgatttcgtaaccccagatcccgctgtactcacatttcacgttacggtacttgatgtaaaccgcagcaacatcttcttttttgtagttcttgcttttgtagatgatttccatgatttcctccttcgtttcgatgtgtgtacaataacagttcagggttatcgagttttagcaattcgtgctaattatgccattttcttagcgattttccatgcggctttgaacgctggaacatcttcaacatcaacccagaaaccagaaccgaaaccatcgttgtagcaagggcaaccgtcgcagtagttttcccaggtcatcactttaccaccaacagaagcaccagtttccatcgcacgtaacgcatcttcaactttttccagtttttctgcgttgtcgtcataaatgatgaagtaccatttgccgttgtattcgttacccagtttgattgcttcgcgaacaagtttcatgatgatttcctttttgtctgtttcgtttcgatgtgtgtaatataacaaaagcccctggcggttgcaaggggctttttaaacaaaaagtgctattttgtttcttcgaggattcgaaggatttcggcgcgggtgattggatgttttgccagctcacggatcgcgtgatcaacgtgtatcttacacatcaaaaacttctccccgcacttgtcgcatgttgcatacatatcgccatgtatacgcccgatcccatcggttacagaatgatgcatccaagcgtaaggagttccccgcatccatccggtagcaacatgcttgcatttacgttttcgtccgaacatatcaccacccgttaggattgcggaaatgggtttgccagtagcgcagttgttcgcggttcatgttttgggtatcaatcaccatactctgaatcatctgcaacatcatgcgggtttgattgacatcctccaggctcgctatacgctgttttaaggcttcgttctctttctccaactcaaccatacggttgtatgcgttgacgcgctccagcggcatatcagggcgctctttgaggacacgggcgcgggatacttcgcattcgtgatttgctttccagtgcgcggcttctgattctgctttttgcttgtctcgaagcgcgagtgacagatcgctaaccagatccagaaccgtttgcggatctacggtttccagatattttccgagaccctcttcccagcttttaatctgtgtagggctgtcgccatatggaacaccatatgagaacgcgcgtttatactctttgcccctgaaaccatattcctgatttccctggatgctcatattttcaacgagagtccacttactacccatcatagaagaaatcgaacgggctgatttttcaatttcttcaagtttttcacttgttactttcattttgtactccacaaatcatattgtgcgcgaaggatagcgtaaaggctaccgatattgattgaatcgaccggacactggaacaaatcagagcgcatcatattgaactcaatattgttctgttcaacgaagttaccgatcattgatgtccagcccatcaccaggttatatccgtcttcggataacccgtaagccaggttaaccctgatacaacgcttatcagccagttctacgctgatacagttacttgaatgcatagaattgcatgggaatttgctaggaaacttacggaacatctgggtaaggagtttagccgtttcaatgttgattgcgcgttcctgatccctttgcgcctggttgtcatgacggcgattcagatacttttccatttttgggttgagattcacatgttgcataatatattcctcacaggtttaaagcgttcttttccggttccattacatgaactgcatttcggagatcggtcgctatcatatcgccccgacccgttacatgcaacacatttccgtaatttccagccatacacgaaccgcatgtaataatcggttcgtgcggccttgcgttcgtggaagttcatactttgttgtaaacctgaaccagccacatttcgatgttcggcgcgtaagtaacgtttaccatcggcatagtgcggtatttgtaagcggctttgtacgcatcgagttcagtcggaacacagaaagagaaaccgttgtcataacgttctgcgttagaaacttcacaaccaactacagcggcaatgtttttgttcatgttcatgatgttttcctttctctgtttcgtttcgatgtgtgtaatataacaaagcccctgcattgctgcaagggcttttttcactttaatcgaatttttctggcaattgatctacaattacctgagtttgatggatttcttcactcaatttatcgcggtaatgaaccagttcacgggttctggatgctgaatagctaatgattttatcagcggtagcggtgtaaccgtaaccagcacatgcgatttccagttttgcgttatcgccattcggtacgcggatatgagcataggtcagcaagtttttaaccgcttgtaacagttcatgatcttctttaccgatgataaactggtttggttctactgaatcaacattcagttcttcgtctttgttcattttgcagccttatacatttcaaggacgcggttcatatgctcttgtgattgaggcacacccgcgaagttcagtttgatgaagaattccagacgatcctttttggtgcattcatccagccccagggcaggtaatgaaatgttttcaaaggctcgctgttcgtgtcgtggcatttcgtcccagaacaaacgggaaccgtccggcataggaatcccaatttcaccttcgtagactttgataatcgtcgtcaggcgttgtttgccgtcgatcacttctacccagtgagtttcgttgaactggctatcaaccgcgatcgcgatgataccgcaagggaaaccactgatcagggtagtcagaaacgcatcttgctctttctgcgtccacacataggggcgctgataagatggattcagatccagatctttattcttccaccaatgcagataactcccaaccataatcgcgtgatcgcgactgcgaaaagttaactgatcgcggatacggttatgaaccggaatatcatctttagacatgattcaccacccaacccaacaaaccagtattgatagccgcaacggtaaggcaaatcaccgccaacacccgcgcgttatgaactttggttttcagttctgcgatctcctgatccttttcactttcgaactcgtcgcgggttccatagtaaccaggatcagcagcggttgcgatacgcactttgtctgtttcgaataatgttgattttccatgatccggcacaaccacacccagaataccatcacggtcggtattgacaattccgtgcgttccggctttggcaaacttaccatccttaacggttactacacgatcgccagctttgtaagtcataatatatcactctttcacgttttgttgtaggaactctaacagctttccttcggcctgtaaagcataaagtttattcagctttgcgatattttcaaagtctgatttttcgctgaacgaccagaccccatcatcggaaaccagcgcaccgattgatacgccagtttcaggatcacgcgtcaacgccagccccaggggatgcaggatatctttattgattttccaaatcagccccaattgagataaggtgttgaaatcaacgtgactcatttaggcaatgccccgaaagacagcagccccatacgatgatcgttatctgattcaccagtgctgaattcaaattcttcaccgctgatactgatagcgcggaaaccgtctttcaggtatggcaacagatacagagggatcagcatcatgtttgaatcgtcgctccacttacggaagcccagatttttcatttcttccagcgtcaaatcattcggatcgacgggttcgaaatcaggggaagcgtaaaggcgtccaggcagatcgcgaatatttttcacggtgaatgaatcaccccatgactgatacgcgataggttcagcggcgcgggttgcggtagccagaaggatcatttgacagatttgaaaagttgttgctttcatgatgtatatcccacaagtttagatagaaggtgtcccatagtcttacgcgcatgatcgcggatctggctatacggaacatatttgaaaccgtccatttctgtgatggttcgcccgttcttcacgaacgttgacgcacagaagcatttatcggcttcggggtaattattgcctttatacacgaataagtaaagctcttttttactggtataatccagtcttccgaggctttccagttcgtgcggttcaacaagaactccggtttcttcgaagcactcacggatcgcagcgtgaataggttcttcgcctttttcgatatgcccctttgggatgtcccaatgaggcgtttcggttgcgtggcccattaaaacgctgccgttattcaggaagagaataccagcagaccgttccattactgcaccctgaacttacgatcgtatgctgccagcgctttatctgctgcatcaacagcctgtgtgtgtttgttagcggatttctcgctaaacacttcgcggtaaatgctaacccagagagatcggcgggtatgttcgctttcttcgttgacacgagaagccgcaaaagcgttatgctctttgatcagttgtgcgaattcagcatcatgatcaatggtttgttgttgaatagctgtagaagtcataattcacctatttctttcagttcagttttgagtttttcgagagtcgattggtactgaatgccgttttctggatttggcagacgggcataatacagcgtaccagttttgttgatgtctgacaacacctcttgatcgagggtagccggatcgatgccaaaagccattttaaacatggtttccgcgtctggggcgaatccgtgagagaatgcaaaccccagctttttatcaaactgcatcagggatactttattcactttttccataatgttcttcgtagtcatcgcattcagggagataagtttcgcagaacatgcacagcgtgaagaaagtaggctggcgaatcccgatattatcaggtaagtacatccagaacgtgttagcaaacacgatgaacgttttcaggttttcaacggttacggtactgacaccatcataaccggattgagcaattgcgcgttccaggggaacagggtattgctcgcagtaatcgacgtaatgatcgcttgttacaagcgcattagccgcttttacgagatcggtaattttcatgctcttacatattccactttgacaggttttgcgataaggcgttctttggtgaagccttgcccgttacagatatcacaggtaacgttgaaatcttccatctgatcaacccagccagaatccggcaagccagaaggatacgtgttgacacgcacaacttcgaaccctttaccctcgcatttcgggcatttgtgcgggtactgggatttaaccatactcagcagttgccccagcgtcgttgaacgatcgaagcgttcgactagtgccattacatcagcaatacgaatcgaaccagcatcaataacggtatacaggtttttcggtacatttgagcgcatagtatatttctcacttaaaaaattttttgatgaaagagaggaacaagccaccaccgaacatgatccagtatcccgcgccgtcaccgttaaacaggacatacacagcgacaccatagcaaaagatttccgcgatattcagtaagtttctcataactccctcctttgtctacaccaggtattttaccagaaagtagattactgtcaacaacaaagttttatcaacccacttatcaccagtcattagtaatcccctacaggttgagaagatgcaacgctcaggatacggaaagagcattcattccatttgcaataagttttcgcacagtgaacagtgcctttcattacaaacccgtttgagaacaccagccagtaaagtttcatgattgcctcctttgtttcgacacccctaatataacaaaagcccctgcacgaatgcaagggcttttttcaaatatttttcaacatatacagttgaggtggacaatcttttgaagcaatcaggcgatccaggcgtgacataacgcgtctgtagccgtcatactcgaacttgattttgggtgcgatgtagtttacatggatcgcgtttcgcgtgttcaggctcaacgtgtactcagggataacggttcggaatcgtacagcaatcactggcttttcgtgagcaacagaatcatccatgttttcgaacatctggacggtgaacgcacaggcaaacactttgccattaatccggcgatacgcaataacttcctgcataccttcgtttttcgctttcaccgcgtaatgcagaacgttacacgaataatgtttagcgagactattaagaatttcactgtagaccgcaaagtcttttttgactgacgcggaacgatccaggaatcggtctgcgatgtgatctgtagtcattgaaacctttgtcacataccaatcacttaacgctttactgaaattttggttaacttctctgcgtaagttattgataacatacatcaatcgtgctctgttcataaatcacccattatgtttaaagtattcgatttgacgcagacgtttttccgctgcctctttcgaatcatattcaccaagttctttcgtgcgatcatggttcagtataacccacttatcgccgcgatgttcgatgtgctccgtgatgtcttcgactttcttatccagatccagaggttcagcatcttcctggatgatagtcaaatctacgggcaatgtcaacagtcttttaactccgctgatatcttcgatgcgggaatcatacgcgagggttacatgtggtttgtaatcgtcataatcgtatgttgctccagcatccattgcatctttgaagcggctatggagataatcagactccagaacacccacgatcgtattaccgtatttcgtttcccacttctccacgtcaaccagtcgggcaggttcagagataccggatgcagggaacagatcaaccgtcttacggctatacacaatcgttgtatgcagctttgcagcggaaacaggattctctacacccagaagtttttgcaccttcgcgagcgcttcacaggaagcctgatcgaacttcgcacacatatagatccccggatcaactacgggtttcgctacttcaataaaacttttcatgtgtactccaaatgaaaagggggctttcgccccccagtggttaaacgcctaagcgttaattatgcttttgatgcatcaatcgcttcatcgtcgccagcggtttctgctgttgctggcagaagtgctttgatcgcgccgaccagggcatcaggggatacaccctgcgaaccgtcgatttccagaagactgcaaatttggcctacgagttgacggtgatttgccagttcttgttctttaccctgaatgatttcgttcaggtcgaatacacgggctttcaggatcaggacatcgttttgaagctgttgggtttggttttgttcagtcattgtttacactcttaaaagattgaatacattaagcacgttacgtttcaaatcgtctaacgtaccattatttaggattgtataatcactcaagccaggtgtcaaaccttgctccgttgaatgattatcttcaataccagtttcacgttcaaggaacacaaagcgagtcccgaacttgctcaggtatttatattcgtgcggttgacgcacatcggtaatgataaagtgatccgcataggatttcaacattttttgaatagcaatcgaagtccagatagacggatctattttacaaacaatatcagtcccgaacacctgcatcaaacgacgaatcgtccagggctggctgttttcttcgcaaattttatgagcgataacatctgcgttactcatgaagaacccgcgagaacttaattttttgataccgctagaaaacagcgcgtatgcatcgttattggacatcaccagcggggcttcacgatcaccctcatagaatgggttcttcgctgccagcgctcgcaattgcgtattatcatgatgttccatagaacgtttcaggatagctttgatttcgtcggctaacgcgataacttcaacattgcggaagttatgcacaaccatttgagcaacggtatctttacccgttcgctttttaccacaaataccataaatcatttttgcgttttccgtggagtcggcacgatcacctttccgtcgatttcaatttccatgtgtgcaaagttgaacatcgtcatacaggatacggcttcatccgaatcattagtatacataagctcaagctctccgaggttggagggccaagcgccatagaagcgaaatgtcgctacagtttttgactgcgagttatccaggatatgcaaggccattgcctgttgtggttcactccagcgaacagactcgaaggtattgaaatctacagtaccgagcatccaaaggtaaaccccaagatacgatcgcagttcttcatcaacagcaaaacgaatagtcagtggatcgaactccattgcagatccagggatcttccctcgaatcattgggttcagtgggacatccgtaattggaatgttgatagaaggtagtgtaacaccctgaacttgtagtttcaacccttttacataatcattgtcaggaatatctaacatgaagttagtaggtgaaatctggttcaggatcatagcagttgtattcatgatgatctccattttatagatatttaggttagaccgtgagcgaagcgaacacacgaacgaagtgagtgttatgtacgatgtactgtttataatatttatattttatatatagagaaaacagtacatttccgtatactttttatacaatcgttaactatccgtcttcgcttcgcttgacggaactcgcttcgctcgcgatctaatttttttagttgatctattcaataaataggtatatcatacctatactttcaaaagagattgaaaacatgaaatcattcaaagaactactttctgaatctgttcagaacaaaaaatttgctaaaaccgttgaacttgttgatcgcaacggtgttgctccatcaaaaggtcagatcggtttcctgcatttcgcacacggtgctgattacgatgtttatgcgccggattcccacgatctcgcttacttcggtaaaggtgttgtccgcctgaaaggtaaaaccactggaaaaacccaggcagcgtatattgactgggcgaaaggcactgtttcattctacagcggtgatcctgctgatgacctgaaatttgacaagccgctgaaattcaaaggcgcttccctgtacaaagaagccgaagaaaatctggatctgtataatcagttggcggaagatttcgaaattgatctgcctctggatgaagcactggtgaaaggaaaggtgtacaagctcccatgcaacgatatgtgtttgttgtataccggacgtaccaaaaccaaagctacaggcgaatacgccgtgtttacggttgtagatgcctctggtaagcctcgtctggtatcgggtaaacgctttacccaggaatacaaaggtgatgttctgtctaaactggttctagctgaatcagaagatttgaacgaagccgctaaaggtattcgcgaaaaagttattgcggtgttggtgaaacgtgggtttaacgaaaaagacgcagaaaagatggttgataaaaacctgaaagatgcgatgaaggttcgacctggcgcaacccctggcaaactcgcggaaatcgtgagtatcctgtaaaaataaagccccttcctttcggttggggcttttttgttaatatctgttccaaactttcttcgcgctgtatggttttcctttggactggaaagcctgtgtaggcaaccaaactgctttcgcccaatcttttggggcgatctctgcaagtggtgaacgtagatgggctggcagataggctttgatcatttgatcagccccgcgcattcccttcacgttgttccagttgattttcagtctggttttgttagaaagtcgatctgttgatccgtagccacgtttcaggagttcttctaaaaactcttgacgtgctcgcggtggcgcatagtgcaagttcagcccgtaaagaaccaagttacccgctttcgaacgtcctgaacccaggaaaatgatcagcgggaaccgatcccagtatggcagggtgtctttgtatttcgcatcgtagatgaacgtatacaagcgacccgttgctggtttcgcaaccctgtgcgtcttaatgctggttttgatgaaatcaccaaaccaatcggtcgaatccttctgacgtttcgcagcggttacaccaacagtcattttcttcaaactgtttcggaaatcgtttacgatatcaaccgcgtgttttttgcgatagtcgttacgtttgcgtcgggcttcggtttctgctgtacggcgttcgatttcatcatcaatctgctgcttgtagcggtgcatagactttgtgaacgttgcgtatgcaatcccgttttcgtccgcgaactttttggctgtcatgccttttaattttgcgcgtcggaatttgataccaagttcaacccattcacccagctttcgcttcggtggcggttttggcttgtcttcttctgcgatgatctcgaactcaaaaataaagctcataattccctccgtttagggtatttattgccctttccatccgaacacacgtttcaacgtgtcctctgtgatgatcttgaactcccagcccttttgttttgctgctgcattcgcggctttccatttgtcaatgtttacagcataagtatacaacgcatcaacaaatttctttttgttgtgaacgttgttgttcgctggcttaggtgggggcaacgtttctttcatcggtttgacttcccaaaggtaggtcacaccgttatccatttcaacatagaaatccatgaagtagcgccgtcgctttccgtctgcgttgctgaaataagggatcacaacctcttcactgttccagcgtttcacatgcgggtttctatcaagccagttcataatatatttttcccagcttgaacgatacgttatctttcgcggatctcccttatatttctgtatgttctggggcataaaagaccccttgtatgtctgtcttccagccattttagatcctaaatatagtaaacattagataggggaaattacaatgttgttctcattctttccaccagttgattacaaaggcacaccaactactgatatctaccgcgattatcgtttttactttaaccgcgtgatcaggaattataagccgcgtacatatcaactgacaggttcattaagacccgaacaattagcggaaacgctatacggaaaccagcaatactactgggttatcctgatgcttaacgataattacgatccgttttacggatggattaccga

(The sequence listing continues in the following parts.)

The invention claimed is:

1. A method of treating an inflammatory bowel disease comprising administering to a subject in need thereof a pharmaceutical composition comprising a pharmaceutically acceptable carrier; and lytic bacteriophages selected from at least three of the following groups:
   a) Group 1: 1.2-2, colon-11, PKP-55, or a family Myoviridae, subfamily Tevenvirinae, genus Kp15 virus that is capable of infecting at least two of *Klebsiella pneumoniae* strains: KP2, CT-123-1, MKP2_21611, and MKP2_251_B;
   b) Group 2: M16-7a, KP2-4a, M16-4a, colon-36, KP2-5-1, 1.2-4br, 1.2-4s, M16-6c, KP2-9a, M16-9a, KP2-5a, colon-14-15, colon-6, colon1, M16-3-2c, M16-5c, or a family Myoviridae, subfamily Tevenvirinae, genus T4 virus that is capable of infecting at least two of *Klebsiella pneumoniae* strains: KP2, CT-123-1, MKP2_2161 1, and MKP2_251_B;
   c) Group 3: KP2-15-2-1, KP2-14, KP2-15-1, colon-14, 1.2-3b, KP2-8c, KP2-7c, KP2-7-1c, KP2-8a, KP2-5, KP2-16-1, or a Podoviridae, subfamily Autographivirinae, genus T7 virus that is capable of infecting *Klebsiella pneumoniae* strains KP2 and MKP2_251_B;
   d) Group 4: MCoc4c, MCoc6c, Mcoc7c, MCoc3c, MCoc5c, MCoc15c, MCoc8a, MCoc9-2c, M16-9-1c, MCoc9-1c, or Podoviridae, subfamily Autographivirinae, genus Kp34 virus that is capable of infecting at least three of *Klebsiella pneumoniae* strains: CT-141-1, CT-123-1, MKP2_2161 1, and MKP2_251_C;
   e) Group 5: 8M-8, or a family Myoviridae, subfamily Vequintavirinae, genus Sc1 virus that is capable of infecting *Klebsiella pneumoniae* strains CT-123-1, MKP2_2161_1, and 8M-all; and
   f) Group 6: 8M-1, 8M-7, 1.2-3s or a Siphoviridae that is capable of infecting at least two of *Klebsiella pneumoniae* strains: KP2, CT-123-1, MKP2_2161_1, MKP2_251_B, and 8M-all, wherein the composition is capable of lysing each of *Klebsiella pneumoniae* strain KP2, and at least four *Klebsiella pneumoniae* strains selected from CT-141-1, CT-123-1, MKP2_2161_1, MKP2_251_B, MKP2_251_C and 8M-all.

2. The method of claim 1, wherein the pharmaceutical composition is capable of lysing each of *Klebsiella pneumoniae* strains: KP2, CT-141-1, CT-123-1, MKP2_2161 1, MKP2_251_B, MKP2_251_C and 8M-all.

3. The method of claim 1, wherein the pharmaceutical composition comprises bacteriophages MCoc5c and 8M-7 and lytic bacteriophages selected from at least one of Groups 1-3 and 5.

4. The method of claim 3, wherein the pharmaceutical composition additionally comprises at least one bacteriophage selected from the group consisting of 1.2-3b, 1.2-2, and 1.2-3s.

5. The method of claim 4, wherein the pharmaceutical composition additionally comprises at least one bacteriophage selected from KP2-5-1 and PKP-55.

6. The method of claim 1, wherein the pharmaceutical composition comprises bacteriophages 1.2-3b, 1.2-2, and 1.2-3s.

7. The method of claim 6, wherein the pharmaceutical composition additionally comprises bacteriophage Mcoc-5c.

8. The method of claim 1, wherein the pharmaceutical composition is formulated for oral or rectal dosing.

9. The method of claim 1, wherein the lytic bacteriophages are selected from at least four of the Groups 1-6.

10. The method of claim 1, wherein the inflammatory bowel disease is ulcerative colitis.

11. The method of claim 1, wherein the inflammatory bowel disease is Crohn's disease.

12. The method of claim 1, wherein the subject is infected with *Klebsiella* strain KP2.

13. The method of claim 1, wherein the subject is infected with a mutant KP2.

* * * * *